United States Patent 9,487,797 (GENOMIC PLANT SEQUENCES AND USES THEREOF) - sequence listing, part 40

SEQ ID NO: 63130 - DNA, 18044 bp, Oryza sativa
  unsure (1)..(18044): unsure at all n locations
ttttgaataagacgaacggtcaaacatgtttaaaaaatcaacgtcgtcaaatattagggaatgagggaatataatacacgtgaactagcaactacaactttacgagagactatgttgagcattagaatatatttagtagacctnacactaaacctccaaatagtttttgaggcaaaaggagaaaattcgaacactaagcccccaaatagtttttagggtgaaaggagaaaaatcgaagtccagcacggctcctattaaaaatcccaaaataagaagacaccaaattctctcccatagcccctaatcctgtgtttgaacatatgggttcgtaacccatttctcccacacgggaaacgacgtagctcattagcacatgattaattaagtattagcatttttttaaaataaattaatatgattgttgaaagtaacttttatatagaaaattttttggcaaaaatttataccgtttagcagttcggggatgtgtgcgcgtgaaaaatgagagaaagtagaagttagaaaaggggatgatcgaacgcacccttaggctgtgttcggctggctgagttcccagctgtgaacagtgcacaccaaaagcggagtggtccatcaacgtatgattaattaaatattagctatttttttaaaaaagtggatcaatatgatttttttaagtaactttcgtatagaaactttttgtaaaaaaacacaccgtttaatagtttgaaaagcgtgcgcgtggaaaacgagagtaaagggttagttcatttttcatttgcaaagtatctaggcttaaactctaatctatagtttgaaaagcgtgcgcgcggaaaacgagagagtaaaggggtacttcatttttcatttgcaaagtatctaggtttaaactctaatctctagccaaacacctgtccccacacatgtctagatcgttcgggatcctctatgaagatcgatctaaatgtgaaaaagcattaattttgaagcactgtggacacctttaaaacctttttttaaaaaaattcaccaccaacctatcatgtgataggaatttaagaaacaaataggagagtaattttagtatacaatcagtagaaaaaaccgtttctgaaatcttggtctggcaaaactcatcaatattatgctggtagtattattttggtgctaggtgaggctagctagtgcatcgtttcaagtggcgtacaagttagactgagccgctaggactctatgccaatattagtgaggaagagcctacaaatcggacgcccgtttttttaagaaaatcggacgcttttttactagttgggaaaaatgtttcaccgagtaaatagaaaatgttttaatctattgagatggtgaaacacatttgaacttatgactgaaacattttggtggaacatataaaacatcaagttttgctctattgaaataccaagaaatccatattggcaaaggacaaagttatggaacaccataaaaactcattgcaacatttcaattcaacataaaagaacattaagttatattgactgaaacataaaaaaaaaatcaagtcgagatcggggaggatatagttgttgatgccgcgtcgaactcatctacgtcggccacaaactgtgcgctcactgtcctctacgccgcgccgagctcgaccgcatccacgtggccgccgtcgtccactccgtggacctcggccaccgttgttgacgccgcagagctcggccgcatccgtgtgtccaccgtcatcattgacgttgggctgagctcggttgcgtccctatggccaccgtgctactgagctcctattctctgccacgagctcggccatcagcatggcggtggtcgcagagagcacgtccccaagcacggccacctacgacttgagctctaatcgcaagagaagcaggcaatcctcctccttgttttcaccggccagcggcgaggtagcaagagcagcctctcgctcccccgacgatgaggggaggtagaggcacatgtgtggggtgtgtggagagagaagatgggatagagagaaaagagaatgagggaatagataagaagtgggtggggagtaactgccctatatttagtgtgtgcatcggtcacccggataggatcattttcgtattagtgatgctgaaatgttatacctcaatggcaataggagtgaaaacggggtggatatttcccgcccgcccgaccgacccaaggcttgcgggaggaatatgagagagaaaatgggatatccgatattatccgagtttgaacccgaatccataaaaaaatatgggttatgatacgtgaatagttatatccgcccatatgttccatattatgaaacatatgtgaaaatctattataagttcacctataaacatgataaaagattagttaatcactatttttatgagctcacatgtaatattatataatttgttccttgatgtatcttttttagcactttaattgtcttcttacattaaatatccatgaattggacataaaaaaacccgttcccgaatccgattcaaaaaaagttatcggacactacccgtacttgattttgaatttaaaataaaatatgagttaggatatggaaatgttgtgatccgaccttacccaccccgtcttcacccctatatggcaataccctcggaaacctgagccgaggtccattcctgcattactagtatcctgagctgtctatttgcaaaaacaagaatacaacacatgggccataatgtaaaaggtcctgcataggcgggcgcgcaataaagccgagcgtcatttcctcgtcctctcctctgtcctccgttccaccacgcttttctctgcttccttctcttctcttctcttctcttcccttctccatcgttccaaaaccactcgccccgtaaaaccccctcaaacctccctcccgcggcggcgcaatcgcgttcatggcggccgccaccgccgccgccgccgccgagctggagcggcgggtgatggcggcggtgaaggcgtccgcggcgcgcggcgaccccccgctcctgcaggccgccgaggccgcgcgctgcgcccgggaggcctcctcctccatctccgtcgatggcggggccggggccgcgctcgccgcggcgctggtgtccaacctgtgcttcgcgcacaacacgggcgcgatgtggaaggtgctggaccaggccatggcgtcccgcctcgtctccccgctcctcgccctcgcgctgctcaccccgaggtcccgagcaagccctcgtttcgccccctaatccaccgccgaatagttcgattccgtgcgggttttgagacctcgggttgagattaatcagattgtgttgggggggaatttctgcagggtggtgcccaaccggcaggcgcagccggaggcatacaggctctacctcgagctgctcggccagtacacggtcgccccggtctgcacggagagcgtggagacgaaggccatgtaagcaccgattgctccatactacagtctcaattgcttgcttcacattggtttgtctcgtgctctggatttgttgatgacatggacatatgcccctatccccacacaaacttatgggcgtgctacaaacctttgaattggtcaacgtgcttgcgagattccgtccaaatccgcggtgtgctcgtgttgctgatgttgatgctattattttccgggttgtagggtagggctgatggtttgagagggatcgcttgcgctgcgccagtggggcctgtgtagagggagaaattttgttaggttgaaaacgatgtgaatttcctagttgtgtgccgtcttggttttgaaagttcaaagttgatagcacaaggccagaggggcactcctttttggtgcactgtggttttgaagacttccaaagtgctcccatggtccaattgtctgattggactgtagtacgagataaaaggatgcatagggcaggataccaccaatgacctttttttttcaatccaaacctgtttggacaactgcagcccatgattacatgatctttgtgcacctgtccacattgtgatctttaccaaggttgtttggacattcgtgaaagatattcatatggatggttacttctttcaccctgttgtggaaacgtggacatatcctctttgttatcaggctaacatagtttatttatataatagtagtagaacaatcaaattaatgtagctgactagctgacatatgcatggctggacagctggctgtgatgagtatgacagccaacagttatgtacagtgatttgtcatgtgtacgcctggactacatgctgtcatgaacgtatgcacaacagtagtcaacagcacccacatgagattcaggatgctagttttaaagtacaacctttgtgcttttttttttgtcatttaggacattaacacgatctccaatgcacatgtattttcattgttcttttcctagttatgtatttataaaaaaagttggtagtgtaactagatgaaagtaattttgaggacaaatatagtaatatcatttttacatatcaaattataatatgttcaataattaaataaaatatacgcagacgcagccaacgtgtaatactatgcatgtagtagcagaacctactgtaaaattcaagtggaattttgattcaagttcttattttcacataataccacatatgctgttaatagtgtgtgggataaaggccatctgctatttctcatgtgctgctattttacactgtcatgcggttctcctcccctcccctcccctcccctcattcatccgtcattggtgatggctagagatggcaacggggacccataacccgagacccgatgggtttttactctattaggaggcaaatgtgttccaaataatgtacccatgggtctcttatcgggcataaacttcacccatcgggtgggccgggtcgtagaacgttctttacccacccgaacccattaacccgtgggtaaaaaatacccataggcctcagcccaaaagaacatgtgcagcccaaggcccaacaacaaatttaaccctaggtataaaagcctcccacccacttcctctccctcactccccctctctacacccatctcacctgtagggtgcccagccggccgccggccgctgcccgcgccacctgtgccgccgcacaccgagaccgcgctcgccctcgcttcccacgctgccgcatgccacccgcgtcgccgcacgccatccccgcgccgccgcacgcagtacacacccgcgcgccgccatcccgtggctggggaagctagccgtcacgcgaacgccgctcgcccgcgccgcgtgcacgaaggctatggccgacgcccgatgcagtccacccactagccgggggccgaggcaggtggctagctaggttaggtattagggatttttgccggggtcgaggcgtcgagcaaagccgagctgccgagttgatttgttatattatatcactgtttgaattatcagttgatttgttgattctgcaatgtgggctgtgcaatgtggctgcatggtttgtgtgtgtgctttttaatcctaatttgtaaataaaactttgctatggtgttgcactgctgattgactggatggattgtgtgctcaatctgattgctccaatgggtatgggtacccaatgggtacccgtcacccgtgcgggtgtgggtatgggggaatttttcacccgtgagcgggtgtgggtaatgaagcgggagcatttcatttcaatgggtgtgggtatggggtaggcgaacccgatgggtacgcacccgttgccatctctagtgatggcgcctccgtgatcctctgtaccacgccccgccggacctccaccaagcttcccctacgagctagagaatgagaggatgagggaaaaaaggtggggactggggaggaaggactccagcaatgacatgtggggccgcagaggtagaaagagagaggaaagagaagagagagatgggagaactgacctgtggggtcaggggtattggatgtttcacgctgtttctctccattatttagccagaaatgaatattctaatagacgcggtgtccagcagcaaatatccatgttttgggagtgctttccccgaaagattaacttctgcagtgttcaccagctaaaattgcaaagtcgtgatgtcctataccaaaatttgccaatctttactgccagtctaaataaagactactacagttggacttcagactctcagagaacggcttgtttattcatctttgctaccatgaatgctgctactgaatactcttttgtgtcaagccagccctaaactcatctaaccaatcatattaacaaacaatacgccatgtggaagggttcatgggggtaaacaatgccatgaaccatagtaaaaaatgccgcaccagccaccgaaccatctgagctcctggtttgctggtgtaacggtccgactgctgggtcagccattcagctgcaggaccagaaacacttatgtcatgtgtacatatccttcattggtcacaccatgcgggttggctagctggagggtttgactcccatatcacctctttttgcacaaatatttggagtaatatgtatatgagccttactaggtagactattgggcctaataaaggtccatgtcttggttagcctgcacacgaaccaccagtttctgtcaataactgcccggttcatctggtcctcacttggtcaattgcatgaatggtccttcaagtaagctgaacagctgagggcgctggttccgcgttttgtactatgacatgaacccctgcacatgaaacactattttagtcatgtatgtttgatatattgtataatatattatacttggaaagcgaaattcatgtgatgatagtctgactgtcatgctttgatatcccttatgtgcaaaaatcctgaatccttcagatgctgtgagatatgatacaagtgtgtttggtattaagtctttaagaccaaagtagatgaataccatagggaactaacatggcaatgaaacaatcatgacattgaagaagatttggttattcctataatcgtattgcatattccttaaactcaagctcaaaatagtacaaggggttgacactttccgacaaccctcttggaccttttgtaccctcgcgtaattgttttacacaagaatccactcatgtgctctaaattgcttctacttgctttggatgagtccctgcggcttgttcatggcttgggttgtttattgccatcccccttttatatacaagttcactagtcatcttccaaacagaagtagaaatcataatcttgttagtgttcgtcctaatcgggtaggatacaagtcacacacctttcaacactggcatactccatttagatccttgtccatacttaaatgtgtacgtataatgcgttatgcaaagcaggcatgtctcctcaagtgcatatctaatggtccagcgcttcatctaatttgtgttatttcatatgtgatcttatctgcatctggtgctgctttcatgtcatcaggataggagcatctgtttttctagctacttcattactaagtactccctccgtcccactcactaaggcgcacgcacacttttaaattcaactctttaaatatttgaccaataaatattttattataaattaaattttatttgatgaaaataataacattggattatcatttagatttacttttatatgattatgatttagttgctacaaacattgtagtatatgagaaatttaaagtcaaagattagtttagtgagtgggatggagggagcactcaacgagaaaaagaaacatatttttagtttatttaattaattatcagaactgttggattctgtaaaatgttcctaattatcttcatttcccattgcaggttagtcaaatctattgatgatgctttgcatctttcagatagctatgggtttcagagagtggattttggacatacagttattttgtttgtgttaagcgttatcaaaatattgactgactgtatattggaagattgtggtttgccaactattgatggtgatggacatgacatttcatatgctattggagcagaaaaaagtatgaacatagatggcaagggaagctcatttgataggaaagatgagcaccgtgaatgtctgaggaggaagaacacaattatgactttagaagtagttgagaagatcactgctaacaaaaatactcaagtttttctccgtctagtctatcgtaacacgtatgcagctgcatccttgtttcttaatctttattgcctaagaaaaaaagattaaataaaatcttatatatccatccgaactctctatcaattttttcatgatatgatgcagttttgttttacttgagtttttagcttttattatttgaatatacttaggtatacaatttaaatctttcatcattatatcatatgttaattttgtggcagaaactgcttagttagaaaatccactcaaatcttttatcatgtaatactgttttcaaatttaccatttttcaccttgtctgattctgatatcagttttagtgattcagcttcatttgagacatagattcattaaacaactggttttcttgccatcacattgaaaccgcttgatgtgcaaatgcaaacgtgaagttttttaacataaaagtgtatgatattttggcagatattatgcagtaagatttcatatttcacagccattgacagatctaataaatccgttctgacttagacatttagttgatgctgctggctgcagcaaaacattcattctggattttagataatttcctcatggtttgaaagttgtcactgttttaagttttgatcaaattctagataactgtagattaagggttcaacatctttagatctagacttcttatctgaagatttcttattaggttggtttcatgatctcatctagtttctgcagtccaaaggtgaagttaatccgtgttatagataaaagaatagttttactttaggtttttagggctgtaaatagtctgatggtctgatctccacaatggtcagaatcagaccaggttaattggggctagatagttcactccgaaacagaggccagaccaccagtatcaccgaaaaaacttatcttttgagttgggatgactctatacttcaaagttgggtttttatttcagttgtcatttcactcatatataattgctgtgcgtttagctgtttcaatcctacatggaagctggaataattaaaagtttcacttaactggcatccacactgactggaaaccctttttttatggatgtgctagggtagacctgaaaatttcaatattttgctccagaggcttcagcttattggtgctctgaagtcaaagaattttggaactgcacataatctgctaggcagcttgatgatgaatatacgaaaagttgttactacaggacatcaattacacaaaggcaatctattgggaagtattgtgagtacaaagccttgcagttctgctgcacgcagtgtctttgggcgctgaaagagctcttgttggataccttttgacatgtttatggagaacacaatggacggaagacatcttgataccatatcatcaattgaagctctgacaggttctaatatatttttcagttgttgattcaactgctgtataaccttttttatcaacttgaaacctttggttggcacagaacttgctaagacacttcaagttcttaatcgagcaacctggcaagaaacctttcaagctctgtggatttcagctttacggcttatacaacgagttaagataacttttgaaacatcatttttttctttattaacagatgaggaagctagaatgttcgtttaatgtaattttgtatctgtttactaggatcgtggcattccagaagggccatttcctcatcttcattctcgattgtgcatgttattggctattgtacctctgtctattgcttccattcttaaggaagagtctgacaagattgaaggtggaatggtctctgttagaagaggagaattattgtcttcacttcaagttctagggcaattttttggtcttctttctcctccaccagcagtagtgcagtcagcaaatattgcagctaggaaagcattagttgctttatctgttttgaaggatcggaatgagagaggtcacaattattccaaagatatctcctctattaaagcaggttatctcagactgattttacaatatctagtatttttcttatgcatttcttattagtaaacaattcattttctctcataatcattctaaaattgcagcgggaaatatgctacatcttattgtggaagcttgtatagcaaggaatttagttgatacatctgtttatttctggcctagctatgttgttccagttaaagacgcatctgctgttgaggaatccccttggtcagccttaatggaagggtcaccccttatgggccttaaggatgcacttatggttacacctgcttcgaggtgatgagtcatggacttgtaaaattcaattccttaagagcattttgggttttttaatgtttgctcactagcttgattaatggtaccgttcctacttgattattttagcctagcagagttggagaaattgcaaccttttgcagtaagtgggtcagatgaggaaaagttggcggcgtctaagattctgtgtggagcatcccttcttcgtggctggaacattcaggtagaattctgtgtggagcacaaatagaacgagtggcacatacaaaatgctcttgttctattttacaatctttggcctgaaaagttccgtatagtatgtgtcattattgactattactgcctttgaaaatgatttaatgtggctttcctgtgctcttttaggaacatgttatccaaatggtgcttaagttgctgtctacattgctccccctagactctggatcagatgggttctatatacatcacatgcctatgctgcatgctctcatatctgggatttcttcaattgatgtggttcatattctctctatgtatggcttggtaaggaaatcgatgtttttcataaagacaatgaattgctaaatttcagagttgcattttaaattattaaagcaaatatcaatatgctggattttatataatttacaaacttttcaggttccagaactagctgccattctaatgcctttatgcgaaatatttggatcattaccttcgtctgaccataggaattgtagttttgaagaggcctctgtgtactccgtattctcatgtgctttcctgtgtcttcttcgcttgtggaaatttcatagaccccctgtggagtatgcactatcaaaacatggagtctttgtttgctcagagatcagtttggattttctcctgctactacgaaacagtcattttgctttgaatagtccgtatgatgttagcagaaagagcatatttcaactagatccatcgtttcaaaaaccggtgtatattgactcatttccaaagctacgggcatggtactttcagaatcaggcttgcatagcctctactctttctagttcttacaaaaggaaaagtatccttcaagtagccaataagatactgaaaattgtctgccataaaatgtcaaaaagtggcatccctcctgtcagttcccaatcaacatcaagttccagtatgagtggttcatctctaggcacacaagatgatgtctcccaagggccgccagctactgcatgggaagtgctggaagctgttccttttgtgcttgagactgttttagctgcctgcgcacatgggaggctttcgtctcgtgatttgattacaggtttttattcagtatcctgcattttacttgcatatctaacactggtcttcaatttacactaacaagctaaatcttccatttacatttaagtagtgttgttcagaaactaataatatctttttgatgaagtttcttaattccctcaagttcatactccctcctccgtcccaaaatatagcaaccagtactacatatgacatgtccccctgtccagatccttagtagcagcatgtgtcgcatctagtactacggtgttatattttgggatggagggagtagtatttagttctagttctgtcctgtaagttatcccagttactttccactgtgaaagattgaatcaaatgccttcagtaacaaaatttctttgagcttttattatcatcaatttaactcaagtgcaatagtactactttcataaatgtcatcctgaatttaaaattgcttacgtgtattcaatattcatatattatgtaatttaatttgcaaaaatatttctgtctatggatatacttctcctgtcccaaaataaatggatctctcgcattccaaggaaactttagtagggagggtaaaacactaaaatgcccctcgatgagaaattagtattagtgggtgggtaggtaaggagtattgaagggatacgatttcttgatttgtggaccaagggtaggtaagagcctactccattccaaaatataaacatgtctaggattcaaaaagtgtaccacaacataagcatttttaggatactgattccagtgcatggatatcaaagcattttcaatcatcaggagcttgggaagggaatctaagcaattcaaaatttgaccaatgaggtgattgaaaagaaatcttttccctcaaccttaatctttgccaaacaacttattttgggacaaattttgaactctagaaatcaatttattttgggatgagtacctttgaatatttcagttctcaatgagactatcacctaatatttaggtggtatacataaaaaagttggctttagactttcatttcctgtctttttttttattttcaattaatcaactcgatcatgcatgaaaatattttccttttcctctaagtggtctaaatattttatcagattactgggtttttaagtgtacaggatgaaatggaatgtcatagtttaatatgacctcataaacatttaaaggtaattttaccttgtaagatggtgtcccaggctgatttttgttttcacattttaactcattgagagctgccatggagttgattaaaaatgagagtaactttggtcagaattggaaagaagggattgcacagggtgacaaatgggagatgagattctccatttgccccatttaagctctagttgagtagcctagaactctagataacttcagggtggccaattttggtgtttgagcagtcaacgtagaaacttgtttgtaaaaccaccttttgggagcagtggcggagtccgcatcgtcatcaagcccaggtgtcaaagagcatttcctggttgctggctacttcttataggtgtttctggtagttgatagtgatgacgccagctgcagagctcaggtggacacttgatcagcctgggagctggctgcaccactgcttgggggttaaagatcctgttaagtggactttggtcttgtacttcaaagtttagggcaactcgtctggttgtagttcttagagttatgtaggatctactaagtctatggcactatggacgttttccctctatgtagcattatataaaaagctcaccttccagctatctgcaaattgttttcgtttatcgaaattgacagacatcaactgtatttttcacttcccattgtcattgcatatttactggtgcataccgttacactcttacaggcttgaggaatcttgcggacttcttgcctgcttcagttgctgttatcgtcagctacttttcggcagaaattactcgtggcttatggaagccagttatgctgaatgggactgactggcccagtcctgctgcaacgcttttagcagttgagtccgatattgaggaggctcttgcatccgctggtgttcatattaacatctctccacgaatacgtaagtttatgtctttctatacaaatgattcatttctgtttgctactacaagctaccgttgtttctattttttatttcatttccagtggccttataagttgttgacctcagtatttgatgtttgaacattgttttatgcattcactctgggttctgtggagcaaaatttaagctatcctccctccattattataagtcactttgggtttgtccggagtcaaaccttttcaagtttgaccaagtttatagaaaaatataccagcatctacgacaccaaattagttttattaaatccatcattggatagatttttatagtatatttattatgttggaaattttttgttatatttttctataaaattggtcaaacttaaagagatttgacttaggacaaacccaaagtgacttataatatgaaacggagggagtacatcatgagatatatttgttataaacttataatggtaggtgtgaatgttgtacatgtatacattaaatagctgctttaaattataattagtgatctagcatttaatctgcatacagaagtagtaaatgtactgtgataaacttataatgggcacccaactctggcgacacccaagccagcgactaaatcaggattgtgtgaggattatcttcaagttggttttatcaggattattagattggttcactacttcactgttagttaatgagttccaagagtttagcttcatttgtaggattgatgcctctcctataaagggacttggccagataatgaagagataagcaagaatttagtccactctgttttcttcttcctccaccactgcactgggatgatgaggtgcagaacgccctcatcctcctgtcatccatggctatagacttcaatcgactccacagaacccactagctgaagaccatgacaccactaaagatccgtagtgggatacctacgatatccccaactctcttttaaagagtaagaaattgcataaattttattttaggatctactcctacctttactttagtaattaaaaaacttggcttttaaaaggacagaaacacatttcttattaaattaggttgctaataacacaggagtagtggtggttccatggttgtatgtcacaggtatatactgctgttatcatattatcctctttaatgttggtacgtttactcattcatgtcaaataggggctttacaggcgatagtaaatcatttatttgtcttcatttgtgagctatgccattgaaaatttatcttgaatttaagaagactttccttgtaagctctttaaatgtaagcttcttatactataactgttgcttgtcactcaatcatacaggtccaccaatcccaatgcttccattaccaatagcaactcttatcagcttatcaataactgttaagatggaggaatttaatcacttacaaggaattattgacaaaggagtggaaatttgtgctacatcaagttcatggcctagcatggcaatcataggggcattctgggcacaaaaagttcggcggtggcatgattatatcatccagtcatgttcagagacaccatttaccagagataaaaatgcagttgctcaactaatcaggagttgcttctcatctttccttgggcctttggttgatgggcgttcttgctttgtagctgacagaggagtgaataggctgctggggcaggctcaccaagaaagaagtccccggttttctttatcgccaggattactttacacacgatgctgccgaatgtttcctgacaactattttgtatgtgaagagattttgaaggttgtcattgagagagctcgtgcattagcaaatgaatgtgactctagtagacctcatcttctgaagtctggtcggatgacactatcttctgccacatgttctgtagagcagatagcatcacttgcagcatctatgctttgtcatgctggtggaataaagttggttcgtcttctgtatgagcagattctgccaacaatgctgctttcagctggtgaagcaaggctgggttctgctggaccagtgtgcagtagtttcgaaggatttgctttggcatatgttctccttgtttctggggccagcacctggggagtaggagaaacctccccagtttatacttccgtatacacatcgaagaggcaacgggttgtagataggcacttggagtttgtcgccaatgtaatgcagggtaacattgagcttggctgtggccaggtcacttggagaacctatgttatatgttttgtgggcttgctggtcgactttgcgccaacatggatccctgaggtgaagctcgagacgctgaagaagctggcgtctgggctttggaaatggcacgagtgcgatcttgccctctctttgctcgagcgagggggtccaaaggccatatctacagtggttgaatacatcctatgatatgcccgtgccaaattggtgctctaatttgccatgtacttatgctctcttgctccagtacaggcatacacatcttacacctgatctgacgtgcagagacccccatcagagaagcatatgttctagtagatggcttgctctgaactagatagaagtctatactacagaaaggatatccagcagttaggtgtttacactttacagtacatttacaggtcagttcttattctggtcttgctgatcacagtgcatgtgtacataattcgtggaatcttctcttggtcgcaatttatattcacaaatgtaattcaaatgtcttagataggatgacatggtgtaaatgatcaagcatagctgccactccaatgacatggtgtaaatgatctttccggctcaattggagatcagattatttttttggttttgctctttcttcaaaggaaccgagaccaagtcttccaagcctgtttcgaccatagcattggtgacagactacagaaaagagaagttacatttacatatagtccactgtattactgttcatatgatcaatgtacaatctggtaagtacagtagtgactcgctctctagaacatctggaaccaacaaacctgtcatgctattgagcatacaacggtttttttttttctaaaaacagtcgaggcgaagcttgaaaattttccctataccttcaccggctatctcaacggagcaggagagagacgtgacaagtgtctttttgctggtagattttgcatgtacagctaacaacacggcagcgcaatgaagtgaataggtactagttgagtcgttagtcagaactcagaacccattgatttccggtcccagacgaggagattcttgacagcgagagaacaagaaaggcttcgcgaacattatttgcaatcggtcggaacacactagtggtcaatgtagtgttgatcaacggagcacctttcgcgtttaattccagtaactaagaagtctacataaaaattttgcccccactttgtatataactaagaagtctacatatgtatttttataaatattgtttaatataattaccttgaaaaaaaatcacatgtacgaggtaagaaaaaagtagatgaacgggtaaaggtagcgagctaacaggtgtacatatgtatttagcaggtgtacatatgtatttatgtatctttcatgtaatatcatgaccagtaaccggtaacagtatagatcatggtgtggagttaagcaaatagcgcgtgagttaggggtttatcttgcgtgcctagaatgaattgaggcctgcaagcctagtgtgcgtgtggcgtgtggcctattagctcatttcagaacatgttaaatattcaccgggtggctccactgtagccactctggcaaatgaaatgaaacacaatccccaactctgctctcactctctctctctcacgttctctgcttcctcctccgatcaatctccctccctccaaccgaatctcgttggcgacaatctcatcggcgggggtgtgttacagtggtatcaaagactagttgtgggtgtcgctgtgcatctcatttttgttgccgattttccatgatgcccgccaagctcccgctccattaaaacaaggccggaattgatggaatccaagcttctggagaagttggaggtcatcactatt

SEQ ID NO: 63131 - DNA, 13054 bp, Oryza sativa
ctcttgtctccttgtctcatttacctgttgcatttacatttgtgcaatttacatttctagagacatactagagatcatttcaccctaggattgctaaacattgacataggagtgtgatttactttcctagagatataattgagccactatcaccctaggtttgcaaaacataaccgagttgcttagttagagttgaccctcaccaagcctagcaacttaggttagttttgattaggtgtcatttagttttaaatcgcctattcaccccccctctagtcgacatctcgatcctacaagtggtatcagagcttggtctctcttgattgagcttcaccgcctagagagaagatgtcgaacgaggtgaaccatgtagggaaggctcccatgtttaatggcacaaactactctacttggaaaattaaaatgtctactcacctcaaagctatgagcttccatatttagagtattgtggatgtaggctttgctatcaccggcacacccttgacggagattgatcaccgcaacctccaactcaatgcccaagcatgaatgccttgttcaactctttgagccaagaggagtttgatagagtgagcaaccttgagaccgcatatgagatttggaacaagttggcggagatccatgagggcacaagcgagtacaagaatgccaagcttcattttctcaagatctaatatgagacattctccatgttgcctcatgagagcgtgaatgacatgtatgggaggctcaatgttattgtgaatgatctcaaggggcttggggcaaactacaccgattttgaggttgcccaaaagatgcttagggctctaccggagaattatgagacccttttcaccatgctcatcaactccgacatgtcaaggatgacacccgcaagcctcttggggaagatcaacaccaatgacatgtacaagttgaagaagaaggagatggaggaagcctcaccttccaagaagtgcattgctctccaagccgaagttgaagacaagggcaagggcaaggtgaatgaagccaataaggacttggaggaagagattgcccatcttgctagaaggttcaatgatctcttgggaaggagaaaggagagaggaaggggctccaactcaaataggagaagaaatagaagacccaacaagactttctccaacttgaggtgctttgagtgtggtgagaagggacactttgcttccaagtgcccttccaaggatgatgatggagacaagtcatccaagaagaagagtggaggctacaagctcatgaagaagctcaagaaggaaggcaagaagattgaggccttcatcggggaatgggactcaaatgaggagagctccgcctcatccgggtccgaggaagaaggtggtgatgatgtaaagctccaagaacaagaagatggccgttgttgccatcaaggaggctccacactctttgctcaagggctcctctaaggtaacatctcttagtgatagtgagggtgatgatgattgtgatgatgtttcctatgatgagtttgtgagtatgtttgaggagctccaagcttataatgagaaggagattgtcaagttcaaggctctaaagaaggatcatgcttctttggatgtcttgtatgaggagctaaagacctctcatgagagactcaccatttctcatgagaagcttaaggaagctcatgacaacctcctttccactactcaacatggagctcacattgatgttggcatatcttgtgatttgcttgatgatagtgctacttgccatattgctcatgttgcatcatctagcattcctacctcttgtgatgatcttgtggatatgcctagctctagctctagctcttgtgtttctatttgcgatgcctcacttgttgttgagaataatgagcttaaggagcaagtggctaatgagacaagagtttggagaggtgcttcaagggtaagaacactcttgacaagattttgagtgaacaacggtgcatccttaacaaggagggacttggattcattccaaagaagggtaagaaaccttctcaccgtgccactcgttttgtcaagagcaatggtaagtattgctccaagtgtcgtgaggttgggcatttggtgagtgatttccccgatggtaagccttctaagacatgcatgtttgattctcattatatgcttaggaaggctcatgatggtagcattgttgctagatatgtgggttcccctatactcagtggtaaaaagaatgccatttgggtgcccaaagctttggtctctaacctccaaggacccaaacaagtttggatacctaaaagagcttgatcttcttttgtaggtgaactaccgcaccggtgggagccattgggtgcttgatagtggatgcactcaacacatgaccggtgatagggctatgttcaccacatttgaagtaggagggaatgaacaagagaaagtgacttttggagacaatagcaaaggaaaggtaattgggttaggtaaaattgctatctccaattatttgtcaattgataatgtctctcttgttaaatctctaaatttcaatttgctttcggttgctcaaatttgtgatcttggcttgtcatgtgctttcttccctcaagaggtgattgtttctagccttcttgacaagtcttgtgtgttcaagggttttcgatatggaaatctttatttggttgatttcaattctagtgaagcaaatttgaaaacttgtttagttgtaaaaacttcattgggttggctttggcataggaggctagctcatgttagcatgaatcaattgagtaaactttcaaaacgtgatctagttgtgggcttgaaagatgtgaagtttgagaaagataagctttgtagtgcttgtcaagccggcaagcaagttgcatgttctcatcctactaagagtatcatgtccacatctagaccattggagcttttgcatatggatttgtttggcccaacaacctataagagcattggtggtaatagtcattgtcttgtgattgttgatgattattctcgctatacttgggtgttcttttttgcatgacaagtctattgttgccgagcttttcaaaaagtttgcaaaaagggcccaaaatgaatttaattgcactcttgtgaaaattagaagtgacaatggttccgagtttaagaataccaatatcgaggactattgtgatgatcttggtattaaacacgaactttccgctacctactcaccccaacaaaatggtgtagtggagaggaaaaatcgtacattgattgagatggcaaggactatgcttgatgaatatggtgtttccgattccttttgggcggaagccataaacaccgcttgctatgcaaccaataggctttatttgcatcatctcttgaaaaagacttcctatgagctaattgttgggaggaagccaaatgttgcctattttcgagtttttggttgcaagtgttatatttatcgaaagggtgttagactaaccaaatttgcaagtcggtgtgatgaagggtttcttctaggttatgcctcaaatagtaaggcataccgggtctacaacaagaacaaaggtattgtggaagaaaccgccaatgttcattttgatgagactaatggctcccaagaggggcacgagaatttggatgatgtaggtgatgaaggcttgatgagagctatgaagaacatgtctattagagatgtcaagcctattaaagtggaagacaaaccatccaccttcactcaagatgagccatctacttccgctacgccaagtcaagctcaagttgaagtggaggaggagaaggcacaagatccacctatgccacaaaggatacacaccgctctttccaaggatcacccaattgaccaagtgttgggtgacattagtaagggtgttcaaactcgatctcgtgtcgcttcgatttgtgaatattactcgtttgtttcttgccttgagccaaaacatgtagatgaagctctttgtgattcggattggataaatgctatgcatgaagagctcaacaactttgcaagaaacaaggtgtggacattggttaaaagacctagagatcacaatgtcatagggagaaagtgggtctttaggaacaaacaagatgagaacgggttggtggtgtgaaacaatgcaaggttggtggcacaaggtttcacacaagttgaaggtttggacttcggtgaaacttttgcccccgtggcaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaatcctaaccatgtttataaactctcaaaagctctttatggtttaaaacaagctcctagggcttggtatgaaagattgaaagattttcttttgtcaaaggatttcaaaattggaaaagttgacaccacccttttcacaaaaatcattggtgatgatttctttgtgtgtcaaatttatgttgatgacatcatatttggttttactaatgaggtattttgcaagtaatttggtgatttgatgtctaggggatttgagatgtccatgattggagagttgagcttcttccttggacttcaaatcaagcaactcaaggatgggacgttcgtgagccaaaccaagtacatcaaggatctactcaagaggtttggcttggaggatgcgaaacccatcaagacacctatggcaaccaacgggcatctcgaccttgatgagggaggtaaaccggtagatttaaagctttatcgttccatgattggtagcttgctttaccttaccgcatctaggccggatatcatgtttagtgtttgcatgtgtgcacggtttcaagccgctcctaaggagtgtcacttagtggccgtgaaaaggattctaagatatttaaagcatttctctactattggcttgtggtacccaaaaggtgctaaatttaagcttgttggctattccgactcggattatgccggttgcaaagtggatagaaagagcacatccgttagttgccaaatgcttggtatatcccttgtgtcatggtcatccaagaaacaaaactccgttgccctctctaccgccgaggcggaatatgtttcggcgggtagttgttgtgcccaattgctttggatgaaacaaacattgttgaactatgccatatccttcaccaaaaccccattcctatgtgacaatgatagtgtcataaagatagccaataacccggtccaacattctagaaccaagcatattgacatttgtcatcatttcctaagagaccatgttgccaagtgtgacatagtcattagccacataagaaccgaggatcaactagccgacatatttaccaagcctcttgatgaaacccgcttttgcaagttgagaaatgagttaaatgtcatagatttctctaatgtggcttgagatggtgcaccatggttgcttcttttgcattgtgtatatttgctctcattcgcacttatgctttggatttattgccatttggttcttcattgcagaaatggagcatgtcacattaagggggagttttgcactcttgcatgtgctctacttccttttatatgtgagcaaatcaactatagtggtgctagtagtattttcaaaatgtccaagtcaacataagtcaaaacttttgtaaaataaatgtaatttgaaaactatctcttggaaaatgtttcaaaagttttcctatatgttttccaagcctcacattgcaagaaaaatgatttttgaatgaaaatgccattttggccctcttttgaagaaactagattcttagttttggccaaaatgagatttatccccaaaatgagattgagaaggaatttgagaaaattttcaaaacaaagttggtagagaagaagatttgaaatgtttttggtattcaaacctattttaaaaaccaaatcattcaaaagttatttgaaaaccaatttggcccaaaaacccctatagaccataaaaggtcacctcatagcacttaagtgagttttgttgcaaatcatcataatcttcaaatattgtggatggttagcaatatttaaactcacacatttcaaaaattgctccaaaaatcaaatttttgttgaattttattgtgtgggggttgccggcttgtgcaagggctgtgcacagccggcagggggcctggcagtctgaccggcgctatatgcgcggtctgaccggccaggtgcggcggtctgaccggccacatagggccggtctgaccggccgaggtgggcccaggcagttttgccccttttcttctccatcccacacctaccctctcccatctcatccccattcacccccaacccgaaaaactctctctctctctcacctcccctcaaaccctaactctttcctccaccaaatcccctcagtttgaccgcagatttctctccggttacaccgtaagtgattctcctccgcttcctctctctattccatggattggtttgtgtttttgttgagtttttgattcatggcatggaaccctaggtgaagcacgaggtgttcttcgatttgcaccaatagagggtagtttcttggtgtgattcaactccttcaaccggtaaatcactctccctcttgtgcattcactcaaatcgatctatttcaacctctagggttaagggtagtttcctcttttgttccaatcttgatgaaatatgtccaaccctttgatattcatgttccaatcctatgctatattgttccagcaaattttagactcaaatgtgtagatgtgaaaattttttggatgcttgaacttgtgggaggaggtctgcccggagccacaggcggtctgaccgtgggtcagccgccggtctgactggcgtgtgcgccctgtctgaccggccagcagcctcggtctaaccggccaccagtgagcggtctgaccggccaccatgggcggtatgaccggccaccatgggcggtttgaccggcctgatgctgtcggtctgaccgccctactggctgcggtctgaccatccctccactggatataggcaaattttcacctctccaaattgtttctagaattattgctaatatcctatcatcctttgctttttgacagtgatgcctccccgcactcgccatggttgtcgtgcgcccactctggatcccatgagtgagcctgaggaatcgagcggagaggattacgctcaaagtgatgaagaggttgaggccaatgttgagggggctagtgaggaggcaagtggagatgatgtcagtggaagtggagaggatgaggatgaacaaagtgatgagatgaacattgatccctccatccagtttgtggtgaacatgaggaatccatcgcagtataccatcttaaggcatcatgatcagttcttgaggcctcgggacaccccggatccccattttcacaccgctttccagaagactgtgtatgagcaggtttatgcagggaaaacatttgtagagcataagtggatttcttggagagacatcaatgagactccagagtttgagagcttgcatgatctcttcaagactgttggcattgaccggattgtgaccctcaagcaagactacaatgaagatttgatccggcagtactatgctacagtgtgggtggctggagactagagtgagatgaagtggatgtccgacaccctccagtgttctatctctcgaaggcaattccggcagctcctcaacattcgcttggactttggagatgatttgcatgaggagcacactcacaatccgctctccatagactatctctctcagttctatgaagatggagtgcggtacacacatgggaaggttgccggcttgaggactatccccagtgtggttaaaaggattatgagagccactatcctccctcgccttggcaacaatgatgacattaggggggtggcttggcacgtcatcgatgcaatcattcagggccgtcagttcgacattgtgtctctcatgatgcaagagattgctatcttcaagaggacattcactcagggaatctattatgccccttacatcatgaggttgattcaagacaagcttggggctgctgggcaaaatttgaagaagcacaagcagtacaagccccgccttcagcctagagctccccgtgctcctaggacggtgccctcttctcaccctggagctagctcaagcccagcacctcctcctcctcatgggtatgatccaaatgcttctttcatcctcactatgcttactttggaatgcaacccaatgaatacttcaacccggtacttggggctattaataccttaagtgaaagcattcaacgcttgtctaccaggcatgaagcattgcatgaggatgttcgtggcttgcgcaccgatgttggagacttgaatgcttccatggggagattgcacactagagtgggtgcattggattctcgagtccaaatgttggagagcacccaagcttttgtatatcatcgtcgtcgtgatactcctaatccttcctctttggcgcttcctccttctcctccacaagaattaagacctttttggtacttgatgccaaaagggagagaaaaatgtccttaggtgtgctttatgtattgtgggttgggactaatggtagtgaggttagtgtcctcatatctaataggttaaggtggtttgagctatattatgtatgggtatgggctgttactctatattgtgtgttctttatcgttttgttgaactctatgtcatttggacccttcgtggtcttgtaatagcctatgtttatttgtgagcccttttaggatgatttgtgacttatgtgagttgaatggttaagtgatgtgaacttgtgcaatgatggatggtgtatgtgatactgatatatatatgaccatcttatgctcatggatgaatatttcttgaagttcacattgagatattgctcttgtgtttgtgatatgttgaattgtgaaattgaaatgtgcattggctccatatttgccatttgtgattgttatgcacatgtttagggggagcttttgatttcctttacagtatatgtccatgtgttctatgtttgattatatatattcgtggtgtttgttatcaattaccaaaaaggggcagattgaagcatctaggccctcgttgttaattttggtaattaatgacaagcgctaattgtggactaaccgttgctattgagatatattttaagttaggtccacgtcatgtgtgcgcatggatgactatcgatggattaaaatttgatggcgcgaagcgaagaaaagaaaacggtaaaactagtgctttagttttaaaattagtcgaggtgaagggcgatcaaatttgttagtttatttttttgtttcgccgtactatcaagggggtaatgacctagcaatgagatgatttttaattgacacattaggtcattatgcatttagacttgtgctcatatttcatctcacacacacaatcttttttgttttcactgggttcggcatgaccaggggcagtcagaccggccacatagtggtggtctgaccggcgtgccctggccggtctgatcggccacgaaacggcggtcagaccggccctctagaggctgggatggtgctgctcggggtggtcaatacagagccgacggagccgtattcggtcagaccgagctgatggcggtctgaccggccactcaacgtcggtctgaccggccaggccgatggggccctctgacagggttacaacggctagttttctagccgttgcagagtagcacggtctgaccggccacatacctccggtcagaccggcagagcacagagctgggggatttcgcccccaacggctagttttggttggtgggagtataaatactccccttccagcagcaagggggctctcttggcacccaattcaattgcatacaccccttgcacctctctcacacacctttgagcttagtgttcatccattgtagtggttgagattgttctagacaagagtcaagtacatttgcttctatttgtagagctagtgtggcacttgatttatcatctccatgccgggtcattgcttgttactcttggaggttgccgcctcctagacggcttgtggaggagttgcccggtgacctctctaagaagattgtggaggaggcccggcgccggtttgtgagtggttttgagttcaccaccttcggagtgaaggaagaactaccctagtggccgaggcttgggtagtcctctccgtgggcctgctcccgtcttgcccaccccttgacgaagggggcgtgcggtggcttcgtggttgagcggtggagttgggctcgcctcaacggggagtaggaaactggcgagtttccgaacctcggtgaaaaatctcttgtctccttgtctcatttacttgttgcatttatatttgtgcaatttacatttctagagacatactagagatcatttcaccctaggattgctaaacattgacataggagtgtgatttactttcctagagatataattgagccactatcaccctaggtttgcaaaacataacttagttgcttagttagagttgaccctcactaagcctagcaacttaagttagttttgattaggtgtcatttagttttaaatcccctattcaccccccctctagtcgacatcttgatcctacagtagtgcatgcagcctacaagagattgtaatatagtatcgttgttgactgatatgtttaaaattaagctagtgtgctcaggtctgcacaagtacaaacaactgctagcgtggatatgtctcactatgattatttagtactacacattagatcaattttgcatgtgtgttgttttgtactaggttcgtataaattagacaagctattgtattaaaacgagcaatttacaagttgttatacctatttacactcgccgagcaagtttatgtaccttatttttatcgatgaaacatttttttgcacgacgcatgaaacatcgttcgaaacaacacacagccaaacgtcctccgtcggatgagccggacggtggatatgggctaaagtcacaccgcaactagacagcggacccgccggatcctaaaaccctacgcctcccgccgctggccacccacggccacagccgccacacccaaccttccgccgccgtcgccagccagccagccatggggagccggctgggtcgccgcgtgatccacttcgccaacctccccctcaagctcatgctccctcccgcgccgctctcctccgtccaggagttcgccgtcaagaccgtcccctccgcctccaaggtcgacatccgccgctgcctcgagtccatgtacggcttctccgtcgccgaggtccgcaccctcaacatggagggcaagaagctgcgccggggccccttcctcgccgccaagcccgactacaagaaggcctacgtcaccctccgcgccccgctccccgtctcccccgacctcttccccattgggcttgtcctcggcgagagggagcgcaaggccagcgccgccgccgccaggaggaaggcggtggagggcgccgaggtggaaggggagggcaaggggaagcactggatggaggatgagaaggtgggcttctccagggccggccgcggcaaggtggtgtacggcaaccccgggaggctggggaagaagaggaatggaggtaccaaggtgaaagacagagccggagaggaagtggggaagttcccatggagcgggacgcgtcttgctaccgagaagaaacctgctaggtgaggcgttcggttcaatctacctttcttgattaactgatgtttcaactcttagcaaattaattgtagttttgttcatgtggaattgattagtactacagtttctaacctttattaatgttcaagaacggtcttttggctttgttgaagcctgagtagaatagtagaagaaaccaggatgatgcggtccaactcttagcaagttagttatttttttgttcatgtggaattgattagtttctaatctgtgttactgctaaagaacggtcttttggctttcttgaagccttggagtagaacagtagaagaaaccgtgataatatggtccaaatcttagcaagttactattgttttgttcatgtggaattgattagtttctgtgttactgctaaagaacggtcttttggctttcttgaatcctaggagtagaacagtagaagaaaccaggatgatatagtagtatcagtgccaaatttttgtgtttgttgctgggggaaattgcatattgttgtaatcatactaaacgagcgatacagatggtgatctagaaatgatattttagatgtacactagccaagtgccgtttgttgcaaggaaagcacaattttctgaaatgtggagacttgctcttactatacagtatcttgagaaatatataaattaacatcctattagtgttaccatcagaaatttatcccgttttagttcaaggtgttctggtgcaaaatgcattttgcatgtcacctcattgctgcttcaaggttcctctaaaagaggatttaaaagcattgcaaattaaaatttgtataacttgaaaataattgattatttgaaaccatgcacagaatgactgttcatcatctcaaccattggtcatctttcttactttctgatgtatcgatgacatcgaaaagcagcagagttatacacataatttccaattttcctttaactactctcttataggttgcacaaccatccctctattggagttagctaaatgctaccaatatcttctctatgccttttctgtgcaaacttttaatccttaatttctaaatcccaagtcacattattgaaaagttgcacttgttaatagtataatacagcagtacaaatgttcattcaaagctaaccattcatgcatatttcaaagattcaatcctgagaagaaagggaaaaccataccgttcataaccatacttttatttagaaacc

SEQ ID NO: 63132 - DNA, 6303 bp, Oryza sativa
gcgcgctctctagcccccgtgagtgtgacccaccgggactaaagatcgagctcaccctttttttttgcacgcgcgcgcgcgtgcgtgttttatatatatatatatatatatatatatatataccatgcatatatatgtgtctatacatatatatgcatacatatatatatatatatatatatatatatatatatatatatatatatatatatatatatatatatatatatatatatatatatatatatatatatatatatacagtacatatgtacatgcatatatatatttatacatatatatgttatgcaaatgcatatgtgtatatatatatatgaccaaaatatatttacattatagaaaatgtgtacacatgcatatagaaacatatgtagtcatgtattaattataatccattatatgtcctagctagctacgatttcgacgtagtagtagtactcgctgctagctcagaaactaaggaccggtgaattgtgtttccgtcatagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcgcacacgtaatagccgcacaagttagttccctgcttttgctttacgcactacaaataaatgacaaacaacgagagatctaattaatatacacttgtatgtatttaaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtgtataagttcgaaaaccttgttaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttagtatgtaggaagacagtaaaattaaactaactctgtgttgtacggcaatagtatgaacgtcttgtaatgctgcgccttcaggagatggacgagattgtcctctgtttcttgtggatattggtcgagcattgcgacatttactctccgagggtcgatgaatccagtatcgaaaaccctccgccgtcgggccctttaaatctccattctacaacgataaaagggagtatattattttctatagtctacttatatacaaggacctaattaattaaaggagacgtatagtaagaaatctaactgaacgatatacttacaaaatccagcaactcataatagagacgtcgagtgcgtccagctagtatagttcgtagattcccttgaaattgatccagagaatgtcatctccttgcaagaagtctgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgatttgtgcgactcctagcaattgatccgtagttagaccggtgtcagtaataaattcttctatcgtcatttctttaccggtcaccaacggctcgatctcctggtttggttgctctccaagctgagggactgttttggactttccagaatatgctttcttcagcgttcgctcatagtacgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggcccttgacttgaaggtgccggaagagaagcttgcggaggagtaggtgtaggagcccgaggaggagtcggtgcaggatcctgaggaggagtcggtgctggagcctgaggtggagacggtgctggaggatcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggttagttgggatggccatgcccgacgccaccttcatgttgtgagagattatttattagtaatcaacatatataagcagcaactagcggaatggctaaatctaaaatatataaactacgagcttacctttattgataagttcttgtaaggaatatgtggctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgctgagttcgtagctcgatacccggaactctagatctgcaatcttcgcctcggtatctctcttactcctcatccgactcctgtacgtgtggatgtccaccttgaaaccaatcttccaaggaatcacccctttccctcgtgttcgtcctggatgctctggagtctgcagggcgagtgtcagctcatccctatctctgtccggtcggaacgtgccctgagaggaggcttccactgcatctgttagtcatcgcgcacctctcgtatctgatcgccgaagaccagtgagccatcagctgggttgagcgttccaccgtgagcatagtaccagaacttcgatcgttccggccaattggcggttgccggttcgatacccctctcaatcaagttagcctccatctcctcccacttcggcatcgcgacgctatagcctcctgaccccaagtggtgatggtacttcttcttggtggcattttctttgtttctttccatcatcgcctgcccttgttcacctgtcttatatgcaacgaactcgtcccagtgatcccttagctttgggaatgtgttgaagttcggtgtctgccccttcaggatatatttcttgtacagctctcccttaaagctctgaaactattctgccattttcttcagagtccaccttttcactttgtcctctgtacccgtgggaagggtgaatgtctcgagcattgtggtccacagcatctctttctccgaatctgggacaaagctctcatgatctccgcgtgcccttgttcttcgccagtacaccgtattgacagtcacgttatcccgcacaacccaaccgctgtgacgtacatagttcttggcggcttcggccggggcactaggacgtccatcttctttcacttacgttatgatgtgccgaccctcaagcttcttcgctacacctcgttgcccgcgtgccctcttttgtacaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcagtcagccatctgttgatataagaaatatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgttttgtgcgtatatgttaagtctaattaagactacaatagtcaattgctaggagtcgcaccaattccgtagtcaataattacatactaattctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattccgtagttaataattatatactaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatgctaagtctaattacaagtctaatattcttaattgcattacaaatataacaatcatttatattattatgtcacttgcctgcacgaattccttctacggctagctcttccactccggcttgagggacgactccgacaacatgtcttttctgcaagatacaaaaaatatgtattaggataaatgcgaagtaacatatatatatattgcatttcacgttcacattcgttcgctcgttctcattcacgttcattctcgttcacgttcgttgtcgttctcgttcacgttaattcgttcgatcgttctcgttctcgctctcgttcgttcgatcgttctcgttctcgttcacgttctcgacgtacgttgacgtgttcgttctcgttcacgtgttcgttaacggcggtgtggcggcattgggccggcgcttggcgcggcggcgtggcggcggcgtggcgacggcggcggcggcgtggcgttgcatgcggcggcggcgttgcgcggcggcgaaggcggcggcatggcgtggcggcggcggcgttgcgcgagcggcggcgaaggcggcggcgtggcgtgccggcggcagcgtggcgcggcgtcggcgtggcgcggcgtcgtcgtggcgcggcgtctcgtggcgggcggcgcgacggagagagagatcgagattggagatcgatgaagggagaggcggcggcggctctcaccccagagatgcggcggcggcggaggaggcggaggcggcggcgaggacgacgagctcgagacgacggcgagatacggcggcgtcggcgcggggatttgccgtaggcagtggcggcgaaggagagaggccgagagagatcgatcggccgaaaacgttaagtgttggtggagaagatgagggcgcgcatcgggaatatatatagccctcgatctttagtcccggttgatgagaacaaccgggagtaaagagtaaagatatatttactcccggttgttgagaacaaccgggactaaagaaaatatctttaatcccggttgttctcaacaaccgggactaaagatatctttagtcccggttgttctcatcaaccaggagtaaagatcttttcccgctatttccaaattatttttaaacccggttagggttaagaaccgggactaaagattatagcactgcatatattttcgcttacatatgtgtttctaaaatagaagttaatgcattaacattatttaaagtacaaagattaatgacaattacttcgaaaaattatttttgtctgtaataaattaagtggataaatcgtaataagcaaatatatgacttaaaattaataaaaattccaataatcatatatacttagcatatgaatgatattattaaat

SEQ ID NO: 63133 - DNA, 8221 bp, Oryza sativa
aagagattggccaaagggaaaagtgttgtaaccgcatcggttaacatggtttttacgttgcctgctgagtttggggtcaagcaatccgatgtcgatgaggttgaagaggaatcggctaagttgtttttgtcgccagaacaagcagtcttcaagaagccggaagggacagagaatcggcatcttaaaccactatatataaatggttatgtcaatgggaagccgatgtccaaaatgatgatcgatggtggggctgcagtgaatttgatgccgtatgctacatttaggaaattgggcagaaatactgaagatctcatcaagacgaacatggtgctcaaggacttcagtggcaatccattagagactaaaggagttttgaatgtggagctgacagtcggcaacaaaaccatccctacatcattctttgtcatcgatgggaagggttcttacagcttgttgcttgaaagggattggattcatgccaattgttgtattccttcaactatgcatcaatgcttaatttagtggcaaggcgacaagattgaaattgtgccagctgacaggtcagtaaatgttgccagtgccaatttggctctttgggagatggatggtcttgattgtttgtccgggaaaatttgggatggagattttctaaaagtgtccgattctgatacacacccagttaaagatggagaacccaagctattattttgagggcgtcgtggagggttcaaacgtctacaccaaggacacagtagatgatctcgatgataagcaaggacagggttttatgtcggctgatgatttggaagaaattgacataggtccaggtgatcgaccaaggccgacgtttattagtaagaatttatctgcagaatttagaaccaagttgatagaactattgaaagaattcagagattgcttcgcttgggagtattatgagatgccaggacttagccgatcgattgttgaacatcggctacctatcaaaccaggggttaggccacaccaacagcctccgaggagatgcaaagccgatatgcttgagcctgtcaaggctgagattaaatgattgtatgatgctagttttatttgtcctcgccgatatgctaagtgggtttctagtatagttcctgtgatcaaaaagaacggtaaggtcagggtgtgcattgatttccgaaacttgaataaagctaccctaaaagatgagtatccaatgccagtagccgatcagctggttgatgctgcctcaggacacaggattttgagttttatggacggtaatgcaggatacaatcaaatctttatggccgaagaagatatccacaagacgacttttaggtgtcctggtgcaatcggcttgtttgagtgggttgtaatgactttcggcttaaagagtgctggagctacgtatcaaagagctatgaattatatatatcacgatttgatcggctggttggttgaagtctatattgatgatgtggttgttatgtctaaagaaatagaagaccacatagccgatttgagaaaggtttttgagagaaccaggaaatatggcctaaagatgaacccgacaaagtgtgctttcggtgtatcggctggccagtttttaggatttcttgttcatgagagggggatcgaggtgactcaaaggagtgttaatgcgatcaagaagattcagcctccggagaacaagacagaattacaagaaatgatcggcaagataaattttgttagaagttttatttctaatttatctggcaggttagagccttttacaccattgttaagattgaaagccgatcaacagtttacttggggggcagagcaacagaaggctttggatagtattaaagaatatcttagctctcctccagttttgattcctccacagaaaggaataccttttagattatatctgtcggccagtgagaagccaatcgactcagtcttgattcaggagcttgaaggaaaagaaagagttgtattctatttaagtcgtcggctcttggatgcagaaactagatattctcctgtggagaagttgtgcttgtgcttatatttttcatgtacaaggttgaggcattatctattgtccaatgagtgcactgtcatatgcaaggccgatgtggtcaagtacatgttatcggctccaattttgaaaggaagggttggaaagtggatattttccttaactgaatttgatcttcggtatgagtcgccgaatgcagtcaaagggcaagctatagccatggactttattctttgatgggtcagtgtgcactcatggttgtggcatcggcttggttataatttcccctcggggggcatgttttgagtttgcttatactattaaaccttatgcaaccaacaatcaagctgaatatgaggtagttcttaaaggattgcagttactcaaagaagttgaagccgatgctattgaaattatgggggactctttgctagtaatcagtcaattggcaagggaatatgagtgcaagaatgatactttaatggtttataatgagaagtgccaagaactaatgatggaatttcggctagttactttgaatcatgtatcttgagaacaaaacactgaagccaatgatttggcccaaggggcatcggggtataagccgatgatcaaggatgttgaggttgaggttgcctcgataacagccgatgattggagatatgatgtgcatcaatatctgcagaatccatctcaatcggcttctcggaaattaagatatcaagcgttgaagtatactttgttggatgatgaactctattatcggacgattgatggggtattgcttaagtgtttgagtgccgatcaggctaaggttgcaatcggcgaagttcatgaagggatttgtggtactcatcaatcggctcatatggtgaagtggttgcttcggcgtggagggtatttttggccgacaatgctggaagattgtttcaggtattacaaaggatgtcaagattgtaagaaatttggagcaattcagcgagcaccggcgtcggctatgaatcctatcattaaaccatggccgtttagaggttggggaatcgatatgatcggtatgattaatccaccatcgagtaagggacataagtttatcttggtggcgaccgattatttcaccaagtgcgtagaggcgattcctttgaagaaagttgattctggggatgctatacagtttgttcaatagcatataatctatcgatttggtatccctaaaaccattataaccgatcaaggttcaattttagtgtccgatgagtttgttcagtttgccgatagcatgggaatcaaattgttgaattcttcaccgtattatgcacaagctaatgggcaggccgaggcatctaacaagagcttgatcaaattgattaagagaaagatttctgattatcctcggcaatggcatactcggttagctgaagcattgtggtcttatcggatggcttgtcatggatcgattcaagtccctccttataagctagtctatggtcatgaggctgttttgccatgggaagttagaatcggctcgaggagaacggagttgcaaaataatttaacagccgatgagtattataaccttatggccgatgagagggaagatctggttcaatcacgattgcgagcccttgcaaaggttaccaaggataaggagcgagttgctcggcattataacaagaaagtagtgtccaaagatttttcggaaggtgaacttgtatggaagttgattttgccaattgggactcgggatagcaaatttggcaagtggtcgccaaattgggaaggaccgttccaaattcataaggtggtatctaagggagcttacatgttgcaaggacttgatgaagaagtttatggcagagcgctaaatggcaaatacttgaagaaatattacccaagtgtttgggttaacgcatgatcggctgatgttgccgatgcatgatagccgatgtgtttacatcaccttgagatggctgatatggttatatcgcccttagttgttttcatattgtaatcggttgtgctttgccgatgtgcaatggcctatatggttatatcgcccttagttgctttcatattgtaatcagttgtggtttgccagtgtgcaatggccaatataaatatatcgcccttagtcgtttttataattttatcaatgtttttgacattgtaaaattagggggcacatacatggaaaattgcaaatttttgagcgtatttggaagttatgttaatcggcatgaaggatggtcaagacagtaaagtactagagtatcttagccgattacaaaaaattcttaaggtctattatacagaatgtcactgagacaaatatcgctgaatagccgatatagctctctgcctaatttgttctacttcttctatggcttgggcatcttgagcatcggttccagggatgactttcaaggacttggtcatatcagcgacattcttaatagccgatttcagccttgccttctgttcttcgacagcttgcgggagatcggctagcttcttgtgctccatatccagctcgacgttgcattcttgaaggtgtgccatgagatcaatcttacgagcttcaagccgatcgatattggacttgatcgggccctcagacagctgatcaagcttggacttctcttcatgcacaagctgtcgattgtgctagattgtagcttcaatatctttgcgctcccggcgatcgactaatctctgcctggccttctccagcttgaattggtgttgctcaaggtagacggctggagtaagggcatcggctagttcatctgggagtagagcttggatatctgtgaaccttgctcggatcgagccacagttggtcaccaagttgtctagtgatgcttctagccgatgagagatatccttaagcgttctcttcacatcatcggacagaggagctatggctttactagtggtgtcttcctctgtttcatcgagacaatccttgatgtcgaaggaaaacagatcggcgaagacctgcaagagataatattatggatggttaaggatcaaaacatgactagccgatctcaaatttgtgtcaacaaaaacttactggaatagtaggagcagctggttgttcttcctcttcgacattgtgactgtctgcagccgatggggtacggttgcttgattctagttgcataggaggtgaaggaggaggaggaggctgtaaaagagaaaaatgttaggcgtaatcggctgagatcaattaatgacataattgagaatgtcttactggtggggccggtttgagagttggtgctgccgatttcttcttcacagcagttttcttcttctgcaactataagatcagtgagcaatcggctataagtgaagtgattgcaaaaggagctgaggagagctgcttactcttggaaaatgagccggagcagaaggagttggaggagtttgcttgggcgaagccgatggtgttctttctgtatcgcttacttcgtctgcggcttggtcaacatcatctcgatgtcttcttcgatagatggatctagggcgggtagatcatcacttggcttggttttctttgatttggttttcttcttgggagccggagctgatgtttccacagccgacgatctggttttcttttcttgccagcatcggctggttctctaatgagcctttgaagaagagttgaagtcttgagggcattatagccgatgacaggaggagatggtccacctccatttggaattaagcctggggcatatttgatatctctgccactattgctttgatgtggaggggaagattctgttgtctacaaaatagaagagaaggttagtcaagttatgaatcgactgataattgttcaaacagaattaatgagatcaaggtttacctgaggtataacatcggggaacagatctgtcatgtacatagaagctggttgatggaagatatgttgttttcattcaccccaccatctgtcaaagttcttgctcctgaaccttgccagctctatgttctcaatactgcccaagggaggtcttgggatgttgagtagccgctccatcatcagagttgatgagatttctcctcggcactggatcttgttggcaaagaataagccgattgggagttggcccattccaagttgtctagctaaactcattgggtggtagaattcataggagacttggatgtttctcccttggtggatgccgacgggtaagatgcatgggctgattgcagttgagaaaacttccctggacttttggtatctttcatggttaatgtcttcaaatctgaagtccgatggattttccagaagtgatgaatcttcatagaagaaccaaacatgggcatctttctggaagccttcataaaagctgcagaaccagtccttgagcagctcagccgataactttgctcctgcatcggctggtgtggatgcatattccccataggacatacacctgcggtgggtgcgctcttctccatcatcatctgtaatcggctctaatcttggaaattcagcttccgtcacggatggccgattgacagctttcatgactactagatttagccaagtttgcaacaaccaccatggcccgcctgcactgacaattgagctgacagcaatcttggctgacgcgttgttcagtgtttgatacaagtagccgaggaggatcttgcctaagggaaattgcttttttgtttctagggcttcggctacaaactgccagttggttgtagggccgcaacttgatccacagaagagaaatttctccagccacatcagaagaaaggctacatgctctcgaggagtgacaggccctttacccatatatgctgctacatagccagaccaaccccctatgcttttggtcctgaagtcaaattagttcttggtgttcatactcatagggttagccgatgaagttacatctaatccggtgatcttggtgatgtcgatcaaagttggagtcatcggcccttggttgaacaggaaggcattgatagtgttggaccagaaataggtggcggcagccattagaggttcagtttttggctgagttggctatggtaagatcaagtgcttggccgattccgatttcgtcccagtgaacctttttgctagccgacatgcgcttgaaccatgtaatccagctcttctcgggtgaggttttctcaagagatggccaagatttgaaggtgttcttccaatgacctagatctgggttggctaatctgaaaggaaccctatttgtttcactgataatgaattcggtaggatcgggattatcaactgggccaagaacatagtggttctcatgcgacatacttggaatcgcaaccagattggacagatgctacagatgcaaatggggatagagaagaagaaaacaagatgaggcaagagaaaatcaatctgctgcgaaagaaagagatctagccgatgggtacttacctctgcgtattcggccgatggcgcggcggatggattggcggaggatgacatcgccgcgggcggagatctaaccggagacgaaatcgcctagggatcgccttgtgcgtcggagaaatcgccggagagagagaggacaaagttaacttcggcggtgaaaatggaagaaaacggtgtgagtttctcgggtgcaaaggttagtatttaaagcactggaataacggtcgggaaacggcagagtgcgaatcttgctcggagttgatgtatggcaaattcgaaacattaccaaatattccggacttggggggcatgtgttaatgaccaaatttggtaatatcagcatcggaaaggaagattagatcgaagcggaatcaaagataaggattatcgcgggaacagagtaagaatcggctggagtccggatcggctacgatcggatcggctaaattcgagtcagacttgttttggtgatgcagctgattccgacaatacgacttggtgtacaacatcgggttgagttgatatgcttcaaggtgattgccacgcatggatagagtcctgggaaggcaattgtatctattaattaggatattttatgtaatttacttagagatatgtttgggcaaaagtctgccgtaaagacttatggtatcttagagtttgttagagataagagtcgtgtccgatatgggcatagtttgtaatttgcgggtataaattgaccccgaaccctatgtaatcaatga

SEQ ID NO: 63134 - DNA, 11471 bp, Oryza sativa
tttgaagatcaaaactttcctctagtatttaagaagaggggtcattttgaccaaggaatatttggtgaaaagaaaatggaagggtagcactaagtattgcttttgtagttctaataaatgaatacatctattttttagtgccaaattgtgagaaatatgtggaatgccgtatattatttttggaattcaacagccagctagtgttttgctaatattcttgctaataggctaaattcaacctaggctaaaacatattttttttcgtaggcattgcagctatatgttgggccatatggcaccaaaactatctactttttagatggtttcattggaactcattgggcgcgcttggtcctcatttttaagaggaagacagtaccttgatgaaagacgggttcaaaattttggaagctattgtgttggatttctttataaattgcaaaaccagaagttgccattaccagtttatttgacctcctcaagcggttttgacaatggttttattagacctgatggctacgtagcgttactattgaaaatatattttaaaaaaaacaatgtgacccataatttggctgccatgtagatctaatactcgcaagcaactggtacatgggctttacccgcaaaaaaatcattgaggtttcatctctgggcaattagcacggctgcagcggtatcctgtcctatggcgaagatcaccattcactagtgaactagcaaatgagttgttcccttgtttaatgtgaagatgaaaattctgccccgaaagatgtgtagtgaaactgtaaaaataaatttcttttgcacttcaattgttccactgtaagatgcggtcaaatttgacattgttttcaaaactaacatgtgacttaacatctcatatatgataatatttgtagcgacgaaatcataaagattggaaaaaaattgaagtgtcaaacccaatcatattttgttcgttgaataaaaattaatttatattagactaattaatggtcaaatatatcgagcgttgaacattaaaatacatgtttgtcttaatctatgggatggatggagtataaacttgtagatacaagcataaaattaaaaccattatatcataccaatgaaatgtatatcttatagaacatccctgactccctgtacaatgtgggagtaaaatttttactcactgtgttcgagtaaaacattatatatcacgtgctgcatgtgattcagaacgtccatgtataaaacacactaacattaataaggcatgcttcttgaaaagtacagcaagaacattttactccgggaaagtgtaccaactatttggcttgctaatttcaaatgaattgaactaaaatccggtgaaaatccaatgaatttctgttccaagtggaacacacaatcaaccaacgaccacgaaatcactggagaagaccatgctctgtccctacctttgtctatggcttcaatcagaaccggtaagctagtggctctaaccgatccctcagtgcataacatagtacaatcggcgctgaaggctcgttccaggaaggagcagaggtcacttacgagtgttttgatgctggcctgaacatttcacctggtccgtggctgtagcaatccacccagcaatgttgcaaaacttacacccatattcaactcgacagcactgagatcattcaattcccaaagcctcccattctcacgaaaggagaataataaccaagagaggctgggtaatatttaaaaaatacattgcagtagagcaagtaacaaatgtgggtgtgcttcacttcggctttatgctaacaatgtgttgtttggtgttgacttcctatcttccactccttgagccaatacagttcccattttcttcatttattgtaaaaaggacctgcaccctctggttccttgatctcctatatatcaaaagttcatatactgagaaacaaagatatgcatatgctattgccgatgtttagataaggctatgagctcttacatggtagtagctacaacataattaagccacaaattgcaatagtacagcctagatagttgtacttttgtgcttgtttctgccttcatgtgtgtatcagcctagtaggctgaatattagaccttttttttttcaaaactacgtgcaaacaaagacgctcatataaacatatgcccactcactcctttgaacatacacatatacatcttatccttatgagttcatccgaaaactagactgttatattttgaaattgataaagtcaccgcggatgtcttactatcgaggggtactatgtcatctactaccgtagcaaattattaggataggactagtgcatatatagaaagggtaggattggctccagtaatttctaaatatacaggccaaatagaggttaaagtactaaatattttacacgagacattttgccgcacactcaccttcttgtcgtcttattttgaagtggacatagtgatttgttttcagtagtttgtattcggaagaagaaaatacacaatgccacatgaagttaacactaatagaaagggcagtaatgtttaatggagaggaggaatcgaagtcgggcagctctcctttgtgcaaagcttgccgcactacagtatgggagtggggaagtatctccaccgaagctgaatggaagttaggcccgtttagcaaggctctacgttatatctctcgtggagctagagataaactagatcaaccgattttagctcattcgaaaaaagaagcggagtatgctagagtgatatttaaaaaataaactagaggggtcgagtgagattcgagtcgtttcatagctccacatcaaattctacttttggatttagatttaagagttgaagcctgccaaacgggccccaagaatggcaatagctctgacctgtatgttgcaagctcatgatgggctgaatgcctgaatgagatggtgtgccgcgttcctcgtaactactacctcgctcatctcaactacttcaagggaaaaattttcgcctttaacatggtcgcccttagtgtactggcctccgtctaatataaggaccatcaccatttcggtgcgacttgtgaaccagtgagtcgctccgttgtttaatgtggagatggaaccttttttaaccaaaaaatgtgcagcgaaacaacaattttcctactttcttcacccgtaaaaagtaaaacttgtagcccaggtacaactgtgtaaattactgtacatttaacgcatacttcttgagaaagtacaccaccagcatttcgatcactccgtgcaagtgtacaaattgtacaaactatattagcagcctaagaattttcacgagcaagcatgcatgcatatacgttgatcaatcctgtgtccaaccaatcacacactgcaaggagacgcacggcgatctctcaacgactccctgatgtgtgagatgaatccgtgtgattctcacaagccctctcgtggagaagctcctgcagatgcgcgttcctggccatctcctcctccacctccgtgctcagctcctgcaccctcttctccagctccctcacgtacccaaccagcatctcctccctccccgccgtctcgccgccgcctccgccatcgccttctagcacctgcatcaccatgtccctctgcatctccaagctccccaagatggtcaccaggtggggaaccgccacgtcgcttgagccatcgttgccatcctgcctccgccgctgttcttgctcgtgctcgaccatgtcgtcgtcgttgtcgtggtggaaggggaagcatggctgctgctgctgctgctccggtggcttgtcggtggggtcgagctcgaagctctcctcgttgaagttccagccgctgatgcgtcggttcttggcggcgacgacgttgctgccgctgctggcgtggcggcacggggagacgcagcgcgcgccgcgggcgcagccgcagagctgggtggagtccctgcacctctcctcgacggtggggacggcgtcgagcacgttgcggacgaggtagtcgtagtccctggagcggcaccccttgaagaacgggtggcggaggagcttctccgccgacggccgcttcgccggctcctggcacaggcacgacgacaccatgtccttgaacgccttggagaacttcttcttcttcctcgccgccgacgacgagccctcggaggaggaggaggaggcgtcgacctcgaggcggacgcggctggtgatccgcatcagcatcgacttggacggcggcaggtgggagagcggcggccggccgtgcgcgagctccagcgccgtgatgccgaacgaccagatgtcggccttgatgccgtacccgacgtgggagtggatcacctccggcgccatccagtacggcgtcccggccatgtcgttgaagcacgacgagctcagcgccgcccccgacggcggcggcgcgtggtttatcgggccggagaacgcggacgacgtcgatggcgcggtctcgtagatggacgcggacacgccgaagtcggcgagcttgaccgacccgtcggagtcgacgaggatgttgccggccttgatgtcgcggtggatgcggccctgctcgtgcaggtagcacagcgcgcggagcgtgtccctgagcacgacggcgatgcactgctccggcaggccgtcggggaagccgtgggagaggatggagtggagcgagccggcggccatgaacggcatgaccacccagaggtggctaccgacggtgaaggagcagtgcgcgcggagcacgttgcggtgcgacagcagcgccatggccttcgcctcgcgccacacctcgtccaggttggcgcgcgaccgctccaggtcgatcgccttgatggccaccaccgccgaccccagcggcacgcacgccgccttgtacaccaccgcgctcacgccgctcccgatcttgcacagcagccggtacgacccggcgtcgagcgggtacctcgcctgctgatggtgatggtggtcgtcgcctccaactgatccggccgcggccgccatggctggcggcagcggcggccggagcaaggacagaagttgtagcatcagtcggtctcgcatagcggcggtgtcacgtacgagagagacgatgactaattaatatacggcgcgaacgtgtaacgagcggcggctcgtgatcgtcgttagctgctaatcatctcaggcgagagctgaggtggttgttcggtttaattagcaccgtgcgtgcatgtgaagaggtggtaaaaaggcaaggcgcgtagcgattcgggtggcggtgtcacgaagagctgggggaatctcgtgaagctttggatagttagttggtgttaattatggtgtgtgattgtgaatgcgacgaacgggccaggcaccactgtacactacaccagcgtccagtgaccgatgatgatgtctgtccatttgtggataattgttttactttctccccgtcctaaatacatgatctgttccaaaacttacgaagtggtgccatgaagtggtgtcatttatatccgtgaatctaaaaattatatatttagatccgtgaatttggtttagtgtactatatatccccaattaatccaattgtctttcgaccgcggctgactgtcaccgtggcaccacacgcaagtaacatctttgtgcttagcccgttctgcatatactttctcgcataacttaacctgaccaataacctgaatccttcaaaatatcccaatcaactagggtttcgacagcgatgttagcaacggaaccgggcaggcggcgaggtagcggctgtggcagccaagtgcacgcagtgaggttagcggcgagaggcagcgcagtgcgatggcgcagtgcagcccggttaaaggcagtaggcggcgcagtgtggttttgcatgctcggcatcccatgtattctccaatacagtcgctggaagaagctatcgttgatcaagtgctcgtcgtgtaaagagaagaccatcgtggatcgcacaatgatgacgatggagatagtttcactatgatagaaggtgttagtccttgcggttgctggcataaaaggtactccttgtttttcatgtcttaaatactctagtcataaaaaaaaattagaaaaatcataagattaacttaatgcgcgagatatcttaattcgcaagaaatcaatatttaacttttagaattgtagaaaaaagaacaaattaaagtccatagttatgtttgttatttttgttacaagttatagaagttaaatttggatttacatgcttgtaatgtgacatatcacatactacctccttttcaaaatgtacgatatcgttgacttttcacgtaacatttgaccattcatcttatttaaaaatttaatataaatatgtaaaagtataagttaatattatatttgtatttgatgataaaacaagttacaacaaaataaataatatttatttttttaatgcgatgaatgatcaaaagtcaatgtcgtcgtacatttttaaataaagggagtattaatctatcataataatttgtttttaattttttaataactatttaaatgatatgtaaaaaagaaagggatattaatgcgaggggaaaaggatacttcacaaaaaaaaattatttgttttgtgggatacataaaaggacattattttagatacctgataaataaagaatacgaagagaagctttctccaatgacagatgtggtacataaaaaaagcaaaacgcacgtcagtttttcatagggatacactaccacactttgaagcaagcctaaggatgcgtatattttctgtcagtcccgcaaaggactcacagaaaattatattctgtcggtgcacccacagggatatattttctgacggtaaaaccaatttttccgtggatttcgctcctacatagtaggtcgagtctggtagtggaacttgtgtcgtgtgtatgatttgaaaccaagatgacttatcgtagcaaatattggtgcgttcgacaactttcacagcattttgcagcagcacgcataattaagataaacctttaatcgagtaagtaattattaaaaaattaaaaatgatattatttgatttttttttaaaaaaaacgttcatatattaaaattattgtacaaaatataccatttaacagtttgaaaacatattaagggaaaacgagaaagtagacatttaaagttgatgaaaaaaacttagctccagttttacactgattaaagtgccacgtaggcatgcacaggtaggcgtcacgttggcaacataatactcaccgtgccaagattgtgaggagcggaggaggaggatgcagcggttgggcagcacgacggcgagcgttgccgcggcctcccgccggccaccggcgtcgagggagtggagagaatggacgtcgagcggcggcggcatgaagggagccgtgccgtcgcgcgtccctcctcctcgccgcagctcatccaatgccgccgtcgcagcgtcgtccctgacgtggatcgatcggctccccaggcggaggcgtccggcaatcctggatctgacatttggtgggtggcgcccggcaacagaattattcccggccgttgctggcgtccgggtggccagccagacctcagttccagagcccgacgactgatgggctgattacttgaggtggtgttcggacgaaaacgctaatccgcgaccggtcgcgcatcgcgcgcggagaggagcggcggacggcgcgtgtacggtattcccttttttttgttttttttttcttccggcgcgtgtacggtttcttttttttttcgttttttctgttttcttccgtatttttggtttctttttcctttgttttcgtttttttgttttcttccctatttttggtttctttttcttttttttcttttttatcgttttcagttttttcggtttttataaagtttgtatacgtgtatataaagtttgtatacgtgtacataaagtttgtatacgtgtatttttttattttttttatttacgtatacaaagtttgtatacacatatataaagtttatatacatgtatacaaagtttatatacagtacataaagtttgtatacgtgtatacgaatatacgtgatgttttttttagttttttatattttttaatatgtacgtatacaaagtttgtacacgttgtatataaagtctgtatacatcatatataaagtttagacactactttagactagtcgcgcattagccccccccccggtgtttggatccagagacttaactttagaccctgtatttagacattaatttagagtattaaatatagactacttacaaaactaattatataaatgaaagctaattcgcgagacaaattttttaagcctaattaatccataattagagaatgtttatcgtagcatcacataggctaatcatggattaattatgcttaatagattcgtctcgcgaattaatccaagattatagatgggttttattaatagtctacgtttaatatttataattagtgttcaaacatccgatgtgatagggacttaaaagttttagtcccatcaaaatagggtcttatctccaatttttttttagagagagagagagaggatttagtgaatcttttcattgaaattcagcggagtaaacagtggagtcagcaagggccgtatcttttcagcagtttcacttgcaggcggtcctacagtggagatgcaattggtggaccaactgtgggtgatcagaaggaggtgctggaagtctttagtaattcctgtttagcgtccaaactttgcctctttgtcatttggcgtgatttagagcttaacctcagttatctattgcaatcttctctttttttaaaaaaaagggcttatctaatgtaatcaattcaaactctttaaaggccatgctggtctagaagaagcacactactacataaataatctttccaaacggctaaaatgccgcctacacccagatgtctatagggataaggatttctccgtacgagcattataactgatcacgaaaatggaattttcaaaggcgggcatattatgcggcccgactaaaaaagatttttaaacaaaataaataatcataaactctaggtcccaaaggcgtcttccacgcgtcgcgtctagatccaccattgtcatcgctcgaggccgccactgccaccatcgtcgcgcccgaagccaccggtgtcattgtcgctccaaagatctccagtggcggagctgtcttcccgaggccgagagcggtggataggcctctcctgacactggcattgaccgctcccgagccattgggtccgctgtcatccctaccgaactcccacagccgctgccatccccgtgtgctcctcccaaactccccttcgttgtcgccctccccacgactggatgtacccctttcgaggccatggcggtggatctgtccttctagtggctgccgtcaccgctgctttcaccacctccggagcacctaacactgctgcggccttcaccacctcccagagcgcttgacgccgccaccgccttcgcctcctccaccacccaatgcgctgaccgctgcctccgcccgaagcaccactgcctgaaccatgaagtggaggaaggtggagtcgggggaggagaggagacgacgaggacttataatatttaagagagaggggattggcaggcagcttagtggcagacagggcctgttaagaggcccgcttgaaaaaaaattgatttttgcatacgggtttgctgccaccaaattcaggtgtttttgacttgatcagttggttggtgggcgggattgaggccatgctatcttcatttcctgacaaaaaagattatgtcaactgatgtaaacaggaaagaatggtactgtagatcagaaaaggatcatctcacactttggctgatcatcttttctagaaaaccatgtatagctatatgcagagctatgaaacaaaaataagttgtactttgcaagctaaggtatgaaataaaatgctccctatttaggccaacatgtcattgaactatactgataaaatgatctccgcaatgctatttagtatccaaaacaaagtttagctatatccatttgagtttttatctccacaagattcatccaccaacgtctagatatcatgcacgtgcacttgaatcttgcatcatgcattatttacagaggtaagtcaaattaatagctgcatcgataaatttttagcatttatgtcaattgagagtgaaagtgaaacaatacctcggagaggtactgtccccgtgtgcgagcttcatttccaaatcattctctcaagcagcttttctgcgggcagcataattttagtaagaaattaagctgagataaattgattgagcataattttgctgaaaacaggaaaacaaaaaaggaaactagctattcttgctgatttgttttcctctctcccactatagcacctgttattcaagtattatatgcctgtgaagaaaattgttactttcaagtgcatgagtatatggctatcctctaaacggaagtgatttaaaaggtacactacagcaatatataaggcatggcaactgggcagtaactggattttgactctttctttaagtaaaactagcacggtggcccgcgcagattgcgcggctagcatcattatattttctctcatataatagcatatatgttttcttattatattattaaaatatattacaatgataacataattttaaattttgcaataacttttcaaaactactaatgtgtaataactactctagtctcctcttctaatattccttatttttttaattctgaatttcagctatttctaaattgtatttctatatgtactttgctttttcttgttctctgattaatgtgagaatttctaggccatgagagcgaacgtggaggctcctttttattccgaattttagttggttttaaattccaatatgaactatatactctacttctaatattccttattttttaattccaaatttctattttttttcttaattgtatttctatatggactctatactctacttctaatatttcttatttttaattccgaatttcggttatttcctaattgtatttctatatggattctatactctatttataatatttcttatttttaattccgaactttagttatttcctaattgtatttctatatggactctagtctcctcttttaatattccttatttttaattccgaatttcaattatttctaaattgtatttctatatggactctagtctcctcttctaatattccttattttttaattctgaatttcagctatttctaaattatatttctataaggactctagtctcctcttttaatattccttattttttaattccgaatttcagctatttgtaaattgtatttctatatggactctgctttttctttttctccgactaatgtgagaatttctaggtcatgagagcg

SEQ ID NO: 63135 - DNA, 32823 bp, Oryza sativa
  unsure (1)..(32823): unsure at all n locations
tttcgcagtcctccctggcgtcctgcaacatctgaccaagatcatccgcaacgtcgttaccatcagcagctatttcctcctcgtccgtttgattttcttcaaatccaacatactgagcaaagtccagaatattgtcgtcttccacttcatcttcttccatttcaataccttgctctccgtgggatgtccaacaattatagcttggcatgaaccccgactcaaacaagtggaaatgaatagtcctagatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaaaccgtacacaaataattattcttacaataatgacagtcatacaataattataagatatctttattcatacaaaaatcataaaatattacaccaaataaattcttaaaaactatttgtaaaactttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagaaaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctagaggaggaagaagacatataaataggggtggaactttagtcctagttggtagcaccaaccggggctaaagatcaccaggatctttagccccggttggtaataccaacagggactaaagttacgatctttagtcccggttggtaataccaaccgggactaaagatcccggggagcctgacatgccctgacagcattcgaaccgggactaaagatcttagtcccggttggtgatcaaatatgcccgttacccttttgaaccgggactaaagatcatctttagccccggtttttattgcatccgggactattgtggaaatcggccaaccgacgaaagatggtttctccaccagtgatggatagcgtctaacgcagcatggcgcccgagatttaggttgggtagattagtaatgccaccgttacctaatagggaagcataatcatcaccgatggtcaaacgtgtcacaggttcagggattagatcagcatacttttcaaatgcatgccaattcccactcctgtttgcaaatgcgataacattaaggttatcagctcgtattgccagcatcgtgatgtcatcccctcttccagttagatttgtcatcttcatcgatgccggtggatggtacaacctctgtcggtcaagaatatatgtataatcaacatgtagtccacttgaggtgcgaatggtagatgcaagaagtgtttgaaggatggagcagtaagagcccctaaagaagtcatgctgcaaaatttcgaagggaggccaccaaatactgaaaacgagaaaggagaattatatgagctcataggacagacaagagacacaagaactaaattagtacatcgaatgcaaccacaagaaatgcctttatgcatacctctgaaagagttcatttggctgcaatgacgatctcacgggagaaacaaggcacgtgataaccaccaccttaatcataacaaccatgttgatatgtgccattgatgctcgttgagaagcgttgagaagagagaggattgtgctagcttgtggctatgcaaggttggactgaggaacagagaagattcaatttgtggggagaatgcaccggcatacaaggaaaacagtttacctttaagtagtcaagcaatcattgttgttgggctgccgttgtatagtgtcatttgcatgatctcgtttaagaataggcaaggcatgatattacatgcatacaatgtgggacaacattagttcgctggcaaaaaattttacaacatgtcatatcaaacgtttggatacatatatggagtattaaacatagaaaaaaaataactaattacatagtttgcgtataaattgcgagataaattttttaagcctaattagtccatagtttgacaatgtggtgctatagtaaccatttgctaatgatgaattaattaggcttaataaattcgtctcacggtttacaggcggaatctgtaatttgttttgttactacctccgtcctagaatacttgtcgctttgagtttttttcataacttttgatctttcgtcttattcaaaaaattatggaattactctctccgtcccaaaataagtgcagttttacactattcatctccaaagtttgatcgttcgttttatttgaaaaatttttagattactatttttattgttattacatgataaaacatgaatagtattttatgtgtgactaattttttaaaaaaatttcataaatttttcaaataagacggacggtcaaacgttggacacggattttcatggctgcacttattttgggacggaggtagtattatttatttttttctgtgatttgctttattatcaaaagtattttaagtatgacttctccgtttttatatttgcactaattttttaaataaaacgaatagtcaaacgttgcaagaaaaaaatcaaaacgactactaatatgagacggaggtagtattaatctacatttaatacttcaaatgtgtgtccatatatccgatgtgacacgctaaaactttacacccttggatctaaacaccccctaaccttatttgataacgtgggaatcgaagcatgacaagacattaggtttctgctgaaattaatgctaggacagcaatgtacagatgatggaacaatggacattgcactagctttgctaattgctacccttaggccctgtttagagcctgtttaggcctgctcgaaaaaattttcaccctgtcacatcgaatgtttggccacatgtatagaatattaaatataaaaaaataactaattacacagattacgtgtaaattgcgagacgaatctttcaagcctaattatgctatgatttgacaatatggtgctacagtaaacatttgctaatgacggattaattaggcttaataaatttatctcgcagtttcctgacggaatctgtaatttgttttatattagactacgtttaatactttaaatgtgtgtccgtatatccgatgtgacaaccaaaccaaaaaattttcccaactaaacaaggcctcactataaaaaacactttttcctggtnnnnnnnnnnnnnnnnnnnnnnnnnnnnnnnnnnnnnnnnccagtgaaaatacaactgggggtcctgcaggttagtaacagcttacaaaaattaattttacaagtgatcgtactaacgtagcagcttgtgaaaataacccaaacaggtattaataatagagtaatatatatgtaggaataagtatgtgcaccttttatttttagagcaatttacagacaattattcaatcgaatccctctcaataataactaatggccaagccaaagaaataagtagacccccacaggaaagagtactaagaatatcgcatataaagatgttatttacgggtaatcaaagattggttcgcatgattaaaattaattcaaaaacataatctacaagataataaattgctgatggcatgccctatatctaggtagaatgaggatatcaactcatgggaccaaataatagtcacaaatccggttctggacacctatgtgtttttcaagaaactcgttcgaaccaataaatttatttgtctagctaacgcaagggttcttagttcacactaaaattgaaagtttggttgaaattagaatgatgtgacggaaaagttggaagttttgtgtgtagaaaagttttaatgtgatagaaaagttaaaagtttgaagaattattttagaactaaacacggcgtaactattcaaatggttaggaacttgtcaggttgtcttctatatctcttcgtgcgtgcttggagaaatgaaccactatattttgctagcttttaaggtcagtcccgactagcattgatcatttataatattatattatattatattatattgtaaataaatgcatgtgtaggatggtgacaagctaaggcagccattgttgctacatctactaatgtaccaataaaataagtgtgaaagcaatattcctagcggcccacgagattttcttaactgtatcataaatgctaaatgttacggtagttattttcatgcagagtatattctacatatgtatagagtgctttattttttttacttgcttacacccgcaacaaattaataaaatagctctatatttttaacatattttttaaacatataccgccttcatatattgtatactgaagtgattatatacaattaattctggtcaagatttattgtgccaaaacaatatcatattactgtactttgtgtgtattttatatgaaatatatttgatatacaatatgaattgaattagagctcaattgtagatataatagaaaaatattatttttgctaacattaaattttaaaagttattaaaaataaatagaatagcaccatagtgtttagcagcatatttctagtttttatggttgttttgatatggtcttggcaattgttttgtagcggtgattggtgatgaaaataagaatgaggggtactgttttagatgtcttttaatcattggatttgtccctgtagaggttgtcgttctgaatcaacatatggatagaagatttgcttatcattttaatagctcaaatgttcaaatacttgggcaatacgttcctaaaattttatagtggattgcatgttcaaggcaagtatgcatctattaagaaaagttggtgagatttagcaagttgtttataattggttgagaaaagatgatagataaggaattactatggtgtgtttgattggatgaaaatagaatattggtagaaaagttattgtatttttggattaatttaaaaggttaaaggttgtcatattttagaacagatagagtatttaaaattaagtttgaaatatgtataacagtgtgacatgtaggaccgtgcatgcctcgacctgatggatctgtacgcacgtagaagtcatggcacttgcgccatgctgctttgcctgcttgctgtcgagtctcgcacgaaatcgctaaaaacagtctcgcagccctccgcgacgccgcgcccacgccaggtctcggtttgtcgaagaggtcaggtccccggaaaagctagcgcgcgggttggcggcgagcgttttcggatagtttagcctaactaagtgaagttattagtagataataatggtaattaagatatgattatttttcgaaagatttttttttgtactaaccgattgaaaactttcaagtttgatttgaaaatctttgaagtcaaattttaaaaaatttcaaaactcaatttgaaaattttcagctcaaaatttaaatgtgtaagacaaatttagaaaactttcaactcagatttaaaaacttttatctcgagatttaaaaactttaaagtacagatttgaaaatttttaagttaagatttgacaaaatatgaaaactttcgactcagatttaaaaactttcaactcaagatttgaaaacattcgactccgattcgaaaacttttgactcaagattcgaaaaatttcaactcgatatttgaatactttcaaatcagattaaaaaaatttcaagttaagatttaaaaactttgaaaaaaatattttgaaaaatataagtgtgctaaagactaaaaaaaagtaataaaaaaactaaaaaaaagaaaaaaatcgcaaaagaaaccacgaaaaaacaaatcgcgaaaaaaaaaagagcttatgggcttttctgagccagaagcagctggcgcgcggcaactagtaacgccctcgagtctcggcggcatgggcatggcacgcccatcacttattcgcagcgaccattcgctactgatcgccgcgcacgcaccgcgcgagcggacggacgacaggtcgaggctataatggatcggaatatgggaggctctggcatggagcccaacgaaaaagaaagcaaggcccatagcaccgcaccgtaaacttgaccgagagaacctggacgaaacccaaaggaaacccaaatcccggtaaactgatttgagctttctggatgaaataagttcatctgaggtcttttaacttgtcaacgaatccgatttttatccttcaaccaaaaaaatcagatacaacgtatccctcaactgtcaaaaccagtgcaatataggtcccatgacggtttggacggcggttttcgctgacgtgacgcccacgtgactattttgactcggtcttcacatgacgtggcaatgacatggcgcttacgtgacaatttgatttggaaaatattaaaaattgcagatccacatgttagtttacacaaaaaaaatagattaaaaatggtgggttctcaccctcctcttcttcctcctctctacccaactcccctgtattcactctctctcccctctcctctgtcctctccgacggccgaagagagatgcggcgcgcggcagccgggcgaggaggggcggtgccattctgctgggcatcgtgggcggagcggcgggcggctgaacaacccctaccaggacctcaatatcccctacaagcagctctatgacctccccacctccctggagttcctcttccaggagtcgctcgcccagcgctgctcatggggtgagaacctcacctactacaccagcataggctaactctcgggcgccgccgtcgacctccgcgacgccgcccgcaacgccgagcccgggacaccgctaagatccgggtgaaccgcatcctcaactcatgcggcagggccactgcatggggaacacgctcagggtcatcggcctgctctatgccgggagcccgggatcgagagtggcatggtcaccgtgcgcgaccgtgacgactggatcaacagcgtcaccgtggggctcagcactggcgcgctcttccgcgccgccgacgggtcacgctccgccgccatcactagtgccatcggtggggtcctcaccggtgccgccatgtcaggcaagcaggcggcgaagagatatgtgcccgccctctgattcgtctgcacagtattctctctgcccctcctcgcccggccgccgcccctcctcacccggcggagaggacagaggaaaggggagagagagagagtgaatacatgggagatgggtagataggaggaacaagaagagggtgagaatgacatgtgggacccatgtgggtcccatcatttttatcttttttttttgtaaactgacatgtgggtccacaatttttagtattttctaaataaaattgccacgtaagcgccacatcatttccacgtcatgtgaagaccgagtcaacatagccacatgggcgccacgttagcgaaaaccgccgtccaaacagccatggaacctatatttagacagttgagggaccggttgtatctggttttttggttgaaggacgaaaatcggattcgttcacaagttaagggacctcagatgaacttattactttctagattgggcgaggatcccatgtgaattgggccttcggggattgagcgaggatggagaaagtctattttgctccgttaactatggacgcagtaaaatcagatatgtagtcccctcaactattaaaccggatcaatttgtctatcggacggtttttattgtggttttgccgatgggtcccacctaccattaagtgttccattatctttatctttatctttgcatgtagcctagtagttgcaatgacctgagtagcaccctaagctcctgagttcatatctctatagcagcgaatttcagatttggttgtttgaggggctaagttccaaaattaagaaggttgcatacattcggttggatgtagatgttgggtaaaaaaaatccttctctaaaaaatatctttgttctctctccctcggctggacacaatcacgcaaagatgggtggcatcggagcctcgttccgaggctagtggctaacgaagaccatcggagccgagcagtgagggcatcatcaaaggggataagaacatcacgaagtagcccccaactccaaacctacggctggtgttgctttttttttcatctggcaacggctgtactttcctcttctcatcatggcggccatggacattgtacctgtggacggccccaaggtggtgcagattttgagcggcgtggtgtcgagtgtgttgtgcaccaactagaggagtggcgatggtggtgagggtaggcgcggtgtgcaacgacgagatcaggggcaggtgcgtcgcgccaacaggaggagtggcggtagggtcggtgcaggcgtcggtgctgtcgtggtcattggacggggagaggtcaaggttggagctacgatcaggtgatggttgggccgaggtagaggcagagccagtctccgaccccatcactccttccctttcctccactcttccgcaggaggggaatgacctctgctgctcttgccaatgacgaggaaccaaggaggaggatggaggggacgtcggccggcgcacatccaccactacctaggcatcttctctgttggcggcaacctctcctcaatgttgtcgttgcttgtagtaccaccgccctgcacagtgctatcgtccgtgcaatttgggagagtggaagaaggggatggctttcactgacttgtggtcctagtcaaggctatgtggcgccacgtcaaaggaaaccagtgtcaaaatcactcgggaggtagattgactggttttttttttttttgaggggcacgaatcaaactcaacctatagttgatggtggtaaattggacttaatccaaagagatcgatcccatacgaattgggcctttggaattgccacttgagctttcactgcggtatgtgggcccactgacaacaacgttgcttaaggccgttgataactttacaagaatacatcgaaggagagtggagaggaaaacaacgagctcatcagtgaccagagagccagaggtccagagcagaagataaagcgcacagctgacaacacacagatgccaaatccggcagcacgacgaagcttctacccgatcgactgaagtttagcgatagccggtaatccgccctccagattaaaataaaatcctgacgccttctagaaccccttgtcgcaagcaaaagccccatcctaatctttcccatctgcaaataagaaagaccacacatcgtcggtcggtcctactaatcattcacaccccccccccccccaccccccccgagatctctccacagacacgagaacattgagaagcacgcgcgacaggaaaaaagcactgtccgtgcgacgtcacctcgcccacgcaagacgctgtctcgccggtcgatcgtcatgtacccacgccacgcgagtactaccatcgaacagcacaaccatcgatcggcacagctcggttttacggtcgcgcgactccgaaccatccaagggaagacgccgacggcgacaaaaaagaaacccaggataccgccccgcccgcccgtcccgtccgacgtccgcgtcacgcacgcgcgcctgctcttgccgctcgatccattagagaagtttaattttatagccaactattacttttaaattatttatagtcaaatttttttataggatatttatagtcaaattaataatcaatttatacaatagttatctataaatataataaatatatgctacactattaatttctgatcccacctgtcatacacatattgtttcttaaagttcgtgctacagctgactataaatttgtagcacacgactcttctcttttctttttatcttcttaaaatatatttatggctataaatcttcttttcatctccttagagtctgctcttactgatcggttccgtctccacccaccgttgcgttgagtcgttgacccgcagttcccctttgttttccacgtgtttcttccacaaatcgcttggcgccgcgtccgtgcgagcccccagccgccgccgagcccccacacatccatccactctcgcggactctgaccagctgaccgctgcgaaacccgcccgcacgggcgcacgcgcgcgcccgcgcccgctacaaatatgctgctcccccgcacgtacgccgccgtgtctcatcacgagctcgatcgtttcccttcccccccaacctgagcgttccaacttccaattcaagcgcgcgcgcgagagccgatggatcatggcggcggcgagaggaggagcgccggcgcctacgaggcggcgctgagggcggtgcagaggccggcggcgaagccgtggcgcggcggaggaggaggaggaggcgcggggggatcggcgggtgccgcgggggcggcgccgcccaaggtgtaccgcgtggcgcccagggacttccgggagctcgtgcagaggctcaccggagccggcaccgcggcgccggcggtggccatgggcgcgagccaggctgtgcctgcgcccccgccgccttacgcgggtgtcccggcgcacgggcagagcgacgcggcggcggcggcggacatgttcgactacgcgtcgtggttctccgtgccgctgctcagcccggcctccatgccggccgccggctacgacggccagctccaccatggacatggtgctttactgtagttttagtatagtcgctgtccttgtaagatcgagccaaattttgcagttcgatcgcttcttcttcctgtcgtagaacgcttgtattagtttcttcaaaaacaacaaattcaaagaattcgatgaataaacacatgaattagttctcggcggcataaagaacacaattttcagtgtttaatgatgtgactaccctctttggtttgactattgctgacgtgtaaattattccctggttatcttgggttcatcgttagctaggcctaggcggctgtggttaatagaacttaattaagctatcgttgtcaacgttgaaacttttgttatctagatggctcaaatttagcatgtgagaattcggcttatcaaatttcgcatcttcttgtattaagtaatgtacgctcacagacaaaggtaatggcatgcagttgcttcatttcattatgggcgttcaggggatgcttgactaaccggaccaagttgagtactccatcctccgctccaaaaaataatataacgtttatcttatttaaaaaatcaacataaatatgtaaaaatataagttaaaattattttttatgatttaaacgtcacagcataaataaataatatttatatttttaacaatatgaatagtcaaacgtcgtgaaaaaaaagttaaacagtgtcgtatattttaagacggaggtacgagatagtagttgagtagggatatatttcacctgattttactttcgatggacaacataaaggataaattgtcatcaacaatatcttatcgttaaggtgatcgttgtctactacctccgtcctataatataagggattttgggtgggtgaatgtgtgtccagattcattgtactataatatgctatatccatccaaaatctcttatattataggacgaagggagtacttatctagattagagtgacatatccacccaaaatcccttatattatgggacgaatgaagtacttatctagattagagtgaaaattcgccgacacgttcaattcatcgcttgaacgggctgcggttgatggcacgaggaagtgatcacatagactcagttatatttgaattttataattaacctataggttaatttatccctccccctaaaaaagaaactctagctagagtttctttttctgttgatttatccctccccctaaaaaataatttttggattgctaatagtagaaatataaaggtttaccttaattaaaaattatttgtttgttttttttggttaataggttataaatcagccggtgagactcgaattcttacgaaagatctcagggaaccatgtcccctgaataataatgccacggtaactttctcatgctgatccattggtgaattcctaaagtctcggtacaagtttgatgaacaaccaaggaaattgaaagaaactatatttttctatatactaggtgagatccgagctttactacgaaatgcatatatagatgaattggtgttaaatattataaaataatggatggatatatattaaaatatttgtggaaataatgtgatcaaaatgatttggcatacttatacgagtcatgcttgcatgagatgagattaaaaatgctattgttttgagactattgtcatccaaacttataattaacatttaacatcatagatgagcttaaatgaaaaatttgtccactccaaaattgtatatctcgtctatatctacaactttcatataggttttatcttcatctgagattgtttagaaaatttaaatattcatttatgtaaatagatccgagacattaaaacacagtttcggatatccaaacgaccttcaatcaaaaagtcgtctactataaaattgtaggtctcatcaagctctacaaatttgatataaaatttatcttcatccgactttatatgaaaatgttagataaaaaatacacatatatgagttggtgtcatcataggtgtcatttttaattataaaccggaagaaccagcacatatgtgatgcatatatatactgattcatgataaaaatcgatacctatgacatcacacttatatgtgccggtttttgttacaaacttgtaccgagtgattataggtaccgatttattaattttatacttgaaaaaggtgaaattagttttatacttgaaaaaagtgaaaaaaaaagcttcatgggtgtccttttttggtaaaccggcatctataagaccggtctctatgtgatgttttgtagcagtgttaacttggcatatcagtaaaaccagttatctatactaccggaggacttaatttaacgcagttttataagttaggagttcaatatttctactattacggtttaaaaataccgattaaacttgatgtaaacatgaggggttgcaagtgaacttattatgtgcagaaaccacccccacaaggcgtcaaccttcaaggcctgtgacagtgtctactgtgactgctgggccgtgagctgggcctgagggaggagggagatccgtagagacaaggccacaagtggacgagatagctagttggcgataagtcgcacgcccccctccccgcgcgactagacacatgtcgcgcgtggagagggggcggcgacgcgccgcgcaggtgaggaagagcgagttttccctcttttttttgttttttttacgttttttccgtttctgttcggttagttttcattttttttccggttcggttggtttatctttctttttccggtttctcttctgtttttttccccttttttttaaattttatgaatataaagtttgtattcgtatgtatactaagtttgtatttgtatgtatgcaaagtttatatacgcgtatgcaaagtttgtatacgcgcatataaattttgtatatgttgtgtattttttagtttttttattttttaatacgtatgtatataaagtttgtatttatcgtatacaaagtttatatatgtcctatataaactttgtatacgtcatatatatatataaactttgtatatgtgtatatattttttatacattaaaaatatatttatatatatacgtatgtacttactatatacacacgtgtgtatatatagtatatacatacgtatcagccgtccccacaagtggacggtgcagcatccctggcagggcgccgaggccatggccggcacagcagttcagcagtgacagcagcgactccaattcagtgtcgtggaagacggtatacggatatcggacggagagggtaccgctaaacgattaatcggaatgcggacgattaatcagaatttggcggaaatataacgttttgaaaatatatgtacatagttgataatagttttcccttctatatatccttaaatagaataaccatatatgatatttaaataagtttataatggatagctgttactgtatatctcaattctcatgtagtgatgggttttgttcataatgcatgaaatgaattatcaagagaatgtagtacatagcataaatgaccgtaatcaaggttccaaataacatatgtatcggcttcatcaaatacaaactccaataacgtgatcatcgtcaaaatcaaggaactcatgttcaaactttagaggaagtcagttccttgtcattttacatctttctgccttgtgagaatttcggaagagcaaacttctagtcaatagtagtaaagggcacagctaatgagttggattgtggaatcgacctttgtcaccacgctgattatacggctgattagacggagacggacgatttaatcggtaataattggatttatgcgtttgttaccgactaatgatgaccgcatcggcgtgacgtgacggactgatctccgtatccgtattatcggacgtattaatggccgttaacatcgttttccacaacactgctccaattaggaaaagagaggaaatgatcacaaagaggtaattgatgaccttatttaatttgaaaaccattactcattagcaactacaaattaccccattgacaagtagtgtagcagcattgcagcatcagtaagagaacaagccaagagctagaagcagaggagtaatgcttttcttctctcctgacccacctaaattttgggtgttctctaccactgggcacaggcaagcttaggatgatgaccagcgcacaaatctcacgcaaggaagggaagtcgttttgatcctgggtatgtcccctctagtttgttgaactatttattctaaaaaattaatataaaatcttaatcttgaactcaactcacaataagataaaaaaaaggattattcatagattgaatatgtctttttctgtatgtgtagttgaatttgaacttgttttggtagagtgatagatgtcggtgtactctacatcatcaattgttttgtataactgtttgtatttaatttagaagaaaagaaaaagatgcacgagggacatcactccagtgattagaatccggttccacaatgggaactagattctctgctgttttcccaatcacctgactagcaaagatgtttacacatagctagttctctttattgattcatggcgatgtactataccacacacacgtaccacaaccagctaataaacagagaaaggaacttaaacaagaacacactgcatgcatctgatctgattatagctaattaattaaacaccagaaagcatcacctcaaacttttaaccgcacatatatatatatatatatatatatatatatatatatatatatatatatatcctcttcatcacacaccctacttgtactcttcacagaacccagtgaatccgtggtgccggcgccgatatatcgaactcggcgtttgggagattcagcagtaggcggtgcacttggtcttgcagtcgatggtgcagccgccgccgccgcccccgccgccgtagcccttgccggagctgctgtaggacgagaagcacttcttggggcacgtcaccttcttcctgtagcacgggcccttgtcggagcacaccaccgtgggcaccaccacgccgccgcgcgagtacccgccgctcggcgtgccgtaccctccgccccacccgccgcccatcccgggcacgttgaacccgcccatgccgccgcccatccccgggatgctcccgaaccccgggatggtcgggatgccgccgccaccgccgccgccgggattggtgcccgggtaacccggctgcacggacggcttcctccccgccggctgcttcttggcggatggcgcggcggacatgaggtcgcgggcggcgaggggggctgtggcggagagcccgagcaggaggaggaacagcgcggcggcgacgcgggcggtgctggccatggctaagctttagctagagctagagtgagctcccttctcgtcgatctcgtggagttaagtagggaaggaagagtgagggtgtgttaagtagtctaaagtttttgaaatatacggaacacgtatatgaagtattaaatgtaaactaataacaaaacatattatatattttacctataaactatgagataaatttattaagtttaattattatattattagtatcgcattgtcaaattatagtgtaattagacttaaaagatccgtctcgtaatttatatgtaaattatgaagttgactttttctatatttaatatcatacgtatatatttaaatatttgatgtgatatttttggctaaaattttttagatatagaaaaaggcaggatgggcaataaaggtggcaagatatggaggaggttggggaggccacaggcgcagcgcatcaccagcagtgcaatgtcagtggagtggagttatggcctctctttgaagtttgaagttttggtccggctcgccaccggcggtgctctaccttttgactcacaaatcttccatgtcatcatcatcatcaatgaaggatacattacgatttttcgtttggccgccggccaataacgcgactcacgtgaacgtccgtacttgacacgcccgcgaacgttgtgctacacctgtttttttttttcggataataaaagaagaatattttttattaagaagagtaaaagtatttacaggtgttgcaaaaccaagaatgaggaggagaaagaatacatgagaaaaggactgaagcctactctcacagaacattttgcgaccaaactgtcctcacgttatcggcgttggagctgccatatcaccgtctcttttgccattgccttcccaacctcctccagtttttctgttattgattaaatacatgattatttcgctctttccaaattgaccaagacgtaggagcagcgatagtgtcgaatccttggtgtttggatttggcaattttttttcctgttgtcgcacaaccaaccatgtaaggatcctttattcattggagagcattttgggtgatcgattgtcctgagtatcagccaccaaagctgtctcgacttaggacatgtatccagaatgcgatcgatgcttgcatcatgttgagcgcaaagaacacattggctagggtgcggcaaacccctgatgcacaatatgtccatcgtccaacatcgcttcagagcaaccaatcatacgaagtagtaacaacgcggtggtgcgagcgattttcaaatcggtgctgattgaaaggagactcttgcaaggaacaatgcttggtaagttgattgagaagggaaggaagggggaggggaagagttgggaagtttctcatcttagagagatactaggagatgcggcggcctaaggttggaccatggagatggggcgcaacgacggtatcgctcgagttgtgaggtcagcagcgggagcaaagtagaatggagatgttaggaggcgaagggaggtgctaatagatccgctcaccaaaggtggagaagggtggggcaaatcaactataagagacggatgaggaaggctaggtaggggcacctcaccaaagcatgaatgtgtggtcgaagggaggcgtcaatgtccggccgtccatggtggagatacggaggatgggggtgtataggtaggggtgggcattcggtctaaccgaaaatttcggtctcaatcttcggtctttgaaaagtaaagaccaaatttcagtgaaaaaaatgtcaggaccgacaaattcggtctcggtctcggtcctgaccgaaattcaacaacattttcatatatgcaaagaaataatagaaattttcaacacaaaaatcacaaaaaaaaaatcgtaagcacttatgagtaaagactcttattatgttacatgcctaaaaaaggtaggaatgtgaaaattagagtttaatcctattaaacatagtggattgtaggttgtatttatacattttttgataattcggtctattcggttacccgaggagactaaccgaattgaccgaacaaaattcagtctttcactacctaggaccgaattgatgaccgaatttcttggtctcggtctcggttttttcggttcggtcttttttttttgcccacccctatgtataggaataaggggtaagatctcaaccgttggattacaattgtatggtccaaaaattgccagatttgaacctaattttctatcaaattatatatataggtaatccctctatttttcacaaggaacatatgtttctctttctctatagatttaggtatgtagctaatccgattgcccacccacttagcagcaggttcgacatctactataaaatagagaatccacttcacaaccacgtctctgctaggcagcgtgtggaatggccgggaacggaccaaatggatataatccaagctgagagtggagttacgtgaacagccatatgatggaaaacaactttcatgttcatagagagcagttcttttcgttgagaataagtccttcccacatacaagtctgcaactcagggcctgtttagttcgcggaaagaaaatttttgggtgtcacatcagacgtttaaccggatattggaagaggttttcggatacgaatgaaaaaactaatttcataactcgcctggaaactgtgagacgaatcttttgagcctaattaatctatcattagcacatgttggttattgtagcatttatggctaatcatggactaattaggctcaaaagattcgtctcgcgatttcccccctaactgcgcaattagtttttttaatttatctatatttagtacttcatgcatatgttcaaagattcgatatgatgtttttgagaaaaaaaatttggaaactaagcagggcctcaatggattaacatcccagtcgtgcacgctgtttcgtcacacttgaatcggatgcatggcacgtagtacgtgtggtgtgcaacggtgtaaaaggcatccggtggagcgatcaagcaagtcgccgacagtgaacgtgggaggaattgaaggcgagggagacggcggctgatgctgcggcatcatacaggtcactttctggcaccggcgctgctcctgtgtttcaattcgttcagactttcaggtcatttgggggtgaacatttatgaggctttttatctgaacctggacagtgctgaggctgtttccagattggagaacggaacacccgaattccagatcatttctgaaccatccacattgtaaggccgagtttagttcctaactttttcttcaaactttcaattttttcatcacattaaaacttttctacatacataaacttctaacttttttcttcaaactttcaattttagtcaaacttctaattttagcgtggaattaaacacagcctaaggttggagtaggagttgtagggcctatttgggggagcttctaactgttgcagcttctcccagaattagaagcttccctaaacagtacagcttttgatccagattctaagaagctgtagttgtagaatctagaaaatgaactagaagccagaagctgggaaacccagcttttccagattctgagaagctggctaccaaccaactgtttctcagaatctcaagctcccccaaacaggcccgtaaggccatctacaatcggtatccccaggtcgtgcccctagccgacgtcgtcttgttccaaacggaaaagcaaacgaggcgtcccctcgcaggaccgcgcgacgcctcactgggggacacgcccccagctcgttctcgcgcaggcgctcggggtgaggcaacccattgcgtgggtaggttcttgaggcgacgcaccccagagcttcgatttcctcttccacccctctcccttttgtccccggcccatgtgttaagggcgaggctgaggcgccgctcgccgccggagagaagaagggagggcgaggagggaggcggcgccggcgagcgcggtgaagaaggcaacggcgccatcgtcgatgcggccaccgccggcaccgccacagtctcctcgatgtagccgctcgccgtcggagagaagaagggagggcgaggagggaggtggcggcggcgagcacggtgaagaaggcgacggcgccatcgtcgatgtggccaccgtctcctcgaagcagcgcggccggcgccgctccatccgccggggggccagatccggccacggcggcgccggatctgccgcctccagggtcgccaccgccaccttccacgggagagagagagagagaggccggatctaccgcctccggccaccggacgacgacgacgactgccgcctccaccccgtgcccttgattcggaggcggcggcgggagacggtggaggcggcgggagagagagagagagagagggagagggaggcggcaggcggcggcgagagagagggaagcagacggcgagaggaacgacaggcagagggagagaggaacgcgcgtacaaagggagaaagagagagaggggggggaagagcggggtagaattggaaatagaggaagaggatagaggattttttttggttggaacactcattggactactcagatgtggcctgcattgtagaggtgagtaccctcagttagcgagggcactatagaagtggcttatactgtagatgccctaatttagatcaagcttttaagttccttgtatgaaagtgcaaaccaactcaaaacaatttactgcaagagtctcattctcggaactcacttgctgcagaccaaaccagttgcttgcatccagcggcggtggatgttttctgccataaattgctgtatctgctcggctgaccaaccaaattactgtcctaactcatttgccatgcctctgcatcatcctgcagataggccacacaaacagcaagctgcattccattgggagaaaacagctagatgagtcattctaaggaggacccactcgaccatgctttctgcaaatatatctgtatatctctcatatctaactttcttagataatggatggataggaaatcggcaatctccatcctctgttcatatatctgtgatctaagctaagccactctgttttatagtattcctatccaatatgagctactattgtactactcctctatagtctatacacgtaatgaacaccactcaggaatcgctaacaataacatcatgtcgtcgcaccgaaagcagggggcaagtagataaactcatgagttggaacttgcaagtcacaggctaaccaaaagccaaaagcaaccacaatggcggcctaagtgccttttttcaccactgaatttacatagaagagtaactagtagactagatacaatttgtcaaggctcaggtaacataactaattaactgagtagtactaataactattgttgtggggagatggaaacaggatcaaagaacctctgttgtgttcttcccaattgccatcttctgcaggccaaaaacaccacaaaattcccaccctcctggctaaattcctcagcatggcatcatctgtagaactacaaaactagcagaatatttactgagataaatgtataacacacacacaaagaagggctttagttgcattacgaatttgcagaaggggaggaaaaaaaaagcatgtttaccttgatagcatcaggaatcatcttcatcctccccatcttgcacaaaaccccctcccatctcgcaaatccagtcccagaccttcgccggcacgggcatcaccgacagccgaggctgccggagcagcgcgaactccctcatcccctccacctcgccgccgccgccgcccgccgccttcttgatctccccgagcgccaccggccgccggaactcccccaccgcgcggacgtccaccgcgccgccgctcgctgcctccccctccccctcgtaccactccctggcgacctccacgacgccgacgacgcggcgggaggcggcgccggcgccggagtggtagaagaggcagcggtcgcccacccgcatggcgcggaggccgttgacggcctggcggttgcggacgccgtcccacggcgcgacgccgccgccgggggcgcgcgcctggtcggaccacgaccactcccccggctccgtcttgagcagccagtacttgcagttgccggcggcggcggcggcggacttgggtgctgctttcttcgccatcccgcgtggattcggagctccggcgatcgccggggtgaggcgaggcgggttgttttggcgggaaattgggcggctagggcttgtggttgcgcggggaattcccaatctcaccatcgtcttcccactcccgctgcctctcctgctcccaaaacgtagtagaaagatgcaccttggtatgagctgggccgggctatctataagcgggctttgtccagataggcccattatgggaaggcccagcaagatagatagacaggacggactttttcaacttcaaactggcaaggaaaaagtatactgtgactccctcaactatcgccagagtatgattcatatcctccaaccacaaaaccgggtatatagactcctccaattatcaaaaccggtgcaaacaatgtccctcggtggtatactttgactccctcaactatcgcccgagtatgattcatatcctccaaccacaaaaccgggtatatcgactcctccaattatcaaaaccggtgcaaacaatgtccctcggtggttttggaggcggttttggctgacgtagcgcctacgtggtggtcttgactaagtctttgtcctacgtggtgcttacgtggtggtcttgaccaagtctttatcctacgtagcgcttacgtagtattagaataaaaacaaaaataaaaaaaatatgtgcgacccatatgtcattcacacacaaaaaaaaaagcattgtgaaccgacatgtcatcctcccactaattcccttcttcctcccctctctctcccttatctctctctcaacctcccgcctttctcttcatcttggccagagcggcggcggggacggcagtggggagcggcggcggcggtggtgaggacggggtggtcggaagcggcggtggtggcggtggggacgatgacggcggggagctgcggcggctgtggcagtgggagcggcggcggcggcagtcaagagcggcaacggcggtggcggcagcggtcgggaacggcagcggtggcggtggggacgaggcggcggcggtcgggagcagccgaagcacgagctgctccccgaggatgggaggtggttcatggatgtcttccatgtcaccaaccgcctcggtggcaagctcaccaacgacaacgtcattacctacatttgagcaggttggtaggttttcttggtggtttcttgatggaataagtccatattgcctccctcaactcttgccattgtttgaatcatctccctcaaccgcaatattggctcccttggctgtttggatagtggtttcgtcctacgtggcacttatggacccacatgtcattgagaaaaataaaaaaataatcatatatgtcagccattctaatcttaattatttttcttttccctcacctctctctctcccctctctctcgatctccgacgaagcgacgatgacccacccgcctgtgtgtcctctccttcctcggctggagccagcagttcagttgttcgcccgccgccacccctgtagccctatgccggagcaggctcctacgaaggtcatgacagtgccccgggcgagggacaagcacgcggacggcctcgtctagcccgttgacctcgccatcttggtcaccgacgccgcccaaggcaccatgcccactggatttgtgcgtgacaaggccgagggaggcaaatccggtggtgtcgcgcccctccgccacccggcggcacatgtcccgtgctccctcgccgctaggagtgcttcgagcaagaagagggtggaggagtgcttgcgacaagaagtctacgagaaggcaccgacgccggcaagaggtggcaagaagtgctcacgccatccttgcgacacgattcagtcaagcgccaacgcatatgccaaattgccattcttgcaatgcgatttagctctcatcactcacctctcgtctcgccagcaagtcagcagggaaaatcaccattggcctcttcggcgacgaggtccccgccggtgcgtcccggttcttgtcgcttggtgttggctagtcaagattgtgtggggctacatgcaagcaggacggcgtgatgtcacacccggccatcccggtgactgaccggctagcggcggagatggacgccgcacgcacacgcaatgcagtggggacaggagtggcgtccacggtccacccaactcccgcggcagaaggcggcgaggcagcggtgaccgaacaactgagcttgtggcgcccgtcgaggaagaagcgaccgagcgagcaagcgagtcgtcactggacaccggaggtggagagagagagagaggaggaatagagaggtgaggaaaaagaaaaacaaataagtgtaacgtaggacatgtgggggttattattttttttctcactgacatgtgggtcccctaagtgccacgtaggacgaaaccgctatccaaacagccgaatgaccaaatttgctctggttttcaaagatggaggaggcgttatatctggtattgcggttgagggaggtgattcaatcaggggcaagagttgagggaggcaatttagacttattcctttcttgattctggctcaagtgttcgacggtgttgaggttttctgatggcatagatggcttctttgcagtctctggggacgtggaacaggccggcgcggccggcggtgctcgaggacgaggagccccacgcgtggacgcaccgcggccgcctcggttgccgaaatcgctattcagcgactggtcgcgcgcccttccccccgcgcggatggacgcgtggcgcgcgtaggagggggagggggcgcggcggccgtgtgcaggggggcccacgtgggtttttctcccggttttttgagttttggttttccttgtttttttttctttctttgttttttctggttttcatatacgtatacaaactttatatacgcatgtatatactttgtatatgtgtatacaaactttgtatacgtaattttttttctcttttttgatttttttataatatgaacgtacctatacaaagtttatatacgcgcatgcaaagtttgtatacgcgtatgtaaagtttgtatacgcgcatgcaaagtttatatacatgtatttttttatatgtcaactttttggtacatataaaaattatatatacgtatgtatatactttatatacacataaataaactttgtattttgtattgataaatacaaagtttataaatatgtatacaaagtatatacatatgtatatatacacgtagtagtacagtagtacactagtactgttgtagtagtagtactactactggtagtaggagtagttagtagtagtagtgcgccagcagaagcaatagtagtagcagcaccagcagtagtagcaccggtagtagtagcagtaggagtagtagacaagtactagaagcagcagtaggagcagactggtcgcgcgcccacgctcccgcgcgaccagtcgctagttagggccacccctcggttgcctcgtcttcctccgcaacgaggaggccgacaccgagaggatggcgcgcatcgaggcccacctcggacacctcctccacggtgactccagcagcgtcggcggcagtgccgtggccactgtccccgccgccagcgtcgcgcacgccgagcgccgcctccaccagctcatgtcgcctgaccgtgaccaggaggagcgcgcgacgacgtccccgagacccgccgtgtccgtccagagctgcgtggagcgcggctactcggtggtcaccgtgcaatgccgctaccgccccaagctgctcctcgatgtcgtctgcacgctcaccgacatggactacgttgtgttccacagcaccatcgacaccaccggcgaccaagcgcaccaggaatcccacaatactttttttgttatgtgaatgacatatgggtcccacatatttttttatttttgtttttattctaatgccatctaaacaccacgtacgataaagacttggtcaagaccgctacgtagatgacacatcagccaaaaccatctccaaaaccacagggacattgttttcaccggttttgatagttggaggagtcgatatacctggttctgtggttggaggacatgaattatacttggacgatagttgacggagtcaaagtatactttttcctcatgaccctatcatttggcttattccatgaacaaattatttgcaaacaaaaaataatttgtgaaaaaaaacgaggaaaaaaccccaaaatcaaattgttaaatgttacatttattaaaaagaacttttatataaaagttttttttttaaaaaaatcaaataaactcatttttaaaaattgtaataattaatactcaattaatcatacgtgtgctaatataaaagtttttttttaaaaaaatcaaataaactcatttttaaaaataataattaatactcaattaatcatacgtgtgctaaaccaaattccagattcaaactaggcttaatcaatactactgaactcttgggtagttgggtatgaaactaatttggagctatttacaaaacacaaaactcaatatcacaatggtgtgcccaaaatgatggtttggaatgttcctttcatctgtggatgttgcaatgttcctttcaacaactagggcatacagatacagctacctgaaactgttctaacaaaggctagagctagagcatactaatggaatagttttcacaatgttgtagcttcagcgttctgatattgggacttcttgtaagcttggcagaagttgaatcagcaaaactggcttcacttgtgtttaattatgtcgttccagtttgcccctcttttgctccctcttgctgctgctgctgctgcttctctgcccagtacttctgaagaggtggcccaaatataacattcccagagatcactccaatcctgtaattgtttgtaagacagaatgaccatgaatatcaaaataagcttgacaataacaagacatctgcttataatgcaatgaagcagttattcaatggttaagatagcaaacaaagcgctacaacgaaacagcactagctgagagcaaaatcaattaaaaaattcagagaggattccaaatagccactgagccacaatagctacaggcaatcatctgtaggatatggccagtcctaataagatgtgatcaaaggatgctaaggtaatttctttcgccacactgtttggaacagggaaagtttgccccattcctgccaggtaaatttcaggactatgattatctttattacagtgtagacagatgtagatgagcattttcaaaaataccaggatattaacagtcaaaatgacataaacaaacaatttaatgcattacaggggaaagtgggaaacaagcctatagttggacataatgtgatgtacaagttggcgcctactttagtgtagatcttttcaggcatgcaactatcatatctcatattaaagcgtactgtagcatgttagtgactttaagctgaacaaggatgtcaatttcatacaatagtttagatacagtgaaggtacgttcataacaataaaatatgtcactttttatttgcttaagcttgaagtcacggttacaagtgccgattaccatgaattatctcagccagtcagccctaacatttttaatcagagtacagaaatgtatatgcagttgttccacatatatgcagaatccctaatgcaattgccaagaaaacaggaatacatccaatatcttttctaatgaaacacaaggatgcttattcacataagaacaaggcaccattgtattttccccccacaaaaaaaaaaggtatcgcattccatcatacatggttttacttgcaaaatactactactagtagcagagcttcaagaaacactgtttttactatgacatgaaacggcaggattcgagaacaagccttccaaattcaccccatctttgatatcggtggagataatttgtccagcgtaattttgctccatatcaaattactaccgagacacccattactctttccctcgaaacactaacaagtactccctccgtccctaaatatttgacgtcattgacttttttaaacatatttgaccgttcgtcttattcaaaaacttttgtgaaatatgtaaaactatatgtatatataaaagtatatttaacgatgaatcaaatgataggaaaagaaataataattacttaaattttttgaataaagcgaatggtcaaacatgtttaaaaaagtcaattgcgtcaaatatttagggacggagggagtacttcacaatcgttggcttggccgcctgggcgagaatcaagcgtgccacctactagaatagtaatatgagatagcaagaaccagatggaacttcatattagaggtcccatcatgatcggaacgcacaacatcaggagccccgaatcaacgcggagtgaatctggttagcatcaagactggtactaggaaacagcagccgccgccgccgccgcagccgccgcggcagtagatctgagcatcagaccgatggtgcggagaggcgagaggatcggagagagagggttggagaaactcacacgacggcgccggccaccagggggaaggagagccgcatcctgaattcctgatcccccctctcgccttctccccgcgggttcttctgtttcttggccctcgctattttttccccacgatttctccggtcagagacggcgaagctgagacagaagagagagagatatttaaccatttgccacatttaaatgtgacaattaactttttgccactggacccatatgtcatagacatatgtggacccacatgtcattgagataggggtggcaaatagttatttgccaaatctaaaagtggcaaatagttaaaagccccgaagagagaacccctccaagaaaggggagagaagtatcgatcgcctcctgcgccgtccgatcaagatggccctgggttattctatatcggacggtttgaaatttacatcgaagcatttttcacgatttttacagtattatggagcactggagctaagtttctgtattgtttgattctaaaagaaaatatttgtttttttagaaaataatattttccaggctcccgtcctcccgtttcggacgggatcccctccatgtgcgcacaacgtatgctataagttagtttctcgagtgtgatcctctcatccgctttgctagcgtgcccatatgtacacaaaatttgataatttgaccctttctgaaaactaattttgcaaataaaccgtagctaaaacttatttcaaaaatgactttttttcagcgccaaattgtatggcgctgaatttagacacctcagtgccacgtcaactgccgctaaatgttgtgcaccgcgtatgggaggatgagtcggcatgacaacgtgcattcaacgccgtgctatttggtgctgatatatctaaattcagcaccatacgatttggcgttgaacaaaagagtcatttttgaaataagttttggccgcgattcatttgcggaattagtttttggaaagtgtcaaaatgtcaaatttcgtgcacataggtgaccaggtttgtagattctactcttccttgatctcgcctcctcatcttaattactactactatccatggataatagcttactgggcaggcggtacttcatgttgaccattctcctcacacccaagggaaaggtagtgcccgtccatcgaagccacgaagattgttctagaaatacagccagcttgacctgttgctagcgtcatcatggtggcccggtcatcgttgatcatccaccactgtggcaccgatggcatcttggcactcctgttgtagcttggataggcctggtgacaaaccgtgtgagtggtggtggcggtggcagccgactgtttcccctgggttgccatacccttgcgtgggcggtgaaggctgagctatggaagcttcttgactcgaggagaggggatggggaggttttggtctaaaggagtggtcgatggaggatgggaagcaccacagtcatcgtcgccgcaaccattgtgccgaagtagagtgaggagcgctactgtcgtcactccagtaatcatctccatcccttcttcttcctctctcagctcagacccccatcccttcttctctctcttctccgtttatatctaatacccatttcatctcattaatccatcccttcttctctgatacatcaactcaaatccaatacctgatgggtactagcctaatattgacaggcattgagctggtaccgacgatgtattagttgttacctgatgggtatatatcggttggtactaatgaggtatcaaccggtaataatgaggtatgataccgataatctagtacttttttggtattatctcgttcaaacgggatatcgtagtataataacccttttttcttgctcacgcacatgaaacagaattgtgcggttcaaatggatgtcctcattaggagagaattcttaagctatgtatcgtcttcaagagaattcttaagctatgtatcgtcttcaagaatgtggtaagataaacaaaagggtaagttcggccctcgtttttatcattttatactctctcattttctgtgtgcacgtttccaaacggttaatagtatgtttcttgcaaataaaaatttatgtaataaagttgctttaaaaatcattattttaagaaaggttttagctaatactttaattatatgttaatgagccatccggttttagtgacagagagaaaaaggttccgaagttttaggcttgaacgcagcctaaagttctttgaacactacagcctacatacatcttcagagattgatatgtgagcgtaaaaccagcaatgttacaagtttcgaacaacataagttcataattacctttacaaacttcatacatacatacaaacacttaaacttcatacaaactttatatatactttctccactctagaaaaaaacacaatgggtagctcagagaactgcgcctagctcagttattagcttagctggacgccttctcgcacttgattccatttccggagtgtgctcatatttcttcataattattgatatcaggctccttcctgtcttcctgatatccagcggctctattttcccatgatatataggttgtacacacattatcatctaacgtcaagcttgctcgctttcttttttctgctcggcggtttattcttgcatggattgctcattgcaaacgtgcatctactcctctgcttctaattgtgtttgccctgcgtgtagatgtagtccagatgagccacgagcaaacgctccactaggcaatcatcttcttcgcaaccttccactctaccatcgtagtttcccctctccacaacctgtgccacgatacccacaacatgatggtaaaaaatcggttaaagatacgttcaattaatcaaattacactacttcgtacatgcaaatttatcaaaggaaaacatgtcgtgatgcaacatgatatcaaatgtacaactgaaactaaatttaaaagaaagaaaaacagtttttttccttcaccttactggaagctttgctgggttcaattggcccaattctaccaccatggcttatgctgatgggaaggagaagtgctacaaggcaaatggctatgaccttcggtgacatggcgtgttatgtttgtgtaggactagtatcgaataggtcatggaacctgcatacacaatggtgtcattcagacgctttatataggactcaaagcaggggagaaacggtgtcaatcgtatcaattcttttacaaggatttttgtttcaaaccgatttgagaaaaggaatatactgtagacaagtatgggtatagttatgctgctgcggtggcaagtaagagtacagttgataggtttcctgaaaaaaaaaattgccacaaagaaaacatacaggagtatattcgttagttatggacgtgcgcattcagacaattgacaagtgacgatgcttctcgtcgtttattataccggttcatccacgaagaaaaagaaaattaatatatgctcttagctatttacaaattaatattgaagaataaactacgataaaaaatcttaaaattatcttgaaaataagttccaaactattttttttcggctgataagtcaataagcaaatgataaaactgtgtatatggactccacttgtctataaatataagtattccaggcatttagaacttgttcacaaatggattcgtgcgttgcatcaatcatcttagattcatttttttaatttactctatttgtttcaaaataaattaactattggatattttcatatttgtaaccataaattgctttccaatcttactcatttgttgcttcatcaatgggaag

SEQ ID NO: 63136 - DNA, 544 bp, Oryza sativa
ttcgactaaactcgaaaccctaactcaactctcaactcaattgctctcaaaaagcgataccgggaaccctcacgctccccctctatttatacccgaggtaggcagcctaaagccacgaaccaaactcatactagaagtcctaaacaccttaggaaaccctctagtacaagaaacaaactttacataaccactcataccaaatttggactcattccaaattcgactccgcatcccatacgcacacaatacctccatcgtatgccatatggaatcttcaccaaccacgtgcatcaactctagcctaggtatcccacatgatctctaaccaccacggacgtcgtcttatcccaagccgactcccggtccatcaccgcaaatactctcccgaggcatcaagtcacctacacatgaaataaacaaagaaaaccatattccgagaccaagctatctccaacttgactcattagtagcaaacaacagtattacatacgtatagtatccatctagaagccataatcatgaaacaatcacggatatccaaaca

SEQ ID NO: 63137 - DNA, 722 bp, Oryza sativa
  unsure (1)..(722): unsure at all n locations
ttcgagggaggagaaccaatttttatcacggggcatgcgctgtgaacaaccggaatccacgatacacacgctccccttccttgccaccaaagcctacacacaagcaaaagtcgaagcctcaatactggggttagataataaaaatttaggaatccagtactaagacacgacaagtagatcgaataggcatatatccgagtgcaaaaataatttgagaatttttagaaaaaaaatatgtctgaagccggtctgaccgccgaggtactgccggtccgaccgccgaggtactgccggtccgaccgctactaattggcggtcagaccggacaccggtcagaccagcggtacagaagcggtaagactccagtcaaaccggacaccggtcagaccggcggtacagaagcagtcaaacttaggttagaccggacaccggtcagaccggcggtacagaagcggttagagaagttccacccaagttgagtttgtactgcatatattgtaaaaattgtcacgcatgtatttgctattgggagcgctcaacactatacgggagaaataccaagccaaaattaattgggggcaatttcgttcttacccctacatcgatgtttaatattgattttgccatgttttttagggtttttgtttttgcccttatctaaagtggggatcctctagagtcgacctgcnggcntgcgngcatnggatctgcattcacacgtg

SEQ ID NO: 63138 - DNA, 10890 bp, Oryza sativa
  unsure (1)..(10890): unsure at all n locations
gcgcgatgaaaatgatatggcacccttcagaaaatccctgttgatttagaagcattgcgcagcattcctctaaaagagagaacgaccatagaggatgtgtctgccaaacttaacatgagcaaatcaaagattcaaaggtatttgagaaaaggtttccttaggcgccactctagtagcatcaaaccatatctcactggagctaataaaaagtctaggttgaagtggtgtgttgacatgattaagagggatttgcatggtggtccaaggtttaaggatttttttgactttgtgctcattgatgaaaaatggttctacctctctcaaaaatctgaaaaatattatttgctacctgaacaagatgatccccatcggacttgtaagaacaagaattacatccctaggctcatgttcttgtgtgtttgtgctcggccaaggtttagggatgggaattgcatttttgatggtaggattagttgttttccacttgttacttatcaaccggctatgagaggcaatgtgagaaccggccgtgtccgtggagacttggttttgaagcccataacttcgatcacaagagaagtgattagagatttcatgatcaacaaagtcttgcccgctattcgagccaaatggccaaaagaagatgtgggcaaaccaatcttcattcaacaggataatgcaccttcccatctaaacttggatgattcggatttctgtgagcatgctaagcaagaaggatttgatattcgcctaatttgccaaacaccaaattctccggatttcaacattcttgacttggatttttttcgagctattcaagcaattcaatacaataagaatgcaaaaacaatagaagctctagttccaacagtggaagaggtaatttgatcaaattgttcacacatgttacattgattcttcaacaacaaatttgctcattgactcatttcttgcacacttattttgtaggcattcatggagtattcggcacacaaagcaaaccgaatgtttgtaacactacaaagtgttttgatggaagctatgaaggtgaaaggaagcaacaattttaagattccacacatgcaaaaagaaacattagaaagagaagatcggctgccaacttctcttccttgcgaaccatctttgctagatgaagccaaggctactctccgattccggtgcgagctcctgcaactccggtgcaaaggagtccggcacgagctctgactccggcgcttccacggaatctggcgcgagctcctgcaaatctggcgtgaaggagtccagcacgagctccgactccggcgcgtccatggagtccggcgcgagctcctgcaactccagcgtgaaggagtctggcacgagctccgactctggcgcgtccatggagtccggcgcgagctcctcctctgcgacggtgtttctggggcagcggtgtttctgggcggtggcgtttgtggtgaataagaagatgagcgaggaaaaagcgcgtggtggaaccgaagagtgcgaagttaatacagcgccggcgtggggttgagatcgaagaggcaggggcaatttcgtcggcttttgtacgtgtggctaggaacatcatctaaacgtgaaagtacgacggccacgcaaaacatcttctaattgtgatacggagggagtacaagaatcagtgagcacgtgaataaaaaaaagagaaaaaaatacatccccacatcccagaaaccagaacgcatccagcgccgcctgccgaccttctcgcttccatcgccgccgcgaaaccacttccccatcaccatcgctgcctcctccccatgatcggggtcacggtgcatgtggtgctagggctcggtttaagtgcacgaggtctggcggggctctgatggtggtgacaatgtgtgtaatggcccggcggcagccgaataggccagacgatgataatggcttcatccggcttcccaactatgaaaaggatgggcacgtgaagctactgaggttctagggatgacacctgcacggaatcaaatggtgactcaccggagaaggaggatttggcggtggtgctcggcggctagagttggggaaaatggaattgatctcggtggtgctcggcggctagagttggggaaaatggaattgatctcctagcttgctctaccaaccttggcgcttattggggcattttgaagaggatgccgaggtgatgaatgaggtgaggcgaccaagctggaggtggtagagggcaagtgtcacgtcccgccttcccccaggccaggcccgcttacatctgatagctttcataggttatagactgccctcacagaccaacacatgtcttttctgcacactttgtcctcactcgtgtgcacccggaaagaatttcccggtcggtcacccatcccaaattgctccaggccaagcacacttaaccccggagttctttggagattagcttccggaaaagaagttgcaacttgttgatatgagtattctattaattctattaagccctaggccgggatgttacagcaaggtgaagcgctcggtcgaagacacctcatgcccacgcgtcgtcggcgctctgccgctctgcggtgtcccttcttccctctctctctctcactctctcggtgttctgggctgaggaggagggaaaagaaaagtggacaagggtggagcgagacagaggggctttctagtgggcctagaccgatggaatcaatggtagggagaccgatggaatcaaggttagggtgagcagtatgggtagagattgagtgaagatcagtttctagaatattacaggattatttctctctctctttgttaatctgtagtttaatttgtgggcatgctaaaatagggtggatggaggcagatgaatttttagttggtttaaactgaggaaataaattctacaaaaattatatttattcattataattaacctggtattcgaataaattagttccattatacacttgtattcagtgtaatgcacattttggtgatggtaggttttagctgattaaggtttataactaatccactgtttgactactttgaccgatttatttgatgtaacaaatgtacatataaaattaggtaaaaattacagtgatttgattatattgattagtactttcatgaatttttccaagattttatcttgcatgaattatttttgataattcgcaaggccttgctttatatgtctgtttccagtatagatatatgtttaagtcattgtgaaattatattttaattttagaatgagcattgttgaggaaccaaaacaaagaggcctgatcttgaatataacgtctgaacttttcgttcaaaatatatgttcatctagatttaactatttttttatcatgtcgatcctatgattttacaaaaaagttcaaatttaaagtagacacagtaattatcatacttatagtgtgtatatattttgggctttttataaaggcttctaaagtcgtgcaacgcacgaccaaatagctattttttttaaacgaataagccatttgcccctatttcattaattcttgctaacggtgttaaatgtgaggtgaaaaggacaagtatacccttagatattttccggtacttttgtacaccactttcaaatttaacccaaattttagctaacttttacaaaattttgacaaactaaattattgctatggcatcaatagatctgattatgtcaaaagtacgggaaagtattgaagggtatacttatctttttacaccccgcatttaacaccattagcaagaattaacagaacagaggaaaacggttgattcatttaaaaaaaagtaggggtaagaacgaaaatcaatattagacatcatcaaagtagggggcaacaacgaaattgtcccaaattaatttgtctactatatgtacagtgtacactatagttgtagttatgaaaatggcatttctattattctctcacacaactcatcttaggatgcggagttgtctgaaattctaccttgtttaaaatttccccatatacctcatgctgcaaaatatagataggccgtgttttgttctttggcaaaatttgtttgacgtatacggatacatatttgaagtattaaatatagactaataataaaacaaattatagattccacccgtaaactgtgagatgaatctattaagcctaattaatctatcattagcaaatgtttaatgtagcaccacattatcaaatcatgacgtaattaggctcaaaagattcgtctcgtaatttacatgtaaactatgcagttggtttttttttttcatccacattacgctctatatatatattcaaatatttgatgtgatgaaatttttggaagtttaaagggaactaaacactgtcatagcattaaattaacatccgttgttccctatatatgcatagagagactgtatatatacatatgcatgcctgcaccaaaattcagccaacaccttgctgacaaaaagacaacaaaagtttagagaccagtacctactgaaatcctttgtcgtagaatctgcttgacatatcaatctcagctctgagaaagtttagattagaacataatttaataatgattaggaggcatcaggaaataatgtcctacacgtttctctcatcatccttcctcagcaagggtcaagctaaggccatttacaatgcaaagacgtggcgtgtgacaatgtagagccacgtaggcaaatcgcttgcgtggagtagagaggggagtggggaccgttcccaacccagcttcgcgtgatcaagtttggccacacgaacctcaacaacttttgtccaaaaaaaggggcacctccacgagaaacgagaaagcaaaagaaaggaggcacgctggagtaaaaaaaaaaggcacgctggagtaggggcactcggggcgtggggctcaccaaagtaggggccgccgctgcgtggtgctcgtcgaatgctcgccgaagtagaggcgctcggggatctcaccgtcgctgccttgggctcggggaagccacccgagatccgccgctcggcgccgccgccatcttctaggtggagctcgccgtcgctgcgtggggctcgggaagcctcccgagatccgccgctcggtgctgccgccgtcttctgggcggagctccagaagctcgccccccacctcgcgcgccaatggcgttggcagggtccgcggccgcgcagcttcggtgctgtgcctccaccgtcgacgacggtgtcgttgacgcagccgtcttccaccacgccgcttggcgccgccggcgtcttcggccgcaccgctggatgctgccggatctgttgctcatcgccgcatgggtccctccacccgtccgccggtgccaccgagctccgccgcgctggccggagcacgccgccatggccgccctggacatggggacgtgagaggattaggtgggggtgggggggtgtgggaggggtaagattttttatattatctgtaggtcccgttataaattttttaaaccacacttgccacacttgcactgtgggtatagtgtcttttagagttcccaagcctacatggcagctatggcatagcaatttactaggacgcattgctactgtcctgatgagcctccattgaggaaggttggatgtagcaacatatatatataagaaattgacccattgccaaacagtggctctacgtattacatccaggcagcaggctcacatcaggctatcaagatacgcagccacctcgcagtctaactgcaaagaagggacaacaatacagagaaatgtgtcaggtttggccgtgttagtctctgcaggtaataatagaggagcgatagcaatgcccctggattgatcattggctgaacatttttagtcctgatgacttagcacctaccttgttgtttacagaaagagatcatagttactaccaaagctaatttgatctcaacagccattatttccccaaaattcatatatcttcaagacttcattatttttagcagcaagggagagacaaaggggtaatgaggggacacagtataagaaaactggcatgacaaagatcataagtttaggaaaggagagtgagttccttttggattgacgataatacacttcgagtaatacacatttattaaattttatgctgcacataatgtctcgatatttagattcaattgatgaaattctgctttccaagaaaggttaagcagttcatttgttattccagatatcattggttaaaaggcgtggtttctacgaaaccacaccttttaaccactcttttcttgcgaaatgtgtcctgtaatttttttgtgtacagctttattgaatgtgtcattaatttgaggcaggtggcaacctttccagggcatatgaataattttctatgttgtactgttatataaacagcaagcagtgtaaagaaacacttcaaaagttcaagggccttttacaatgtacatgtgctatgctctaactaagggcacctactagtggcattgagttgataaatatccagtagaatgcaaattatattttgctgcaaactcaaaacatagggctggattataacacgaagcaatgtcagacagcgatagccttttcatgggttctttgtgagagtgttctaatcctgactcttaaatttaatctaaatggttgtgacaaaattctaaacaacttgacaatctagagtatagtaacatgtaccagacaccactgcaccaaaaattatattcaacttcaatatacaaaatgagaaacaaaaaaagattaagatgtgaatactgaaagtagaaaagacgattaatatggctggtctatctcaagaatgaattgtgtactctgaaatactctgttcttgcaatgaaatgctcatgtcatgcaatacacatgcaccttctttgtatatccatctttatgaaacttttttttaaaatttacgggaagctgcagccttcgtagttcatataaagatcttctctataatatattggagaataaataccatgcagtatatatataaatatacaaagagtgaatataaacaaatggctagcttcttaacaagttggagggccttttgcaatgtacacattcctctataattttctaataaaccaatacactggcatcctctgatgtatccatctttatttgtttggacataactagctagtataggattggaagtaatatggaattctggcataattctctggatgactaaaatcatactctataaactggaaaaatggccgagcataacatatggatctagaaaacactgccatggacaaaggtgacacataggtgcccctcggtgattttatgcatcttgctattgttgtaaacattatacagaaattttacaaacattgttggttagatacttagagtcttacgaactaaatcataatgcattgtcctatttatttggacacgaatcaccggtgaaatgcaaaatgtatcatgttgtaaatttcaaacatggaggaagtaacatatatcctacacacttaaaaccgtgacagctagctatctcatcttgtccatggatgtagttttttatgaactttttaagcctctgcaacaagattcattttctaaggaaacatcgtatggatagccactttgattttctaggagcgctgatcatcacagaaaacgtcaagaatggccagtcacagatgctcttgggaacgctcatcacactacatggtgtaaaaatcaaagtgtgtcgatcagaccagcgggtcaactccgatcagagctatctacatcagatttaagggtaatttttaattccggtaaaagttttagtttttgggtacttcaaccattcactcctctggttggtttagttcttgctattcgagactacacatgggacaaatgccaagacataattaataaggctagctatcatttgtagaccatagttctagtcatgaaaatggtctttttatggtcctctcacacaacttattttatgatacggacctatctggaaatactaccttatttaaactttctccatctacctggtgctgcaatacataaatagacttaatgaaacttctatcttccttagccagcaaacattttatatatatggagccgatgaacacctgcaccaaaattcagggaacactttcattgacaaaaacaaaaaaaaaacaaaaaaaaggtctagagaaactcgtactactaaaacctatggagatagaatataatgttcttgcgatattaatcccagccctaaattaaaaagttaaagttacattactctaatatgattaggcggcatcaggaattgtcctacacatttgtttcatgatatgtacatgagtacatacatgattatgaccgtctacgccaaatagtggctctacgtaccacatccagacagcacgcaggctgcaggcaatcaagaaataaagaggtctcgcagccttaaccgagagggatagttacccaactttgctgttaagagtgctcaatcgaacaagatcacccagtgttatagagactcttgaatctattgacaacttgccctagttagtgagttctctcctgatttttacccgtacaagatgtctttcaattcattattttgctcaccttgcttgatatacgtactaagtacaaaagtggttttatacagcttattccatcttttggtctacagcaaaactgctaggctatctgaacggcatgcaatgaattatttctgtatatacgaccagcaaagtcatatatggcatttctaacaaaaaataaccttgataaaaaaaatcaggcattgctgcttgctgcatggtgagtttggctatctgttcgttgctttcgactttctccctcccaaaatgtgaaaaatatgtttgctaattggtagatatatagatgctcagtctctctcacacacagagagacacatacatatatacacaaaagaccagcaattcgaatgatcaagtgcatgtcgctacgcacaaactagctaattctcgacctggaaaatatcatgcaacttgtaggttttaatgtacatcttttctggacaacttgcatagaattaggaggcatcgggagtaatctagcctctttgaaacattctaattgtttaattgttactcgagtattttctgcaagttggtcgttggcgacgaactgtccacaggcttggaaataactggcgagctggctggtttaagaaaaaggccaaaggtgaagaaccatttcaaaccatgcgttgtagcagtttccttctagttccataccacgtctttgcgagattgcagaggcacagagatacagtatgtatgtttgataatactttttgtaattaagttgtcgtttaatttataatatattggtataatttaaacattatttttaagaatagtataaattagtacgacgtataaaaaaatatcatgtgaagcaaatccagaaatggtggagggcatctttttcttctttttcttctttgcatgaggatccaacggggtagggggcttgaggcttacaaatatattaaatttatgttaaacatcgcatccggaaatttacattcatttgatgaaatttctacaagctttccgcaaatggttaaacatttcgttcgtcgttacacgtcttgtaccagcgctaggaaaccacacaatttcccactctattcttgctatgaaatttgtcatgtaatgcatgcaacttcttgtatctagctagttttttttgaaatgtgcaattaattttaggcaagtaacaaccttgttaggggaacatgaataattttcattgttatgtacgttggagcatataagtagtgcaaacaaagagttcaaaagttcgagggccattcacaatgtacatgtgtgcaatgtgctcatggtattgagttgacaaatcaccagtataacgcaaactatataatgttgcaaactcaaaacatcaatgcggcagcatgcagtaacagatagcctccatgggatggcttcatggcagcagttttctgcttgcgcgtactgctagattgaaacacgaggctatcgtcaaaatcttagtcatttggactgacttctctattttttatcaatgcataataaactatttgcattgtgtgtcatataattccaaacaggctccaacctgctttgcgtgctgccgtggcatgccatggtgacaccaatgcctacataaattaagatcaattttttttacttctcttttttaattatttatttaaaattaaaaacttccttgtctcatctctctcctctctttctaaattttatattttgtatgcgactaacatgtaggtgtcattgtggcatgccatgtcagattatggagcgggttggagcccgtttggatttatatgacacctatgaaaagtttaggcacctacgaatgtattttcgagaggggaaaagtacgaattatccccttaaaccacaaaactggatatccttcacccctaactatgtaaatcggacaaataaccccctagctcaatccgcggcggttttggtcctccatggcagtccattcaacaattcttttaataaaaaaatctatgggccccacatatcagttccccactcctctctatctctatactctatccccaatctctccttctcaaccatctccctcccctcaccagctcaccagcacggcagcatcgagaatggctgcgggtaggcgagggtgggggcaagcagagcttgctcgggcactggtggcgctggctatggcagcagaggcggaggtcccccgggtagctgtagcgcccgttccgtcgtggcgcctaacgggaaaaattatctcttaaaaaccctanatgcgaaatttggttctttgcttggtggctagcgcc

SEQ ID NO: 63139 - DNA, 9303 bp, Oryza sativa
catgtcatgatagaatcttgatcttcgctgctctgcagcgtcgactctagaggatccccgccgtggttcgctccgccgctcgccgctgtcgcccgccgtccattcgcggccgggtcgtcgtctacctcccgccagcccacgtggcagccacgtaggcgccacgtcggcgccagcccagccgaggtcgggacgggccgaccccggtcagtccctccccgtgcgcgcgttccaccgcgagccgtgaggctgcgcgtgggcccgccgcacccacgttcaccacgaaccacgcgcgtgcaccgcgtccctcccccgcccgcgcgcatgagccgcgtactccctccgcacggtgagccgagccgctgacaagcgggtcccacccgggaccgcgcatggtgagcccggtccaccggactctctctctcctccctccgggcgcgcgcgtcttgggccgctctgggccgcctccttgggccggccgacccgttaagttcggccgagccgccctttctctcgggccgcgccctagccgcccgagggaagtctattttccccccccccctctttccttttcttttcttttctaaaaggatttaattaaatccttttcctttaggtcaaaaattcaataatcttagaaattcaatatcttcccaaaccgtaaatccgtttgactccgttcaacttctaaaattccccaaatctcgagatctatctaatggcacgcttagaggtcattaatagggctttattttcgccgtttgttgagttgtcccgtttcgcgtgtagtttcggaacccgaagacccgcagtgcgaggatttcgaggatcaagctccagatctcgagcaaggcaagccacctttgaacatcttgagcctatatttgaaatttaattatattgcttgcaaaatattatgcattgataggatcacacttaatccgtttgtcccgtctgcaaggcagattggcggacctacctaattcgtcgcatttgatccttcctttgttaattgttatatcttgtccccttgtaaccatctagttgcgcctcgatattcgtgcaccctgtgcgagtatcgacggacgccttcaaacttaaaatctatttaacaacttgggtaaaacttgggttttacaaaaggtttggaaaacccgacacctgggtcggtgcttgcgaactaaatgaatttccaaaaccgcggaccgggaaatgtaccgggtgtatggtttcccgctctcgcacttaaggaccgattccttggaatttcatccaaacataagacaagtacgaccacatgggtggaatgagacactcctggctgagtaactagcttatcaggggagccttgatgccgagagacatgtggattcgccggggtggtgtcggggaggacccctgggcttcctggcacagtatggtctgggacctaacctgttgttggtctgggacccctcttgtcggcatatggtaaacctgtgttggctttggaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgagaataatgggttcgatgtttgaaaaatcagcagctgacgggatcagctaggcccgggtggccgtttgaagaagttgttggcccgggtggccgtttgaaaagttgttggcccgggtggccgtttgaaaatctgttgactgggtgccaaccttgtttcaattttaaagactgatacattgcacatactccgaccggacgagacgcactgtctcatccgtgtcgtttgagaagcactcacctagtgttttagaaaagagttcaaataaaatcaattgcaaaaacaaacagcccttctttgaagcctgcattaaacacttatttcccctggcttgctgagtactcccgtactcacccttgctctatataaataattccccccccagttgctgaagaagatgaagcggatcctgctgatgaggagttctttcaggagcaagccggctacgacgagttttagggtttcgacctagttcccaagtcgcgcctatgatgattggtccaagtcctggcttccgctttcctactgtaatgcagttgtgagctcgggatctgtccgcagcccaacatgactgtacttctactccataataaagagacctctgttgctgtgatattctgtctccctgtgataccagcactgtttcctgggactggtatcgattaacaggttaatttggggcgtcacgggctagttccggtcgggactggttcggggcgtgacagtagccgacagaggaggaggtagctcgagcggccgatgggggaggcgtggctcgttcgggcggcagacagtggcgtgcggggtcgggcggtgggtgggggtacgagacaatgagggggatccagtcagtgggctccgcacaaggaaggggaagagggcggttgcagcaacgccagcgtgtcggagctccgcgccaccgcagccgccacgctccacatcccatcgcccttgccaccgccgccgctgccaccggagccggctaagtgctgcccatgatgaaaccggagttgtgggcggccacaacaagcatctgcccccttgacgcatcgatggtgagacctagcgcaaccctcccagcctgaaccccagcgagaacgtccccatgaacgccgccactgcccgccactcgaagccaggcgacgacacgcagagggagaagccgaggatgaggagagacattgccatgtcgcgccacacgctcgtcgacccgccgccgccgccccaccacccgccccagtgtgctgccgggcgcgccgaccgcccgccgccactcgacgtacccgacggctagagaagagagagtggaagaggggaagaggaggttatagtgtatatggtaggtgggccccaccaataaaaaaggaaaatacatactggattgacatgtgtacgccacgtagaataaaaccgttctggattgggtcgagagggataaaaaaggggtgcaaatattgttttatgggccatcgccgatggttaccaaataatcactagacgggttcgtgcagcgtaacgctgcacggttagaaatatgaattggtgattatactattttatttttttatcatattgatttatcacatatgtaatacatgttattactttatagtctgagacgtgtgaccgtaccgtaatttttatcttcaattcttcaattatggatgtgtatctctttaaattttcagtcgtaatttaaaactaatcgacgcaactatcaacatatacaggaagaaattagtcggtaattcaaccaccatttcaacatgaggttgtacgcgtgtaagaatacatagctctgagacttgggctataccgctatagcatgcattttatagacacgtaatcactagtggaacaatagccccggttcaaataggaaccgggattaaagattctttttagtcccagttaaaaaacccaagggaactttttgatctttataaccaggactaaagatcatttttagtcccagtttaaaaagtcatccggccccactatctttagtccggtttaaagatatatatttagtcccggttgtttataccaactaggaccacatttgaaaaaaaatatagccgcacaccttcactctcgagacactatcttctcgtccaccgcgcacgtcttatcccttcgccagactcatctcccctctcctctcgatttcttctcctcttcacggccttctctcttggtggcaggtggtggcggccggtggtgcatggcagcacgccatgaaggccgtggagggtggcggcaggtggagtggaggatagcggcaggtggcgggtgggcggacgggcgaaggggtgggcgactacggctcggaggggtcggcggcggatctgtgttgtgttgattttttgttgtgtaaatgcatggtgttgtttatgattattttttgtgaatttgtggacgattaattttattgttgagtatgtgaatttgtgatatcaaagatctgtgaatgtttatttgatttgtgaatttagcgttgatctgtgaatgtgaatgtttatttgatttgtgattttgacgcgaaattaatatgcaaacaaaaaacaaatgaaaaaaaaagaaaacaaattggtgatgactctactgtatttatagtaccggttaaagttacaccccggttatttcacccggactaaagatagctataaatagtttcggattcgtagtcccggttaaataaccgggacactacaggccgtgaaccggggttaaaaaccctttctccagcagtgaacagaaaaactggaaaaggaaaacagaacaaatatgcatgcgtacgtaccgattctcttaggaatcctaaggaaatgatttaacttatataatacctggtatattgaatctatatatacaacagtacgatggcaaggggttaaccataggattcagatttcagaattaacattccaataactgagacactcataactagtcatctctgctgcaaccactatctttttctatagttgagccgtcttattttatgatgggagaaaagtttactcctccggttacgacacgattttaaaatatatctttttgactatattatttttctactataatatatgcaagaatatatatatatatatatatatatatatatatatatatatatatactccctcagtcctaaaatataacaacttttagcctcgagatttatccaaaatataaccacttctccaccaacattttcttcccaaccaatcagaacttttcatcattcaattttcccacctaccaccattagtgcttaaccaatcataaccctcaaccattcacttctacctactttcttaataaccgtgtccacctctaaaaatacttatattctggagtagtactttataagataaatagctagtgcatttaaattaaatatttttaggttattgatagttaaaattataaaaatttaacctcattcaaaagtcaaaacttttgaacaggagtgagtacatgttttttaataatggtttacagggtttcactacaagagacggttacaggatgaaaagttacatcttccaaacgaaaagctattctgtaaagtcgttttggagcgctaatctacttttattgtagtcttctacgattaaataggtgacatgatattctctagctactcctaccaagttgcagcttttgcatgctgttgaagagataaaaaaagattttgtgtaagcaacaatgtgctaacaaataattgactttttggcataaagggatagaagaggaaagcacaaataatattctaccttgtctgtactgttgtaaattttgggaaaatcacggtgaaaagaatgcaaaaagagaaaaagaaaataaactatgatgagcttttggggaaactggtgtgttttcaaatttaatcaaagggaatcaaaccaatataaccgcatttggcaaagatactttaaaaatgttatccaagattttaccacctaaaagcaagaatgcatagcatgctaaaccaatatggttgttatctctacaaagatagaaagatcatagaaagtttcattcgcgctcgcgccaccacatattaagctcgggttctacgccgatgcgctagggccacagtttcacccacaacaggacccaccagccacagccggtctggcatcatggaggccaacgcttcggtggacattgacgatcaacatgtctgcctgaagatctccaaccaggagtccaccacgagcatgtttcgctcgcacaagcagaggcacctcgtccggctcaccgacgcccagctagccctgcgccaagatgcatccacgtacatctcgcactcgcgttgttctagctgaactaagtagtgacgatgccaggctcagagaactatggcgacgggagaagtagcggcgacgcaggaaagagcacggccagctaaataactacaaactaaagaaagacaggaagtttgatttgaagcatggatgagaaaagaacgagatgctggcttaaatagggaaagaaagaggtattaaagcgagaaaaaagtactaattaagaagcaggaaacagaaaatgtaccacggtatggcacaagcgcagcggcattcagtgagccaagtagggggaaaagctagcctacgagaaaacatgtggccatgcatggtagcacgcataatacgcatgcaggcacgaggcaagcacaaacagctagctgtgcgtttgcttactacagcagctaatttttccaggaagcggcatgcattggtggaaccggttgagcaaaaaaaaaaaaaaacgagagatcaccggcacgtatacgcggggagcatcgaccatcgcgcagacaccggatacgccacctgaataaatatccaaccggttacccgacaagaaggaaattagaaagaaaatccatataacacgcggcaagcaacggagtgaatagaaaaaaattcaaaaaatcagaaaaatgggaacctgatcggagactactaggtaagtatgagttccgtaatcaaacgcaaccatttgatggtacagtggaacataggaccgcccctcaagcgcccagcagtagttcaaaccttactaagttggaaggcagaaatttcacaatgagaaaaatcaaatgatcagccaatcaaaggtactgacaaaaagaagaaaactaaaagaaagaggggaaatgatggtgagagttcacaaacaagtagttctggaggaaatagtcccacggatcctatggactggtggaagaagaaaagcattttcttcaaattgcaatattgggagcacttgtctttgcgccataatcttgatgtaatgcatatagaaaaaaatgtgtgtgataaccttgtttgtactctgttaaatgatgccaagtcaaaggataatctcgaagcacgtcttgacttggtagacctaggcatacatcaagaacttcatccaaaactggaagaagatagtcgttatatagtaccactggcttgcttcacaatgtctagagagaataaggaaactttatgttcagttattcagagcatcaagttgccttatggctatgcatcaaacatagcaaggtctgttgatatgaaaagctgcaaattcattggtctgaaaagtcatgattgccatattttaatagagcaccttctaccgattgcactgtgaaattgctatcctaacaaagatatcatgtcaattgttgaggagctatccaatttcttcaaatcattgtgctctaaggtgctagacatatctgaacttgccagccttaaagaacaagttctgatgacactgtaaaatggagaagttatttattccttcctttttcactatcatggttcatttaattgtgcacctggttgatgaagctaaattaggaggtcctgtacactatagatggatgtacccttttgagaggtaattaaatatgctcattctatttgttccattaaaatttacatattctatagtaattgatttgatcatgatatcaaacttcagatattttgttcggttgaagagctatgtgcgtaatcgtgcacatcccgaagggtctatagcagagcggaagaatgtttaacattctgtgcaagatttctcaaaggggttgataaatctagtctttccatgcccacaaattctgaacaaaaaagtatttgtttgatagttttggggaaacaataggctctgctcaagatgtgaagtttgatgcaaaaacacttactcaggcccatcgttatgtcttacgacatcttgatgaaatagaggattttcgtaggtatagtacctaactgaacattacctttaaaaaataaaatttataaaataatataaatatgctatttgtagagaatttctagaggaggagaagagaaaacaaaagaagtcagttttcacttcttttgaatctgacaagttgattaatgagcgattccatgattggctataccacaaggttagtataagttaggcaaaacaagtcagatcatgcatgtacttatgttttgtaaaattaatatgcctaatgtttaaaacccatgtttttattggttatgcttaatgcttgtggtcctgatccacgcatcacggaaaatatcataaaaatagctgaaaaaccgagtaactatggaaggagatttggtagattcttaattaatgggtttaaattccatactatttctcgtgagaataatctgcaaacttaaaacagtggtgttgttaatatatctgaaggtgatgccatcagctattatggccgtattacagacattatagagctgaactataatggagcatttaaggtcttcttatttaagtgtgattggtatgatgtgcaccatcgcgtgggtacgagggaagatgagtttggttttactcttttgaatttttcgtggggtatacacattggaaataagctgatggacgatccatttgttttctcttcacaagttgaacaagtattctatgtccaagatttgtttgacatgggaaaggttggagatgaagatgatgagatatgagttgtacatgatatattttgttgcatttatttgctgaaggcattagagttttagttatttacattcaaatatatttttaatgtatttgtttgttcaattgcttggtaatttctataagacacttccatttagtaactggagatatggagatgtgtgatctagagctatgtgtggtctcattttgtcattttaactggtatgcaatggttgtcttgttacttatatctttaaaattctaatccatttttaaatatagtgtgaatggctgcgaggtcccagacactacagggcttggatcttttgcagaatggagtgcaaaatcaagaaatagatataccaaggaatgatcagtatgttgaagaacagaacatatcaaatgagaattggtgcacaaactgccatgagtatcgtaagatatattgtttatttttctgcaaaattgtttcttatatactaacttttaaaactttgtagatcctgatggacgtattaaaagacgtcggggaccaacaaaattggcaaatgtttaaaatctttcaactggagttaagattattggcaaactggacccgtttaatgcaccttggtgacaattttt

SEQ ID NO: 63140 - DNA, 20784 bp, Oryza sativa
agaaagtcttacaatatgaaacagagggagtattgaataacaataatagttttatttttattccagagatatcatactgaattattttttatttattttgtatttttcatgtatcaacaatcttatagagatgtttttatgcttttgatagcatttggcaattccaaaaatcccatgtcagactttttttgcaagttcaaaaaatgattcatgatcattcttcacattcagtcggtgaactgataatcaattgttctttcatggattattaaaacacttaactaatggtagactgattcccttttgtacaatttgctgtgcaaataattgttgaattaccgagttgctcctatgactttttcactgtgccaaaaatgattttgtgagcacctgcgggtgctggtcctcttgaagatggcaacgctatttgtcgatctggccaaattcaaggtgggtctaactgaatgcagaccatactatctctaaaagtgcctttgagcctatagtaagccaacttataataacttatattaaatttggaatgacagtgttttctttttgtgggtttattggcccgagtgaaatctagccagatcaaggccatgtgtgattttggtttctaaataaaagtaatggttatgaacggtatggttttccctttcttctcaggattgaatctttgaaatatgcatgaatggttagctttgaatgaacatttgtactgctgtattatactattaacaagtgcaacttttcaataatgtgacttgggatttagaaattaaggattaaaagtttgcacagaaaaggcatagagaagatattggtagcatttagctaactccaatagagggatggttgtgcaacctataagagagtagttaaaggaaaattggaaattatgtgtataactctgctgcttttcgatgtcatcgatacatcagaaagtaagaaagatgaccaatggttgagatgatgaacagtcattctgtgcatggtttcaaataatcaattattttcaagttatacaaattttaatttgcaatgcttttaaatcctcttttagaggaaccttgaagcagcaatgaggtgacatgcaaaatgcattttgcaccagaacaccttgaactaaaacgggataaatttctgatggtaacactaataggatgttaatttatatatttctcaagatactgtatagtaagagcaagtctccacatttcagaaaattgtgctttccttgcaacaaacggcacttggctagtgtacatctaaaatatcatttctagatcaccatctgtatcgctcgtttagtatgattacaacaatatgcaatttcccccagcaacaaacacaaaaatttggcactgatactactatatcatcctggtttcttctactgttctactcctaggattcaagaaagccaaaagaccgttctttagcagtaacacagaaactaatcaattccacatgaacaaaacaatagtaacttgctaagatttggaccatattatcacggtttcttctactgttctactccaaggcttcaagaaagccaaaagaccgttctttagcagtaacacagattagaaactaatcaattccacatgaacaaaaaaataactaacttgctaagagttggaccgcatcatcctggtttcttctactattctactcaggcttcaacaaagccaaaagaccgttcttgaacattaataaaggttagaaactgtagtactaatcaattccacatgaacaaaactacaattaatttgctaagagttgaaacatcagttaatcaagaaaggtagattgaaccgaacgcctcacctagcaggtttcttctcggtagcaagacgcgtcccgctccatgggaacttccccacttcctctccggctctgtctttcaccttggtacctccattcctcttcttccccagcctcccggggttgccgtacaccaccttgccgcggccggccctggagaagcccaccttctcatcctccatccagtgcttccccttgccctccccttccacctcggcgccctccaccgccttcctcctggcggcggcggcgctggccttgcgctccctctcgccgaggacaagcccaatggggaagaggtcgggggagacggggagcggggcgcggagggtgacgtaggccttcttgtagtcgggcttggcggcgaggaaggggccccggcgcagcttcttgccctccatgttgagggtgcggacctcggcgacggagaagccgtacatggactcgaggcagcggcggatgtcgaccttggaggcggaggggacggtcttgacggcgaactcctgtacggaggagagcggcgcgggagggagcatgagcttgagggggaggttggcgaagtggatcacgcggcgacccagccggctccccatggctggctggctggcgacggcggcgggaggttgggtgtgccgcctgtggccgtgggtggccagcggcgggaggcgtagggttttaggatccggcgggtccgctgtctagttgcggtgtgactttagcccatatccaccgtccggctcatccgacggaggacgtttggctgtgtgttgtttcgaacgatgtttcatgcgtcgtgcaaaaaaatgtttcatcgataaaaataaggtacataaacttgctcggcgagtgtaaataggtataacaacttgtaaattgctcgttttaatacaatagcttgtctagtttatacgaacctagtacaaaacaacacacatgcaaaattgatctaatgtgtagtactaaataatcatagtgagacatatccacgctagcagttgtttgtacttgtgcagacctgagcacactagcttaattttaaacatatcagtcaacaacgatactatattacaatctcttgtaggctgcatgcactactgtaggatcaagatgtcgactagaggggggtgaataggggatttaaaactaaatgacacctaatcaaaactaacttaagttgctaggcttagtgagggtcaactctaactaagcaactaagttatgttttgcaaacctagggtgatagtggctcaattatatctctaggaaagtaaatcacactcctatgtcaatgtttagcaatcctagggtgaaatgatctctagtatgtctctagaaatgtaaattgcacaaatataaatacaacaagtaaatgagacaaggagacaagagatttttcaccgaggttcggaaactcgccagtttcctactccccgttgaggcgagcccaactccaccgctcaaccacgaagccaccgcacgcccccttcgtcaagggatgggcaaggcgggagccggcccacggagaggactacccaagcctcggtcactagggtagttcttccttcactccgaaggtggtgaactcaaaaccactcacaaaccggcgccgggcctcctccacaatcttcttagagagatcaccgggcaactcctccacaagccgtctaggaggcggcaacctccaagagtaacaagcaatgacccggcgtggagatgatcaatcaagtgccacactagctctacaaatggaagcaaatgtacttgactcttgtctagagcaatctcaaccactacaatggatgaacactaagctcaaaggtgtgtgagagaggtgcaaggggtgtatgcaattgaattgggtgccaagagagccctcttgctgctggaaggggagtatttatactcccaccaaccaaaactagccgttgggggcgaaatcccccagctctgtgctctgccggtctgaccggaggtatgtggccggtcagaccgtgctactctgcaacggctagaaaactagccgttgtagccctgtcagagggccccatcggcctggccggtcagaccgacgttgagtggccggtcagttcggcctcggctcggtcagaccgccatcagctcggtctgaccgaatacggctccgtcggctctgtatcggccaccccgagcagcaccatcccggcctccagggggccggtctgaccgcgcatgtgccgccggtcagaccgccgtttcgtggccggtcagactagccagggcacgccggtcagaccgccactatgtggccgatctgaccgcccctggtcaggccgaacccagtgaaaaaaaaagattgtgtgtgtgagatgaaatgtgagcacaagtctaaatgcataatgacctagtgtggcaattaaaatcatctcattgctaggtcattaccccccttgatagtaaggcgaaactaaaaaataaactagcaaatttgatcgcccttcacctcgatcaattttaaaactaaagcactagttttaccgttttcttttcttcgcttcacgtcatcaaattttaatccatcgatagtcatccatgcgcacacatgacgtggacctaacttaaaatatatctcaatagcaacggttagtccacaattagctcttgtcattaattaccaaaattaacaacgggggactagatgcttcaactactagagtacggattatatttttcaaaacaaaacaactactagtgcgcaaaggtgttagctggatgcatcacattagatcaattttacttgtttggattattttggcccatgttcacacaaattagtcaagttattgtaccaaaatgagcaatttacgagttgttatacctatttgcacccacatcataagttcatgtatcatgagtgcaatttactcaaatatattatatgttcatacgatttcttttacgtttcgtcagttaaaactcacggcttgtttgggaactcgagagaagaggattgggagtttacatgagggaattgatgatgagattaagatgaaaatttgatttctaatctcaatatcttatttgatagaggtggtggaaattgataaagagtttagttaaagattaggtcattaatgaaaatggatagttgacatttgtttaggcaaagtaaagaagaaattaccaccccctaccctgatattagaaaagagggagttcattcctcaattcccctccccatcccaccaaaattttcatgtcactcaactatacaaaatagttaataatcttatccctctaatctcctaatccctcttaaaaactgcccccaactaaacgggccgtcaatgttttgtagtggatatccatattatagttagtattttttaaaatattgcatttctgtaaaacatttcacaaagtggactgaaatattttgatcaagtgatgaaataattttctgtaagtggtacaacactgttttgaacatatatcttttatcaaaatgtaatcgtgtgtgatcttgttgttaaaatttaactaaaagaaatttaattgtgcaattagatttagaataaaaaataatttaaagtttactaatatgtgcataggaggagagagctcgtaagagatggcttttacgttagttgtatacatggagatatgtcagacatgtgtgactgagtctgggagtgatgcagctagtgcatgcgctatggagacaaaagggagtaggcatcaaaaatttacattaacgaacgtccgatacatggttgtgcccatgctaatgttatggttgcggccaggggcaaatccaacgtggggtgctggggggctttgagtcccctaccctcgttggatcccaatggagagaaggtgaggggaagggggaagaagaggaagatgaaaaggagtagggggactgaaaggatgaaggagaatatgagccctccctccccccctcgaaatagatctatactagggatgaaaatggtcggaaacggtcggaaaaaccctctaccatttccattttcattttattttctcgaaaatggaatcggaacggtatactcagaaacggtaacgatatcggtaatgtcggtatatcgaaaacggaaccgtcggaacgggaatctaccgatgtctgtcggaagtcaaaaattcatgtcggaaatagcaaatcgtggtatcatcccacatttaactatgtatgaagatgaccttataatttcacccttgcatgatcatgctgccacaccccacacaacaccgttatatgatgattaataagttgacaataaggtcgacaaacaatataaacaaagttcaatgatacttcaacatcaatgtggctaaagcatacaatgtggcttacatgataggattactgcataactaatattgtccgactttttttaggatatagatttgaagtcttcgagaacactgaacaccaagctcacaagctggcatggcttcagctgatcagctccttgtcaaacatcattcatcatttcatcatcaattgacatagctacatcgtcgtcctacagtggcacattgcataagaacttttatgttgacactgtataactaccattggaattaagtttcacgctagcaaagaaatgaaatttgtacttacctcaataaccaatttgtttgccataagctcagcaagctcaagatcaaccacaattgactgaatggcaacacgatctgaaaaaaaacaaatagaaatatattagtaaaatagttattgattgttgcacataaataaaatgtctaaactgttgtaattcttacctcttcttactccagctatccaatctttagtacaaatcaatgcttgtgccatttcagaatcaagacgactgcaatatggatcaacgacacggccaccagcgctaaaggccgattcagaagcaactgttgaggcttgcatagccagcacatcacgagcaagtaaggagagaacatgataagtatctttctggttcttccaccaagctaaaatatcaaatgtactttcatttgctttagtaaccttcaaagtttcttctgacaggtacttctccaaatcatttacttttgaagaagtgttatgtgtttcagcacgatatagatacttatcaagtgcactaacaaactcagttggatcttgatttgcatctggtgtatcaataggttcaaatgcattatgatttctaggaggtgcagcagaagcatagcagtcatacatgttccggatgatattgagaaattcagtaaccttaattggatgcatatcctagtgtatgaactccatgcaaaattgtactattctcatcttgaatctaggatcaagaaagcttgccacagcaagagcagtgttagacttattccaatatttgtcaaacttagcaagcatagcagttgccatccttctaatagtaatatcagaatccttgcccttactccaatcagtaagtataatcttaatgtcacagaatcctttgtaaaacaagtttgctgtaggatataaagtaccagagaaaagctcagtaagatcaaagaatcttttcaagaatgcgcgaattttcattgctttctcccactctgcagctgaagggcacattttctcatacctgcgccgatcataggatgtaagcctgtcaaaagcagccctataatagatagcatctgccaacatgagataggttgagttccaccttgtagaaacatcatttaatagtcctttggttgtgtccaacccactttcagaagcacacttcattaactcctcccactgcaacggagagccctttacagcattgacaaaggatttaattttctcaattgttgattcaatttcttgcaaaccatctttagcaaccaaattcagtatgtggcaggcacatctaaaatgaaaaaacaggccaatacatactaagggactgtgcttcttaagttcagaaattatatccttaacagcaacaaattatatccttaacagcaacatcatttgcagatgcattgtccaaagtcaaagaaaacattttcttctcaacaaaccatctcagcatacttgtagtaaaaccctcagatagtctaacaccagtatgacgtccttccacatgggaaaaggtgacaattcttttctgaatacaccaatcatcatcaacccaatgcagtgtgatgcacatatatcctttgttttgattggatgtccacatatccatggtcgcactaatgcggcatttcacagttttgagatattcatacaacttatccctttcctgcatatagatgctcaatatttcttttctaactgttacacgggatttcaatggaaagttagggcgcaacgatgtaatgaaatcacgaaaatattcatgcccaaccatattgaaagggtactcatgcatgattattgccacatataacttcctcaagctagcttcctcatcatacttgtaaggttcaacaacgttgatgcccttctcttggtccttctgagctttgagttgttgctgccctttgacaacactgtgatgtaatttcagatggctccaaaatccgcttgttccagtggcactctcacatctacctttgtaagtgcaattcttgaatttgcaatgtgcccactcctgtttatagatcttaccattctcatctatactcactttttccttgttgaagtactgccagacttctgatgtcaattttttccttttcacaggacgctcatcattgtcatcaaccctattaacatcagcatcaatctcaattgtttgtgaggtacctgtggcaatggttggaggtaccgctgattcaggtgtagatgatgatgcagtcacacccacatgatgacttccactggcacttccagatgcagcagattgagattttaaaaaaatgaggaagtgattaacgattaacacaaggctcaagctatacatctaaaaaaaacatgctcaaggattaagctgtacatctacagaaatcgtgcttgcacacatcaacagaaaatcatgctaaaaaacatcaaggctcaggcattcatctatacatgtaaaaaaatcatgctcaagcattcaagctatacgcctatacggctatacctggtggtggtggtggtggacctagcaaacacaacggtggcgaactcaatgttcctctgtctctgttgttgccgtcggatggatccagaagggtgcggcgttttcctccggcaggtgccatcttgcttctccggcaagggacgcggcgaggcgcgaggatgcgacggctaggactagcaagcggcggtgtggcggcgtggacacgtggttgcggcggtggcggtcaccggaggtagaggcggcacagagctgtgcgacagtgtgagacagcgagagtcgcgagacagggagagtatgagaaggataagtgacacgccggctgacgccctagggtttttcttcccagcctaaatgcctaatgggctgctcctgctccagctatacaggcccagccggcttccttctttagaagtttgtcgaaaatttgacggaaattaccgataaaaatggttaccgacaaaacggtcggaaaaaagcccatatcatttctactaccattttcggaagagattactgttttcatttccgataccgacaattactgataccgactgaaacagtcggtgcaaaccggaaacggtagccggaattctcggatatttctgtgccgttttcacccctaatctatacgatagttgattccttagttctacttaaacaaggggatatctgaaggtataaatacaaggccccctagaaagagagggacgaaatgaaggcatatctacataaatccaatgtagaagccacaaaaaccgacatgagggatttagagctaccttcaatctcgccgagttcatattagaggaagaagactacactagccatcaaccacatgtgagagctccatgccgctaggccgatagggattagattaggtcatcccatattctgtactcgtgagatattaatatacaaaggcaacattggctttgcccaacaggaacagggctattacccatcaagtagtgggtccgaacctatataaaaatccatgtctaatgtcttttttacctcaatctcacgtataccctaacaccaacgatcaccattctctttgaataccataggcgggcatagtctgtcagcaataacttgtatgtaactaacaaataatggcgggtatccgatttgctagcagctttgcactgaaaaatctcaaggtcgtgcgcttgaatcctcttgcctgcgcaataaatctagcaaaaaccatttgataaacctggctaacatgcataaattgcatatgatgtatctaatacattttgttttattttccacatattcgttttggaggaattttaaaaaatttaaatttctaaagattaattcctataaatgctgttcggttcataaaaatgttgacatagaaaaaccaaaagaaaaattcctttcctacaagttgtacagaaaaactataggaaggttttcatccactcaaacctcttgaaaattttctatgggttgaagtgtgcatacattgttgatctttttttttctccaattcctttggaacgacttggcccttgctagccaagtcactttgacaccttgacccgattcaaacaagggttaattggatacatgccattaaaaatttgctggttttaaaatataccactagtattcatgtatttgaaaatatgccattgtaatttcacacatattcaaaagataccactacttacctcttggatgcatttccagaaaaaaaatagaccaaactgccccttttcccttcttcttctttcttcccctttctccttcctcctctcttccttctcagcggcgcgttggcggcagcagcagcagatgcggcgcggcgacgacagcagcagcagtagcagcatcgatgcggtggtgcggcgacgagcggcggcagcagcagcggcgtggcacagcagcagtggcggccgcggcggcagcagctgcaacaaaaggcggcacggcgacgagtggtggcagtagcagtagcaacatcgacgcggcggcgcggcgacgagcggtggtagcagcaacagcggaaccagttggccatggcgctctcggcgttcggcagcgtcgccgcggggctcgtggcagtgccggtcactgtgttcggcactggcatcgacgaagccgtgctcgccaaatcattcaagaccgatgtgcccacaatccagaagctcaaggtgaacctgagtacctgactccacccaacaagccctaattaagcacgcttgctaatcttctctcgccattgtcgagtggctgcagtagtagggccacggcggcagcaatgagctgtagcgacggtgagcggcggcatcgcgagcagcattaggagtggtggggatggaatgagcggcgcagcgaggggaaagagttgaggggtagaaaatggggaagagagagaggtagaagatgagagcattttcattcaatacatgcaaaatacgtatctcagtgacaccactaagatttcaaacaagtagcagtggtatcgttacaaatatagacaaatagtaatgttatatttcaaaactgctaaaattttaatggcatggatctaattaacccttcaaacaatgccccttttcccaacccctttctctcgttttccgcgcgcatgtttttcaaactgttaaacggtgcatttttttaaaaaaaagtttctatacgaaagtagcttaaaaaataaattaatctttttttaaaaaaaattagctaatacttaataaatcacacgttaggccatgtttagttccaaaataattcttcaaagttccaactttttcatcacattaaaactttcctacacacataaacttctaacttttatgtcatatggttccaatttcaaccaaactaccaattttggtgtgaactaaacacggttattgccccgttttccaggctcaagcagaaccagcgaacacaccgtccttttcttacagaaaaagcctgcaaaactgcaacaaagtagtcctccaactccaatccattaatctcaaccgcatgtaaaagcacattcaaaggtcaaaatatgacaggttgctttacatcacgtcagtttagcctttaatttaacgttatctgttcttccattcccattaatccgccatcaatatggagcttttcgttaatcaactccaaagctaccatctcgtccgtccgatcggtacggcgatcatcgtccaccactagatcgatcagtgaggcagagacctctcaatctctcgcgtccctctcgctctcttcccgctattcttctcgtccagatctggacgtcggagcaccgcccaccgctcgtccccaccgcggccggtgcctcgccggcggccggctcgcccgcactgcctctaggtcgtaggagcactgccagctcgccagtgcggccgaagagcggcacgcactgccccctcgcttctcccctcctgccctctccgcgcacccgacatcgccgccccccacccaccacagcctccacggccgcccaaatgtcggacggtgaggagaagagggagatcgccgtctggttcctctccaacgcccccgccggcgagatccactacgtcgccaaaggcaatccccccaacccctcttcctgaccctcgcaatccaagctgtacagccccgtgtgtttcgttgtttgattcctcttcggcgtgggcgcgcagatgtgcgagcgctgctgggggacgaggcggtgtacgaggccgccgcggcggaggccttcccggagcacaacaaggcgcacctcgtggccctcgagctccctgaccgcagcggtgatgtgagcactgggccatctcctctccttgccgacttttgccgtcgcgtgttctcacgtgctcgaaattgagtgtgttctatctactgtagggttgtgcttgttgtagctcgtaaatcagcggttaagacttagcaaatctggcttttaggtagtgattaataaatcacttgtggctattgtgtttgttactttacttttattaaattcagtaagctattggtgtttctcattggtatgtttatgagcatgagactataggatgatgccttaacactcgagggtgggtgcttgctggccagacattaaaacaatgtgtcctcgcgcgcagataattatcacaacttatggggagcttgacaagaacaattatctggatcctaggactgctcaagttgctacagtggaccatattaaacaggtaatgctgcagactttacatctgcttatcctggatttagttcttaagccagctatgcatatttaacatagaatcttttaaagtaagagaacatatataactactaaacaatggatggtcatcttaacttatggtctatgaactatatgaagcagtttcacgtctgtaatttaatatgcacagtatcttgagcttgatggtttgactattcttattcatttgatgaatattaattgagaaatggatccaatcacaggatattgatactgaactatctttcttgaagaacatgttacattgaatatagtccacatagattagtattgtaactgaactctgcatgtaaaagtttgatcccacaagtttctactttttttatttacagtgttaactgaggaataaattatgaccataattatgaattttctggacatagattaagttacctattttcaatggaatagcatagatgtaggtaaaagagcttttcattatacctcaaatagtacatccagcagcagctgtattaagcttcagtaactagtattacaggtttctgcccaatccattttgtattaacttgtgttacctctagacaatggctttcattctctaacaccgggttagattgagatgtttggttaagtatttgtttttgaaatgtctatagttttctttgttcatttgaaacatgatgtgtctgctttaatttaagtcaccatgttttttgttttacatgttaaaagaaatgtacaaaattgaggccagctgctgatgaggagcttccttcagcatacattgaagatttcaggtaccataattatgctattcttttccccaaatttcttgaactccacattgccttgctagtcaatttatgttctgcaccttttgttatgggtgcaggagtgccctggatgttgaattatccaaatatgttggtgaagcttatccaaaaggggtgtgtgctgtttattgtaccagcggaaaagatatagagggaccaggagttgattttcgttttgcagcagttatttctgctgctaaacgcagcccacaaaacttttggtatgttgtctgagtctgcattttctctgttgttacagatacttgcctagttttctctaatcttgaacttgtttatatgtccattttgtgtatctcttctatacattttagatccttattgaggtttctagaaaattttggcattcctatgagaagctatttcatattcaacttctggatcataggtttgcacatctgtgagtgtttaattctttattttccctttgaactaatcatgtgttttgtgggtaccctctttatcatcttcccacaatattatggtgtctttagtttttatgcagaaaagtttagaattgtgctttggctgaatccttgcttcacataatctgttactagagtcgcttaagtcctctcgtcatagtttgacatttcattatttattcactgatggagacaactttgtattgagtcatccagcaacggcaattggcgctcaatttggactctggaattcatagatggattacagcttgtcgaaattaaagggaaaatacaggtttgcttttacttagctagcgctaaaacatggttaattattgttattgtaattgaagttggtaactaagatacatgtgcatataccaggtaggtgctcattattttgaagagggaaatgtgcagctggatactaacatcgattgcaaggattccaccatattgcaggttagttcatacaatacctattttttttatcctggcatgttatgaacgattgatggcatctgcttcttttgacctcgtgcagtaatccacacactatttcatcgtttgttgttttgctgctttaggtttacgtgctaagttcattctactgttcaatatattttggagaaaattttctcctgctttggtatgatttgctactgagttttagagaattatatatacatgtataccctgtaaacttagttgcgcatgcataagtatgtgctctgcattcatggatgaagtacagtttatgttactgatagattttcatagaaccttaaaaaatttatatctgcactatgcttaattgtgttgggttggtgcctgatactttgagttgttgtcgatattctattgatgcaaactgttaaaacaaacaaagttgaaattttatttatcctttttatttcctggggtgaactgaaaggatcaacttatgattgagtagattttttaatataaaaattgcacgggtaaattttgcccctatttcatttcctttttggttctggagtttttgcatgtgcttgtccggagcatttgtgtatgttaagcgtaatgttttgtttagagctgcattatgcttgcatcattttgcttgctttgtttttgcttgtttttaatcttcaccaggctgaaaaatgcgaaacccttaactgttcttttcatgtgctattactcgtgtttcagtctcctgaggaatgtgcagtatcaataactaacatcattcggcatcatgagtcagaatatttgtcatcacttgaggttgaaacctgtccctatttgtttattcaagcttatatgttaacataatgagtaatgccattcttttcacttgtgaacaggaatcatacatgaatttgtctgatgcaaccttcaaggtacaccaaggaggcagtaacaatttaagaatttgcatgatagttataatgctagtaaattttgttgctacttttacctatcctctgctcagttgtgtttactggttatatatgtgcacaggatcttcgaaggaaacttcccgttactcgtactcttttcccatggcacaacacattagccctcagccttacaagagacctcaccaaagaactggctataggaaaatgaagcttgtggaggtcagttcattagattagctttgatatggatttttttttatctccatgctatgtgttgttctgtagatcctgcaattcatatcctgtagccagcaattctcttgttttgatttctgggcttccacatatcagtgtaaatcaagaacatgcacttcttgtgaggaagttacatttcaagaatatatgatatctgaatgttgactgtgtcaactcatgttaactcttgctgccgtcatgaaacaaaccgggcaagcctaaatcgattctttgagatttgttgtatagaacattggtattatttgcttccgaaatagtggggtttcctgccaaaaattactgtgtttttacagccccattgtttcgcttattagcaaataaagaatcttttgtgagtaaaatttttatacttgtggctttagtgactcaaaagcaaatgctataaaataaactatgatgaaaaaaaaaaaccaaagaatcataatcaaaattaagtttaaaattcaaattttggcttataaacataagtataagaaattgcaggttttagggattagccatttattatcttttcactgccgccgaggtgctgagccaaatacgtcaccacaccattgctgctcgtacggacggtcatacgtcccaaaggctcaagcctaaacctccaacgatcgtcctgcacgattgttttacccaccatttgttttggtatcattgggctgggccatgatatttgcagcggtgtcaagcatccgacatcaacggcggctgcgtagattgcatatctcggctgaggctctgccgtaatttcagccccgtgtagctatgccgttaaaagcacttggctgaattcgaggttaaacagttgtgctcacagtatgaagttatttttgtgatactgtgtgatcaaacaattcagcatgaatgcattgatctcatgaaattgaaaagatatatatcctgatgagcaggatgaggctcgtagcaaccagcaagctaggatcacagggaacaggaaaacaatatgcttttttcccctttaaattcacaagatttggtctcacacaagttacacacgaatcaaatgagatattatcagacaagctcatcatatcgtacaacaaatatgtacaactccgaatatgcaagcagagacacgccagacggccggccggcgtcgttcaagcagcagcggtttccgggtaaggatcggcccaggacgcgtccgccgccacggcctccttccatctccggttgaatatctgcatctcggcgaaggatcgccgcctcaccgcgatccggccggccgacgccgaccacccgccgccgccgccgagcgaggggatgcccctgtgcatgacgtactcgctgtcgacgacgccgaccttcatcgtccggtcgccctgcgcgcagtagccgagcttgtagtcgaggccccacccgtggacgagatcgttctgcaccatgccccaggtgcaccgccacgccgcgcgggagaacaccggcaccatcctctcgacccaccccgtgcacggcggcgccgtgctgccctcgtcgcaccgcggcctggctcgcctgtagaaccgccggtgcacgtcgccaccttctcctcctcctccggccacggtttgtcgggcggtgatgccgtggtggatctccgagccgcgcgccagcgccggctgcgagacctcgagcccctccctcctgacgatggcgaggtagcgggcggggtcgaaggcgtcgacctcgacgtcctcgtcccacaggaagatgtagtcgtactcggccaccacgtcgggatggaggaaccgcttggcgaaccaccacttcgtctgccccgccgccgccacgtgcaccgcgcggccgtgccactccaggtcgccccactactcgaccgcgccgtcgtagtggaacagcatcaacgcgaactcctcggcggggaacttggacaccagcttgtcgacggccgccttgttcttgatcccgacggggatcgccaggaggctcttcgacgccttctgccgcccgtgctccgggtcgccgaccatggactccatctccaggttcgactcgccctgcacgatgcccctcgggagaggctcgctacggccgccgccgccgtcgctcgacgcggctggcgcttcagctcgcttgtcgtcgcgcagcatcttgcgcgacagggtgatcttctcggctgccgccggtgaagtcgacgggctgatcgggcgccggtccttgtggtgtaccgtgacggccgcgccggcgacgaacaggaggacgagaaagacgagcgccgccaccaacatgtgcggagtggaccgcttcatctgcggccgcggcggcgacgagcccatggctgctgtcaagtaatcgtcgccgctatgttgcaccatgattgccatagagtccatgcattcaactttatactgaggatagggtcttggaggccgactccgaactggacacgtacgacgtacgcgacataagctgactccgaacgggatttggactactcttaagtaatcgactgataattctgtcaaaaaaaaatcgactgataatactcgccatcggtataccgatcgctcgattattatcgggtgctccaataacaaattaagcaactgctctttccactccattcatacgtatctcgctctaatttactttttttccctgagcttatttttttgctttgagaggtttgtcaaaataatctttctcctaaattatttatccaacatacgatttgattacaccgttatattcgttgtaattaaaatctttacattaagatatcacatgatcatattatgatgaaaaaaaatatatctttcaatccatcaacactcgatatttcatatgcaatagcaacatgttttcaatgtgtgtttcaccatgttttataaaatttacccaactagctacttgcccctactctcacctctctctccactgcatccatccatacatgcatacatttatgatgctcaaaacaattttttttctcctaaattacttatccgatctagtccaatcacacgttgtatttcttttaattcaatttttacaaccagatatatattccatgattatattctaataaaaaaaatcatatgtttcaatctgttaacactcgatgtttcatacgcgatagcaacatgattcaatgtctttattgtgttccacaaaatttttaaatgtttcattttttttatcaaatataacttaatgttttaccgatggtcaactgaaatatttgaccgtccttttctttgacacaatcggacatccgatttggagtttcctcctaaattgactactaaaaattagaaaaagtaaattttattttgggtcaaatttattggagtttcatgatagaagtaggtacaaagtactgcctctgttcacttagagcgtatatattttgactgctcatttagaacgtattttgatttaaaaagaacatttggaatattttgaccaacactaataaaattacaagtatattaatttacttacaaaggtgaccaataaattctcacttcaatgtgttttcacacaatattgctttcataactatttaagatgacaaatcagtggtgaacgtttgcccttgaagatgttttggaatcaaaatatgcgttacaacaggcttgctaactttgttgctaaactcgtattaaaatttctaattctattatatgaaccaagggcttgctaacactactacgaaaaccatttttcgtggcggccattttagatttttgctggcggaatttgcagccgacacaaagcaaaggccagtgaagatcaagatcttcgctagcggttattgaccgccagcaaaaatacattttcgctggcgttggcttaagacggctgccagcgaaaatggatttttgctggcggctgtgttaaatcggccgccaacaaaaatggatttggggaacaaaaaaacacgcatgcagctgcccagccgccagcgaaaatacccatgtagccacccattagttcattaattttaaatttcaaatctacatctagattcgctgctcatttccaaattcaaacacgaaatacaaaatcatcatcagcacagatcaaacatcatttacacaatcaaacatgatctacacagatccaaacatgtgcatcatctggaacaacatgcaaaaagaaaaagaaaaaaaaaatcaaatctagccgacggcggagcaaggtcgacagtggcggatcccgcctccccgcggcccggtggcggcggatccggcctccccgcgggccgccgcccgctcccgagcgccgccgcgcccacgcccacgcccgcgccgcctcccgctgccgtcacccacccgcctaccgccgctgccgcgcacccgcatcgcgtcgtcgtcgccacgccgaaaccgccgccgccaactatggggtgggaggagctagttagtgaggatggatggcgccggcgccggtggagaagagacggaggagagacgcgagggagagaagggagggaggggagctggagagagggggcgggtgggtggtggactggtggtggtggtggtgggccgcgtggtctatattaatagatgatggtccatctatgcaagcggtccttctaccgccagtggttgcttaagtgggccgccagaaaaaataattgcattttccctaccggtctgtataacacgaccgctagcaaaaattatccatcttcgctggcggcacacttaagtgaccgccagcgaaaatagacgggctgca

SEQ ID NO: 63141 - DNA, 9946 bp, Oryza sativa
caactttgttgttgatgactttttcacttgatatcatttagtatttaaaaatgttgtttgaagttgtcatatttccaaattcaaattcaaatggttcaaaaaatgttatatagaaaaatgaccaaaataaaagttatagattttgatgagttatacaactttgttgttgatgactttttcagttgaagtcgttcactgatctaaaattctatttgaacttttcaaactttgaatttcaaatttcaaattgtttaaatagagtcagatggagaaatgaccaaaataaaaattttgcacctcgatgagttctacaactttggttttggtgacttttccatttgaaatcatttaattaccccaatttaacatcctggcctagggcataataggattaatagaatactcatactaacatgttacaattacttttctggaagccaatctctaaagaactttgacgttaagtgtgcttggtgtgcttggtctcgagcaatttcgggatgggtgaccgatcgggaagtacagatgaggcgctagttgtgacccgattgagatttgactggtcgtctgggtcaaaactatcggtgacgggctttacttagggcccgattgagatagaatcatccgtaacggccgtttgcccgattgagatagctcttcacatcagtgacttctagcctgtgacggacgccatgcccgattgagatggggtttaccgcccgattgagatgagggtatccgttctagtgatacctatggttttctgcaacttaaactataaaatgtggggttttcttcagtttactataaaaacaaggatgataatttaaaggtgatgtttatttttgtttaggggcgagcatgagataagaagaaagatccctaattttcaacattgttgaggctagtttgattatcacactactcaaaaaaggttattgggtattggatttcccaacaagcacccaacaggcgacaccttcgaggactcaaaggtgctggtctaggaactggcacctttgagattctaggaataaaaaaacagctcgatgcatcgactcgaattgagccgcttctcattacacccataccaccatcgatcccgaaacatccccaaagcagcacaaaccaccatcgatccatccatcaacacaacacaaattacaaaacacaatttcacatagcacaaatcgatcgatccaaaaaaacatccccaaatcacatagcccaaactgcacgccacgggagccctgatcagccgaaggaaccgccgtcgacgccgcgcctcctgccactgcgcctcctgccactgctggatccgccgcggcagccgccaccaccgccctgcccaccgctgacgccaccgacaccgcatctgccacgggagccgacaccgccaccgcctgccgctaatgccgcccaccggatgctgctccacccgccgtctctcacttggccaacggagaggggaggaggagttatgagagagagagacgaagatataaatcatactcttccgtcaagaaaaaaaatcaatagtccatacctagatttatagtcaggaattacgaagggtgtagttatgttattccaatacaaagaaattagatataatttagataaagtatgagagggagggagagagataaaaggggtggaggtgacaaagagagaagtgagcacgcgtagctccaagcataggcatcatttatgcaaggaaccaaccacgtgtgctcactctcttctgtcaccctcctagtacgagtagatatcaaacctttcatggaactatatatccttgcacccgtgctacatcattcccctatctatatatccatatgtgcatggttagacatacatttgaggggtctagcttgttagttataaatggatgatcgaaggggtttatatatagctagagaaaagttatttctcttttatgtcctcttgttaaaatactaatcttcttttttttgacaacaaatatactagtcttcaacttgtacatagcatatgctaggactctaggattaattagtggtgtttaagtatataagtatataacggtcatcggaagtcatcatcattcctaaagtactaaagtaatggttgggtgtgattctgttttgatatatatctctatctctactattataaaaattgaagatgtttttttggtattttgatacgccctccgtatttgagttagtttttaagtccgttcgcttttggaaatacaaattcgtgtttgagtcggattttaaatttatttgctgttggaaatataaaagaagtcatataagaaatatctttaaaaaactcgtatgctaacttgagatgatagtcggcctcctaattgtagttcatgattttctaaaaaatatatatccaagcgaattcccaaagttaatttcatcctagctaagccgtataacaataataagattaaaatagcattcactcgatacaacgtacgggtatttttttctagtatagtattaagattcacatataccccaattatttcacatttattcccaagctcgaaccattcgcgctcgaaagcattttgtgaattaaattctatcgagtaggttgtgcaagggtattcattccaagggagcccataaatatatcaacatgcatgagccgttgttgccttcgtcatgcttatgcaattttccttcattaatcttgtcatccttcgaaactatacttttgattttaaatcaaaattaaatcgcactcctggtataaaaacttgcatatggtgggtttcaatatatacaacttacaaattacttattccgatacaatggctaacttagctagtccgtgagagcataagccaagacggtcatcacaaaattgatctaggtgaacattgatgacatggcaggtacgaccatgttttgaagatcttatttagaatcgaataaaaagataaattaactgtttctttttcatgttttggatagagaataaaataaaattattttatgactttgggaattctgatcccatatataacttgtccgatgctcatttttgtgtagaagaccgatacaatttttatcatgcctcagtacaagtaagtcttgaaaaacattttgatttttatgtataaacactccattttcatcgaattttatggtcagtctaaatcttaaaaatatcatgcgaatagtaattattgcatattttgtcagcctaagtttgacgtgtaataataattacatatcagtgtgcgttatgttaaatcaattttgcttgcatggatcatttgtgctcaggtttgtacaaactagcttgcttgttttttaacatatcagcacacaccacacaagtaaataatttacttataaatcaatttaagatgcatataactcatgcaacaagaaaattttccgatcgagccactgcaccttcctttatatttttaataaaggaatctttattgatcttagataattatatcaagatgatacaatcactctaaggttgtgttctttgttcagtgttcccaacacctctccctcgtgttccgtacacacgctttttaaactgctaaatggtgtattttttgcaaaaaagtttttatacgaaagttgtttaaaaaatcatattgatctttttttttaaaaaaatagataatacttaattaatcacgcgctaatggaccgctctgttttccgtgcgcaagagatggattctcaacccatagaaaagaacacagcctaaggttacattcggtctctgcatagctaggatacgcacgacgtaaattttttttaaaaaaaaatgatatggcaacacatgttatgccacagtgagctacaatcaacagagatctttatcctcatactccaccgaagcaacactaaaaattatgataaaaatacccttcaaaaacaacgccttcaaaattaaataaacgtgaacgtgtagccgttgccatgattcaatcaacaaaggtcagactataagttatttagaaaaaccaaccgacaaacgtacatgacaaagaaacaaggatgctatcatgattttttcccaaggattttacgatgattttgcattctcatataacatcaaaactgccacagcgtatgtactttagattgttgatgtatataatgacaaaaatagggactcgatttcgttttgagattaattcgattgtagggtcatgttgaagttgttattagtagcaacgggaagaggactggcttcatccgaaatgcattcggtttgcagcgcaaatttttaaagggaaagaaaagaaaaggagatagtggaattgtagaaaggatgaagaattagtgctcagtctcttaatttggtaattaactttgtttctctctgctctgtcgtatagatattggtcgtttctcctttgaagctcactttgtctgttccaatatgcacccctgatgagactagacgtagaaagttttcttccagaatcgaatactagtatttttctttctattttttaatgaattttttatttgcacttgtgacagacagttcaaagtttccagacatgaccaaccatttggcggctcaaaaagagaataaaccagatatgggtgttgcacaaactgcagtatttattggatatatagtgaggtcaatgagcactgtgcgcatcattactgagtcgacaagctaatttacaagtagattcttattccaaccaagatgtgacattagccaaactaattaacgtgtcttctttttattccgggaaataaaagtatcttctctatttccattaggagaaaaaaacttgagctactcttgacttgcaacacttaaacattttcagtatatagctctgtcaatgatgaaaatttgttctctctccatttcagatccatttcaggttataagatgttttgattttagttaaagtgatggttataagatgttttgattttagttaaagtcaaactactttaagtttaactaagtttaactaagttaagtttaactaagtttacagacacatatagtaatattatattaccaaattagttttattaaattaataattaaatatatttttataataaatttatcttgggtaaaaaatattaattttttctataaactttgttaaacttgaagcagtttaacttcgaccaaagtcaaaacatcttataacccgaaatggagggagtagttgctataagccgataatcattacgtgttcaatgatcgtgcgaatttgtcataagtgtggacagataactaatatgaccgcactagtttttttgtttattcggattttggtgcggttttaatttcatccgtgttgcgtttctggtttggtaaatttggaaatttagttttcttggccttttttcgaatgtatgaattgtaccaaaattatatagagctcatacacagaaattactacatcgttttgtaaacactgacctcggggtactatttgttgggaaataaatttaagagagataagtttattgtgcaccaatctgaatctcagcataaaaataaaattcaggcaaaatttactataagatatatatctaaaatttatgatctttgttggtggactctgtaagaatgtggcacggctttaacacactttaaaaacttggtaattataacgccccacaaataattagagaaaaaagaaaaataagaaaagaaaagaagagataaaaaaaagagcaaagctagcagaccagcagcagcagcaggccttggccggcccatacaagcaaaacagcagcaggaatttttttcatttttaattttttttaatatttacagaaataatctgtcggcgaaaaaaattacaagaatagaccttgacgcccctacagagggcggtaagctgacgtggcagacgggggagggacgggcggtgacggagggaaggttttttgcaggaaaacccttgccgccccaacagagggcggcaggcctcgctgcctataaaaggcctgccgcccctgcccccagccctcattcctcccctcacaactccagttaaaaaaaaaagagaagggggaggagaagaaaagaaggggcgaagccctgctggattcagacaccgatttcagataatattcatagatcctatatgtgactattaagttaactactgtgtattttttaaaactttgtttgaataaatgcattatatttttagggttttagttgtactaatctagaactgcgtattgtagatatcggtaaatacgtagatctactagtttgaaatcaatactttaccattacattggtgtacatgagaagatattacgttgtaggtgtttattgcatgaaaaaataatatgatctagttatttcattgacagatatgtcgaacaaacaaatatttcaagtttaccatggcccaggaaacgtccattactggccaactggggtagatctgtcagaatttattgtatcagaaaggggaattgatagaccagcagagaggagtgtaccttctataaaaggatggttgatgagtggcttgagagttgatccacagactagtgacataacaatcaatgttatagtaagtcggacaactgagggtttttattgggaactaatgccagttcaaaactctcgaatgtggagatggtatgtggagaatgcattgcaacgcgggtggcctctagctatggttccgtttgttcacccgaaggatccaggtgtgcagaagaacatggatgatggcgagggaccaagtgctgaagtaaatgagagttatgtggaagaggtcaatgcacgagaggaagggggcgccgagaggaagggggcgtagtagctccagtgggcaatcaacccggtgatggagtggccgatgagggggagactgtcggtgccattgtggatgaaatggagagagaggattctgacaacgagcgtgtggaggaaggtgattcgtcagatgatgagacggatattaatctagccgaatgggctagtcaggatttttctggtctggtcgtatctgaagagaatagtgtgagatgggagtacaaagaaaataaggttattcagagagcgatttataatagagcagaagatatgaaggaggcggtaaagcattttgcagtgtcacttcatagagagttttgggttgccaagtcgaaccgaccacaatatgaagttcggtgtgttaaggaaaaagatcgttgtccctggagagtgcacgctaatatcaatattactactgtaatacctccttgtcccattactacatcgtcgttgtgttcaactcttgcactacctccctcctagttcgaatctaatatcatctatgtaaccgcaatggaaatagatgtatcatgttcaaattcgactactatttcttcatgttacataattctccttgtttaagtgcatataatgtttctacgaccgagactgcaataggcctatatcaatttcgcacactaatacgtcgaataagttacaaaataatatttcacttaacatatgaaattgcgaaacaaccaacttcaatacatttttataacattattaacaagttttaccaataaatacttctttaattattattaacgtaacatagaaaaatcatttggctggtaaattttgcatctgggtcccttgccgctctagcagagggcggcaagggacctcaatgcaaaaaagctagccccctccacaccccttgcatccaattttgtatctctccgcggagttgcaacctttttatttttattttattttttgatatttttttcacgattaggagcacacaagaaccaaccatagaaaaactaaactcaaatggacgaaatatgtgacgtggaattttctaacccctctcccctctagtgtagaggagagagatgtgcaacttttttatttttattttatttttttgatatttttttcacacttagaagaacacaagaaccaaccatagaaaaaataaactcaaacggacaaaatatgtgacctgtagaattttccaaagctctaccgaaaaacttctctcctaaaaaacacaatcttgcaagtggaatttggaggttttaatatcgccgaacccggtgaagcggggaagaatcggatataactttttctgtagatatccgtggatatattatttgcctgattccgagtccgtaagataaagttacgcctgttttaataaatgacactcgaatgacgtctattttcggtagagatttagaaaattttacaagtcacgcatttcgtttatttgagtttattttttccacggttgatttacatttaaataaataattctttaattattatcaacatatctggaaagaagcatgtggctgttttgcatctgggacccctactagagggcggcaagggacccagatgcaaaatgcaccagccaaatgctctagagggctgggaaaattgtatttagccccttgccgcaaggggctaaatgtaatttttccagacggcggcagacggcgcggtcaagtcgccgtctgccacgtcagcttgccgccctccactgaggcggcaaggtctatttctataaatttttccggcgatagattatttctgtaaatattaaaagaaataaatttaaaaatgaaaaaacttccagcagcagcagtagcgcggcggcagcagtgctacagtgccatcgtggaataatcccacctcaccaataggaaaggttgactagtcactggaactctgattttggaatttttttgttaaatcgaggacgaaaaacgcattgagttatactccctctgtttcaaaatgtttgacatcgttgacttttttacgtgtttgaccatttatcttattcaaaaaatttaaataattatttattcttttcatatcatttgatttattgttaaatatactttcatatacacatgtagttttacatatttcaccaacttttttgaataagacgaacagtcaaagatgtgctaaaaagtcaacggtatcaaacattttgaaacgaagggaatagcagtgttaggggtgtgtttagtttacatcaaaattgaaagtttggttgaaattagaacgacgtgatggaaaagttggaagtttatgtgtgtaggaaagtttcgatatgatgaaaaagttgaaagtttgaagaaaaagtttggaactaaacaggaggtgtggttatccaataccgtcactctaatctattagcacaattattttattacttttgagctaaatataaaaaagaaacatgccaaaaagatgaaaatgcctctcaggccacgagcatgtaaattgcttgggaggagagagattgttaactgacatctacctctacaggaaaggaagtcttttttttttaaggataacaggaacaactttattaaacaagacagaatttaggggatacaccccagtacatcacaaaggatatgatttaaggcaataatccatctctaacagggtagaggctaaccaatctaaggaagcaaatttcctgatgaaagtaaacaacaatagaggatcagatcgatagagttctgcgacaaagccatgacgactgaatactttggcctccattgacatgctcgtcgcttgacaatctggaagactcctacagctgtcaccacgaaaacggtatagatcgaaggtttgatgctaagctctagattttagtttaggtatcactggactcagcaaattggttctacggattctgtcgttagatctgaggagcagagtttgctcaacctgaacggtagaccttgcaaggatactgtcgttttgaaacaaaaggaagtaaaatttagaagaacagttagtcaacatcacaggggaaatcagatgttgcgataaaacttgtctttgtagaaggcctatgtttgctatagattcgtagtactgaagcagagtacgacagacgaagaggagcaagctgccaacaaagaagtagccttcagat

SEQ ID NO: 63142 - DNA, 36711 bp, Oryza sativa
tccccttttcctcttttctagcgttggcaggaagtatgcggcggcagcagcaagcggggaggagacggcggtagtgggcgcggcggggagcttgcgtcgcgcggaggccggcgggcgcggcgaccggaggcggcgggcgcggcgagtagcggccggcgggccgtggcgagcagaggcggtgggcgggggccggcggccgcggcgagcggaggaggaggacgacagccgcgtgggggccggcgggctgcgccgcgcggaggccggtggtggcggcgagcggaggcggtgggcggtgctgcgcgggggccggcggcggcggtgagcggaggatggcagtcgcggcgagcggaggccggtggctgccgtgctcgagttcctcgtcgtgctccttctgtgcttggttgccgtgtggggatggaggagatgggctctgtggggcccaccattggccagccaaatagagtggccaaatttggctaatggagagagggttttggccagccggttggagaggttgttggagcacttttttttggctagaatggctaaaatttggctaggagagtgggatggagaggctgttggagatgctctaaccactaacctaccgctccatataccaccatcaccagaattggttacaaagtcactcgacttggaagaggaacagtggtggagtcaccagacttggagatggatagagtgggggtccaaattgaaaaaaaaaggtaaagttagctattgtgtacatgaaaaaaatagttaaaggatgatataatatgaaaacttttaagaatacatagtacaaattgtaatttacttttttttgtctagcacaattaaatttgagttatccattaacaggtagtctcgattcaattgtgatcttcttttctcactgcatgacatatgatgactatctcttatcactatgtggcatggttccaacaaacccataaaactatatattggtatttccactatattgtttttttaatttttacatatatgttaatttggactaatatttttctcataattgaataggtaataaatatttttccatattttctataaaatgtgaataatgcatagtataatttgaaaattatattataagtatatgtaatttagtgttaagatatggacttgtagtactaaaactgccgcaccatagtagataggtagtcaaatgaacaaccataacataaaaaatatgagagaatctattgtgtgccactgatcttgtccatgttctacaatataccactaggtttgtcaagttctaccatataccatcatattttgcttaacttctataatatatcatcgtcgtccagttagccttcgttagtacggtaaaattttgtcttaatgatcgaaatacccctggataaaacttccaaattttgatcaaaatttctaaaatattagattgtaaaacttccaaaatttgagacggacaacttctgtgctagtttacaatatgatattttggaattattggccaaattaaaagggggcgcccaaccccttcccccttccccaggtggagttcatcgggaacggggtggggcagtagcctcctggcgagcgacggtgaccgtgcattggaggcacagggtcaacgtcaccgtcggtggagcagatgagaaaagatgggagagaaaaaaaaaaggagaaaaggagaacagggtcaacgtccacgtggtatgacatgtgggtaagaccactatcaaacgaagctttggactagaatgatacaataaaccaagttaagggatctcgatgcgtgatttgtaagttcgtggatctaggtgaaacctgcttataagtttatgtatcagtggtgtaatttactctattatgaaatttggtcttcgtagtaatacagcgtgaaagtaaaactttaactctatattcttccattgttccatcttcttcttgttttctcgttcttctttatttcgataataatattgctagagtcaaacactattacttacacatgaatactagcatctagctcatgtgtgtatgctccgtaatatatattatatatgttttttacataggtaaataattattattatcattgttatcgatattttatttatataagatacttgactagtttttaaaggacaagaaagatattttttttctaaactgttgatgcggaaaacacgaagacacgggagatttgcttagctctagtgtaggtcctacattttgatgaggtgcggccgtgccagctagtttgatcctgcaactgacaagatggataaatgacaagatggataaattgatggtcaaagagtctatcaaccaataagctgatgtagcaatactagctgatgtcggtagggtttgaaaaattggctatatatccgatgtagattctaatacttagataaaaaaaatggaagaacatgagcaaacaatccaatcagctgatgataatatgatgaagtagatgtccaatgaaccaatcatcagaaaaatgtagactgaatggttaaaataaacatcggctggaagtcagatgtaaagataacttatatgttagcactccgataaaacaatatacatgagttactagggtggattagatctattaatcaacagtaaaaactaataggtcggaccaaaccgatacaacattaagttacatcaacgaataaacctaataatatcgataaatcatgtataaagtgatgggctaagatagaagatcggacctaactgagacagtcccaactaaaccgatgagcttctaaacacaatgcacttaaagatagaattgaaatatcagatacgcaaatataccaattgaatcagagcaatccaagagatcgaagcgatgcatcctaaaagaacactagtgtagcgataaatttgccagggccaacggaacttagggcttaccccttcaccggagatcgaagccaatgcagccccgcgtcaggtgccaacttgcgccgatgataaaaacctcggaaaagagcgtgacgatgctccgagagtagttgtattgatcgagagataggtttacaggacaccgggatggatactagtcctgatcggacactaaacaaacttgcctgaagataaaaaggaaaattactgcaccctgcctaattaacactagataaattaaattatcgtgccgtggttttcatgatttctttttaaactcggtctcttctggataagtttccatcggttaattctggataagtttccatcggttaattgtctcatttcattaacaaatctagtaaaaattcttactaaatttggcgttaacataaaaataatctaaaatgctataaacattaataatattaataatattgaacgatatatagtcatataaatatatactatctccaatttttttaatatacgaccctgttgacttatcatttattttattgtgatttgatttatcatcaaatgttctttaagcgtgacttaaattaatgtttgtacaacaattttaaataagactaatggttaaacatttgtgaaaataatctcacaaaacgaacaagacgtacgaaataaaggtttcaaaggaaaatacatgtgtttatttctcgggtggcagtacagatcatcagcaatttggggcaaaatgttactacatatgaaacaggcgaaaaatacattcactgtaaatacaaaacaatccttgtttgtcatgacttctcaacagctcatcgccgaaagataacatataccgcaaacatgtgtcactgaagtgaggcaacaaacatcccttgttaggttaaactacttggtaattagcggccaccaaacgagccctctgcgaatactttggcgggttaccatccttcagaggacggattccagtaacctgcaaggcatgcagaaaacaacattatgataaaatgaaaccagaaggaagatcaaatatggagaagtgcgagtctgtaaacaaatatggggagattaccaaccttcaaatcactgaatgtactcgatgcggaaaatccaatagatatggggaaaaatgttgatggatcagctggggggacaacgaattccatggagccactgcaaataagggggaaaagagttaacaacggagggcaaaaaacccaaatagaagtacaaaacataattatatgaactcatatttcaaggacctgcggttcgactgatcgataagaagaatggaccattccaacacggagtttctcgagtcatacctgtatgcacagtgaaatgtgaaacaggcattagaccaataagctttcactgtgctgtctacgttattgccaacaaggaaaaaaaagttgagctctatctacaagagatgtcatttaggaccaattcatacaagggatctggactaaatcccgataaattcaaaacacatccctcttaagcatacagattaacagtttgagatgccaataagactgtcaggaacaaaagccagaattgaaagttatcacttgttatattttaatactcctaccatcaagactaaggaaggagacaagtatgacctgttggaggattattttagtataatataacagataagttcactaaagaggaatttgaaacattacttccattctccatcaatctgtctaacacttggagcctcccggagagcaggcaatggtatagagatgacaacattgtgcaggtcaaacatctcagcagcttcatactcaatgttgacataggtttcacttccagatactgatggccagcagttgactatgcgaagaaaaagcaagttaacaaaagtattaagcaaccagtgtaagaaaaatacatgtccttgaagtacgagttagtggacagaagaaaataaaatgattgtgcacctgatagaggtaacgatgactcatccatcccctgaattctccatttaaccagaggagtttcattttgaccacttgggaatggcctgtttggatcttttgctcccacaacttgctgactgttaaacagatccttgttgatattggggtgtgttttgaagctaagtccaggtacatcttggttttcaatctataagacataaatatgaaatgatcagctatgatcaatagtatctatgagaatggacagaacaatgctgctcatcggcaatgcaaacatggagcaacaatcaaagatgaaactgaacataataaaaagaaacaatgttgctcatcagggacacaaacatggcatgataagcataaacaaatgcaaatgtaccaacaaaattggaaaccatatgacatggaccagaaatataaatgtaaaggaattatcttagctgaaggtgaatattgtcgcaaaagaaaagatgacccaatataacagatgcattctatttacttatgggtacatatctgatatctcgtatagatttatataagaaacaaacaaaaattgtgttacattctttggtgttgagaatttctgtaaaaaaaagaattcaagcagaatgctataagttcagaaggaatgttacctgcaactggataaacccatctgcatcattaaggacctgaagagcaagggttccttgcacatcaaagttattaacacctccatctcttttaactgtaacattgagtttttcttcaattgtcactgtgacaggatcacttggtggaagaggcgatgcccttgactgaactgagctgggttgtacatcctccagaatgacttctccttcagctttcaaagactctaggaactgattcgtcttctgtgttttgcctaatttcataccaagacctttaccaggagcagtagcagctgcagatggacggcctgtgcaaatattgctagcaaacataagtaacattgtatagctgactgaactttgtcaagcagttttatgtaaagcaggagtactggcatggggaaactatattacgaatttaagtcttgagatatttgaatatcaagtaccacaagaagaaagtcctaggttaacacagtaagtttacccttaattgttatggcctaacattaatgctagaatataatatcagccaagaaaaatgcagagagttttcaagttacctcctttgggcttgctagcaaatgagtccatatccatgcccagtccacctaatccagaaccactcccaaatccactaccggtaatgctcatgtcattgaatgttttctcgattacccggggaccagatattgatgagtatcctcctttgtcaagttttcctctttccatctgcaagaacaccaaccacaaaagttcaccacttagacattaacaaatgacggcaatgccattgtaatttaagcactaaggtttgcgcgagctaagctggaaccaaagaaatgacaagctgacagaaaaacagaacacaaccaaaaagtcaaactagaaatagtaatggaatattgttttcctaatgatcaaagtccactacattaactgtcatttattttctcgatataatatgtattcttaatatgaaaaaagatgcagtacataccctcatcttatcaagctcactagctttcttcttcatcacgtcccttgtttcattgattttgctttgcatcatcagcttgtgagccttctcttcatggctctccatctcgcaatattgtttgacttgttgaactgttacattttccttatttccaagagagatggcttcatcgaaggcaaatataagctcaaatgctgttttacaaacaccctcctcatcaagagagggggagtattcaggcacctatacaactgttaaggagataaaagtactggattattgccaagaaagaaaatcaatgcagcttaggagcaagtctgaagatggatggatatacaaagcccaaaaacatgatagtttgcatgttggtttcaatctaaattcacattgaaaatgtagtgcctttctttcctttttgtccccttggtggtatatagtgacaagctcaactataccgagacattataatcttcatcttcattttatcccacaaaacaaacgttggtaacattatgtgatatacatttattcactacagagcaatatatgtgtaggttaaaaaaccatgttttatatgtttcataggataggattgtataggttagttaggtcaaaaaactggaacagtgaacatatgggaaaaaaggatacaagcttagagagcagcctcaaggtgtccagatcttcaagaatattgctctgcttgtttgtgataagtagcaagtacaggccttctattggctgataaacatagcgaacattttcagtctcaacataagtgtgctgcttcccagttccaaccagtttggggaaagctgcaagtaatccttcaatccttatgcgagacatgtcaacaaactgtcttgaaacaagtgctgcaattgaaaagcacagaaaagaaacagcatttagtctaatcacattaacttcctggaatgaagcatcaacaaattggtaaccaggaggtgctcactacataggattttagggttataggagttaagaatctactgaggtaacacgataacagctagtttagtatttgggttccacaaatttgcatatgagctaacactcttattagcataggtgaatgataaaaacttatacaaatactttttttttctttttctatgaacaaaaggatttgttttgattacaatataacaatataaattaaaaaaacttcttttcggcactgagaataatacaatacaatatataaacaacagaatatttcaagccagctgacctttcccggactttgaaatgatggaagcagcaagaaccacctgcggtacacaaaaaccaataataagctctcctaaacaaatcaaccacttgcttataccagcaaaatgtcagaatgttccttcttaatattacaaagagtaataaaccattaggcataccattttgagggcttttttggtactcagaattactgcacttaaaatggattcaggaattatgcgcctgccagaagtggaaaaaacaagagattattcaatcagtacgacataatcagaagatctcctgcgagcttagatccaggccccaacttttcttttttgcttccagatcttactacttagtactaagaaggttaagccaaattaagagaaaagcagcttccagatccaaaagagaagctatgatttaacgcgaatcgacagagaagaagaagaagaagcatattgggtagagatagatgggaaacggatggatggacgctcaccagcgagcgagcgaaggatgcggcggaagaagcagcggggacgccggcgctgctgctcgcgggatggagatcggctcaggcggccggcggcgagctcgcgaggagaccgaggagacgcagggagatcgctcgccggaggcagccgcgggatctcgagcgcctgtcagaatggctgatgaagtaaacaagggaggtagctgctggtcccactgtcagtaacttactacctccatccattgtaggccgagtttagttacaaaatttttcttcaaacttctgactttttcatcacatcaaaactttcctacacacacaaacttccaacttttccgtcacatcgtttcaatttcaaccaaacttccaattttaacgtgaactaaacacacccgtagtattaaggtgatttctacgtagggtgtgtttaattccctttaaacttttaaaagttccgtcacatcaaatatttggacatatgtatggagcattaaatatgaaaaaaaagcaattacacagtttacatataaattgagagacaaatcttttgagcctaattacgccatgatttgacaatgtggtgctacattaaacatttgctaatgacggattaattaggcttaataaatccgtctcgcagtttataggtggaatctgtaatttgttttgttactaatctatatttaatacttcaaaaaaaattaaaaaggaactaaacacggccaatatgatgtctcattctgtacatgggttgtgggtttttttttttgctagctttcccaacttaatcgtctcatttttcgcgcacatatttttcaaactgcaaaacggtatagtttttataaaaattttctatacaaaagatggcgacgtagagctgcatgaagatggcgccgctgagcctaacgaatcccttgagcaagccgagctcgatgccccagctctccggggaagttcttgacgcaggtgacaagcacgccggtgttggcaaacgactgcgagttggcgccagctccgctccgctgcagccgacgccctgctccactccgccggccaccgtcctcgctatctccgctgcgaccgacgccgccccatgcgcctctgagaatagagagagaggagatagagctgacatgtgggcccaagggcatttttgacatttcacgcgatttctctttcctcttcaaccggaaagtattattttaatcggcgcgatgtccactggcaaattaccacgtttatggagtgttttcccccaaaagtgagtttgggcagtgtcctagggctaaaaccacacataaacagtgtcctgtagcaaaatttgccttagttgttttaagtataaatcatgttttacgtgacgtaaaacatgattttgctgtacttatgtgatgagtttggttcgttaatacacgagatgagtaaagggataaaagtttagatatgttcatatctccttaatgaaaagtaatactctactccggtttcgagaattgaattgccaggtgttgtattgatctcacaatcgagttatagttatacacttgtacgcctccctgccttacttatatagctttgggggcaaggcttacaaggagaacaacctagccggatatgatttttttctatgcatttacataatcatatataacttaagactatggaatatagcttgaaatacaatgcaacataatgtccaaagcattcatacatatacttccaatagtagtacatctatgtgcaaagtcgtatcttcaaattcattttacatagacagagacaaaattatgacagaattacaaacttaaaactgtcaaattttatttttgttacggctaaaatattatgaatttgaggttaggattttatccctaagtgtaatactattgaaagtacatacgtgaatttttctagattttttagtgacatttgttagttggtgtgcacgtgtgtacacgtgaaagcttgtgtgcataacatatgttgcctcaccacaattggatcagaaactctacacttgttgtctatgagtttttaaccttatggttacgttcttgtatgattgtcgaggaagtttagtagcgcatgcgaaacgaaagctcattagcatataattaattaactattacaaacttaaaattggatttatttgattttttttaaataacttctatgtattctttttaaaataccattcaacagtttgaaaagcatgttaacgaaagtatgctaacaaaaaatgagaaagttgaagtttggagttgaaaaaaacaactgagcctaagagattagatattcgcttccaacaattggattggaaactctacaattacacctaacttagctatctacgagtttttaacctctaagagattagataaaaagaacttgttgaatgctggtgcttaaaaaatccccaaattttcaccaagcacaggagataacccactccaatccactcatacagacaaatcacgaagaccaagaaagagtagggaaagaatgaatctcaacaaactcaagccaatggcaccttaatatgctattgcaataaaatcaacaatcttagctttggggtggggaggggtttaaataccgcctcacactaatctgatggttggaggcaaagattactcatatgggcttgtggtaagccatggaaggtttgtaaatgcttatattattggtgaaagaggagtgcatttgtaaaccaggttagagatggaaaagtcccagctttttatgagctactcaacaaaggggtataatgctcttaaagatttgaatttcaacaaatacatcagcttcgcatctcaatgaaatcatgctatccatagtagttctgatttttgcttacttgtaccacgagtaacttgttgtttgtgctagtattgtttttctagtgctacatatagtagtcgttgccatcttgatcttgctggtgcagaatctatgtcggaaaaaaaaacccaccgccattaagcaggcctgaaaccccaaaaagaatattcagctcgttgatactagggtaaatgtatccagaaatatgagtattccttattcattgttgttacctggtgttaaacttgctgcaacaatcggtctccaacaggaacctataattactttatagagtttggcaggcagatacatggattgcaaaacgatcatgctagctgcaggcggggggttgtacaagtgatccgggcaaaatccacaacctactcaatccaatccttctcttcttcggctggagtatccaccttggctgctgcagaagcgtagctcacgctgctgtctctcatgctcttgcactggcttgactgttcataccgaacaaatctgatcttgatcttcgtcgaacaatgtttcagcatctggaacattatattgcataaagaggacgaagttatagaagtagaaatgaagagataacactagttagatcgccacaacgcttacactgaggaaaacgctgatggggtggcgcccacatatggtattttcatactcttgcaagtactgcttgaatgcatctggattaccagtctctattatctccatgcccatgtggtccaaggcctctatcgatttatgtatagcaccatggctcttgtcgtagtatgtgtaactaaacctgatgagacgatgcaggtgagcataatcatatgcaaatcctataagatcgaagtaacaactacaacttagcctggtgatgtatcatgggcaagcgttctttggtgtccaattatgaaatgaactgatctgggctgttcaatcacgttttctacactatcgatcaaagcagatccgggtgaaacaaagcctggagcaaattagctccctttttacttcccaccaaaatcttatgcaaataaattgtgtcgtccctgaaccgcaaacaacatcagcccacagcgacctccccccatcttcacactcctacaactccaaacgcttgcacactggtgatcaccatcgttgggcagatggtggaccccaacatgatcaggctaagccatgtggcagaagtaaaccaggatacatctacagcatccggtgtttctatagatgaatttagcagggaagcaaggtgctgtcaccatccaccagagatggattcgagattggggtttgcgatatagtgttattacaacatgtgccaggtggagttgtttttttctttcaaaattgagatggttctaggatctgccaattggatctgatgggttctcaaattccatctgatgcctatatcgattattcgagcctaaatgttattccacatgataagttgcatttatgctaagtggaaatacaagatactgcacaacaatatctagagtactcttgctatgaggggttcaattgatagacaaatgctgctcatatgatggtacccttttcgttattgagagcaaattttgacatctactgaagttcaaatttgcatatacaaaattaagattttgtactgaaatttaaacttggaaagaaccatatttgtaagtgtgatgatgagttgatctgaaaagagagtcatagctaaaactgctattatggcatactatctaccttctggaaagagtacaggtagaaagactaagaatttggacaatctataggcctactaaaaaaatattcggcaagagaactctaagattgtggattttgcatcatgagctcattttaactaaattggctagcaaatttaatgaaaaaccaggcatgccaactcttctgcttttctacatggccagatctttagcctcgaataggccaaacactgcaaacttcattaattagttctgcagaactagtagatgacaaatgtgacacaggacaattaaagttttctcacactaaagattaccataggaaaacaagcaagttggcagagcatgaaaaagctgacagtagaaattaagtatttaccgggttccccagtggcagaaatctgaggagatagaaaagaagttcttcggatcgtcaagatatctagagagcaactgcccatacatggcttcattttggtctcaacccatttacagaaaaaggggtaagttgattagtgggtgcaggagggtctcaataaggtttagagatttaaacattggtttaagtaggtaactttgcaaaagatccgaaaatatttccttttgtaaggcatttgacctggagaggtgcctttcagaattttttttttccaatctcgtctaattttgtgatgacccagatgtttcagttgcccagtctttagaggaaggtgtctcagatgtttcttttagaactcttggaatatcagaatgtactgaaacatgttgctatatttgctgagtagggtgcagttctataaagtgtaaatcatgtgagttggctgttgagaaatcttaacgccttttctggtcaaatgcatcgtttatgttaagagagaactggctacctaccacccagatcttctatacagatatataccattgatttttttggttctccttgatactatcaagaccttctgatccttcctctaattatcacacatccattttctcacattaactgagaccctgagctaccctatctggcatgctatacaccgtcccataccaaagccctccatccttaacacatagaactttgcctttgtaaccaccttggagagaaggcctagtgtgcaacatggccccctcttcccctcagaccagacttatactaatttgcttttgttattcttgatagatgggtgaaattcaaacaaaatacaagcagattgtttaagcacaacaggaagagatttgttgatacatcgtgggtaagaacctgcaaagagagaacatgaattcccttagcgcgttggatcatcgaataatctgagccagcggattctcactaaacctgggtaaagcccaggtttagtgagggatgtgacacccctactatcagttattgtgctaggaggggtatgggcatgctcagcgctttaactgatagcctgagagttttgtttagtgaggtttgaaggctaaatggtttgttctggacttgcttattttgtttatggcttatgctggtctcccttgcaagggccttatgaccatgatgtttgctttgatcaatgtaactaaaggccatgctgctactgagagaaagatactccatccgacctaaaatatagcaacctaatacttgattagacaccacctagtactatgaatcttgataggggtctgtccacattcgtagtaccaggtggtgtctaatcgagtactactttagtattttgctatattttaggacggagtgagtatatagatgtgtggtttttgcatcaaaccagttacacattgtttgcaacgaggagcacttgacaatgtttaaacacattgaataatataataactcatatactgtacagtgtgcctgtggcaattcacttatattggactaatgtgtgatattgaaaattttcaggcaactcaagaaaaagtagcaacgatagcaggtggggtggcagattattaccaccactactttaaaaggggaatcttaagcacaaatggctctgtctgaaaatatagaaagttcaaaacagaaataattaatacggatggatgtctaaaaataattatgtcgtaaaatcatattagtactgctaaagtgctaatcatgcatggaaggcatattgggtcaggttaagggcaatactaatgttggtgttctggcctattatccaagagaaatcttaggtaaagacggtaattagattgcatggcatgtaatatgaatgtaaaatattcaagtcagtaacagcataccttcatggtctactggcaaatccccaattggggtgctataaatagtagctcttgttaatgcgcattttggagtatagtagtgatgtgaggggcctaacaggaagacccgagaactggatcacatacaggaaaacatattagatgggcaaagtgaaaattagaataaagtaatcagctataataatgtaagtagtattttttggacattcttaaaagctgaagctgattctgaatttcagagtttgattttgcatctctcttttcatcattgttaaggagacaagtaaaaaatctaccaaaactattcttaaaaatacatattcaaaattcaaaagtagcagaactattgcagtgtttagaatgacaaaagcatatcatatatttatgcaacaaaagtgaatgttttatgattatcttggtgtgttcggtttgaatagacatgggatgtttggaaactgaggttgtcaggaaatggcctatagctttggtggtgaggtaggtgtttaacatcctcactcacccgggtttaaactctaggattaatacatgtgaccatctagttctttagttaatgctagaacccatgtccaactttcaaaataaaataaataaaaatgcatgcatcactcataaagatcactttaccaattataccaatgagagataaaagtacaggttgataaaatggtacatccgaggtacttttacatgaaagcattcaagtcaaggtattaccagtacagcaagacagtgatttactattagaagatctgaaattttgagagagtaacagtaatgtgtaaataacatacatgttagttggatcaatgttgccaaaagcatatgccgcacaccgccctgagtatgaatagccagcatggctgtaatggcaagaaacaattgttaaaatagaacagaagaaattcaccatcatatgaatagttaaataccatcttacggcgcaattactgcactcacatcaggggacttggttagaccagcagccctcagccaaccatcaagttcctcatccagtttcctggctaacatggagtaacgaatttaggagacagagctaaagtggtaaattgtcgaaccaaaattttaaaaagaagaaaatggttgagatccctgaaagttttcaacaaattacatgcttttatgaattaatgttggaaactgcagagcaagaagataatggagtcagctaggaatgaatggttcaactcccagtaaaactaaacagctcatgtgtttccagaatggtctgacagctaaaatagttattgcatttgcataacaaatagcaaatgatccagtttcatcaatcatgtcagcctactacgtgtttgggcaaaaaagaatgatattaatctaataagcagtacctaaaatgtcatcatgcctgatagcacaataaaattgatccatgtccatatgataaggttgccggtaattcattccttctaataaaaaactattccgaaagtgcataatttatatgaaaccatgtataacaatggcaagcggttcctgcatttttctaacaatataaaaatagttcccacaatcttagcaactaaatttgaagcaagagagccgtaatgactggtgaaatcatccaaaatgccaaccaaacaattcaagcacgcatatttggatgactatcaagaaaattattcacaacaacctgcaaaacatcaaccgccaacatatatcaagttatcaacagtttgaagctactagactatttacactccagatcgtttaaaactaaaactccgaagatatgcagcatcctcttttgcattttgaaaagcgcacacaatcgaacaagtcaacactcactcctccacaacaaacaacacaagtgcactccaagaagctaggctaggccgcggaattgagtaatcaccaccaccgaaccggaccccgttaattccccaaatctcgtaagcaagaaatccctcctctaacttctcccccctccccaaaagtgggagaatccatcgattggattgaactagtaagaagcctcctcctccaaccccacacccccctgccccaaagtgggagaatccatcgatcggattgaactactccctccgtttcacaatgtaagactttttaacattgcccacattcacatagatgttaatgaatctagatatatatgtgtgtctagattcattaacatctatatgaatgtgagcaatgctaggaagtcttacattgtgaaacggagggagtagtagagattgcagtagcggaggagagtggatcaagtaccattgttggtgtaccaagagccggcgtgcgaggccctcctccatccccaccccgcagcagagaagaagagcggtttcgatggcggcagcaaggaagaggaatccctccctcccctctggccctctcgtcttccttgttagcttaggttggtttttccgtctgggctgaaaaataaaaagtaatcactgcctcaagttgccactccaactttcaagaactgcaaaagaagaaaagatatgtagtgattgagaaaaaatgagtcctgaagaaaatagtatttgatggcctgtttagcaagagaaaagaatgggctctcctcatcaccaaaagaaaacctaacacaaagttagcttcaacagacaagcaccaagccactgagattaatccgttcaccaatttcaagttgaatactcaattgagaccacgtggatctttacaccgaagtgcatgtattatgttcatgtgcacacatgcaagtataaaaggtggattaaagtagatagtgtcctgctgcaatgaaaatcccaccgattcacaagtaaatagcagaaaagatgacagacgatatttcccaacagattcgggtgcactgcttaaggcaatactacaaacaatattcggattcctatatgaacagtagtaaacagtggagtaccttaggaaatccagcgatggacgtcgggggcggacggatcagatcggcaacggggaagagatgttcctggcgatggcggttggatcatggggatggggggcggcgcgagaaatgtgcccggcggctgaatgcggagatgcgcggcatcggtgacggcgatgaatcggcggcggcacctgtgagggcgaggcagagatattagaggaggattagggtttggaagcgcggcgaggaaggctgagcaggagcagaccgcgaggagatcttgacgatcttgttttgcccggcgcggcagccggcaggggcaaaggcggcgacaggacgagaaaatttacatattgctaactccaaaaacgggtttcgctcaaatgccgtataggagtggtttcacctgaagcctacttactataatacccgaacagacaaaaatacccttatttctacccttcttccacctccgtcggtgaccagcggcgcagggatagctggtctgcggccggcgcggcgcgcggtcgcgtgtttgtcactgggggcgtccgcgcaggctacgaccctgccgtcacccgctctggcgcgttgtgggaccccgcggcctcgccgcccaccgccgcgtgggagccgatcctgccgctgcgcgacgggcggttcagccgcggaggccgtctgctccggcggcaaggtctgcatggtcaacctccgcagccgcaacgctaaggagcgcttagtgttcgacctccgtgccgatcgttggaaggacatgccgccccgcatgctcgccggttggaagggccccgcggcggcgtcgcccctggacaacggcgagaccatctacgttttggatgaggagcgtggcgcgctcaccgcctacgactggggcaccgctcggtagaggatggtagctgagtccgagcgcctcaagggcgcggcggagatgaccgtcggcggcgggaaggcatgcgtggtggccctcggtggtgggaaggtgttgatcgtggacatcatgccgccgtcgctgctcaagacgtcaccagcagcgaggagggaatcgtgggacaggaggtggcggcgccggctgggaagcaggtggtggcaccagatccacgcgctcgtcggtggcggcggcagtcggtgaactacgcactcggcggcaggcagtgaaccgcgctcagcggcatgtggatgaagggtagcattctggcatgtaaccttcggttgaaagtggcattttaaagaaacccactaccagcatggcatttgagctaaacctggttttgaagatggcacaacgtcaattttctccgacaggacaggagcagcgatgaggagcctcagttggatgaaaaccgtcggaaaaacactataccattttcattttcttttttttcgtgaaaacggaatgggaacgttagacccgaaaacggtaacgaaattggtaatattggtatatcagaaacgggaccatcgaaacggaatatactgatattggttggaagtcaacaaatcatatcggaatcagcgaagagtggcatagaacaccgagaaaactaattcacccatacacgctggcggcgcacacttccacgtgaggcatacacccaatgaaacctgctacttctaccgtgtgaaaggtctgttgcatgattctatatttctatcttgcacaagttagttaatccatgcccacgcgagattttgcattatttttttcgtgttttttcttaatcacgcgtgcatgattttttttcacgatttttttttatttttttgtgaattttttaaatcatgtgcacctgaatgcgcctgattcaactcgaattttgagtcaaaagtttttaaaattttagttaaaagttttgaattttgagatgaaagttttcatatttgagttaaaagttttcaaaatccgatataaaagtttttaaatcttgactttgaaagttttcaaatctggattaaaaattttcaaaaaatcttgttaagttttcaaatctaagttgaaagttttaatttgaaactttttaaatctaagttgaaaattttccaaatcgttaaaagttttattgatgtactaggaggagaggccgagaggggctgtgccatctagcacgcacgtacccattaggaatctctatagcacacatttaactatgcgcgaagatgaccttttaactttattcttacatcatcacactccacataacatcattatatgatgattaacgatatgataataagtttgataaacaatataaacaaagttcaacagtactttagcatcgataagctgaggagaccaaagttcagcaaaatccacatgccacatcatagggttagcaacattttcttggtcacttccccttttttatgagctgcaagcgtaccaggctttcttcatttatgggcttccgatgggtttggccggctgagccactggggaactttcagatttttttttcagaattttgacgaaaactaccgtacaaatacagttaccgacaaaccggtcgggaaaacctccatcctatttccactaccattttcggaagatattatcgtttccatttccaccaccgtcggttaccgataccgactgaaacagtcgatgcaaactgaaaacggcagccgaaaatctcggaaatttccagatcgttttcacccctacgaggaggcgggttgtgtcgtggcgcaactgggcagaacgcattttcgggtggtggtttggtctttggtggatgtgaaggaggtgggaagcagtgcctaggcatgttaacacttaccccctctgtccgaaaaaaaaacaatcttaggtttgaacctggatacatgtgtgtctgtgtccaatttaggttcaaacccatgattgatttttttttggagggggcggaggggacggagggagtactggccatagtggcatcggtggcgcagctttgcgtcgtcgtggtttgcatgtacactcagccatccgcaagtggccgctacgcgtgcaagttctctagtgtctggctaggattgagcgagccaaaaatatcgtataaaggaaatgtgcatatggtacattttgttagcacctaatgtaactggccttagatttatgccgcttccctccttgctcggccgccacgcgctacccctcatcactcacacctggagagaggacagagaggggagagagatgaatagaggggagttgaggagagaggaggggtgagaatgacatgtgggacccacgtggcccccaccattttgaaattattttttttggtgtaattgacatgcgggcccacaattttattatttttcaaatcaaattgccacgtaagcgccacgtcactgccacatcatatgaagtccgagtcaaattagccacgtaagcgtcacgtaagcgaaaactgccgttcaaaccgccataggacctatattgcaccggttttgacagttgagggacccgccgtatctagtttttcggttgaaggacgaaaatcggattcgttgacaagctaagggacctcagatgaacttattcctagaagagaagatagatgaagtacgttgggcttgggcccaaggtgcggcccatcccttcccagccgtctcgtctctctctctctctctcaaaaaaaaaaaaaagaagtggagtaattttcccgtctccttcggcggcatccaccccaattcatccgggaaggggaggaggcgtccttccttcgccgctaagcaagcatccagcccacccagccatccatccagggaaagggtaggggaaggtggcaatgaggatgtccatgcccaggtgactcttagatttcttcggtttgagggaagggaggaagggggatcgatttcttcttcggttctgatttggcggaggaggaggaggagcacgacacccaacgatatggtgggcgtgctgtccaaccgggtagatcggctggacctcgccgccggggatcacatctactcttggagaactgcctacctctatgcgcaccacggtgattcttcttcttcttcttcttcctcctcctccgatgcttgctatgcttcttcatccccaaaaacctagtcactcttcatccatgtgaaatacaatgtgtctgatctggagatggagaagtagtagtaatttgttcatggaaaaaacaaagcttgtatttattttcagttagtatcccttttccaagtcataagtcaacaactgtgcctgctcaaggctccagtgaacaatcacctcctatgctggctgttgatgctgcctgatgcaaaatgattaacctggaaatggtcgaacctggctgacatttgtccataacctgttgatgctgtccgctgtgtcttaccgatttaagccatgtggattaccagtcagctcaaggaaatcggtaccattttccctgagcactcaagaatacaattttgggcgatatctttaggagtctggttgtttggccacctggatttccattcttttcttgtttttaccattgtccaaagaaataagtctggaggcactaaaaagaagtctcgtctgttgagtcgcatggaacctgcatctcaatcgaaggattctgcttatctttccatttaagataaatccatctcaaatttagagctctcccgaacacaggtaggtattttatgcccaacctgcccttttttttggtgtacaaaccttagacaattaactaaacaatgcccaccaatccaccatcacaatggccatcccctttccaaataaagcctctcctattctaatatattgacgtgcaatcattttgcgcattcccgaaaataaagcctctcctacatgctggtaaccgacatatgcacaatataccgtcggcgatgtcatttgccatctattatggaaaacataacactcattacttgattggcatgccacgcaacatttatgtgctccatgtccgttaaccccacattatacagtcagttcatgttttcctgttgacttatttgctaaggagcaaggatactcgctaagaccatgtctctgacctgttcccgaaattgaacttcattttcagggatatatattggtgatgccatggttattcattttacaagagcaactggacatgaaattgggacaggaacattcttggacatgttccttttcagctcatctccagcaacggaggagggtcctccctgcgagaaatgtggtcacctgattaagcagcagggggtcataatgtcgtgcctcgattgcttcttggatgggggcaatccgtacctgttcgactacgcggtgtcccccgctttcttcctcgtgaaagcgcgaggaggaacgtgcaccctggcagcctcggaccccgccgacatcgtgatccaccgtgcccagcacctcctgaacagcgggttcgggacgtatagcctgttcaagaacaattgcgaggactttgcgatatactgcaagacggggctgctggtggagaccgctttcagcgtggggcgcagcgggcagctggcctccctcacggctgccttcagcgcggtggcctcgtcgccgctccggttcctgacgaccagcgctggtgggctggtggttgtgacgagcggcatgtactgcgtggggcgatatgtctcagatatcggtgttcgccgcgatgtcgtcaaagtgcccgtggagaggctggtggagcactggccgccgcgggatgttgctgttgctcctcctcaggaaagccatcaagaatgccaaggaaatgatgttgctcctcaagaatgccatggagacggcgatggcggctgcgtctcggagtcgctgagctaagctcttactaataggaaaaaggcagtgtgccattcgatctgttgccgattgtaccgattatgaatgtatcatcgtttatgttgctcctcaagaatgccaaggaaatgttgctcctcaagaatgccatggagacggccatggcggctgcgtctcggagtcgctgagctaactcttactgataggaaaaaggcagtgtgccattcgatctgttgtcgattgtaccgattgctctgcgctgtttgtattctgtgattctgtccatatgaatgtatcatcgtttttatttactgtatctgcattctggtaccttgaatggggaatcctgaaatcgatgcctgctgtcattgtccgacttctcggttcccattgaaccaagatatccagtgttttgcaggaatttggagctagatgcgtccaagcgagtgcttgctgctgcaattgtgtcaagctgtagactgattgaacaaaatccatacttttgggatactagtaagcagcgcacagatcgcatatcatttgacttacagcatacacattaattcttcaagtctcaacttggattacagcgagattaacgtgcgctcctccctaacacctctacgtcacatcccgtagttaaccggacgtagagagagagagagagagagagagagagagagagagagaatacatctattattcagatattattccaatgtgtttctggacaagtagcctaaactccgatcagtctcgagaagcctgcccgtgtgtgcaaaatccagaaatcacccaggacaaatttacatgatcccaaccgtatttgaggccattaacattgattaaagtcaaactatggccgttccgactccgaaggcgctatcatagttcctcaccatgttcttcgtcgagggcataccagcaacaacatcttcttcgatgccacattcgtttgtgccccttatgatcttgaagtacccatcctaccagtatcaccgaccaaacattattaatagctcaaaaaatacaaattatgcaacatttcacttattgaacttatatatttgccaaggacttacatcgccccatcctctgttccactggtttgcaagcagctgtaacacacaaaaggatgaaagaaagaaaattagtgcttaaatataggtttaattaatagataacgtaatatggggaatagacaagtacccagtaatcctcgccagcatccgtggttccccatccaatcaacttgacagcatgaccacccatcatgccacctgtgatgtgcttgtatactcctgatttgtagtgtgcaaaatccttcacaatgttggagcattaaatcaaatcaacaatgctatgcatcaaagagaaatcatactcttttctgatagacctcagaatgttataaatgaagtcacaaaacatgcgtaaaattagatgtgtagccaattgaaccaaactccaacgtttgaaagattactagtgtgcacatcttctcatgtagtgcaccagaaaaagataaatactccaggccccagaaaatatctaagaactactttcctgtttgggttattttcatcccccacccctcttcttccgtcttgttcttcctaagccttatctctatacgtaaagctctttttaagaagctttatattctgcacgtcatattttatttgaaagtgacaaagcagcaactgcagcctacagtccattttgatttctgctaaccaacaatcaacaatttggtgaaagagcatggaaaaaaaatagaaagtcaatggtacctcataaacggtgaaagcaacttctacagggccattttggtagacctctgccattatgtcatgtggatcagaatttactctgtatgcattgacactgaaatgcttcttttccagccaaacttggttctgcaccttgcatttcttctcgcacactggcgtaggataagcaggttcgcatcctggatgcttacaaccgacctgatcaaagtatggatcgcactgcaaaacaatggaaaatgtgcattttctgagtatatcaagctgaactaatgttgcaggagccgggaaaaaaatattcacatataggattactgctggatcatgcagaaacattcatgtcatagcatgtagaaaatggacaatacctcatcggtaacaacaccattccgaacaaagtagcgccatgccatgataggatagcctccatcacaaccatcgccgcacatgaaaccgcagcatgccactaggtcattgacagatagcgaaatgttctacaaggaataaaaaacagtagcttggctatgtgagcaaaggaacaataaattaagttagaagccttggccatgagaacggacttgtcattcatattcactgaccatgttgaaatgaatgcagaaacgatcctggagacactccacagcaccaaatgcccaacacgagccacagtgaccctgtcattgtcaaccaagacataatacctattatatcttgcattctaaaccctcatgggattaacaatttatggtggtgcgcgtagtttacctgatctgcgcatgaaaatcaacatttcccatggtttggtggaaaattattgaggaaatgaagaatggttagtgtattcattagaactaattacaggtcaaacattgaggtactaattgaacttaccaagtatggtcccaattgtgttacactgtgaccatgcagacctggcatcaaactcctttggaagcatcagcgatcttggataagttttgacagggacatcatttagcacactatgcggtgttggcttcactccaaggatatgtttgaattgcgcagtctgtacaggaggattattgaggccaccgaacaagcatgagataaatgttttgatgtatgcaatactaacaacaacaggaaggtgtccccgcaaaaaaaaaaaagaaaacaacaacaggagggtgttgttatttacagtatagtttgcaaagtatggattccgtgcagccgtccagccagcattgggatgcttgttgattgcctttatgatgtcgtcctgtgacaacaaaataccattgaatgatatgtcatgagtaaataagaaaatacaataaggtgagaagaacgaattgaaatagaaaggcataacctggatgattcttgaactgccgccctccttggtcatgagctggagatttgggattggctttgcagctctgcctgcctgtgcatgtgtacatacagatgtgattcagctcacaacataattcaaggtacagttccttctctgttttgttttgtgtagaggaaacatgaagcttttgtgtgcttgtattcttttatttttgtgagggaaagggaaattcattaaataaagtaaatttcagagaactgcaactattctatcgaaactatcggtttactacaactttagtcagacatttcagaaaactgcaacaatagtacacggtgttatcataaaactgcagctttatacacttgacgaatctagacccattagtcaggcatttatgtaaaactcacacagttacacatcgagcccacatgttagacacacgtggtgggttaaagttgtagtttattgataaaatcatttgctaaagttgtagctttgtgaaatggctgactaaagttgtagcaaagtgatatttttgatcaaataattgcagttctatgaaatttactcttaaataaagtgaactgtcggaaagggaaaattcattaatcatgagacaattcctcacacataagatgtgaaaatgaggtacaccaattataacactggaagcctgaaggagcttcctattttgtgaaggattagtcttttgtaactgactttccatatttctgttttgatcagaattcccctatttctggtcatgagcaactttgtctccctgaccctaagtatgcttaactcagatctatctttctccttgatataagcaaatctatgacaccactacagtccatttcaataatcagatgtccactgtagggctgtagagatgcctccaatgcacgcaagtgcgtttttctattcagtaatccatcctcagactaaggagagaactagcgcaaatagtaatggatggagcatatctgcggcagaaaatctgcctgccccaagaagaaatttcaattggattccaccagtaaagaatcgaagatacttgattggatcttagtgttagctgttggttttgtacagtaaaaaggtgaattgctggtcgaaatgtatggatagatttgagacggctagatcgcagaaagaaagaaagaaacaagtaaaggtgatgagaaaaggacctgggggccagcagcgacgaggatcagcagcagcagcagcagaggcatgcccatcttgttggattgcagctagggccgattgcctgtgttctgaaatctgaaggtgaggactgaggaggattcctcttcctctccactctccagacctacagcttgcaaaaatgaacaagtcaattaacaagaggatggatgtgggagtgggattaatggtaggagatgatagtggcagagcaaaatatctttggttgggataccttgaagagtcctccactccttgcgtgttgctgttggtgttgcttgcttctcttctcttctttcccctacctcagtcctcagcagctccccccggctgtgcccccggtctgtctctctcatttatttatagctgttgtgcctcttgctgccatcataaacaagaggggaaaaaataataattaaaaaaaagcatcaatagagatgggcgcgcaggtactaagagcaaaaagtttaatagtagtataaccaactattagctctaaatcatctatagctaatataatagtcaattcatataatagttgcttactatactattaatacctgattctacctatcatacacatattatatcttgaagtctgtattgcagctggctaaagatttatagcccgctactttttttcttactttctttatctcttttaaaatatgttaacgaggtgaggccgtgaggcgaggcacacgagacagagaccgctgattttttttccctatccttttccttgggagcactcgccgtctcgcccattcctccaccaactgatttccttgcgtgccgtgctcgccgttggctgttcttattgcgaccacgaccaactgaggcccccttcatttctccaactaattagacgaagataaaaattttcgtggcatgttttttaaattgcttaacagtatgtttcgtgcgaaaactttctatatgaaagttactcttaaatatcatattaatctatttttcaagtttataataattaaaacttaatcaatcatacgttaataccacattgttttgcataaaaaacataatcttcatcttcaggagaaaagaacaccacttgagatatattgagtatattataattaaggtaaatctaaaccgagagcgttctcagtttagttttaacgagtgacgcactcatacgcatacgtgagtgatccacacacttgttagtgccttagcggtcggttacaaaccattcattctatctgtcatatcatcttcattaaaaataccagagatagatacctaatgcttgtttccccacattgttgactctcgcgtcgccttccccatgggttgcaccggaggcgaaaacctcgccgctcccctcctcccccccccccactcctccttcgcctcgccaccgcgcgagtggccgccggcaacgccacgcggccgcaaggacggcggcggcggggcttcgcccacctcgtgcttgggcggctaggggagccactcggggtggcggcggtccggccaaatccgcgccgcaccgtctggatctagcgagagggcggcggcagttccgatcgacggaaggtggtgggacggaggaggcggctggcggcagcagtggaggtggccaatggcggtggggttagcgacgacgtatgatggcgatggccacgtctccgtggcgcgtggcgtcaagtggctgcgagcagtagggatgagacggtagcggggacggtgatggcatttggtggcgatggtggatgctacggatccggaacggccacgcccggatctagccgtcccgtgggtggatccggcaactccgcgctggatctggctggccacggcgcggcagtgtggcttcggcaggaggtcgacggctggacagcgagtggcagcgacggctgaacgacggtgtggtgtgggtgaacgatgatgacggcgaatgtgctcaagctgatgaaggtgccggcggctaccaaggttggcgcgggtggcaccggcacggaggccggtgccgggtgttcctggatcggtggccggcggaggctagcgcggcgcaaggacacgcgactggcggtggaggctggcacagtgcgacgagggtggccgtgtggcggcacgcggaggctagccggcggatggtgccgatgcagcggtgaccatgcgctgacgaaggattgacagcggtggagcatggtgcatcagttgtggatagacaggtggtcggcagcgggtgaaaacccagcccagacttggccgagctggcaacgagggcgttctcgagcgtccctttccctcttgagggccttgccatgctgtcccatctcctctagggggcctgtcgagtgaaaacctagtcctggtctccctgagacctcgacggacgacgacggcggtgctttcgccgctcctctccctggagacattgtctaggcacacctcttgacgaaacctccctgacaaacggtgcaagctcgctgtagattccagtcctcttgtgtcgaagctctagcttatgcaagttgaccacgtcggagggcctaggagggagagcgattccatcattctttctcaccctctctccttgaatcccaaagatgtggatagagtgcggttagtgtcggttgttaggatagtgttttaggtgatcccggttgtagctccattgttggcctagctgttggtatttcttaacgacattactagaaatataattcccagcaatggcgcataaatactcttggtatattatggttacagagttcattcgcaagcgcacggatataccattgtagcatttcacccgagagtattctaagggtatcgtatttgtttaatcccgtgggaagatcatagtagagagaaccgtactaataatttatatgttacttgtaataatcacagtataagcaggggttaagataaatcaagggtagagtgacacacaagcagggagctactcattctcaaactaaaatatctaagctaagtggaaagaaaatagaaaagagaatctattcatatacttctagtatacatatattctagttatacgattaactagctaataccctcttttcgatgccctcctagtacttcgagaagccacccttgactgccgagttcgttacgacagcccgtcatgaccatacaacggggttaaatacagaggagtacctgttgatggtcgttagcgattagtttcgaccgtcaatattaccaaaatagaggagaactagttaggcttgcaatacatatacatgttagaataataatattccactagtatttggttcactaacccttttgcagagaataaccataaagtagaggagaatcgacatcgaatcagacgataaatcaatcggtcgatgtcgagaatcagacttatgtaggaatgggccaagaacatagaattgacacgataaattgggccaaaattcacaagtctgcagtgagcaacagaagaggaggccacctgccaagtttgagccaggtgggcccagcccatggttcggccgaaccccctgcagcgccattcgatccaggtttctcttggacggttgagatggctccccaatgacggttagtgggtattaccgacctttccaaccatcacaactgtaattgggaggctataaaaggagctctcatcctcccttcactcacacacctcaagtaaagctttctcatattctctcaagtttagtttagtattcttaagctagtggaataggaatagagtagaaatcggagtccggaagccttcggaaaagttcgggtatggctctagtagctcttctcttctcttttgtaagctttgtattattattacaatactcttctttatacatttatggtattggaatactttctaagtatatgaatgccaactctatattatgttcatgttatactgattatactactagcttatctgggagatgctttggtgtgggtgtaatatttgcttatgcaattactctatgttatgacgatgatattagagtagtatctggtactttagacatgatgtctagattacgagatatcattatttgggttacgacctcccagggttataatcttgtatttttttcatgctttatcaatataaactttgcgctgtatggtgcgagtcgttcaaaaaaaaatgcttgtttccggtggttaggaatgcagatcaaagcaaatgtggaagcaaatgcagggttaatcaaccatctcatcgccaaaatccaacaaactacattcgctgatgtgtagcaagtgctcgtctccgtggattggcttgaccaacatctatcaactctggaaactggactacatttctttcttccttcctagcttcttactgaacgaattaactttccttcattgcttgtttgctcctccttttattgagcgatggtcgatccatttcagtttgacgagacagccgtactgaagcacttcagctggttggagagaagagacgacatactctaggaggcggccttcgaataccgtcatctcaactctcttcttaaacagatgacagtttaggctcgtcactgatgatctggtttggcgtaggggttcgatttcagttaagaaatttaaatttcggccattaaatcatccagagcaaaatatcgtagagtacccatgtcatgtgggggattcagttccagagaaggaggcctggcgcgacgggagaatcaagtgcggcaattgcttaggaatttggttttatctttttcttaatattagttaagtttgttagcaagttgttagaagtaagtttgctatttaaaggatgtactttggatgttttagatcaacaagaatcagattaatccttgtcgtgctgctcgactccggctccatgcacaacttcatcaactccaccgccgccgtatgcaccggcgtcgtccttgacccccgacatggccttcacatccgcgttgccaatggcgaccgcctggattgtgggggcgtcgcgcgtgacgtcccgttcaacaatggcgacacgacgttctgctccgacttcttcgccatccacctcgatacgtttgacgttgttctgggcgtccaatggctccaagattctaggtcccatccattgggactatgcgcaactcagcgtcacactcacacgcgcctcgctgcccgtcacctggcgggggattggcggcccctccggcgaccagggtggcctcgctttcacgtgtttcgggcccgatacattagctgatgagctagggagggctttagcactctcttcgctgccccgcacgggctgccaccgccgcgatcacgcgaccaccacatccatctgctaccggacacccgccccatggcagtccagccataccgctatgcccaacaccagaaggatgagctagcgcgacagtgtgcagacatgctcgcccaaggcatcattcgtccgagctcgtccaccttctctgcccctgtcctcctcgtagcacgacaacagttggcgcttttgtgtcgactaccgtgccctcaatgatcgcacgatgaaagacaagttcccaattccggtatcaacaaaacagtacaaaaacaagcataaacagtacatgtggatatttttaacatgtagatctcgattttagatgaatttagcaacttgaaccactggaatccgacttacgatgatttagttatgaatttccaaagtttaatcagattttcatctaatacaaaaaaaatattacgatttaaataaaagatttatggtgtcatcacgacatcatcgccggccatggcctggaccacaaggttaccagcgctacagagctcggttgggctttccgaagacaccaacatgaagaggatgacgacacgaactcaccgaagcaaagaactacgacgaacgatgacagacgatgaactccgacggcggcacggctcggctcgacgacggcgacggctctctggcgagatgcagcagcggcgaaggggcggacgggatgctcctccacctggctgttgatgcgaaaaatacacactggcctgggagatctgcttaactccagtgcaagtccaaagattgatgagatgcgggtgtgccagtcagtttgatcctgcaactgacaagatatgtaaacagcagataaaacagccgatcggctgacaagccgatggagtagttccagccgatagccgataatagccgatgccgataccagccgatagcgatagggtttaagcaatcggctatatgtccaatgtagataatgatatgaaggcaatcggctgatgatgatgtaataaaataacaatataatccagtataaaccaatcggcaaataatgatatgataaataagcatcgatccgaaggttaaagcacacatcggctggaggtccgatgtcatgaaatccacaagattagattaaacaatgaaacctttgttgtcatcggctaaatccaacttatatgtatgtgcaatccttatgagccgatgcaacgtccagataactcaccggctgaaaccccgatgaaacccttattggcaataaagaagcaggctggagattatggttctaagcacgacatagtagatcaaaattaactgatgcagcactaaatatgaaaagaaacataatatctagacaatcaagccgttgactgagttttcagggtggtagatgtctaagctaatctaatctagcaacacgatttagccgataccggcataaaccctaaaacgagaagcagccgatagagctaaattgatatgctaagactagattaacaaagacatatgataaataggtaggcaaatatatcatccaaaccagagcaatccaagaggtcgaatgtactgatgctgccttaaacgatgccgacgtaaacgatacaattgcctggacagtaggaacattggacttaccccttagccggagatcgaacaccgatgcagccccgcgtcaggtgccaagtcccgccagacgataaaataaagtagaaaaggtaaaaggtggcgatgcgccgaattgtattgatcgtagcgatagattacatagaccccgggtgttcatatttatacccatgggttgatacaagtccttttcggagaagaaagaaactttcctaaagataaaagaaaaagataaagtccttataggacactaaacacactttcctaaagataaaaggaaactaacagactattcctaattaatagataacttgccatgccacattctctttaaactcggtctcttctcgataagcttcctttagtagatcaatttccttaaccgaatatagcaagaatccgacaactgacgacttgacaactctcatcggctaatctcaggacttcaaagccgatgctgactctaagccgatgactattccgggcttaccaaatttcactgttaacactggtgaacccgacggtggtgacggaaggcggtggcaacgaccacagcgagggcgcaaaacggtttaagcagcgacggcgacggtgacgctagggctcacatggcggcggcgctacgggcgacggctgcagcttggacttgaggcaaacggaagaggacgactaggggatgctatttataggctcggattaaagagatcgaactctaaacgaaaggaatcgaaaccggaaaatccgatggttagtttggagagataaactcgaaacgagtttgatttagttgaaatacgaggaattaaactccggctttttgagggaaatgaaagaggacaacgaggagataaattcccctcatccaattggactcaggagcaactgatggaggtggattcaaaggggaggcggcagcagctcgggctcagtcggctggcctgaggttgaagaagaatagtgccgagggagtcattgtagactttcagagaaaaggaaaaagaaaagaaaagaaaagaaaggaatggagcagcaggctggcatggctggcagcccgagagaggctttgtgggccgaaaatgacccacggcctagagaaaggttttaatacttttccttatttgaataattcgtgaaatgctatttcgttgattaaaaatacttcccttgctcaaataattcccagaaaaaatccaggaaacagataaacaagcaaagtatttaatgaaatttcatctaactcagttttatgttgcgatttttcctagattattagagttcaacttgtaaacttttaaaataatttctaaaaatgcattaaagaatgaactattaaattaggcgattttcagggcgtgacaatcgctgtgtagaagaaatcgccaacaacaactctcaaactggctcaactagtaagatgttcttaatttctcattagccgatcatagccaatcttatgttaacacttatctctttttgcagcctcctcctcctcctcctccttcccctgtacaacaatcaccaagtaaccaaaccccatcggctacagggagccatcatgttgaagaagaagaacaaccagctgctcttgctatcccaatacgtttccctttgatacaagaacttagatcggctatatctatttagcttctaactattcctaaattattcttgcaggtcttagccgatctgttctcttttgacattaaggactatctcgatgagacag

SEQ ID NO: 63143 - DNA, 22933 bp, Oryza sativa
cagttgtaagaatggtacatttaacatgtaactacactaaatttctcatgtttagactaattgataggctcaaaaataatccaccaaatatgggcacatttggctgggatctagcttcagatccaccttttctagagctgtagtgtaaccaccaacatgcatactagttgcattcacaaaaaatgactaaaattacacatgtaactactgtttatctgaaatgtaattacagaataactataaaacagaaatgaagccaattcacacataatttacttttttttgcaggaatgaagccaatttcagaatataaacataaagtgagcttggagatagaggggactaaagaaaaacacaagatgaaagaaaatgcaggtatcagatagaaacattaaccaacaaaatagtctgaacaagcataaaaaaaaatccatacatttggtttttacagtgagtcagaaccaaaaatacatatgtatatacagttgatttgtaatgtaactttgtttttcacagtatttgtttctatatttttaataaaatagagaaagttacaatgagaatttaataaaattacacatgtaattatagtgtgtgtgacatgtaacaaaactttaactaaatgtaaaagtactctctgacactttgaattacacatgaattttgatgctataactatttttttaatatttcgcgggagcaggaattatttcaaatgcagaatcaaatgagaatagcaacagtatgacccaaggtacaaaagaaaaaaaatacaaatttgctagatcgtaaaaaatctgacatgccagtacttaccaataaatgtgacacttcttgcaggtacagatattcatcaactacaagatataaggggaagtttaaaagaaccagagaaggacaaaacagaaacaaagcatattcaagaaagaagttctaccatcacacaaaattcaggtaaaaaaaataatattctttgactatatgtattctgcaccaaatgaaaaataattttttaattacaaatagccaatccttcatgcattttcaattgacaggaataactgcaactcaaataccacagagcccagcattgctacatgatgagttaaacatgctaaaactctcgagcaacaccggtaaaatataaataaataagcaacatacaaaaaagacaattacatcattttctctgatactaacaaattgaaatgcaggtagcacagttatcatatataagtctcatgcaccaagtgataaacagtccacgcataaacatacaacctaatatggtaagaatatagaatgacaatatgaatatcattgtacaacaacaaatgtttgactatgagaaaaaataaaaatgatgcaggcaagcctagaaagtttcacaagtctccttcagacaccctcggcctttcatgtaagtatttttctgcatttaaatttttgtagagctaatttatcatattcattgtacaaactaatttttttttaattttgatagtgcagaattcaatgatcctaacgacaagcaggttttctccttaaaacacagagctgaatgacagaaacagtgcaatatcattgaccaaacccgaaaatctatccatccatctgtgctaatcttacagaaaaatcaacggtccaaaaaacgacaaatccagccaccaaaaatcattcgacaaatgtatagcaatttcgtctattattggtgctaccaggggagacataagacgcattgctaaacacattcttgaacaaagggagtatcatccgacggtgaaatatacaatttcgaattgacgttttgtcattaaacaacagggctaaattcacatagcgagggcaacattctgcaatcttggattggtcaataaacaactggaagacaggcacaagacaaccttcgctccaaactccgactacttatctgcggcaggcacaaagagcccaaataatcttcaagcagtttagctaagttacattcattaggagtacaggagcttgtgcattctgttctctgttgcaacaaaatagaaccggagaaaaatgagcaagcatagttgctttccacctcaggctataggtggctgcgcttgctgtttctgtaccatggccttatgcttctgaccaattatgtgaaactcataaactttctggctgttgacgaccacattgcacacggtacatattttcacttctccttgagctgctccagcgtcaagtacacgcctcctcttcacctccagttcctctggggttgctgcagcactcttcttcttcttcgtttgtgcagcaggaatcacactggtagtgacactagtagtgacaggatcaggtgccatatttgctgcaagagcaacagtgtttggagtacttggaggctttactggtttaggtgtgatagagtcttgtagcctctctaagtttttcttgtgcttctttcccgtcttatggatccttagaacttctggagtatcgcactgaatcttgcaaacttcacaagtcaatggttgcacaacctttggctttttctttatatgctttcttgaaacaattttcggcacaggatgcccgaaatgggcattccactgagcagggtgcatgcctggggctgcaattgctggtgccactccattcgaagatctggcggctgctgcctacagatacattgttgttgtgaagctaaaagcaaagaataagtatgaatataaaacagataaccagcagacttatagctccctccttgataagatatggcacataaacaaacaattacaagacaaacagaattatggatttaaacaggattttggcaaatgaatgaaggatagatgcgacatatcctaaataggttcagcaaatgcttaaggctaaaaatctaaaatcaactacaggaattaaaaatgacacacgtgtgttataccagaatgacacatattataaggattgcatatagaaggaaaacaaaataaacaaaacacaatctatggaacatttaatctttgataagagtcagtaaagcttccatagagagaatgagctctaaaataatacaaggatttttgttctcatcctatgtcaacatgtatcgttataagtcgattattttagcattatttacaaatttcttctagtcacaacaggtatgatttattttccaaggtgattgttccaacggacacttgatccaagacttctgctgtgttgtgcaggaaaagcttcacatactactaataatgttcacttgatccatacttaaggttctatttggcacagctccggattcgagatttattggagctgagtatttctagctccacaaatccatagatttagatctacgattacgttgataacatttggattaatcattttattcccattttatatgaaatataaaattttaaacaactataatttgacatacaatcttcaaatccagcgttgatctgggatctatagttgtaccatacatgaccttaaataggtcacaactcttgctttctgctgacactatggcagatagggaccaaaaccactttaatgacgagaaattacagcaagctcaacatgaactccactgaaacagattatttggagggaaaaataagaaaataccaaatggattatatattatacatcatggctctaacaaataaatatattgacagattatttcaattatatgttcatctttttcagcaaaaaaatattttgtaagttttttaatcatataacactcgcagaccatacatgttctatagcttggcttgttaaccttgaatttattgggacctccagaaaacacgtcaataataggaactacagtagttgctgtctgaggagcataagcaaagttcaagtaactaagatctgactgcaagatgagagatgcttcaacttttgcctttgctgccttctatgtaaatacacactttagatttgcagaaataagagaactaactgaggaatcatatgtcgcattccaacaaaacgtgccaacgcaagcagtgtggtatgggagcattacaacgtgcatgaacatcaaatcagaccaccaaaactattgctcaattgatgcattggctgtctaaactctacagagacatctagcaaagaagaaaatcagcaaccttttactaaaaacctaatcagtagtagtagtctagattcagatattagagcactgctttattttaattttcaaaatgccttactttaatcagtacagaggatagtaagtttcaggatgacataagacatatcttcataaacacatattgtaagatcaccacaagcaattgagtgcatattgattaatttattgtatttgtttcatagtttgacaagatcaactttgtggtgtgaattgtgatccaagtgtgcaattacaactacaacaaccgagttattattattgttctaattggtttttcatcatagaatagaatgctataatcaccacagtagtaacatatcgaatgactaatcttgaagactgtatatggtttgttttgctgcaatcttttgcccgacattccaacatgtgcaattgaagaaaacaatctcaaggacctcagaaatgaaatttctatttctatatgtcccaacggtgtccacacaataagacatgaactttactgaaagaagtgaactggtgtaaccaagttagcaaagtttttcaaacatgaaaaaaacatacaacaggctaaaataactataacaggcaaatggtatacttgattatcttttaactttcttgaaacaaaactcctgctaccatatgctgatacaatcctttggttggcacataataaatacaaataacataaacattaataaataaattaattaaaaccagacttcgcatatttgaaacatggtgtcaggtcaggcaagttaccacttgtttctactgtattatatatgtaaaacccaataaaattgtaatattatgaaagtgctttttagcacaatccaaacatatgaatttaaagacccaaattaactatttcaaatattcagttttggaagtttgccatgaagtatgtccagaatgacattttctacaattgtttcaaaggaaaccaacccaactaaaaacataagttattcagttaaccatacaggcataagttctccaatatctccaatatcaatgcgtttcaacgatacggaaaccataagatcgaactccagatagtcaaatgaggacaggtaaaaagaatgaatgtttcaccaagtaaaaaaaaaatgaggttacgtgatagccaaaaaattaggatgcaagttttgccattacttaggatgcagtatacacttaatatgtctcactgtgaggtccaaaggaattgcgcgtaggcaataggcatatgaaactgtggcaagtatctgagtaggctgcctaagctttgggtggcacggtagtggtcaagtgaatagtactcaatatacgccatatatttttacaaatctttttacaaatattatctctaatatatgccatatatgccatatatttttacaaatcttatctctaatatagaatgtatgttatccttcaaaacaaggcttcgatttaatcgattcatcatcttttaagatttcacggaacaaactgaaattcgtgtgtcttggcttatccacaaacaagagtctttcatggaagcaaaaaactcccatgccacagaacatttcagtttgcacgaaagaattgtgcttcacagtaccatgattccacaaccgctaccaacggatgaactaaacaatgtggaaaacacctaatccatgcaaatgtctgagtctcacatataaaaccaagttaggactaatcgaataacaggtaatcccttagcgagaaaatcgccaataggccatcaaattcttaatttatgcctaaaaatgacatctcaaaccctaacacgcctgaattcaccacaaaacaatcaggaactaagggacattgaatcaaaagagaagcagggtggatcctgacctgcgcgtagcgctgaggatcgaacccaaagtgcttcccggcctccttgccagccgccgcggtagccgccggagcaccctgcgacgccgacgatgccggggcctgaaacgcctcaccggcgccgaagtagtaccccggcaggcccccggcgccgccgctgcctggcccggccgcggcggggtcagcgtagtactggtacgccgcgtaggggtcgtactggccggcagaggcggcggcggagaccgcggtggggtagtagtaggaggatgaggcggcggtggcgggctccgaggcgggggcggccgggttgtacgccgcgtaggggtaagggtagccggcgtaggggtgagggtagtgcgggtggtggggatccgccgccggcggcggccccgcggcggcggcgtgagaggcggcggcgccgtagtccatgttggtgcggtgcgagtgcgagtgcgcgaccgtcagatcgcggctgcgggcgcacgtaaggcacaggacaatattgtcgtgtgtttcctttttcctctctttttttttacgcgtcttcacaaaatgcttgctcgtttcaaatttgaggaagaagaatctcgttgatggagggtcaaatttcatcagggagaagaatttcatttgtggtaaatttcaggggaaaaggacttgctaattttggttgcaacattctgttatctcagaatgcagataagctgagtcctacgaagaatgggtagcaagatccttatatgttgtagtcaaattagcgaaatcatctcaagcacatatatgaccgtaactattttgaacacggttaaaccaaatgtataagtattcttggttagatttattttctgttacatcatgagttttatgtgtttccttagtcctatcaatcattgcttgagttaggattgtgtctagtctgagccattatgttgactttcatttaaaattattattccatcagtcccaaaatataaatatctagtactggatggatgggataatacatattttcatattccggatgaagatagtattaaactttccattctctgatttaagaatttgatatccttgttatatatttaatcatacccatagctgtatggatttgatttcattgtgtcagtggagtcaccaacttacattggtaagatctcataggagcttggtaaaatgattaagtgtgtgtgactttcaagactgacacctaatagtttattggaacatgcatatttttacttgtattcttgttttttactaaccatgatagggatacacaaaacaactagagatgattgtgcacaacttcaacatcttcattaagacatgaggacattgagatatgaggaccgaccaacattgggcatataagatatgtgatgatgttctacataaaatcattagtacactcatattttgaaggaaattacctcatgcttacattaaatgggagctagcaatagataaagaatttcaaaagcatgatttgtctaaaaaaacaaaagctttggtgttctaattttaaaaaatgcttcatatgattgagaatatttttataggcatgataaaatacctcaaccttggaaatacatgaaacatatttgagatatatttatgtttccatggattatgccaatattttgttcattgaaccataatatttcgaacaagagagccaaatcgttacatcatacaccatgatcttctttactacaatgtggtttacacgaatgcaaagaaactaaagaaatgaggtttttagggttaacaaagaaattttagacaagattgctcgttgaagttatagttatctttctcatttattacaacttgcttgcaatgctgaagtaaaaataaggaagacataagtgttgatgtgaaaacacgacggcctgggagatctgcttaattccagtgcaggtccaaggctagactcgagagtgtcaagggcgtgtcagctgatttgatcttgcaatcagtaagaaagacaacagcagaattagtcagccgataaccgatcgaccgagaggccgataaggtattgttggtaatctcagccgatggagttagaccaaatcggctatggactgagtatataaaagaatattgaactccaaatatgcctaattgactgtaatactgtctatcaagtttgataaattggtttaagacaatatcataaaagtagccgatgtgacagtatttagaacaagaaagaaatgtactagttaatactccagtacaaacctatataaataaattgatctatataaacatatcaaatagaaatcagcttgaaggtgcaagaatctagccgatactgactaaagcttaatatgcttatataaaatgatctatctatataagtggcgaatatacatgaaacaagtagtaaaacatgcatattaggtaagatcggctgaaaccccgatactatcattattatgtctaattgcaagctggtttgaatggttttaaacacgactagggatgatacatctcaaagtatgaaagaagcatacagtctagacaatcaagcaattaaacacttttcaggatggtagatgccttagctaatctaatgtcacgcccagaaattcccgaatagaattccaagtagaatgtgcattaaaatccccgtccaggaccggccggggtacacaaacaacaaagttgacatacagatccacgtcttacaaacattataaaagtcttacatacatgcagcggaaaattaaaagaaaattggagctaagccttgacttggaccgcagcgggatcacctactccacaggcatcctcgacggcacgaacgaagcctactcctcggagaagctaccatctgacgcatactcaaactctggtgtttgggaaaaatagagtaagactgagtactacccactgtactcagcaagacatgccggaataggggtatgatgcagggaaatatcgagggatggctatagtggttcatttgcataaagcgagcatttataaacagtagttgaaagcagtaaaacaattgtaataattaatcaatattaatcatccactgtccaacgctataccacgttgcaacaggcccaaccatccacctatactattcaattccattagactagactagggtgaaactaatcacggtgaatctggttgaccgctcataaccgcgggcacggctattcgaatagttttactctaatcagagttgtacaactgtacccacaagacacagccccacgacacgtttccgtgcaccgacatgccaccacgacatacctgatagaggccgtgacaggacccttcgcataaccccctctaaccaagcacaccacacctcaggtttcacccccactcctcgcaaggcagcgggcagtcccctctcatgcctaggtgaatccggaagccgcataggccgtcgcagggcccatccaaactccatcacacccacccttgcctggatgcgtcagtcagaggaaagctacactacaagcccagccgttgcccacgttggcttgtggtaagtacggggaattctcccagggtttcctgcgaaccggtccttaagtgccatgggcgcgactagcaaaaccatgcacccacagcccaccatttaacatattttaatgaagcaacaccaggacggtggctctaatccaatgtcaacactagaacctgaagtctagacattaatataattttccccattgtgtgctagttgaactaagtatggctaagcaatccctagtccaatatctagtcatgttatatcttaagctaacaaaggaacatggtacaaaatagcatggctataacagtaggtaaacatcccatggtaatattataaaacaatgcagtatttgaaggaaaacaatagagcatttgcaatataggatcaacatgttcaagtgacaagcatgacttgccttgctctgctgctggaggaacctcggcgactatttcaaagtacaccggagcgtcgggagagccggaatctaagcgacatacaaagcaaacaatacaaacaagctataagactactgaaacagagagcaaaaccatttttaatggattctacgcatttttcttgatttactgagacttgaatgggcttaaacggagctcggatgaattagatatgaattttagaagattcactgtgtttttactataaacagaaaaatccttaattgatttattgcgcaataaataaatcccgggagagagagaggcggcgccgaaatgcgggccccacatggcagtgacatgggtggcggtccgcggtggaccgggtctacggaccgggaaaggggcggcgcaccacgtggcgctgacgtggcgccgacgcggcggccacgcggcagccacgcgggcggccgaacggatggccctgatccactcggggtggatcggacggcggagggggtggcactcggccggcgcgcacgtgcggctcaagctggcctgacggccatggcgcacggcggcgcggctcgacgcagcggcggcgttgcggcgacgcggatggcgacagcggtggctaagcggctaggcggcggctaagcggcgtaggagagagggagagagagagagagagaggaagagaggcctcaccgacgacgattgacgacagcgagcgacggagggcgatggcgacggcgggacgagctccggaaccacctagtgaacaagatgagaggggttagagggagagaggaaaatgggagagggcgaggacgccggccgaaggcggcggccatggcggtcctcaccggcgcacgatgtggagtgggttccggcggcggattctgacggggaagaggtggacgggatgatccacacgacggcgaacgtgacggcgtcgacggcgtggctcggcacggcggctagcggcgaccggagcggcggcgacgccggcggagagaaaggcaccggcgttagggtggtggagggcacggaagagctcggcgaggaaaaagagagaggggatggcggtggtgcttaaataaaggaggaggggtccggacgtggccgggagaggcgggaatcaccggccgacatgggggagtgggagaggagagagaggcgggattcgaaaatcgaatcccggccgtctcgagcgcgggcgcgggcgggagagagagggaactgggcgcgggggacgctggtgcgagggcgacgtgggcgacgtggcccgggagacacgggagcggggtgcggcggcgccggctggaggtgggagacgggcccgacaggtgggccccacctgtcggcgacccggggagagaggagggggctcgggcggctggctgggccgtggtcttcggctggcccagcggggagggggagagaagagagaatgggccggcggcccattcgaaagagaaaaagggaaaaagaaaaagaaaaagaaggaaatggattttcctgggattaaatattgcttgtgctcaattttaattggttaaaattatttctagagctctgaaaattccactaaaaatcttgttagcgtatttcgacatgtagaactcaagaaaaattccacatgccaattccgattattatttgcattgatttattagggtttactcttgctttacaccggtattttcttgagaccatttataacttcaatttaggcttgggaaagaacttcagggtgtgatatctaatctagcaagacaatttagctgaaaccagcataaaccctaaagtgagcagcagccgatagaggtaaattgagaagctaagaatagattaactaagacacatgatagcaattactcgcgatatcgagcctaacacgtctaaagcgacatgttagccccaatagcaccggccattgagatgggttacctcttgcgaagaactcgccgaaaacgaagaaaagtaaaaagggtagcgatgtgccgaagttgtattggattgtctctcgtattgcaatgttatggggttcatatttataccccgaatacaaacttagtccattatggacatgactcaaacctttctaaagttaagatacaaataagaccatatatggcggtttcttaccaaatctctaacaaaccgactcaatatcctaattaatagatacaattgccttaatcgagctctatctctaattggcaatgacggttatctcaatcttggcccatgtcgagcccaagtcataccataatggttgtatcagccatctgcctcatctacctagatctgactcatactctgttttcagccgatacgatatccagccgatgcgcagtccgactcgtagatcaactcgatttcacaccgaatcctctttgatcttattcctttttctccgaatctaatgcaaaatttcgttgttaacaataagaaagcaatgtctcttacatgtttcctaatgaaagggcatattctagaacaataaaggtctattggatttggctaaacatcggtacgtggttgattgtattagtgggaaaaagttggattttgttgtattttagagacaaggaaaaaggacatgtctaagacaaatccagattgcctcacgggagcgtggattttatctagcattgtcttcttcctcgtggacaatcttggggtatcatcctatggataaaatgctttaaagatggacatatctctcattgttgaaggtaggggtgggcacaataaactgagaccaaagaccgaaaccgaataaatcgagaccgagattgaagtaccgatctgtcagtcctcagtctgttgatcggtctgggacgtggaaagaccgaacttttatttggtgcttcggtcatgacccttggtcaaccgaacagaccgaactctagaagtagcagcaggccataggaccacagttgctccagaaccatagcccacttcacccaggagatcaggatccaagagataacagactgaggcatcagagagagtagtacatgcacaactgcaccatcgaaaacccaaatcgttccccactgccctcctagcaaccgccgcttcaccctgcgctcgtgctatggtgccttcctgccgccgactaccaccagcgccgcacctcggcgtgcctgcgcctgctgccagcaccactcgttcacaactgcattgctgccgtctcctacgtccccctgttgttcggcttcttcctttcgctcgaatccacataagaagagttggccccaacgacactcttctcactgctgctgttgtccatgtcctgcgggagcagtgcgagacgactcaatcttcgtctcagcggcggcggaggcgagacctcctgtaatgtcacatcctgatctttgtttcaggatttataaattatttaataaattattattagaatttatattaaatgttcattaatttacaagtgaagttaaatgtgggaaataaaatttcctaaatataaagcatggatggatttaatttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattagtagaaatgatcttaaaagcctaaaagagaagatttttttttaatttgctaaatctcaatataaaattgggctagataaaattttgttaaatacttctcttgaatctttagttcctagatttttttgggatttatttgagccaagaaagtatttttaataaatggaattgcatttcatgaataatttaaattgaaaaaggtttttaaaaagtctcttttggctttgggccgaaagccggcccaaaacctctctctttctctctccctcctcggcccagtcggcccagcccgccgtcgcttccttctctctcggtgccgctgacaggtggggcctacctgtcagggctgtcttcctcctccagccgtcgcccggccgaaccctagccgagctgcgccgccgccgctgcccttccaaattccgtcgcccctctctatttccggtcaaattgattgagggcaaatgatctttgagatctcctcttccttttctcttttggaaacatcggctaattttctttggaaaccggtggatttgagttggattcggattcatctatctcctctaaccctagactttcctcctcgccgccggtcgccgtgggcctccgtcgccgcctcctagcctctataaaagcatccctgggacctcctctatccgccgccacctttgccttagcccgccgtcgcgtctagcgccgcctccgcgtagccctagccgtcgccgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgtcgccgcttcttcctcatcgccggcgccgtccgttgctcttccgccgttgttttggtcaccggtgagttcgccgcgtcgccctctacccgttggtgtcctccgtttgcgtcgtcgcgccgtcgttcgccggtgagcatgcgttgccgagccaccgccggtgatgacgtcatcgctgacgtcatagctgacgtcatagctgacgtcatcgtcgctgtccccgtagacccgctgtggaccacggtagatcaagtcgatctcggccgcccgttttggatagaatcgatctcggccgttcgtttccttagaccgtcccgtgcacccggaccgcctttgatgacgcaataattcccttttctttttcaaaaataattcattattgcgtcataattcaattaaaatccatataaatgctttaatccgatttaatctttgaaaattcataactaattcattgtaactcagtttaatgtggttcaagttgcaaaaattatataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtattgtttatttggtttttattagtctttttcttcgttttgcgtgttagcttgtcgtttccgtcgttgtgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgggctatatatattggttcagctagatattaaatatgattgcttaaccatgcttagaaacattagcacactattgggataattaatgtttcattattatttaatgatagcttaatgatagctcgcgatggtcaatcgtgattggttaattaattacttgccaaccaaaacttgataatggtgggttgtgagcacatggttttgagagtcgtgctcatgacaattaaggaccggttcgcgaggtactgttgtgaaacattaaccgtgccaaccacaagccagcatgggcaacgactttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcagaatggttgggcctgagtagcatgggcgtgttgttcagtgttgattaaaattaatgattaaagtactctactgttttattactcttaaatgtttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgatttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacatgtaatcctacctgctgttgtgtcctatactccttcctactaattaagggtgctcggtcaggtcaggtaggaccgaagaccgaaccggtagttcagttaaccgaactctcggtctaagaaattttgttgtgttgatcggtcatcagtttctaaaaaccgaactttaaatagactgaacaaaccggactgaaaattctgtctagaccgaatgcccaccctagttgaaggcgaatgttacctaaaattccatctgatcaacaaagaggataatttcaaatggattctcatggcggtatatagactggcacatactctaagggggatttcttggttgaaatggttcggacatgccaaacaaaatcatcttcccactctaatggcaggtgattttagtatactcaggaaaagtactaaaaaatgcaatgatcgccgcaatagccgttgtccatttctttccagtgttgtcattgacagctttgatttgcgagaaatcgatctcacgggtagaaaatttacttgggcagactcactattgacaccaacttttgagaagttggatagggtcctcatgtctacggagtgggagtccaagtatcctttggtgccggtacatgccaaaaaaggcttatttgatcatacccctcttctcatggacactgatgcacatgttttcacggggaatatgaagtagttcaagattgaacttggatggttcccgcgggatgatttgtatgtttatgtggtcgagatatggaataagccaatgaaacggggaaatgttgttcaaaggtggaacattaagatgaatgccttacgacatcatctacgaggttggattgcacatgttagtggcctttatcagaaagaaaaggaaaaattgcagcacactattgacactcttgatatcaccgcagaagtttgtgttctaactaatcttgaaagaccgactcttattcagtccagagatcggctggcgcacctacatcgtgaagaagaaattaaatgatatcaaagcgataaagctaccaatgttctttttggtgataatctatactctaaaaagattctaatggtggtggcgttggtatttgtcgcgatcacagataaatccgcaagagcatggataccgctgtagcacttcactttagagtatttcaagggtatgaaattacagggaacgtgtgtgtataatctaataacaggttcatccaaggacaacatgtaaatggaaggcttaggatagagaagattcctatggattaagattcttgaattaatttaaggtaaaactttatctcttgcttcggtcaccggctttcccttggtcttccaagtgaatctggaatatagttctgtgacataccgaacgtggaggattacaaagaatggacatggttgtctccacctgccgcctacctctatacccgcggagtacacaacaaacaaatgtaacatctaacctagacatcacgtctctatgttattgattataactctagcctcgcacaagatctttcttctttatcctgaggtttagtactatagcgctttataaatattaaatgatgaacaagtaaggatgggaatatatcttacttaaacaagaaaattaaatgaccaaaagaaatctcgacttacttttataaaagaagtatccgccgaggtacaagagttgagagagtgctgacaaccccaagactcctccaaaacttcccctcactctctacctatttcctaacactctactagagagttgccttgaatgaaagtcacagtccttcacttgagttgtgtgttgtgaagtgaagtgagaagctccttttatagtgcttaatgacggttgctaatgtcggtggttaaggcggtttcatccacaattgccattagcagccaataggggatcaccacgcggaatatggtggcaaggggcgccaaccacccctggttcagtcgaatcctggtttggccgaactaggataaccgccacggcccaccgacttcctccgtgcgtatgacatgtgggcccttatgatgatgaatggtgactttggcctaaattatgttggtttgctctgatttgtgggctcttcaatccgtgtactcgcgtctaattggtcagaggtgtattttgtcacatggcgggtgcgttgtaagggcaatatactcccattgtagtttttacacattacccttgaactttttaatattacataacaactaaatctaaatagatagccacatataaaattaatttgagatgagtattccttgtagagaaaaggtgggtaacataatcatgaaaaacatgctttcatttttttaatgcattgttatgatatttttttccttttatccatatatagcaaagcaagggcacttagctagtcatactaaatattatcacttgattgctaattgcaaacataggaataacttttggtttgcatttaagcagcgttgctggactgccgatcttcttcagaagtgtggtatcgatagccactctgcttgccccttttgcgctcaggagcttgagacggagaaccacatcctcattgactgcgtgtttgctcgacaggtctggctccgtgtgatgtcccctcctggctgggctgccttctctccccctcgtggcagctggctctaggattgtagtcatcctccagggcctgtttacctgagcacctccgcatcggctttgacttcttggttctcctagtctcctggcagctgtggaaggaacgaaactccagggttttcgaatctgcgctcacttcggtcccagtggttctggagtccatccgcttggagggccagctgtggtctttagccggcgttgctatttttggggatttcttgggagtgtagcgtggctctgccccctcccgctgtctggcgttgcatttttaaccgtcatagtagttcctagcttcaggtttttttattttgccttttctcccccctgggcataagccagtctggctgattgctttgtgtaacaaaaactcttttcttgctaatatattgacgtgcaatccatttgcgcgttcacgaaaaaaaaggaagaaacgaatcattagccttgactaggatgaaggaaaatttgagggaaatgaagccttaaaaatttacatcacagagttttgtattaaagattttggaccactagatgtgaattccttctctctcaatgaaaacagaaaagaagacatcccccaagtgtctaaggcataaaatgatcattttattgcatctttctctaaggaggaagtaagagagctgatttttggtatggaaacaaataaggcgtcgggcccagatggctctccggctgaattttaccaaaaaatttggaatgttcttaagcatgatttattgcacatgttcaatgaatttcatgccggagatttcccaatgtttagcctcaattttggagtaatcacttcatacccaaagtaaaggaggacaaccaaatacaacaatatagattgatttgcctcttgaatgtcagttttaaaatctttactaaggtgaccactaacagaatcaactcaaaggctggccatatagtgaggccagctcactaaaagaatcaattcaaaggttggacgtatagtgaggccaactcagtcaacctttatgcaaggacggaacatccttgatggggttgtgatcccacatgagactgtccatgagttacacagtaagaaattgagtggggtcatttttaagattgactctaagaaggcttatgacaaagtcaaatggactttccttctacaaaccctacatatgaaaggattctcatcaaaatagatatcttggattgagtctttcattttgggtggaagcgtagctatcaaagtgaatgacgatgtcgggcgtttctttcaaacaaagaaaggacttcgacaaggggaccctttctctcctattctttttaatttggtagttgacatattgactgttttaatccaaagagtgaatacaataggaccaattgatggcatagtgcctcatctgattgatgggggcttaagtttgtcgattctgcagtacgcagatgacactgttcttttcatggaacatgatttatcataagcacataattaaaaatgttgctaaatgttgtcgaacaattatcgggcttaaaaatcaatttccataaaaacgaaatatattaccttagcgaggccaaagtcatgcaagggcaatatactgatctttttggtcgtgccatcgataacttcccattttgctatttagaatttccaatgcactattggaggctaagtaattttgattagaaagaagtgctagaacattttcagcaatggcttgctagttggaaaggtaagattttatcacttgggggagactcacactcattaattcagtgctcacaagccttccgatgtatatgatgtccttctttgcaatacctaaagatgtgatcaagaaaattgattactttcggtcaagattttattggcaaggagatggtcataaacgtaagtatcaacctgcgagatgggatgtgttatgtcatcctaaagatcaatggggtttggttttacatgatttggcatgtaagaacatagcccttcttagcaaatggttgtttaagttgctcacaactaatgaagcacaacaacaattgttgtgtaacaatcgggttcacaaccttcatctcaagtttggtggaaattgggggattcacacttttgggctagtcttatgaaggccaaaccggattttcttaagtttggcttcttcactattgaggatgacactcaagtttggttctaggaggataaatggtgctgggtaatgcaactttgcatgagcaatatccttgtttttacaatgtggtaagacataaacaagccaccatttcagatatctttcgaccaaccctttcaatttcaccacatctggataattggctctaagctagtggcatagaatcatttactcccacgtatcgctaaatgagcaagatgaatgtaaatggaatctaactaccattggtggattctcggctaaatcacattatagtgcttcacttcatactggtgttcccaatattaaaaaaaatctagaaactaaaatcccctcttaaagtaaagattttttcttcgtggtatttgcatcgtggtgttgtgtttacagaagataacctagcttaaagtaattagaaaggaaacaagacttgttgcttttctctgttttctaaatgtcggtttgcctgatcgatttggtctcaaatccactttgcggccaacatttgtgcgccaagggatgcgtcacatatgtttgggcaatggattttgagtcaacccttaaaatttcgaactctaatactgattggggtggcaacagcttgctggtctatttggctttgtaggaatgatgtggttttgaaagaaaactttatttcttctaatccgcaggttatattcttgattacacgatggcttcatgcttggcttaattttcaaaggcccattttgaaggactttactgttgcggcttgttttcaattggagcaggtagccaaggagtttttttcaccccaatgtttgggtggcgttttagttttcagataaatggcctttgatttttacagctttttctttagcgatgtgcatggggtgttttggttgtgtgaactttgttgtgcagagaccggaagtgttctcagacatttgatttcaataaagtttccgttatcttaaaagaaaaattcttgatgataaaaaactgtctgttgttttgcatagacctccaagatatagtcgttcacttataatggtcttgtataaataaaagtaattatgagatctgaacccttctgtacatgagtgttgtctagaaagtttgtatgcagcggtgtgaaatgattcctttgtcttaatgttaatcatcttttttttaaaaaaaagataagagaggaaaggctctcatagcaaaatttattaagagatcggtgaggctcgaacccgcctttctcaatgctaatcatcttacaaatatgtcacatgtattcatcctcatcatcccaatcaataaatttataaggttcatacttgatatcaacacaaggatgatttggatgaatgcacatgacattattgaaaacaaattctacagctgttctatctgacagagtagcacggaatccactgatgcttgcatggatttgtttgaggcttgacaaatgccctatgccaaaaggtaactccttttgt

SEQ ID NO: 63144 - DNA, 56459 bp, Oryza sativa
  unsure (1)..(56459): unsure at all n locations
cgatcgatctctctcggcctctctccttcgccgccactgcctacggcaaatccccgcgccccgacgccgccgtatctcgccgtcgtctcgagctcgtcgtcctcgccgccgcctccgcctcctccgccgccgcgcatctctggggtgagagccgccgccgcctctcccttcatcgatctccaatctcgatctctctctccgtcgcgccgcccgccacgagacgccgcgccacgacgacgccgcgccacgccgacgccgcgccacgctgccgccggcacgccacgccgccgccttcgccgccgctcgcgcaacgccgccgccgccacgccatgccgccgccttcgccgccgcgcaacgccgccgacgcatgcaacgccacgccgccgccgccgtcggcacgccgtcgccacgccgccgcgccaagcgccggcccaatgccgccacaccgccgttaacgaacacgtgaacgagaacgaacacgtcaacgtacgtcgagaacgtgaacgagaacgagaacgatcgaacgaacgagagcgagaacgagaacgatcgaacgaattaacgtgaacgagaacgacaacgaacgtgaacgagaatgaacgtgaatgagaacgagcgaacgaatgtgaacgtgaaatgcaatatatatatatgttacttcgcatttatcctaatacatattttttgtatcttgcagaaaagacatgttgtcggagtcgtccctcaagccggagtggaagagctagccgtagaaggaattcgtgcaggcaagtgacataataatataaatgattgttatatttgtaatgcaattaagaatattagacttgtaattagacttagcatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttagtatataattattaactacggaattggtgcgactcctagcaattgacaattttagtcttaattagacttagcatatacgacagaacacttagcatatacatgactattttagtcttagcatgtaatattatttgagttttaatataagattattttatttgtaattagacttagtatataattatttactagctagggttgtataatatacgtcacctagacttagcttatatcacgattgtaattagacttagcacgtaaggttgtgtagggttctaatgtacgacatttacacttagcatacatgacttagattgttaaaacataaatgttcgtgacttagcagatatttcttatatcaacagatggctgactgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttgtacaaaagagggcacgcgggcaacgaggtgtagcgaagaagcttgagggtcggcacatcataacgtaagtgaaagaagatggacgtcctagtgccccggccgaagccgccaagaactatgtacgtcacagcggttgggttgtgcgggataacgtgactgtcaatacggtgtactggcgaagaacaagggcacgcggagatcatgagagctttgtcccagattcggagaaagagatgctgtggaccacaatgctcgagacattcacccttcccacgggtacagaggacaaagtgaaaaggtggactctgaagaaaatggcagaatagtttcagagctttaagggagagctgtacaagaaatatatcctgaaggggcagacaccgaacttcaacacattcccaaagctaagggatcactgggacgagttcgttgcatataagacaggtgaacaagggcaggcgatgatggaaagaaacaaagaaaatgccaccaagaagaagtaccatcaccacttggggtcaggaggctatagcgtcgcgatgccgaagtgggaggagatggaggctaacttgattgagaggggtatcgaaccggcaaccgccaattggccggaacgatcgaagttctggtactatgctcacggtggaacgctcaacccagctgatggctcactggtcttcggcgatcagatacgagaggctgcgcgatgactaacagatgcagtggaagcctcctctcagggcacgttccgaccggacagagatagggatgagctgacactcgccctgcagactccagagcatccaggacgaacacgagggaaaggggtgattccttggaagattggtttcaaggtggacatccacacgtacaggagtcggatgaggagtaagagagataccgaggcgaagattgcagatctagagttccgggtatcgagctacgaactcagcatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagccacatattccttacaagaacttatcaataaaggtaagctcgtagtttatatattttagatttagccattccgctagttgctgcttatatatgttgattactaataaataatctctcacaacatgaaggtggcgtcgggcatggccatcccaactaacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcaggatcctgcaccgtctcctcctcatgatcctccagcaccgtctccacctcaggctccagcaccgactcctcctcaggatcctgcaccgactcctcctcgggctcctacacctactcctccgcaagcttctcttccggcaccttcaaagtcaagggccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcgtactatgagcgaacgctgaagaaagcatattctggaaagtccaaaacagtccctcagcttggagagcaaccaaaccaggagatcgagccgttggtgaccggtaaagaaatgacgatagaagaatttattactgacaccggtctaactacggatcaattgctaggagtcgcacaaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacagacttcttgcaaggagatgacattctctggatcaatttcaagggaatctacgaactatactagctggacgcactcgacgtctctattatgagttgctggattttgtaagtatatcgttcagttagatttcttactatacgtctcctttaattaattaggtccttgtatataagtagactatagaaaataatatactcccttttatcgttgtagaatggagatttaaagggcccgacggcggagggttttcgatactggattcatcgaccctcggagagtaaatgtcgcaatgctcgaccaatatccacaagaaacagaggacaatctcgtccatctcctgaaggcgcagcattacaagacgttcatactattgccgtacaacacagagttagtttaattttactgtcttcctacatactaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttaacaaggttttcgaacttatacacaggtaccgtcataagttcctctgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgatttaaatacatacaagtgtatattaattagatctctcgttgtttgtcatttatttgtagtgcgtaaagcaaaagcagggaactaacttgtgcggctattacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttatcgcatgagggataacctgaccacacacaaggaatttatcgcggcggttcaagaacaactcatgggattcatcaacgaagaaatccttgatcccaagggtgaattctactatgacggaaacacaattcaccggtccttagtttctgagctagcagcgagtactactactacgtcgaaatcgtagctagctaggacatataatggattataattaatacatgactacatatgtttctatatgcatgtgtacacattttctataatgtaaatatattttggtcatatatatatatacacatatgcattggcctaacatatatatgtataaatatatatatgcatgaacatatgtgctgtatatatatatatatataaaatatgtatgcatatatatgtattgaaacatatatatgcatggtttatatatatatatatatatatatatatataaaccatgcagcaacagggccatgcaaaaaaaaaaggtcagctcgatctttagtcccggttggtgaagatcgatctttagtcccggttatttcacccgggactaaagatagcgatctttagttctggattggtactcccggtttggaaaccgggactaaagaggagttacaaaccgggactacaaagggtttctccaccagtgcatgttttatccaactacagtccatccgtagataatagagttcttggagttgcactagcaactatgattgttacgctaccggaagcgatatgacttagaaatatccgtaaccgacagctcaaaggatggttcacaggaacccgtcttacccttgatgaggcaaaggaagtacttgaatggcgaacaatgacatgtggagtccttatttgccacaagaatgggaggtggggcaacagtacaccaagagatgaggccgtggaattgttcaatgctttacagattgtaagcaataatggtgcgtttgaacgcctcggtgtaatggtttggcctagccagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttggcgcggttaccgtgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttcttttttttttaaatttttgaatttggacgaattttattaaaccgtaccgcgcggtacgggtaaccgtacccccgcggtacgggcggtaaccgtggtaaccgcgcggttaccggcggtttttcacaccctgggcctagctaccatagatgctcagaaccagttttggatgacaaacaaatcctaaaatcaaggaggatatgaacaggatggcgcaaaggagggggtgatccatattttagttttctatatttaccatttcagagtggtatctctatatatgtaataactagatttgctcttcataatttaataaaagattgttgttcctcatataatttgtacttgcatatgcatatcatgcaaagtctgttcttaagcaagagttcattctgattgcatttttcaactgtatcgccacaatgttcattctgttgtacatccgcaccttcccctcactaaatcgtcttaatttgttccttttgtgatgatgttacagtttttaattttttttccctttcctttgtactatatacttgtatgcagtgcaacaacgcttgtccatgattactagccttttaattaactagatgtcgtcattaaacaagagaataagcccttgttacaattattattttttgaataaattaatcgattggaaggaggggatgcttgttgtctaaatatagagaagggtagacacacctacaccttatactacctacatccttcaatatatggtgctagttagttcaaaattaaactaaccaacggcttaataaaatcagagggagtacatactatagaaacacactacatatggccaagctcctaccttatgttattacgcaccgacacacgtatttactctactatagaaacacattacacatggccctatctctgcaggagctcgtacgtatgtctttttctcacataaaaagagcatcggtggaaaggagagcaacatctctttccaagtccaccgcaaaatgaattggaaaaatgtgttttgtgttggctctaggaatccaagcataaaaaggagaggatcaagataacacggaatatgttttctaggtgactggtaggaataggaggcatgttgaatcctatcggaaggaagaatgcaatattcgtgtaggaaactccaagtcctcgcctagcaatctagcatgaaggaagaatttgcattattcttgtcgaccatcgcagattagcagagagggctgcgtgtaggggccctagtttgcattacttttgttgaagaaaaacagattggatgcagtaggaataaacgacagatcgcataggctacccacttaggcccctaattaatataagtgccaatgagcaagccatgaagcactaggacaatttatcgagcatcagttgttcattcattttatctacataagttttatattgaaattgccaattgattaaaaattatagtagtactaatcctgattttaggaaatttaggagctctgttcaatcgcggcctctggctgcacccgttaatctacacttaattaaaaaaaatgtaaggctcccgggtagaattttcgtccgtcaacgaaaaattcttcctcgcgtgtgcgatcgatcccgcttcaatccgtctccgatggcaaaagaaaaataaaagaaaaaaatcgtcgcggtgacaaccttgcttctggccctgcccccgtgcgccttgattcgagtccgcataaaatttggacctaaatccaagagaaaactactaaaaaaacacaataacagatttcaacaacaacaataacacaagaatatcaatcacaaggacaccaagaaaacaccgacgtcggaagaggagggtgccgctgtcgccgccgaacagccacagggacgctaggtcgccaccggctcccctcccgctggattcggcggaggggaggggtgccaccatcgctgggacgtcgggccgccaccttctcccctcccctcccgttggatccgagatgtcgtaccaccgccgcctcctctcccgctggatccggcggaggagagggcgtcgtccctgcccgccgcctcccctccggccggacgggagggcgctgctgcctaccgccgcccgccaccgtcgagccgtcccgcggccccatggcgagagagaggaggcgaaggacggagaggcgccgccgccatcgccgcctgctgccgtcaccgaggagtagctcgcgggtagagggagagggagagaggaggcggagagaatgggagaggagaggagaggagagtagaggataagggagagcagctcgtgggcggaggggcgccagtggcagctcgtctggtgctgcatctcggcgccaacgacagcggcaccggacgagcgcggaggggcgacggtggcagctcgtgggtggagggccgccggcgacgggcggagcagctgctgcatccccaagcctagcggcggcaccgggtgagcgtggaggagcaacaatagcagctcgcaggtggaggggcgacgacgacgaagcgggcgcgtatcgtggagcccgttggcaacattgggcaggagcttccagatctggtacatccctctctctcaaacctctccaccgctgttgaggactcactttcgccggcggccagcgacgatgacgatgggcggaggtcgttccgaaactccggatgggggcgggagctcgacccaaagtggcggttgcgatttggcgtggcgttcctctctcctgttttagcgatccactacttttggtgtagccgatggagtatccgctggaggccgatttttcactcccatccgctatttctcagattttaaatgctggggatgctcctagtctctgttagccaccctagttggagtagtttattcgtttttatgttcccattaatatgcctgttttttgtgctcacaagctggattctccttcaaagagggagttgtagtagaaaaccgaaaaagtggactcaatgatgactcatcgtgaaggcatgtctgatacataaaacacatacttccttcgttttataatgtaagactttttaacattgtccacattcataaagatgtgaattaatgtaaaaattcatatgtctaaattcattaactaggaagttctatattgtgaaacggatggagtagtatatacgtacctggtgtatctatatggctcccctggcggcctggcctctgagagtgtatggccttcgtgcaatcgtgctactctttgcgccggtcttcttgcactgttggatcaaaaaccaacggccgacataactccacgtgtccatggatcgccgtacaattaaatcatttctgcaccaaattcccgtcttgggcccaaattggcatgggtggaaatttccaacggatagaaatccatcagtttgcctcgcggaggcacgacgataagatcgctttcattcgtacagtgtggacctcctaccgttcaatcaattaacaaaagaagaaaatagaaaagaaatcaatgtagtgcaaatcctatatacatatgcaaatcatccccactactagaaattctctgcttcctggtgcttccacgtcaccccattttatccccaccgttcgatctcaatcaagcgatcgaccttccacctggctttcccccatcccgcatcgcacatctcctctcccgcatctcgctgcttcgccagccccacacgcatcgacccctctctcccgcatcgctcctctcctctcccgcgtctcgctcggccgcttcccaccggatctctcgccgcaccacatcgacccgagcccccaccaccacatctctcttagcaccgggttccgcttcgcctcctcctcctcctagcaccactctgcgcgccggttccgctttgcctcccccttctaccgctatcgattccctcctggcccctgccacatctccggtcgtctttgccgaaaattaatttgtttcccacggtttcttcctcccctcgaaccgtcggcctcctagcctcctccacttcaagaaattagaagggcattcgcctgcttggtcggctccaaatgggaaatagcacgctaaaatcacctcctgcagccgcaggtaatgtccacgtccaattctcctcccacagccgcaggtatggttcttcctggtctggaaccagataggtcttcatctgcttattttttcttcttatttagaaaagtattagtcacacaattttgtttgctacttaccctcacagtgacacaatatcaagtgatagatttggtttcggtattctccagcctattgcgaaaggaattttggttccctctatttggtcaggtattgaaatttacttaatttgtttacttccttgaattttttacgaggactcgaagatcaaatgtatgtaaacctaattactctaagactaggtgtattactctaagctgcactgaacctatcatttgttttgctttgccttcagattgcaagtcattaccctcggcagattatgtaccaacactgtagaatctaatggcttcggactatgttcacaggatttgcagaaatataatatctatgtccatcataagatacaagcttcataagaggtaaggcaatttctttcgtagttcaagtttcttctcacgtgaattatgacaattaagctcaaaggtcacactgtgattagttcagtgacaaacttataaggtagagaaaatcccctgtgtacccttgaaagttcactaatcccttctgtatccctgaattttgctcaatcccttacatacccctgaattttagtttggatcccttctatgccatttccgctagttgaccgttaaattcttatgagaaagtccattttgccctttggtataaagaagcatataaattaatagagtatattgttggagcatagaaatttgttatatgagactattatgtttatgagatagttatgcaccatattatttacgataaatatacttttagatatgacataaaaaattaatacttatttattagttattaaaagatttttttagcttatgtgttctgaagtaataaacaaatctgttgtattactatgaaaacacatatgctacataaaagaacttttaataactaattaataaataagtatcaactttttatatcatatgtaaaagtaaatttgtcacaaataatatggtgcatcacatactcataaatataatagtctcatccaataaatttttacattccaacaatatacttcattaatttattatgtttcttcatagcaaagggcaaaatggactttttcaaaagaatttaacggtcaactagcggaaaaggacatggaagggatccaaactaaaattcaggggtatgtaagagattgagcaaaattcaggggtatagaagggattaggtgaactttcatgggtacataggggattttctctataaggtatatattcttctctattttccattgtacattcagtcttataagctacagtttagtgattgatgttacttcattcttcaggtcggtgttcttttggattggactatggtggatgctctttgtgattgcagcattcttctatattcactcaaattttagatctaaaggttagtgcagctacttatcttcggttgtacagatttttcattccaaaatacttaaagtggtttcgtttttattaatacacactttgcaccccggatgaatgattaaatttcttatcagccggacttggattatcaatacaatgtagtgaaaattaagatgggtaggtatgttaatagcatatagatttggtgctagcggcaagcacatcatgttttttttgtcagagcacaaaagaagaccatttacaaataaacagggagtcaaggacattgtttaggtatttcacattgcccatttgcaaatctatttccataatatttctgcatatttcaagatattcaacctcatcatcttttgtcttttcaggacatgtatgtaactactttgtgtgcaggacctcttcaaacaagggaaaaatgttatgagagttatacagctcgagggtaatggcaaaacacatttcaccaagatgaaattggatctttgcttttatttaccctacctattatatatgctgcccttttttcgtactagaagcctcaagcttcaaactttgagtgatttagctcatcactgacacttggatgctaaggataaagaacaatgctattttttttgtgtttgtggcttaacatagccttttcagattaagacataattactaggctttatctaacatggtctagctaagatacaaggatcaaatttgataagaaccgctatgtgtttacttgattttcaaaatgccacaactgcttagggcatagggtgtttggttccatgaagttatcaaaaatcaattgaagtcagagccttactttttaattgaagtagaatgtacagttcaactattactttgtcatataagcagattattcaaattcgcgattgtgctttgtgttttttaccaattctctgttttttcctacttaaatcagtcaaccaatttaattttttaagtttattactataaattcccgctgcaacgcgcagggtatcatctagttacatataaagtgaaaacctcaaaactatttcctctgtttcatattataagagtttctagcattacatctatatgaatgtgggcaatgctagaaagtcgtataatctgaaacggaggtagtatcattgtatcttaaaatgaacatatatgatttggacacgtcaccaagagtgaaatatttacacctagtaaaattattactcatggttgaatcttgaagagaaacccccaaaggtctggctagcttcacaaggtgatgggctaaacgatttatgttcgaaggctcaccccttctaattatttaatattaaatcattccttaatattcacgtcatggttgaatctaggagtaaaattttactcttgataacgtgaccatatctcaagtatccatttttttaatccaacgatagtttgcaggttttcatcacacatgtggtttgcaatatactccctccgtttcaaaatatttgacaccgttaactttttaacacatgtttgaccgttcgtcttattaaaaaaatgtaaaatatgtaaaactatacatgtacataaaagtatatttaacaatgaatcaaatgatatgaaaagaataaataattacttaaattttttgaataagacaaatggtcaaacacgtacttaaaaagtcaacggtgtcaaatattttgaaatggagggagtatatatttcccgtttatcaacggccttaagcaaaagatgaacgttgttgtcagcggtcactgatcagttgtgctgaggagacagggcccacaactccacatacaaggtcaggacctattccaaaggcccaattcataaggggatactctaccaggattgggtttcgttcaggttctctcgggcaagtttacgtacggtgcgctgcgctgggccttgcttgctttctggttgggcttccgaccaaaacctcccatgcaattccggtccatcatagcccatgacatgtcgtccgtcgcagcgtgccgtcgcgatcgcggatacgcgatggcatggcttggcatgccaccacgcgcacggcctcatctcggtttcttcactcggacgcggtgttggctttaatcagcgcgcgacagtggatagctttgccagtccaagtcagacgtgtaccgtgtcgagaagtcatcatgtgatctttttttttaattattactccctccgtttcaaaatatttgacaccgttaactttttagcacatgtttgaccgttcgtcttattaaaaaaaatttgtgaaatatgtaaaactatatgtgtacatgaaactatatttaacaatgaatcaaatgatataaaaataataaataattacttaaaatttttaaataaaacgaatggttaaacatgtacttaaaaagtcaataatgtcaaatattttaaaaacggagggagtccgcagcactatattatcggttgtcaaggatgcttacgtccgcgggataatcgatatcggctgtctccgtttctctactacacgggggctgctattcttctctcgtcgtccacactcgttgtagttggagtagtttattcgtttttaaatatctttttcaaataattcttccgtctaattttaaatgtaactatgagtttctgtgttttattttagttgtccgtcttatttaatttatttttataattagtatttttgttgtaacgagatgataaaacataaataatactttatgcgttacttacgtttttatatttttttcaataatatttaaataagacggatgattaaagttgggcacggaaattcatggctgctcttaaaatgggacggattagttttttcattcttaggagggattcttcttgaaagagggagtagaagaaaaattggtcagaatgatggttctcacttcaccatcgtgaaggcatgtctcatgcacaaaacgcagatcagtatacgtagtgtatctatattgttgaatagtcccatattggttgtggaagggcaaaggacctaagatataagtgggggagcccctcacctcaatggctagcttttggggtgggaaagatcatttacgatcctacaattggtatcagaaccaggctaggttaacatctctggcttgatggacacgtgtgaaggcctgatggaccgtgggcggtagggcccggatacggtgaaggggcggtgaagagctgagagacaccaatgtgtgaagggttgtggaagggcaaaggacctaagatataagtgggggagtccctcacctaaatggctagcttttggggtggaaaacgccctttacgatcctacatatgtagcactgctccgtgagtcttatgacattcctgcgatcgtgctactcttaacgttggttttcttgcactgttggatcaaaaaccaacggcacacgtaactccacgtgtccatggatcgccatagaattcaatcatctactctttctccccttctgccccaaattcccgtgcaggccccaagttggcatggatggaaatttccaacgaatagaaatccatcagcttgcctcgccggggacacgacgataagatcaattatcaaaaaagaaaatagaaaagaaatcaatccgtttgcccattcgcacagtgtggacctcctaccgttcaatcaattatcaaaaggagaaaatagaaaataaaacaatccgtttgcccatttcaagtcaattcgaagaagaagtcttccaaacaaaattaaactacacaatgatttgcaagactaacacaagggtttaacccaactttctctcacctcatctcggaatttcactatttccattctcctccatctactattaaactagctaccactagccgtctaaaccagaagcaaagcttcgtcaaggctgcatcccagcattccggcttgcagggccatcgcccatggccacggccggcgagcggcggggcgcgcgcaagtcccgcgtcgcgggggcggccgtgctgcgcgctctgcgccgcgcccgcgacctctacgtccggggcgccaggggcttcggcaagttcgtcgtggcggcgaaccccagggcgggcgtcgtcggccggccgacgtcgagggtgttcggcgtcggcgagctcaactccgagcaggagctgcgggagctcgtgcgcggcgccggcgccatgtgggcgacgcgcggtgcggccgcggacgcgggagctggcggcaagaaggcggatgctggggctggcgcgccggcggcgtggcgcggccgcgggacggcgccgctcgggaggatcgaagaggacggcgccctcctcgtgcatggcaccaagtagctagacagatggcataggggagtggattctaatccctcgagaggatatctcctcgtatacctttttcttttaaattcgatgcaaatagttgtaaaaatttctgaaaaaaattgacaatgtagagtataatgatacctactagtccactaaaatttatattcaaattcgatctacacatcgagaaacaaaaaagataaatttagatataaacagtacgctactattcatacgctgaatttgtcttttttatatctcgacgtgtgagttgagtttggacgtaagattttgtgaagttgcatatatatgttgtataaatgttgtcaaatttttccagaacttttcataacagtttagatggtttttgagcaaatgagggtacatcccctcgagggattagaatagtttcccatggcatagatgttccgaacaaaagaaaaaaacgagaatgtttcaaatcggttatcagtgattactactgtaccatactaccatatcttcagtgatttgaggtttatacaaggagtttctttacgtttctctgtactcatgcagcctgaaagattttcgatccgggacaaacttctctgttactatcacttattataaaaagttttatcgtcactttattcaacaatattaaatttaatgaagtttttacccgttatccctagccgggctgtggctccaccctatagatggccataaaacccgagaccccgacgacacggcccgagttttattgggccgtgccttgaccatagatagacacggcccggtcaggcgtgtaggtcaggctgtgccggcctaactgaccttgtcctagaccccgtcgtgcctgagccatgctaggccggacggcctataatccagccctgatcatactactgatccaaagagtaaattctaggcgcacttggaattgattaactagagtgcagcggcaagtgatcttttcttttcggggtaatccttattatttgacgaagtaaaactaacggtgtactatgccctagtataataactgagggaataaaaaaggcctttgcaaatacatgcgtcatttttagcaggcactctccagccaaaaattaactttgttcagtaccatactatacatgcttcacaaatactaacctatacatgcatgtacacacaatgtcatgtaaaattaaaccaagaaaattatctcttaacatgtcatctgaagtaacatattttttcggttctccacacaaacttacagcaccaaaacatgctaattgtaagatgatctcctaattacgagctttcataatgctcccctgtatccaacacggtctatacataaaagatgcatacatgtcttgaatatacaaatgatcataaggttttgggaacgtactacccaaattttgaaccttcgagctattaaaatgataggcaagtcctctttgcatctcttggttcagaaagataacttctttatagggatggaatcccaagattgaaagatttctacggcatcgtacttcatttggatttgcagcgtcaagaatatatatcatcgttatcggagtcccattcaaatttatttactcgtactaccacttctttcacatctttctcgatatcaatgatttctgtacgaggcattgtcatattcatagcaatatctccgggtgatgtattccttgtaagcttcgtagtactcctcagcgccattttgactggaatgtccaaagtagttcttgtagtgcaaagtccacggaccatcattttgtatacagatttcctgacaccctagaaggaaactaagatagatccttgtcatgcttaagttcccatgtcatctgaccacatgacttgttgaggaacgaaacacgtagtcgatgctcattatctattaatgcatagtgcacacccctcattgatctcccaagaaaatagtttttatatggagatacttcattattcatgggtaacttaattacttggaacttattatctggcaaggatattatgcattaaaacaatataaatcatgaaaccattgaaaaaaaatataaagaaagaagagaaagcaatggtaattaagcacacttgtgtttggaaccccatgttcccaatccctccctatcgtttttcgtgcgcacgcttttcaagctgctattcgaaagttgcttaaaaaatcaaattaatctattttttttaaaaatagctagcacttaattaatcatgcgctaatggattactccgttttccatgaggagggaataggttcccatcccctagatatctgtctggcaaagtacaaaagaatgatgaactcgtacctcatgacaaaatctgtctggcaaagtacataaagtgctccctgccagtagactccattgtaacgatcatatagatattctgttaccatgtcggcaattgtaccggcagcatcaccttcccgtgcaaattaaccatctctcttcccattgcccagtcctcgatgagaacacctgcagtaggctttgtgatggtggccatggcatgctcttaaccagaggatatagctcgtaggatttactacggatccgtgggatttggaagatctcgtagtgtggtgatacggtggggtcgaacacgagatagttgtcaaaccggtacaaatctatccagatgtgctgaagttgaggtagatgccggcgagcgagagagggaggaggtcggcgcggagcaggcggcgggtgtcgacgatggcgcgccatgccttgcagacgcagtgggacgcggcgatcgagccagcgcggcgcgaggcgcgcgaggacgtccgcgagcacgtcgtcggataggagctgcgtcacgtcgtcgtggtgctcctccatcgaatctctctctgctcaaactgctgctcggtttttagatgtcgtctcgtcgggtaatacttgcaggcggtctgttaatctatggacgagaattcagtggcggagccagaaattatacaagactagggctaaggtagggctggactaatggagtttcagttttctgaaaaatttacatggtgaatcaacaaaatttaagcaagtttttggagacaggcctagggctcaagtcctagctgccctaggcttgtctccgcccctggacgagatggcatccgattccgcgttggttttgcattccgagagaagtgaagcgcgcgctctgttccgattctagaaagaaacgggtggagtgggagttttgcctgatacacagagttttgttactccctccatttcacaatgtaagtcattctaacatttctcacattcatattgatgttaatgaatctagacatatatatatctatatagattcattaacctcaatatgaatttgaaaaatgctataatgacttacattgtgaaacggaaggagtacatgttttgatgtcatagttgttaaaagaaaaagaaaagaaaagaaaatacatttcaaatcgattatcaattattactaccttttatcttcagtgattggaggtaattctacgagattgaaaatatacgattttcttaatttagttgggaaagtctaatttgttgctagtattggtatgagaaagaaaggacaaaagaaaccatctaaacaaaagatcctatccacatttgaaatttatgaactagagtgaaatttatgaactagagtgcatcggcaagcaattttttttccgaggcaatcctgattatttgacaaagtaagtaaatgatatatactccctccgtatcaaaatataagcatctttagactctgacatggtctccaaccaataatatctataaaataagatgttttaaataaaaaagagttgcatattagtataatagtttgtttaatgataaatctaataacatcagttatacatgattgatcttttttacttttttgctattaatagtcaaagttaaaaatgtatgacttgtcactattctaaaaatatttatattttgaaacggatggaatactatgttctggtattataataaaaataagtcctttgcaaatacatgcgccattttctatcaggcacgctccagtcaaacatcaactttggtcggtaccatatatgcttcacaaataaaacctatacatgtatacataatgtcatgtacaattaatcgagataattgtctcttaacatctcatctgaagatagcatatttatttaggtcgccacacaacttacaccaccaacacatgctaaattgtaagacaatctcctaattacatgctttcatagttctcccctagatccaacacggtgtatatataaaagatgaatacatgccttgaatatacaaatcatcataaggttttgggaacgtactacctaaattttgaactttcgagctattaaaatgataggcaagtcctctttccctcttttggttcagaaaaataacttctttataaggatggaatcccaaaattgaaagatatccatggcattctccttcgtttggatttgcagtgtcaagaatgtcatcgttgtcggagtcccactcaaaattatttactcgtactaccacatatttcttgatatcttcgcagtgatttttgtaccagacactctcatattcatagtgatatttcctaacaatgtgtttcttgtaagcttcataatagttgtccatgtcattttgtctgggatatccaaagtagttgtggtattgcaaagtccacggaccatcattttgtgtacagatttcctgacaccttagaaggaaactaagatcattgtcatgcttcagttcccatgtcatctgaatcatataactcattgaggaaccaaacccgtagtcggtgctcattatcgattaatgcatagtgcacacccctcattgatcttccgagaaaatggtttttatattgacatacttcagtattcattggtaacttaattacttggtacttgttatcagacaaggatattctgcattagaaaaaaaaacaatatatgggttataaaaccattgaaaaaaataaagaaagaagatagagcaatttaagcacattaaaagaatgatgacctcgtacctcatgacaaaatctgcctggcaacgtacataaagtgccccatgccaatagactccattataatgatcaaatggaaaagccaatgccatgtcagtaactgtgccggcagccacaccgtctcgtacaaacaatctctccccattgcctagtccttgatgagaacacttgcaacacgcacagtgagggtggccattgcaagctcttaagcataggatctagcacgcgaaatcctgtactaggaactcgtgggattttgaagatctcatagtgtgtcgatatggtagggtcgaacacgagatagctgtcgaaccggtagaagtccttcatccagacgggctgaggtggggcaggaggagaaggcacccactgtcgggtagcagggttagccacgccggactttagcagaaggagtccgttgcaatgatcctcgactaggttgtcgttgggcgtgtagtcggtgaacatgccagagatggcggggcgtgtggagctgggacgggataggaacaccgaacggtgcatctcgtggaagttgatgtagatgccggcgagcgagagagggaggaggtcggctcgcagcaggcggcgggtgtcgatgacggcgcgccatgccttgcagacgcagcgggacgcggcgggcgaggacgcccgcgagcacgtcgtccgggaggagctgcgtcacgtcgtggtgctcctccatggaatctctctctctgttcaattaattcgttgctcgaaaggttttcgggtgcgtgtacgtacgtacgcgtacctcctacctgtgggcggtctgttaatctatggacgagagatggcatccgattccgtgttaattggttttccacgcactccgagtaaagcgagcgctgggcgctggagtgggagttttgcctgatacatacggagtcgatcgagggattcttatcggttggacttggggcgcgaatccgttctgctcccagactcgggcacaagaccactgcaatactaacacccagcgtgaacaagccaacaaaagattggacgcgccgtcgataccaatggacgagccatgagcaggcggccaccgcgacaggttcggtgttggcgcgcgagctcaattccgagcaggagctcgtacgtgcgcttcatggcgcgccggctgcatgctcgggaggatcgacgagccgcggcgagagcgtacgtggttttggagtcggagcgcgcacagggcggtttgcactgcgccaatggatcgaatgtctggatggatgcattatattgcatttctagttttttttttccctttgggtggggggattactgatggtatactgtggagtagttgttaagaacaaaaagacgaaaaactcgtcacactcccaccacccgggcacccgccatctgcgccacaccgctgggccgtcgtactatacgcctttcgctgagagagagatgtgtgtctctgcggccacaaaggctgcccctcctgtgccgatcctgcctcctatcatgcacagctgctcggcaacccgtcctgaaaactagctgctgcttaattattttcacttgttcgtgaatcgtgaccaatgcaacagctaagagaatgaactagctcgttctcgtccctactctacaattatctatgtgactgtgtaggaggaaacgggcgatggagaaaccggattcctggatgccaaccagacaattagacaaacatgccgctgctgcacgagatatggatcgaggcatcgagctgctaaacgcatgcccctgccgagtgaccagctagggtttctcctgagagtcgttctggcttcgttacacggtacgttagaggcaactgttttgatcgtgcagttttcttgagccacttaatggcttccccgaattaaatggtttaactatatattttcaccacattccgcaaaagacactgcctgaaacacaaaagtccgttgtattgcaaacattgcagatagagacagacaaagatatgatggccgccgcctcgccggccaccgcttctaggtctctagacccctccctccgtgcccgtttgtcttgttgatcctttgcaagattgtgtctttgttagttgaaaagcatgctttttgcttcttctttttttttttgctgtttaaaccacttgtttactaaaattagattgtgttgcctcgtctttccctcccccagcacagggtgaggattacccggaggatcagacttgtgaagcaaacaagctggcatcacagttaattgattcttgcgggaatgggtcttctcctgatgttaggtgctgcgagacgattgtagtggtagttgatctacccaattgtctttgcctggtgtctctgcgccccaagattaaggagtcccagttttctgcttttactttgatcacctcttaccgagcatgttgaggtctccgtgccgtcaaacagaaggatgcagccctgtgctatggcttcaatggttagaatgtttctgtggttctctaatcaataaaatttcaaatgatgcgttcttttgcatgctagctagtactaaattggtactgtttttcgtgtgcagaaacagaggatgagcagccaaatcttccgcctccggctggaaatggcgttggcacagccacagtgaagcagcctaagatgatacttgatcccggggacaacttcagcaactgggatcggtacattatggcaatcttggaggtggcgactggagttcagatcatttacgcgctttttcgagagatagtaaatcgcttgccgaccatccttgcacggaataatattcctcgtcaagtgtaaggggtcaatggtcgatccatgtatctctcaattgtagctgttgcctgatgcatctgagttaatcgtaggtagcagctacatatgtatccctgtttatgtatcttggatccctggatccctgaacttgaatctggtacttattcgttgaatgactgtattaagcaatacgaagagcgtgatattgttccttttcttctctgccattcgctgttcagatggcaccaccttacatctttgcagtactcagctgtccacacaaacgattacttgattactatgcgtcgaaggtggtggcctatgaagccagctagagttggaaggtgttgactactacaagtctctaccactgatttcaaggaaacattagttatggaaaagtaacgtaataatcgactatgctgttggaaaataaacattaaaaggtggacagctaagttaaaaattgaacttaaaaatgccattggttgaagtagaagcgactgattttattgggaaataaatccactttaggtctctcaactagcatgcgccagctcaattgggccgaatagaggtattccctgttacatttatatgaacgaggagtgaatggcaaaaaattaaaaatcattatcaactctagctactgtgttgccagtgcaacgaggcaaattacaaacaaaatacatgctactataaatgatcattactcataaccaattatatcaccaagccatgtccacaacgactagggactagggagatgtgtgatatccttattatccgtacatagtcattgaatatatagcttttagttgagggtccctttgaatcacaggaattaaaaaatagaggaataggaaaaacataggattctgacaggaatgtaagtgtaaaacaggattgcaaaacataggaaaaacgtaggaatgaccgtttgattggaccacaggaaaaacacaggaatttgaggagagataaagactcaaatgattttttccatgaggttctacctcttgctaaaattcctccaaaacttgtatgggaagaggcattccataggaatttcataggattccataaggtccattcctttgattcaaagggctttgtaggaaaaattcctatagaaatgaaatcctctgaaattcctttgaatcaaagggggcctcaatcttatctgtccatgacaaactattcgagctcaccccttgtaagatgaggacacaaatgatggggatcgatgccaagtaatggcacgattattttcgatgaattttctgcactaagtaagaaatgtcaaagtcagtattacacatcaataagtgataataccatatgctaataatgcattgcaaataaaaatgatatcaatgaatagctataacagaactgaaagaataaattcatgatacaaatcatcaagcatacgcctttagccttttgcagcccgaaaagaatccttttggctatcaactattatcaagcacaccatatagcagcatcaaaagggataaaaaattagaccaacgaaatggctgcaaagtggaaaaggggataacaaattaaaatatgctttttttaatctccaaaggcacaggtggtcctaaacgaagaacaacaccatctaaatttcatgataccctaagtataaaaaggtatctaagttataaccttacaattttcacgaacagcaaaagtgatttggccttccattcctggaagtacaatgtgtgcaacattgatcgagtaactggcaataaggaagagagagaaatcaaagcaagaaaaatctttgttactgccttactggtaaggaatattttctgctggcagtcgtgcagaattgtagtgctgattttatgtaccgatgagactctcttttttttctgagttgctaaataaacatgttttcatctagaccagcatggttcgtgctagcatattataagggatatgtttctcaagttgcagttgttatgtaccatgcaaaattaatttcacttaatcaaacaaccctaagggacactgatttgattaaggtaatgaacaaccaaaaatgtgcgtggattggagaagaggatgatcgattttaattaccttagggctggaagaatctgagagcgaacttgctgtgctccaagaccggcttctggtcatcgatgagcggccagtccaccatgagtgtgtcagtggcatgcaagcgcagtcaaatgagataaagtacataaacttcttttttcagaaccaaattcgcattcttgaatgcaagaaggcgctgctggaagaacaggaatcgttcatcgtacaggttgtcatgacaaaccatcagaacatatatcaaggaagtttaccaattaaaaattatattcagaagcctagcagggaagacagacattatattcatggacattattcatcgtgataacaatatctgatcagctaaaatattcaaaattgacaaaaaaaaactattttcttgtcttccctaacctgatcattagtttttggcaaatgaaattgacaacataaatattcctactcaaaggagcctttatatttctatgcatgtgtgttttattgttgtggagtgtggatgaatataaagagctgttaagtttcttagaactggcatttggaaaaaaaaacatatcctagctatatgtttagtatgacaccaagaaaatggaaaacaaaaacaaagcattatggtcatgatctatggtagcagctaagaaccctggatgtcatgttatctgaccttaatatgctctatggtttgccaggtgatggtaaaaagtatgtcttttaaaactaatgacaatacaatgcatgtcattgatatactcatgtctcgtgttaagtgatagtatcttgaacggacgggttaaataaattgataggctaattggcaacttggcatgaaatgaagtaatgaactggagagaaatgtaagcaacataaagaagaggtaagtttatatataatagccaccggtgctacagtacaaaatcatccgttgtggcatgttatttttagatatcctaacaatgccatgatattcagcaagagggatagctatttttgttcagagcttggctttaggattcatcacgacaattgatttttgctctacctaacccgaatatgcaatctgtaaccatgttatttgggaatggtagagacaagttaaattctaattgtgctcacacaaaaaaaaaatgcagtgcggcacatctaaagagggggaaatgatagaactgaaaagcatttcagaatattcagggcattcgccatcatcgggtaaaatccatcaaacaaaaacaacaacacagtgtttagcctgcacatctcaagtctcaaccatctaattggaagcaaaacaaacgcagtgtacgattcaaggtgacctcaggcgtgcagatcgttcggtctgggcctccatggaaaccagctcctgttgctctgttgctgttgcctgttggcgctctttctggtgcggccgggtctgcagggtgaagttgggcttcgcgttgagcctgatgccgagaatgacgacggtgaggaaggaggtgaggtagcagggaagctcccagtccacccacttgcagaactcccctgctgacggcgacggccgcttgaagagagccagggggtcaaccacccgacccatgccccttgtcgtgcctgctgcagatgcgcgccgcgccgcacaaccgagctcgcaatatccatgctccttcgccggcgcaggcgcgttcgcagatgaagtgaagagggaggttctgtgggctagggtttttagggatgggaattggcgaggtgcagcggtggccaacgtcggaggcggttcgcgaatcgccggagaacgggcgagagaaggggagaatttccctagaatgaatgctaacattttcactaaacacccttggaagatcaaattttgcagttacgtcctttgaaccatctctaccgttgattcataatccaacagatgcgggtgcgaaccgagccttggaatagcacgcggccacgtggcgcgtttcaaagatatgtaaactttgctcactacaaaaaaaaatcgatttttcatggtgtttacctatttttttctctggcggctataagcaaaaaccgctagggaaaatttgacgagagatgaggtgctaagaaccgccagcaaaaaaccattttcactggcggctgggttaagaggaccgcttgcaaaaatagaggtctttttacaagcggtcctcttaagtgatcgccagcgaaagtttttcactatactaaaacaccaagtgcgcacggactcttcttatccactcactccatcttaccctattctcctcaccccacctccatcttatccactcacgcccacgcctcccctgttcttggctgccatggcgaagaagacggcggacaaggcaactgcagcgacggcggacaaggcgactgcggagacggcgacgatcggccttctcctctccttggcggcgttcgccacgcggcgagctcggggccggatccaccgccgccaacgaccggggaggccggatctgccgccgccaacgacgggtgaggccggatccaccgccgccaccgctgactagagatggcaacgggtgcatacccatcgggttctcttgccccatacccatacccacgatgtctaaatactcccacttaaatatccacacccatcacgggtacaaaattgtccccatacccacacctatgagggtaacaggtatccaacgggtacccatacccatataattgacttgtaatatttatagttttgtactataattagccatattagagttgtaaaccatcaatattttctctagcagcaatgctattaatattagtgttcaaaggcgagtaaaaaatttatacaaccacattacatactcaagagatcaaataataatttcatataactagactaagcaatgatttaagatgtgaaaggagttttatgctatgatttagtagtcgttgagagttataatgctcatagttttagactcaatcaacgggttttttctacccacgggttggtgggtacgggtgggtaaagaacggacccatacccacgtacccaatgggtaagagttttcgcccgttagtagacccatgggtataagagttagaacacgattggctcctaatagagtaaaaacccgtcgggtctcgggttatgggtacccattgcatctctaccgctgacgggagtggtcggatccgctgccgacgccgacgggggtggccggatctgccaccacgaggccttggcagctagggctggatgaaaagctcgtggctcgtgagtagcttggctcgactcgactcggctcgttacattttcttaatgagccgagctggcatctcagctcgttacacataacgagccagctcgagctagctcatgagctcaaacgagctgatggaaagtaacaggccagtggcccaaccagccggtgcagtccattttccaccaagccgtctcaaaatattaaccctagatgacacccaatcctcctctcaccctcccagccacacaagcggcggcggcggagacgaatctggtgcgcccatccccttttgttccttccttgctctctaccgccgtagcaaaccggcagcaaatccactctgtattctgtggtatctattctatggtgcgtcgtggctgcacgactatgctggcactcgtgaaatccgtttggagaatgcgccatggcatcgtttgcggagtccgcgacggacaggaaggcaaagcccaggcatcagagcctcgaagcagcacctggatggatggttcacaagtaaaaatcgtcttcctaatcaccgagagattggttctcagtgagttagtgttcttcatgtgtttgctttgttttgtggctgctctaaattccgccagcgaaaacctaaaatggccgcgtcacgaaaaatggtttacgtagtagtggctttgaggtttagccatgtggcccaatgagatggtagtgtttgcaccctgaaatcggtattctagatgttggattttgaatcgcgtccctaaaccgcaataccaaatattacacatttctcaaattacaataccgatgtaccaatgtacatgaggtcctaggaactactgtccggttttagctagcatgatggttgagtcaacgtgaaacccacctgagccccacgagtaagctccctccccctcccctctctccctcccaatgttcctcgtcctcattccccctctacctctcttcctagcctccaaggcagtgggctggcagtcgatagggagaggggtagctgagctccatcatctcatcgcgagccacaacagagcacccagtcgtttctaacaaagaagacagggttcccagcgagacaaggcggcacgacaggaagaaccggtcaaagagtgggacgagcatggcgaagtacgcgagaaggagcacctgttggggtcagtcggactcggccccaggaccacgaccatggccacaccggatgccctgaggtgcaacaacacatgatttaatttgcagcgacgacattgatgggcaggctgaacccaaacggagcctgacgcatgtctgctagtcatggaacccaggcatggacgggagccccatggagaacaccgcccgtagatcatagatcgggtgggaacgtgaatcccatctcggtatcggtgcacagttgctctgtgtcagatagccccgggagcacagccatgcgacagcactatgctcgccagcgcgtggaacgagtggagcccatggtgcggtgaggccgacatcgacaagggccccgccatgacatgcatggacaaccgccgaagctctgccaaggacaaaccggccatttgacggtccgcgtccaccattgccactatctctatatgtcgatcgtccctagaaagtggactagtaagcttcgacaatggctatggtggcgagggggcgtggtgagtggagaagaaaggcatcgcccttgagactaggaagagagggagaaggggaaagaggaagaggaacgctgggaagggagagatgggaggagaaaagctgacatgtgtggggctcacgtaagtcccacgctaactcaggcgccacgtcaaccaaaactgaggactatactttctaggaccttgggaacaccagtattatgagttgagggacgttaaagatgaggaatgtaaagtgaacttattcggatgcaatttatttttttttgtaagggttggttcatttatattccaaacatccctttttgagctcaacaagattaatcctttcggcctgtatattccaccggttttggggaaaagccagccattcgtagcggggccgccgatgcttatgcctatgatccaggtcagcgcaaaggttttggtggcataggttgaaactaaaaggaataagtctattatgcttccttcaactcttgcacctagttgaatcacatccctcaatcgcaaaaccaggtatagatagccaaaaggtccacccggcacggcccggcccaggcacggcaaggcacggcccaccagccatcgggccggcacggtctgatcggcacttcgtgccgggctgtgccggcccatcagctccacctttggcccaggcacggctagggatggcaacggggctacccccgtcgggtttagccaccccgtccccacccccgatgtgagaaaaatctcccgtcaccattcccatccccgcacacgggggaggtttttaccccgtccccgtccccatgcgggtacggcgcacccgccaggtccccacacccgacaatcgaaagaaattcatccagcagaccaacagtgcagcggtaagccatgaggcactaatccacaagcaattcaccaaatcaccataatccagcagcaacaataaattgataatggttgaatcagtgaacaatctgataattcatcattagtcattactcattacataatgtaaggtagcaactagcttgttcatcacagatgtgttagaggcggccacgtggaatgggcgacggaggcgatgctactgtgtgcgcgtggtggcgacggcaactacggcgtggagtgggctgtggctagaagacgggaagaaggcggcaagatgcgccgccgctcaccgagcccggcgcggcggctccctggcgacgtcgaccccccccccccccccccgccgattggatctaagggtgagataggggagcagaggagtgggagagagacacggtgagatgagaagacctagggttttcttgggtttatataccaacacctccgaattgggcagggcttttactttcatgtgggctaaggcctgcatatatgcctacgtcggggtcccatagggatacggggccagggagctagcgcccgcccccatactcggcccacccgacgggtgaggaaaaaggccgataacagccccacggatagtatttctctcccaactagagaccctaatagagtttttccccaccgggatcgggttacggggctccattgccatccctaggcatggcccaccagtagtcgggccgtgcagggccggctcgaaggcatgggtggcccatcatgctttttttaaataagtctattttccctcccttctctttgggaggatatatatatctacttctacttctactattttctatttaaaaagtttaaaaaatttccgtcgtccgtatatacataaaaaaaagcgaaaagaaaagatacggcaaaaaaaagtccgattgtgcaacggtaaaaaggaaagttccgtccataataaaaagcccgtaaaaagggccaaaaaaaacaaaaaggcgcggccaaaagaaacatgaaaagggtgaaaataacaaagaaaagaaaaaaaaagattttcgattctaaacgtcgccagtaaaaaaagctgaaaaggaaaaaaaaccgccatccctaataaaacggcgaaaaaaaggtaaaaaaaaaagcaaaacgccgtaagaaagatttgaccgcatatatgtctaaacgatccctcaataattttagagatcaagaaagattcaaagatttggccgcatatatatctaatcgatccctcaataattttagagattaagaaagattcgaccccatttgacggagaggattgactctgttgtcatgcgggcatggtactatgcgagctcgaccgaattaccggatttgatgggaggatcggctccgtcatggtacaggaacgagtttgttcgagctgggtctatagctccacttgtgggctgagccggtagaccgggcacgggtctgttcgagttgggcctacagttccacgtgtgtgctgagccgaagagaggtagactgagcaaatagaggtagcagactaggctaagactagaactgaaaagggaggaatgaatgaacgttcgcttcaaaaccaagcaagcattaaaatatatatagctaaataagtctattttacgtctctattctttcgactttggcataaaataggtctatttttactccctattgtttgtgtgtcgggcctggcttgcggccccatcgtgccatgccgggccggcccaacgtgccggtggaggggcccaggcacggcccggtggtcaggctgggccggtacgggcccaacccacatcgggccgtgccgtgcttgggccgggccaaaatgccgtgccgtgggatgggccgtcgggcctcaggccttttggccatctataaaaccgaggggactacctatacatttgtcgacaaatttttccccaaaaatttgacagatgtaattatagtacaatcgtagtgtaattacactgtaacttatatgtaattacactgtaacttgcatgtaactacactataacttatatgtaagtttaacataattttgaatcgttagatctattacacgatttgttttggttaggaagaaaacaaatcatagcacacacatatgtgaaagaatttgtttccacgacctccattttaccgaaataacatgttacggagagatttttgaaagttacatacaagttacatacaagttacagtgtaattacactacgattgtactgtaattacatctgtcaaatttttggggaaaaatttgtcgacaaatatatagcaaaatcgaaaccgagtataacacctcccttatttgtaaaaaccggtataaatcgcctccttaagtgatttgaaaggtggttttatctaacgtggcagctttgaccctattgactagctgactcagcttgtggaccccacccatcaaggaccacttcatcttcttcctcgcctctcccgtctctcgttcctcttcctcctccatcacctctcacagcagaacgcggggcagagctcgtcagccgaccacgacgcgcgcgtgggaaggagcttgccggccgtgtcgtgcgcgggccgcgggggagggaggtgtttccggccgggaggagctcgtcagaagcggcgcacacgggtggaggggtcgccggcgcggtgcgcacgcaggaaggaactcgccataagcggcgcgcgcgtggggagcggtcgcgggccagtcgcacgctcattaggagctcgccggccgcggcgagcccgcggggaggagcttgctggcctcgacgccagtcgatcgcgcgcgcgggagggctcaccggctggtcgcacacgcgaggagggctagccggccggtcgcacacgtgggtagggcttgccagtgttagctgctatttcagagtttttcaaagttttagagaatcacgagagagaaggaatttgtgggacaattttctaggttctttcattcaactgaattgaaaaacttacaaatggaaattttagctactgctacttatactctaataacagaaaaaacgaatccaagcctacaatcgcgccatcccacgatccggaactcctggatccaatgccgtgcaaaactcacgcccacaacgcacgcctgacgcggtcgtctactcctgcagctcgccacatctctcgtgcatgcataacaaactcaaaactgaattattcatccagccgttgcaactgccatcgcctggatcaccttggggccatagctgaaataacagtcaacaaactcccccttaattctgctacagcccaaaatcacgaacacctagcaggtgccgtgctgtcgccaatctcgctgctggcaacccttttgttaacgcatccgcccgctgctcctcaatccggacgaattcaatctgaatcttcccactttcaacacactcacgaataaaatgataccgggtatcgatgtgcttacttctcccatgaaacacagggttcttcatgagtgcaattgctgatttattatcaacatacagcttcaccggcctggcttctgcaccaatcatctcaatcaacaatcccctgagccacaaagcgtgacacgctgctgcagtggctgccatgaactcagcctcacaggacgaaagtgccactgttttctgcttttgtgaactccacgagaccaaactgccgttgaagtaaaacgccatgccgctagtactccgacgatcatcactgtcgccggccagatcactatctgtgaaaccagtaatctccactgcaccattgcctccagaaaacatgagtccacagttgattgtccccttgagatatctgagaatttgcttcaccgccttgaaatgcatcactgtcggtcgttccatgaatctgctcgccacgcctactgcgtaggacaaatccggccgagtatgcaacaagtaacgaagacaacctatcactcgcctatactccgtgggatcaactgtgcttccttgagcatctttgtgcaactgtgaacgatgttcaataggaattgaggtagaattgcaatctagcatcccaaactaggtcagaatcttccttgcataagcagcctgcttgatggcgatcccgtcagtgccttgcaacacttcaattcccaagtaataggtgagcagtccaagatcgctcatctcaaactcccccatcatctgttgtttgaatgcagtgatgtcgcttgggctttctcctgtcacgatcagatcatcaacatatactccaacaattatcccggtactccctgtacctctagtgtagactgcttgttcttgtgcacaccggctgaaaccaagctccttcatgctccgatcaagccgtgtattccacgcccgtggcgcctgtctcagcccgtagagagctttgctcagtttgtacacaagatgttcctttcccttctcaacaaaaccttctggctgagagacatatacttcttcctcaagatcaccattaaggaatgccgacttgacgtcaaggtgatgcacctgccaccttcgatcaactgcaacaggaagtatagctcgcaccgtgtccaaccttgcaaccggcgcaaacacttcatcaaaatccacaccttgccgctggacgtaccccttcgccaccagccgcgccttgtgtttgatcacctcaccggcagtgtttttctttagcttgaacacccacttgagccctattgccttgtgactggctggcagcatgcacagcgaccacgtcttgttcttctcaatagcctccagttccttgttcattgcgttcacccacgccggctcgccggctgcttcacgataggatgtcggctcctccatctctacgagcagcgcttctgtgtcgtcatcatcctccaccaggtccacccgaggtgcttcaatcatgatctccgccaagcttctgtaccgcaccggctcgtcgtcactgccggccgtgcgcggtgacgcctgcacctcggcagagtgcgttgaggatgagccgagtgtaggcgtgctaggcaaggttggtgagaacctcgccgggcttgccggaggcgttccccgctgttctgccacttctggctccttgccggctcgccttcctgccggcggcgcccggtaccacggtaccgagcctgcctgctctgctggcgccggctgctctgcgccaacgggttcttctacctcgaactcagtggaagtcacctctcctgcagcagcactccactgccaaggtgtgttttcatcaaaaacaacgtcacgacttacaatgatttgccgacgacgcggatcaaacagccgatgggccttgctcccttcttcaacccccaggtacacgaccggattgctccggtcgtccagcttcttcaagtgcggtgcagtcaccttcgcgtgcgccgtacacccgaacacccgcaggtggcccaggtgaggtttcttccccgtccatgcctcgaacggagtgcgatttcccatcgccttggtcggcagccgatttaggaggaatacggcgtgacgaactgcctcgccccacatcctgccgggcacggacatccccttgaggagagaccgcgccattgccatcaccgtcctattgcgacgctccacgacgccattctgctgcggtgaatacggtaccgtcaggtggcgctcgatgccggctgcatcgcagacgcgcgcgaactcgccggacaagaactcgccaccgcggtctgtccggagtgtcttgatcgttcgtcctgccgtgttctccgccaacggcttgaacttctcgaaggccgcgagcgcttggtccttcgacttgatcacaaacacccacatccaatgagaaaaatcatcaacgatcaacataaagtatcgattaccggtgaacgtcgatggagtgatcggcccacacagatccatgtggagcagctcgagcggcgcctctgctagatagtttgccattcctgggaacggctgccggacttgtttcgccaccagacatgcttgacacagctggtttgggtggtggactgcgggcactcctgccgccatctccttgtccaccaatagcttcaacgcatggaaattcacgtgtccgagccgggcatgccacagccacgccgggtcatcgagactagccaacaggcacaccggtgacgccagctgcagctcgatgcggtacagccgatttgaggatcgccgcaccttcatcaccaatcgccaaggatttttgtcgaacacctcgaggtcatctccatccatcacgacacggtggccagtttcagttagctgccccaaactcaccatgttgcagtagaggctggggatgtagtagacatcgtcgagcaaccactggtcaccgttcttgcatgagaaaaggatggatcccttccccattatctgcactgacgaggcgtcgccgaacctgacctgccctgtcacggtctcgtccagttcccggaatttccgatgatctcctgacatatgattgctggcaccattgtccaggtaccacagatcaccagcagctgctcccttctctgccagcatcaggcgaggccacacacgctcctcgtgcacgaccagcccgcagagcgcatcctggcgcgacgcgttctgcaccgcctctgtcacagcgagcaacaaagttgggccagcatcctccgtttgcgcaagatgagcttcagccttcttcttcttggggtgtggacactgcgtggagtagtggccaaactcctcacagttgaaacattttatgtggctcttgtcgcggccaccgctgccaccaccagagccgccaccgctgctctgcgtcccaccgcgtccgcgacccctgccacgaccacgcccggcctggccgcggttcgccccctcaccagagggcttgttcttctgtggcgacgaggtttctcccccgcctttcttgaagcgcgcctcccactcggcctgagtgaggagaacttgcccgtcagcggtcactcctccggtggtcgccttcttcttccgcatccgctcttcatacgccttgaggcgacctaccgcttcttcgaacggcatggtgtcgacgtcgtaaaattgctcgatccctgcgacgaggctgatgaacttctccgggacagtgtcgaacagcctcttcaccatggcggcatcgttcaacgtcgcgccaagagcagagtaccggacccccatcgtggtgatccggccggcgtactggtccagcgtctccccggcctccatcaccatgttggtgaactcttccttgagtgtctgcaggcgcgcatcgcgcacccgatccgccccgatgaatctcgtcttgaggcaatcccaaacctcctttgccgagcgtttctttgcaacctgcatcaagagatcctccggcagcgactggagaagatgagactttgccttcttgtccttcctcgggtcaacggccgccctagccgccggctcgattgcttctcatacgccttgatcctccatcatagcctgcacacgtattacccaactagtgtagttggttgacgtgagctgtgggtaaaggaaagcacttcctgagctccccctcgccgggtccgccgtcgccggaaccaacgccatagtgctagatccgccctcaacctgagaagctctgataccacttgttagctgctaatcacccgatcgaacactttgtgcgcacactgcacatgtccggcacggcaacagacaaaaaaaaactgaagaacataggaagaaattcagaacatagaagcagagtatttcagagtttcagagaatcacgagagagaaggaatttgtgggacaattttctgggttctttcattcaactgaattgaaaaacttacaaatggaaattttagctactgctacttatactctaataacagaaaaaacgaatccaagcctacaatcgcgccatcccacgatccggaactcctggatccaatgccgtgcaaaactcacgcccacaacgcacgcctgacgcagtcgtctactcctgcagctcgccacatctctcgtgcatgcataacaaactcaaaactgaattattcatccagccgttgcaactgccatcgcctggatcaccttggggccatagctgaaataacagtcaacagccagccggtcgcacacgcgggaggggtcgccggccgcggtgcacccactaggagggcaagctggccagtcacgcacgcggggaggagctcgctggtctcgatgccggccggttgcacgcgcgggagggctcgccggccgcgccgcgcacgcgggaaggagctcgctggcctcgacgccggcaggtcgcgcgcgctggaggtctcgctagccggtcgcgagggcggggagggctcgccggccacggcgcgcgcgggaggagcggtcgctggccggccgcgacgcgtgcgcggggaggaactcggtttgtcctccagaacctcgcgagaactccgcggtgccaccgccgtgtccgcgaactctcagtattccttcctccttcaccttccgcaccgaggcctagtcgccaccacgcatcgcctcttcgcgcgtgtcagctcgccgggacgacgccgcatctggcgctgcgtgaacggcacgcgtgtagggcggagagatgcgcgaactcagccgccaatgccggattgctgagaggtggtcggccctacatccttttttccatgctccctgacatttgggaccactgtatatggttttccacatctcattgacatgtgggccctagatgcaaaaaccacttttgaaaccaccaaggagtctatatttaccggttttggaagacagaggatgcgctatacccgatctcgtgaatgagggatgtgattcaatcagtaacaagatatgagggaggcaaaatagtcttattccaaactaaaaacatgggtcttaacataaaacaaattagttacaaaccttaaatccatctagaatcagtatttatatgatttttgatagatataatatcttaaattttcttcctatatttctggatgaaaagttattgaccatggtatcaataccaatatcatccaacaatttcttcttcattgccccatttttattctctcaatttattcacttgtccttttttttttttgctgcttttctctcaacaaaaatgatgtcaaggatatgcaaaaaattgaaaaagaatatttaacatctgaactcatatttttacctattataaaaattgaagatgattccatactcaccataattgtataaaattttcgtccgtcctagttgttgggatacttttatttgactgtttgactagcaactgaaccagtcaaaccgctcaacctgtgaattgaatttggtgtataactataataattgaatttggtgtataacttgtaatttttttctaggaaaaaaaatccaagcaaattcttagaatgagtttcaccttaactaaacagtataataataataagattaaaatagtcttcaccaattgcaacgcacggatattttttctagcataaatataaagtacaaacataactagaaaagcaccagatttattcaaacaaatctaaatctcactgatttgttgatcgcgggtgtgcaaggcaacacgcacgacggctgcttcgtccaagctgagaacctcccacaaggaatataaataaacttgattaagccaaatgtgtatgtcactcacaacatatgtcaatggtcatttggcaacgagctgttgctgctcctggttacctcctagatatttcacaggccgatgagcagatcggcgagtagtcaacgtgtcttgcagttgcggagccgcggcggctgttctgacgaagcggcctgccggccggggaacagtggtcggtgctagcgtcgacggttgattatagacgcaaatcgctagtcgcctagtactcgtctcggcggaggaagggttgcgtcgtcgtcaatgtgctctctgctctcctttctgtctgagaaccatagaaagaggcgcttaagtcttaactccgtgtcgcctactactccgactctccggtatatgattcgtggttttttttcttttttcttttttttgaagttggttgcctcttccgcttcgcggcaacgcaagagaacagccgcactctcctactcggggtcggagttgagaacacagacggaatcggatgccatatcctctataaaattaatcacggaacacaccgaacaccaccaaagaacagatcaggaacggccggagcagagagagatggaaaagcaggacgacgcaacgcagctcctaccagacgacctgctcgccgaaatcctcggccgcctcgcgccgcgttggctcgccgcgtcccgctgtgtctgcaaggcatggcaagccatcatcgacagccgtcgccttctccgcgcggatctcctcccgctctcgctcagcggcatctacttcaacttccatgatgaacggcattcggtgttcttctcccacccctcgacgcgccccatcatctccggcatgttcaccgactacacgcccaatgcggaccgcgtggaggatcactgcaacggccttgttctactctggggtggcgtagctaaccccaccacccgacaatgggcgcctttccctgagcccccacctccatgcaccgagattaagggcgtctgccagcttagtaactatctcatgtatgaccctaccatatcatcgcactacgaaattttccaaatcccacgtgcgcttgatagatatcacgacgagcttgatcctatggatgacacctcgcaatggccaccgtcaccaagcgtgttgaatgtgttttcgtcaaggaccggagaatgggaaaagagatcgtacgtacgggagggtgaggctgccggtacagttgccgacatggcattgtcttttccatacgatcatttcaatggagtctattggcagggagcactttatgtacattgtgaagcagattttgtcatgaggtaagtggctatccactcttagcattataattgctttctttctccatttaaagattgcttggtgatctgatggtgtccacaacgtcgctttttacttttgcagaatatccttatctgacaagacatatcaggtcattatgctgcctataactacggaagtatctgaatataaatcgcattttttcgggagatcgaagaatggggtgcactatgcattaatggatagggaccaacgactacgaatttggtttctcaacgagtcatgtggtcagaaaatgtgggaattgaagcatgacaagaacattagctttctactgaaaaggcatgacaaatatggacaaaatgatggaccctggacactgcactattttgactattgtgaaaattatgaccagaatgacattgatgcccattatgaaggttacataaatgaagattataacgaagagtacatcgccgcccaagattgcaagcattttgaagctgcctcctatgaagatcgtaatggaaatagcatcagaaacgtgatagtaccaataaataaatttgagtgggactctgacaatgatagcattcttgacattgaaaatatgaatgacgaacatcgcgatacatttttttcaatccttggatttcatccctacaaagaggttatatttctgaaccgacaaatggagagaggattggcttatcatttcaatagctcaaagattcaatacttgggaaaaacgttcccagaatgttatcattcggaagttcatgagatgtatgcgtcttttgtgtacactccctgctggataggggagctttctgaaagcacataatttatgatatcatcttacagctctccaaagaaccgaataaattgatgttacagctaggatgcatatcctcttcttctgttacaacaaagagacactgttacagcagtgtcttgactcaactgcagtagcttgctgtggttcactgtacaaacaataaccttgcgtgtacggtaggttagacagggtactatatcacattttactatagaagccgatcctggaggcgcacgacaatgtttgtttggatttaataggtgcaaggtaacgcatgcataggaacgataataattggttactcatgtactcccttcgtttctaaatatttgataccgttgactttttagcacatgtttgaccgttcgctttattaaaaaacttttgtgaaatatgtaaaattatatgtatacatataagtatatatttaataatgaatcaaattataggaaaagaattaataataataacttaaaatttttaaataagacgaacggtcaaacgtatttaaaaaaatcaacagcgtcaaatatttagaaacggagggagtatatattactagatgaatacccgtcacgttgctgcggaaaattaagttgcataatatgtacgaataagatgcaatttgaataacaaaactaaaacaatttattacaattttaagtcaaaaaataattgagattgcgtgtttttaagagagaagaaagaagagacaatttggaccatagatctatcatccaaaggctagaaataattgaggtgatgtggcttaataagagaagagagaaataacattaactacgtttagtggggatgaactatataagtatataggatgtacgaataagatgcaatttgaataacaaaactaaaacaatttaatacaattttaagtctaaaaataattgagattgcatgtttttaagagagaagaaagaggagacaatttggaccacagatctatcatccaaaggctagaaataattgaggtgatgtgacttaataagagaagagagaaatatataacattaactatatttagtggggatgaactatataagtatataggagcttgaaatcacataagtgaaaaatgaatatcaaaagaaccgatttcttccataaatagaaacaatacatttttaaatctacaatataatattacagttacaatataaatagaagctgttatatcatccgaccacaaaagaagaaacaaatatagcttgttcagtcatacaaaagaagaaataaatgtatccgcattaatccttgtagcttgtcagcagcatcacatggatcaaggtatcttctcctcaacaaaatgtaggaaaaaaattagtgatatcatttagggttgaacaatcgagtatatgaaataacaaatagtaggacacaccagaattcaaactggctaaatgttgggcaaacaatttctttctgcacagtgtataaatatccaaagtttagtagctgcctagctggttatatgaaatatgtgaaataagctactgaacagtaaagacagattttcctctcccctaattgtcatttcatataatgcactataaaaaataaaacaaaaaaaaaacaaatgacgatgtagtgagtatagttattagaaccggaccggaccggcagtccgacggtgtcatggttatggataccacatacctaatagtagttgattaagctcgatagggcctaccatataccgtgtcttatatggaatcatatctcgtgtatagaaggggttccggataagtaatgataagtagagttctatgtcatggcggcctcccggctcacgcactcactttgacttccattctatgccccgacgccgacgcctgcggccacggcatcgtcttcttcgtcgccagccagtacatcggcctcttcaacgacatcagcaacggcgacgccacgaaccacctcgtcggcgttgagctcgacattgactagaacaacaagttccgcgacatcgatggcaaccatgtcggcgtcgacatcaccagcgccggctactacgacgatagcggcaactccggcgaccatggcttccataacctgacactggcgagccacggcaaggctatgcaagtatgggtcgattacaacggcacggccaagcagatcactgtcgccatggctcccctcaagatggccaagccttccatgccatattgccattgctatcttctacctacgacctctcccgggagggagaaacgggacatgccgtcgatacggcgtcgtcatcctcgatggctcgatctccccttcctctgccgcctctcccggaccgcctcgacggcagccatcggtgacgccaccgccgccgcatcggccctcggccctcggcacattgctgttcatgatgtagtgggagagtgttggtatttcttaacgacattactataaataaaattcccagcaagggtgcaaaaatactcctgatatattatggttacagagttcatccacaagcgcacggatatatcattgtagcatttcacccgagagtattccaagggtatcgtatttatttaatcccgtgagaagatcatagtagagagaaccggactaataatttatatgttacttgtaataatcatagtctaagcagggattaagataaatcaaagggtagagtgacacacaagcagggagcttctcattctcatactaaaatatctaagctaagtggaaagaaaatagaaagagaatctattcctatatttctagtatacataatatatatatatatatatatatatatatatatatatatatatatatatatatatatatatatatatatatatatatatatatatatattatagttatctgattaactagctaataccctctatgcgatgccctctggtacttcgagaagccacccctaactgccgagttccttacaacaggccgtcatgaccatacaaccgaggctaaatacggaggagtaccttactcaggaaattcacttaggactatatacacgcgtggaggaatacccatactgagctgtcaccatcagcggcacacctctcatccgcagcatataaccccaaataacaatatcccgtaatctagacaccacgcctaaactaccagatactactctaatgtcattgtcatgacatatagtaattgcataagcaaacattatacccataccaatgcatctaccagataagctagcagtatgatcaatataacatgaacataatgtaaagttggcattcatatactcgaaaagtatttcaatatcataaatgtataaagaagagtattctaataaaagtacaaagcttacaaaagaggaaaggagagctactagagccatacccgaactcttccgaatgtttccggactccgatttctactatattcctactccactagcttaagaacactaaactaaacttgagagaatataagagagctttgcttgaggtgtgtgttgaaatggagagagtgaggggtttatgtagcctcctagtgacggttggaatggtcggaaataccctccaaccgtcattgggagctaatccacatcgtccagccgcaaccctgcatccaacagngcgaggangggnnnggcngaaccccntggntaggccgacacatgggttgggccatcccgacccatcttcggctgacggcctcttggacttctcttctccgcagacttgtgaattttggctcaattggtcgtgtcatttctgagttcttggcccattcatacataagtctaattctcgacatcgtccgattgatttatcgtctggtttgatatatgtcgattctcctccactttatggttattctctgcaaaaggttagtaaacctaatactagtataatattattattctaacataaatatgtattgcaagcataactagctctcctctattttggtaatattgacggtcgaaactgatcgctaacgaccgtcaacagggagaatgcgcacgggcgggcgacgccagcgctggcgttagcgtggggccgtgacgcgatcccgtgcccgccgtccgctgccgtcgacccgctccccgccccgacggagctctgcctccagtacctcaccatggacatctcgccgccgccttgctcccctgcgcccgcgtcgtctccgccgccaccgccgccacgttgccgaccgccggaccttctctcccacctcgcaccgtcggtctcctccccacccgtcggccggcggcgccgacctgcctagagccccagagagaagagtgagagagagaaagagaagggagagaagaggggaaagaaagagaggctaactggacaggctgacatgtgggggcccacgtcggtcccacactgactcagcagacacgaaagataaaaccgggatcaaaaccaccgagggatctattgtgaccggttttatatagttaagggaccctgtatatctggttttgtagttcgaggatgttttgtatcccgatgacaagttgagggaccttcggtgtactttttcctttcgtggactgccgccatgggcttggcagtgtctgtttgtgcaacactttatggaactgcctattcatttgtccggtgatttctaacaaaaaaaaatcatctagattttttctaccgttcgatttacatccaacggactaaaaaaaataacaaatacatatttacttacgatatttttatcaaaattacagtgcacttacatgtcatatcaattgaatttacaaatgtaattttagttatatatggctgtaattttatattttttaaaaaataacaaatacatatttacttacaaaatatttttactaaaattacagtgcacttatatgtcatatcaactgaatttaataatgtaattttagttatatagaactataatttcctgcactaatcttggtgcatgcctctacggccaaaaaaacatcaaatatcagagaaaaaaaatcacgtttagcaaaatcgacaccttacacctaaccaaaccgagctgcacaacatgggaaccagatcctctaacgtagcgctggctacgtcagagggacgtccaacggctctcgtccgttcattcggcatcggacggagtcgagcgagcatagcgattagactcagcccatatgttgcagaaaaatcggcccacgcgacctacagccaatcagccatcgacgccgcctccgagccacaaccgccggcgccgctaggaagcaagtcgtcgccgtcggcgtcaccgccgcagcctgcgcctcccagcgaggtcccttcattgccaccctcctcttccccatccccgtcccccacccgcctccgtgtcctccctcgagcggaagcctccgctgcgtccggcgtcccgtcgtggaggtcgcggaccgtgcgcgtcgacgaaaccatgactcctggttggaggtcaacatgtcatggaagatacagcaggaaagaagcaacttgtccaaagcaacaatgcattgttgtgagatttattgttaagagcatcttgagtgctgcaatttctgttggagttaatttatttctagaacataccagcctactctctaactctctctactactccctccgtcccaagaaaagacaaacactgatttccgtgccaaacgtttgaccgtccgtcttatttgaaaaaaatatgaaaaaaattaaaaagacaagtcacgtataaaatataaataatgttttatcatctaacaacaattaaaatacgaattataaaaaaaattcatataagacggacagttaaaattagacacgaaaacccaagatttattattatttttttttacggagggagtactcatgaaacacaaaagtcaagcagcaagtcgtgtagacacataagactcgccacgtgcaccgacctgtctgcatttccgctcacccgcgtcgtctcactcgacagcgacttctgtatcagtgtcactggtccgctgcatagggtggcgctgttgttccacagcgccatgcccccggcccccgctgccttgccaaattctgactgccacgcgccctcgctgcaacggggtggcggacgcagtttaaaatatataggtgagatgaagaacgaagatattcgctcaactagagcaatcaaaatataacctactttgtatttatagtttaatcgtataactaccatacctcgatcatagtttgtgttatgcgtgcgttttgcagagacgtattaatctgttggtcattctcacaccttaatttatctaattttgttgacccatgactactataatgggtaagagatcttaaggggtgggacggcacgggtcgtaacggagtcggtcgacccaccctgcccccggtaccgtaaatcaatattgtatataaatatgctttacgtcgtaaatatagtaaactattgattcgaaaaatacaataagcatatataaaatactacatacccgccgaatatgtgtacgaaattatagtagattaattcaaataaactaatatactaactatcttaatcagctgtgctagcaggctcggattgtgctccagatatatctgaggaaaaagtacaccgaaggtccctcaacttgtcatcgagttacaaaatcgtccctaaactacaaaaccagatatctggcgtcccttaactaatcaaaaccagtcacagcaggtccttcggtggttttggccccgattttgtcctacgtggcagctgagtcagcgtgggacccacatggacccatgtcccggtgtccacgtcaccaccctctctcttaatctctttcccctcttctgcccaggaccgccgcgcctccctcccggtgctcggcgctcctcctcaacttccgcgtcctcgccgccgtcgcagggtcccacttctcccccgcggtctcccgcctcgcggcccgcctccgcctctccccgtccatggccgccgtcacgctcctcgcgctcggcaacgacgcgcccgacgtcgcgggcgaacgacgacgcgggagggacggcgaacggcacggcgatgagcgcgacggccccgacgacgaacgcggagatgaacgggcgtcggcggccagcgacgggcgatgcggcggcggagacggcggcgaccagcgggtcgggaggaggtcggcgtggcgaggagggagaggagaaggtccggcggctgactcgccccgccgccgctccgctccactccgcctgccgccgcgcgctcgcgggcctgctccggccgttcgcttgccgccgctccgctccgctggcagcgcgctcgtctgccgccgccggtgctccgctccgccggccgcgcgctctctgcacgctcgtcgctgccaatactggctcagcatcgtccacaaccacaagaacaggctcttctacctgctacgctgttagcacacaagaaaacactcttagaccgagacgtactcacacctggtgaatacacatgcaggagagtaggcaaagaacacaaggtatttgtgctgcacaaccgcaaccttttctggcactgcacaccgcagtgttttttttcaatgcacataatcaacctcaaagtacatgcttaaatagaccagctagcagcccaagttatgcatacataagaaaacatgcaaaagcaaaatactaagtctagattatttctaacatacgctattgcggctccatcttctcacctcaccgccgatggcggcggcggcgtcgtcgtcgtcgtcgtctccgtctccggtagcgcgaaccatcttgcgctcgccgccgcatgcagccgcagccgcatcactcctctcctctgatcccaaacccacacagtacctcgccgtcacgccgcgcagcgagctcctgcgtgtgacacggcggtggcacgagacgacgatcatcactccagcggacgcatccaacaacagggcgcacctgaagcacgtcgtcttcacgacgagcgttaaggtcgaggaggcttcttcgccttcgcgaggcccgagagcaaaaccaggtcgagtgttgctatcgcgtcctcctctgccaccaacgccgccgcggcttacacgtcttcttcgccgccgccgccgccgaccgccgtcgtggcgccgccctcctctcccgcctcgcctcgccccgccccgccgacaggtctacaggcagagagagagagagacgaggaatcgaggaagagaaggggagagatactcagcctaacatgtggggcccacgtgggtcccacgctgacttagccgccacgtaggataaaaccggggtcaaaaccaccgaaggacctattgtgaccggttttgattagttaaaggacgccggatatctgttttgcggtttggggatgattttgtaactcaatgacaaatcgagggaccttcgatgtactttttcctatatctgatcagcgtgcatatatagcccatagatatgtgtgtgcatatgtacttatagataacttaactatgtgtacgtgtactatcgtgtataggtttcggtgcataccgatgcatatgatgtacgcttagatacaatagattaattttaaaaaaattaatccattagctacataactaattaaaaggctctcatgcgaagattgtggttgggccgacaacatacgaaaatggtgatctttaaataccttttcgtacaggcgggtgacataatcgcatacgaatatcggttttaagcttttggcaacctgcaaaaaccatttattagtagtatacattagctcataggtttgatgaagagttcttttttttaaaaaaagaaatagagggcaaaagttttgtgtagtatgtattgatatagtagggggtttgatgaagaacttttaccaccgataattataacaatatgttaccaactaattaccaaaatcctctatattcatatgtttcttacattcaacctactcattaccaactaattaccaaaatcctctatattaatttgtttttttacattcaaactactcaataccaactaattattcaaactactcactaccaactaattaacaatatctaattattaccaactaattagctaaatcaccaggtaaagactatataagatgagctagttattagtgttaattgcacaaaccatgtctacctctactgtcattacagcggtgtttctgttataccttgttttccccgtgcaatcagtagagttcttcaagaggtacgtcggaatgtataagaattatgttgtttgcattctactccctccatccataaaagttacacctattttacatttaagattttctaaataagttgtttctatttatagtctttatgcattcaaaacttaaatgaggagataaattaaatgtttaattagaacccagggagtcatctaaatactcattggttacatccttgcattcacttcttgattttgtaacatccaagatagtttaatttctccttatcttggtggcaaaagtaataggtgtaacttttgtggatgaagggagtaatataattcttatgtcttagctccatttgtttttttttctgatttcttttctccttttcagtgttgggtgggctccatatcatgttttggattacgacttcttcagaaacagttactatgtcaatttttacatgtttcgagacgatgtaattgctacctcaagtcagctacagattgataataggtatatccttagcgaacaaactcccaatcgtgcgccagtagattggaagatgggacatctgattgggagaggggatgacaatgcaatgttgtcaatccgagcagataacttgtatgtaaccggatttgccaacagaaccggtcattggcatgtatatccaaagtttgcagatcaaattcccgaacccaaaacactcctgacttttggagacgactaccattctcttctaggtgatggttccagccaaaatctacccaaaataaatctcggactgcatgccacattaaatgccatcgagactttgtccaactaccagccatcctcagataacacggccatcaaaatagcattaaccacgctaattgttaccctgccagaagccgtacgtttccggcctatccgataccggttattggatggatggtttacagggactcgtcttactagtcatttggcaaaggaagtggttagctggcgagacatgtcctgtgctgtccttatttttgacaagtatggaaggtggtgggcaagtgcagaggccggaatattgcaggggaagttccagattcgaagcaaatttgataccctccaataccttgatgtggtgctttggcctagacctaagaaatgctccctaccaatcttagatgaccaacatattcagcagattagggcacggatggataggagggggcaaggaagaggttaatttgtagcccctgattaactgctatctatatggaatagcttgttgagaaatttccttttcatatacaataatgttggtgaatgaatcttctcatatcagttgcattttctgtgtttgtgcatgtatatttttcattcattttcaaagactctgcattctacaatgatatactaccctttaaacaaaaaaacactaacctttggattcgctaaatcacgcattcaacgccccccaaccccttctcctcgatcttccttctcccgacctcaccgccggcaaggccgcccccagctgctactgcgccacctcaatccccagcgacatgggacggatggtactgcacgagtcgctcgacggcgcggggggcgcgaccccgggagggaacgaagcagcagcatgtcgggcgggcggctcgacaccagcgtcgccaacaacccaaccggtgaccggacctcgcatgcgccgcgctctgcgtcgccgcagccgcaggccgcagcggacgactggctcgctcgtctcccgatcctgcgtgctgctcccccatcggacaactacccttcttgtttgcgcccaccggtgcgccgcctgatcacgtcttcttcgaccacctcggctgttccatctacatccacaaggtacgttactataaagcacaattaacaacatttgcaacaagcacagataattcttttcatcgtttgacttcagactcactctgttacttcgcttccttgattgaatttggaagaattgcagcaagcacatatattctttgtattgtttcacttcagactctgttagtttaaattctcaagaatttcttcttgtcctggtttgcttggtggctaggttttaacatgcgatctgctttaatgcttttgttgatattttcagatacactgaagatgaagatgatatgattggctttactggtttttacaatgtggatattttcttttcacatgatcccaacagccttcctaggggttatgagaaacacaaaaacaagttgggcaaagaaccacatattatgacatcaaagtcacttcaggtagaggtttttttgatcatcagtatccatgttctatatttaactgtcaatgtgtttttatctgctcaatagctgtttatatctcaggaaaggtagttaccacaaattactcaattcgtagcattaagccagccatcctttgggccccttcccctacagagaactttataccaatttctcctcttttccccctacagtgtctgatgtcaaattttaagatttgtcagcgcacagggattatgcttatactttttcatatactttgaggaataaaaattcatttaagccattttgacctcttcatatgatccagaatgaacataaatagttttagttaaacctttaggtatcatatactgttaatactgtggtttacaatattctatttattattttccaagtgcacagtcagcttttgggtcgtggactcatggattttttttcattgattgtttcagagctctgtatatcagtatgtccttatctcagattaaatctgctgccactattttgaaaagtaagctatggtaccagcatatctatattgctagcgaagcctttttgtttacatgattgaatttttgttcttattagtcatctaactgaatattttagttcctctttggccagagtgagtcctagatgaaacccagggaaaatatctttaatatattatatatttaacataaatgttggtttatccctgtctctctgttcataggtagaatctattatataattaaaggaatagaaaaaggagcctccacgttcgctctcatggcctagaaattctcacattaatcggagaaaaagtaaaaaacagagttcatatataaatacaatttagaaatagctgaaattcggaattaaaaaataaggaatattagaagaggagactagtctatatagaaatacaatttagaaatagttgaaattcggaatttaaaaataaggaatattagaagaggagtatagagtccatatagaaatacaattaggaaataatagaaattcgaattaaaaataaggaatattagaagtagagtatagagtccatatagaaatacaattaggaaataatagaaattctgaattaaaaataagaaatattagaagtagagtacagagtccatatagaaatacaattaagaaaaaaaagaaattcagaattaaaaaataagaaatattagaagtagggtatagattccatataggaatttaaactaactaaaattcggaaaaaaagagcctccacgttcgctctaatgacctagaaattctcacattaatcggagaaaaagaaaaagcagagtccatatagaaatacactttagaaatagttgaaattcggaattaaaaaataagaaatattaaaagaggag

SEQ ID NO: 63145 - DNA, 20781 bp, Oryza sativa
agtattttatagaaacaccccgaagttttccggttggctctacaaaatgatggactagacgacctgagtttgaagtctcaccccttttaattatttaatattaggtcattccttcgtatttagatcttttagggagcatttcatctaaacggcccgtacaaatgcacggacaggattaaaaggggaacgcactatattaattacaaacccagatcatagcaacgttgacgcgtgtttattaatcatggttgttgcaaccatgattaaagtcttaattaaggcctgccgttattggccacattgtcactcactcatgcaccaaagtgatcaatgcatcacgctatgcttttcccccctctaaaacttcgtaaggatattatagatttctaaagtttaaggtggtgttttcttttaattaagatatgctcttttcttctcaatttatcatcatatttgtaaataagcaacgatggtatttactcatgcacagataaataaagagatatgtaacgatgacattactcctcctattctgcacacgtaaacgaacaaacacgcaacgatgtcatttaattctgcaagaataaacaaatagaactggttagatgatgaataatttgaaaatatcttaagggatgattaaattgggatggagatagtggattttaccttaatttgcgttagtacactttttaaactactaaacattgtgcagaggtggctccaagtgggtgttcaggtggtctatggaccacctgaattttggctcaacgtatctcatttatcccaaatactcgacctagtaataacctattccattttccaccacgcccaattctaggtttatcgtgagtgcgtcatacatgcgcagttgttgtgctcatctcatgtccctcggctgcggtgctgctattcaagtatatatgctagaatttttagaaggtgaagtaggcacacccaacgggaatttcttggagccgccaatgacattgtattttgtacgaaaactcttcatatagaagttgttaaagtatcaaataaatctaggtttataataattaaaattaatttattatgtgctaatagcttttttaacatggcctaacttcatcttcatttttattagaaaagaacaccaacttaggccagatgaagtttcactgtgcacatttttgtagaaaaaaaataacatgctgaaattaatttccattttttgaatacatacaagggtggtttaatttgatcttggagtggactggtcgttgctctaactaattgtaaggttgtactatatgcaactaccattgcaggtatcgactagtgataaatagccccaaattccgtgaggctctgatcgatatatatacaaccgtgcatatactagtgtacagtgtactggatgatcgagttggtgacgcatctctatccttaacgcctgctttatttgtcatctgtcaccgaagagcggccaaatctcccacccactttcttcttcacgagattattaatttccctcctccccggcacgcagttaattaatttcaccttaatcacactcaacgacgtacgcatgaaccggctaatatgatatgtttttttatcccaacagtataatactcacttcgtcctaaattatagggcgcccccattttaacaaaaatcaatctcaataacttacctaataatcatactgagtatatctatactaagtgttatatcactagatttatattttgaaatactttcttgtgatgctaatttcatatttgttggaaacatactctctccaggttgataatacttgtcattttggacaagagcacggtctccaaaaaataattttgatcattatttttcattataatatgtataaaattgttaacaaatatatgattttattaaagtacttttaagactaatctatacatgtagtcaccatatttgaaacacaaatattttaaaaatgattcataatcaaatattctaaagtttgacctcacacttgtccaaacgacaagtattatcaacccggagggagtagcatgaaataaaatgctggtcaaagcatgtcattgaagacagtgtaagaaaaatatatgccttatcatttgggacagaggaagtagaatttattctggcttttactttataaaagctataaccagatattataaatattacaatacaaatgttatggattataaaatcataagttgatttaaaactacttaaaataccactcaaaagaaagatttttcatctatggttagtgagagtctgcatatccattgtttcttcacaatgccttacatgttagatgtaatcactatattccttaaaccaaaaatagaatctccgaaatcagcggtcgatcgaatcaagcacacatcactgccagcaactaatgtcgaaccaaagcgaaaagataaaccgaataaaaacttagctgtaaacaatcattcacccatatcttgcgaccaccatatccatcaaagccgattcaatgaaaatgcggtcactaacaatgccatatcaacatgaaacctccaatgaagcgcttttaagaaggccacaacatataggatcggtgtcacggttgctatttcaatcatccggactggttttcattcgaagactccacataaggcaatatcagaaaagagaatgtccattacaccgttcacatgcgtcaccaatgtcaatactccattgaccctagatctatggcgatttgagcttgacctcagcatcgagtggcggtagcgacaatgatggaggtgactagcaacgggaagagggacaagacgcccgtgccaacagcacaacgttgtcccaccatttaaagagactgatggtagcaatgggtagggtggaggctctctctcacagtggctcgatagtaacttcaatgggcataaagagcacatacttcggccatcctcaacctagaaactattaaatagtttccatacttgtcatgtcatatagacactatacatagaaactatatatctaatggatggtgtcttcaaattaaattctcatccaatcatctcccttctctctcctttatcgacctattctcttgtttcattcttcttggttctcgtgtagagacggtttcttcatcttttatctctctcctcattaactcttttgccacatcagatttttacttatgtgataatgtatttaatactatggacactatatgatatggagggatgtgaattgccttatgtatcaccaaattaaagccggatccggccaagccccgctacttccttcctcgaaaaccacatgttcgtttctggcgttcccctccagcggcatcaagaaaagaaaatcacctcgattacacgagatcccctgaacacgcaagggtgttagttaggtgcagacggtaagcgtagctagatttttcctgaaaaaaggaaagtatgtaacttactagatgacaggattaacatggtttgtatatgttagttgtacgtaatggtaatctgacagccatgcatgtacgtacctgtagctaatacttgtgtaatgcgcataagtagttaccatgttgtaacggggaaaaaaaaagggaaaatgcagcacaacggaactacatccattctcaaattgccagcttaggtagtacgtattgctgtgttttgtacagattttgatttttgggagcatggcagcaggtactagtactacgctactagtacttctgtagttctgtgcagaagcatgtgtacatgggagtgaaaccttccaacgtaatattgtcgttaacatgtgctttactttgatacccacacatgtcatcgaccacgtcactgaaaagttcacatcagaggaacttcttttgtgtatatggcatattggcgtacgcataacgccggagacagctcccgagcaaattgggcgatcatgaaaacaccggtgtataaaaaaaacactattaatcatggtttgggtcctagtggaaaaaactggaccgatgagtgacaaggacgacccctcggttcaccggtccgacggtctgaccgaggaaccgttggctgaaccacagttcaataactaatatatgcaatatgtatttcctctattacacaagtgaaaaagtgtaggatagctagagccaagtgcttctagtgcaaagacccaggtttgagtccccgcgccacaagcattatttatgttatttttgtacagacgaaatagtcacgtgggcctggactgggccttgatatagcccattatctcctttgtccggtccgaccaagacggtttaatgctaggtttattcaaaactcggccggttcagccggttcaatccgagttgaatacatgtccggtcattcagcttaaccgtaccgtgtagacctctggctcggttttgtccggttgaaccttcggtcaggttcgggtttttccactatggttcgggctcaacagcgctccgccacctccgccaccgcgtacgtgcgtgcgtgcgtgcagctagctaactaacgaatgaatggtagttaaggcagagccatcacaccgatcatggtcataaaaaacccttgttagtactgaacaggacaaagggcccggccgaccaaatcgccccctgcacgtgaatacgtgatcatatgccattgcattgccctgctcgatcaaacgaatcagctgcagagcctgcagccgcccgtaacagttactcgtacactactaataaaattttgcaatatttactcgctgtaagaaaagtaatttaaaattggtaatgaaccaggaattaatttcttcaaccaccggccatgactcgccatttacccgagttgttcactttgcttcaagacaacgaagtgagattgcttttacagttttacgtggctgcgaaaaataaagttaggcatgggcaacgtggcaaacacgtgcattatcagccttatgatgatcagcacaggtactaccacgcaacagcgagtagatattcatgctttcagatgcgccgcttacttacacacgaggcaacccatcgatcgatccatctgcattcgagctcacatttttcatcacaagaagggctgcaattaattaggcagctccatatcataagccaaagtttatacattaaaatttggatctgtttgaaaatataagtttttccgaaagttataatataaattataagatgaaaaataattgtgattggttgagatggaaaaaatagtgaaaaaatttaataacatgaggctgtttttagttgagataaaagaataaaagaaatatttaaactatgacataaaattttaattatattatattttagtacagtgggaacactttgttttgttaaggcagttgaacaaagaaagttggaacacatgtctcctccatgcggcgccagctagtctggttgacagtccacgtaagcaaagggcggccccacctgcagagcaggaaaaataaaacagacagaaaagggttggcatgtgggacccaccatccatcatcccaactcccagtctcccatccagattttccatttcattaattattaccgctccaaccactatcctaaagtagctaacatagggccggcaccggtcttccctgtgggccccaccagtcagcccccacccacacacactcttttctctctcctctctcctgattagcaacagtagcagcctcacttccactaatcacactctacagtctcactcctagaatctggtgcctccctctccctctctcatccacctccaacccaaacacaactttttaacagttaattaattagagattaaagcctttctctccccaatcccaagaagcaaacctagagagagagagagaaaatcatcagcaaaattaccaggagagggtgttcacctttgcccctgaagaagtggagattagtagggagagagagaaagcaattagccactaacagagagcaaagaggacaccagctgtgacttgacttacgagtccagtgacgcgtgaggcgccatggaaatggagatagaagcactactataaatatcatcaacgtattaaaatatagtaacctttgtatagataagatatatcttaatattaagaatttgatactcttcagattattggacacattctgatactatgtctagattcatagtattactatgaatttaaatactgcccaaatttataatattataatacgtcttatccgcttaaggttgctatattttttaatggagatagagagcaggagtagacaagaaaacctgggcgaggagagagaaagagagccaaggagagagagagagagtgtcctcatgtgccgtcagtgagagaggaagcctctcactctctccggtggagggaaaagcaccgaaaagcgcggcctttttttcttctttttttccctcccttgttcttccccacactccactccactcctcgcatcgcatcccatccatggccgcctccgccgtcgccgtcgcgttcgtcgtggcggtggccgccgtgctggccgcggcggcgtccgcggccgtgacgtacgaccggaaggctgtggtggtgaacgggcagcggaggatcctcatctccggctccatccactacccgaggagcacccccgaggcaaggcgcacacgcttccccttcctcctcctcaccgtgcttctccgacggcgacgcctcctcctctctctcgccggaggaatgccggcgaggcggctggttgcgtggctttgctatgcttgctaacttgtttgtggggggtggtgcttactgcttgggttgcagatgtggccggatctgatagagaaggccaaggacggcggcctcgacgtggtgcagacgtacgtcttctggaacggccacgagccgtcccccggccaggtagttaccggcaacaataaccgtgaaaacaagttgtttttcgtgttcttgatgtggttggtttggtttggttgatttctcgcagtactacttcgaggggaggtatgatctggtgcacttcatcaagctggtgaagcaggccggcctctacgtgaacctccgcattggcccctacgtctgcgccgagtggaacttcgggtaacagcaccaagaacatcttgtgttcttagttttcctgcacttgcagtaagtagccaattggtgtttgctgtgagatgtctgaatctgggggttatgggaagtggcagaagtctttttctttttctttttggtgggtgtgtcaaattgctctatttataaggtagttaagttgatattgttgctgatgggggctgtttgtggctgcagtttggctgacgaggaataattagaatagaattcttgatgttgagttgatttgaaatatgctaattttatgctcctttaaccccttttggtcgcagtgggttccctgtttggctcaagtatgtccccggcatcagctttaggactgataatgagccgttcaaggcaagaatcctttgacagcactaactttaacctttactaatctccttgacccctctgtaaaaatttcctatgatctctgtaaaaaaaaaagaattgacttttgcgtgattctccaaacaggctgagatgcagaagttcaccacaaagatcgtcgaaatgatgaagtcggaagggctctttgaatggcaaggagggcctataatcctctcccaggtacgcttgtaatcgaaggtgcattcttggtatttgttgatggcattctcttcaatgcaacctacttttctgagtgtcccctgcagatagagaacgagtttgggcccttggagtgggatcaaggtgagcctgccaaggcatatgcatcatgggcagctaacatggcagttgcgctcaacaccagtgtgccatggatcatgtgcaaagaagatgatgcccctgatccaattgtatgtactgtaccacttctctttaatacagagtacatgtactgggggaagcagttcctcatttctttaatgttctttgtgaccgttgtccaagaaatgaaaggatatgatcgatcatacattgaatttcctttgttttaaaataaaatctcctccgctcttacatgacacatctcatacagtacatgccaattggggtagaaggtttcagctgagctacgtcttacttcgatttatctatgacagattaatacatgcaatggattttactgtgattggttctccccaaataaacctcacaaacctaccatgtggactgaagcctggactgcttggtagtgtcccttttctttattttcctgaggttcttatgatggctatgtgcttagctttcgccttacgtatatcttctgttccctctgcaggtatacaggctttggtattccagttccacatagaccagtagaggatctagcatatggtgtcgccaagtttatccagaagggtggctcttttgtgaattattacatggtaagtcccatcaatacgctttaaagctgaaatgtaccatgttattgagtagtctcaagctgtgacactgttgcttttcagtatcatggtggaacaaactttggacgcacagctggtggcccattcattgccactagttatgactatgatgctcctattgatgaatatggtgagttaagcactttacatatcttgcatatgattgcttattaaaccttaagaaatacagtatccattagtaagaggtatatactttgcacctgtttcctgcatgtaggcatttctgctatccaaacattacagacatgttacatctggtaaataatttgcaacacaacgggtgatgctctacgcaaaacgaaaagatatgggttgtaaaaggtccccttttttttctaccatctctgatactatgcaaatatgtaaaagttttactatatttttgttactgaaatttcactcaaaactattctagtagagctttattgaaacttttagtgtagtttgtttttgtatttgtaaggcatcttttaaatttgtctagatttgattttgtgaagtttttgaatttatggggattcaccaaacggtaataatttatttgagttaaaatatttttcattttaccccccgacaaaataaacatgtgagctgttggatgtttatctagttattgaaaaaagtgagttaaaaataagaaggaaaaactggatacctgctgaataggatggtccctatgtgctacatcatgtttaccaaattgatatgaactttcttcccttcgctacctcaggtttgttgagagaaccaaaatggggccacttgaagcagttgcataaagccataaaactttgtgaacctgccttggttgcaggagaccccattgtaacttcacttggaaatgctcagaaggttcgttacacattccgttctctattgtcccttagacctacaatattttgttctgaactgactcctccttaatttgctgttcagtcatcagtttttagatcaagcacaggagcttgtgcagctttccttgagaacaaggataaagtatcttatgcaagggtagcatttaatggcatgcactatgacctgcctccgtggtccataagtattctcccagactgcaaaacgacagtcttcaatactgctagggtgagatagatactttagtttttttttttttggttgtcttgtccatgctataattttcttcttaatatacttgagttgcttgttcaaaagtgggtttttgttgctgcattttaatacatgtagcatatccttggtacaactgttaatgaaaatcaatatttttttttataaatttattccacatccaatctgaatttggatccttttatcatgtgatcttgttaatatctatcaattgaaaatgttaaattgtgattaatcttaaataaatttatcatgtaggtgggaagtcagatttcacagatgaaaatggaatgggctggaggatttgcatggcaatcatacaacgaggagataaattcctttggtgaggatccacttacaacagtaggattactggaacaaataaatgtgacgagggataacacagactacttatggtataccacatagtaagtactaagaagctgaacccccaaaaatacaaatacatggtgatgtgcaataccatgtactaaacatttttcactttcagtgtcgatgttgcccaggatgagcagttccttagcaatggggagaatctcaagcttactgtgatgtcagctggtcatgctttgcatattttcattaatggacaactgaaaggtaaaacagataaacctatactctgtatgcccgccatatgcaggtgtttcttgatcctcaatacacttttcaatttgctggcaggaactgtttatggcagcgtagatgacccaaaactgacttatactgggaatgtgaagctctgggcaggcagcaatacaatttcctgcttaagtatagcagttggcctcccagtaagtagatgttcagcctcaggctcaaatagtactcttggttatatgctgtttgatccatttcagactcagttaccattttcctctatcatagaatgtgggagaacattttgagacttggaatgctgggattcttggcccagtgacgcttgatggcctgaatgagggaagaagggatctgacatggcagaaatggacttatcaggtatatatcgtttgccatttgatgaggtaataactgtttatctaataatctggagtgtacatgagaaattgttgtgtttgtacaggtaggactgaaaggtgagtctatgagtcttcattcactcagtggaagctcaacagtggagtggggagaacctgtgcagaagcagcctctaacatggtacaaggtaatgaagaaattattaattcttgctcctataataaaataatgtctatcattacactaatcctgttatgtcgcctgtttaggcttttttcaatgcaccggatggtgatgagccattagctttggacatgagtagtatggggaaggggcaaatctggataaatggacaaggtattgggcgatattggcctggctacaaggcttctggaaactgtggaacctgtgattatcgaggtgaatacgatgaaacgaagtgtcaaaccaactgtggtgactcttctcagagatggtaggcattccataaaagtatcattctatgataacattgtagtactgtttacacgagaagctcttataaatctaatgtcatggtctgtcaggtaccatgttcctcgttcatggcttagtcccacaggaaaccttttggtcatattcgaggagtggggtggtgaccctactggaatctcaatggtcaaaagaagcatcggaagtgtctgcgctgatgtgtccgaatgccagccatcaatgaagaactggcatacaaaagactacgagaaagcaaaagtccacctccaatgtgacaatggacagaagataactgaaataaaatttgctagctttggcacaccacagggctcctgtggaagctacaccgaaggaggctgccatgcgcacaagtcgtacgacatattttggaaggtaaaggatttgcgttcactgtgtcgactaaagcagcactgctaaagttagtctgtctgtctataccatgaacttatgtcatgtattgatgcctgttgcagaactgcgtcggtcaagaacgctgcggggtaagcgttgttccagaaatatttggtggagatccatgcccagggacaatgaaacgggctgttgttgaggctatatgcggttgagaaccgcaaactcagatcctcccaaatcatcctatatcttagtttcgacacggttttcggcttaccgaccttctggcaagaggtgaaagtcacagcaacagtgacgcacggaccgtcagaagttacagaaaatttagttgtaattgaagcatcagtgtatgtacattattctacatagaaattcactgggaaggaaagattcaggactctgcagtgcaggaatgggaaaccaaggggctgtatgtatggtcctctggacagtattggtttttggctggggaagggcgcataggagactctgctgatacatgagtccatatgcgcaatggcttttgcatattggattggaggatcaactctgtttcatacgtgatgtgatgattcatttttaagctcactgaaaactactgcaatgtaatgctggtaatgtgcagggtccatcattgatgtattaaattgtcctcttaattagctaattagcaatgtactaccttttcagcttataaataaatctgctgtatgttattcaaccgtatgtgaatgaattctctcaggtggtcatctcaatgcccacttgatgattaatctgatacacattcctgccccatttttgactgattaaagcagtggcgaacccaggatttttatcctgggtgtgcctacagcaagccaaaacaaaaacctcaagcacaaaagtacagttacatcttaaattatccaaatgtagtacaattagttcattttggggctcctcactccgaattgaattagatgctcttgaagttgaatttgatgctctaccactacctacagttatatcttcttgctcttcattttggggctgtactggtggtggtgttggtgaagcctgagcgtgtggtgattcctctgttgggattgaagaagaagaaaacaacaccaattgcaaagtctcattttctcgagtttcttcagttactcttccttcctatagttaccccatgagaaatgtgaagccctgtcctaggagatgcagaatctgaattagggaccttgctcaataaagaaagtatgcccatatttctgttgttcctttttatatctgacaaattaattcaacttgacctctgcctaagtgcctactgcctacaaaatacaaatcacaaaaaatgtaccctcaatttcagtttccaactttgcaaattgaatcgatgaatcgaatacaaaaatctcaaagtgaattagtgaaatgacatacctgcagctggatggactgctgagcgactgagctgaggactaggagctaccaagctgagcagctgccttgttgctgccgggctggcctgccagcgccacagaacccatgccgaatcgccgacccgccggccgccgcccggcgcccattgccagtcgccaccacggcaccaccgccggccgccgcagtgcacgagaaactgagaaagggattgggaaaagaggaaccctagagacgagaaaattgcgattctactgtcgtaaaatggtttcgctggataatgcaatcctaaaagtgttcactaaaatgctattttggtctttttttaatagaaatgattttactctattttatttttttgtcctgaccaaaatacccttctctcttatctctttgaccagatcgaatcgatccagaaacgccaagaagcaggtagttgcagagcaggaatgccctgtgcgtgtgcacccccgccattgccgcaagcacaagcaagaagaagctttctcacgatctcttcaaggatttgcgaggaatcgttggctgagagagtgcgagatgaagtggagagcgagagatcgatgagttgaagggagagtctcgccggcgaggaggggatttaacgaccgttggtgctctctctgtcttcggcatcggctctagcgcccctccgcatcgactccggctccggcgccggcgctggcccccggcgctcccccacttgctcctcccctccctcctcccccaatccactcgcgtcgccgcctcccttcgcgtccgccaacaccggccgatgcgctcggagtggcgagctcctcctggtcggcaagcaccatctccgcatcctccttgccgttggtgcgcccaccgctccaggcagcggcggccatgggatcgacatggagcccgttcttctcggtgaacccggggccggcggcggcggatgaggaggaggggccggggaacatggcgcggccacaccggtggcggcggcgaggccgcgataggatgggggtaggggcggcacgccgcgccgtggcccggccgccggcgcgagggttttgggcgagtcggtcgccggcggcttctggtgcggccgctggtggagcgacctcgctagagatcgggatggtgggggaggaagaggggaaagagaggggagagtgtatgacaggtggggcccgcgtcaggggcattttggtctaggaaaaatataaaattgagaaaaaatatttatattcacacaaaagaatgaaaatagcattttggtgaaacctctcagtttaggatggcataacataccagtgaatcagtttgaagcgatagcattttaacgaaaccactcttttacgataatataatccaattttctcccagactctagcagcacatggcacattggctagcagattgggctgcctccctgctagcacgttgggccttgtaggccttgcttttgatccaacgaggcaccaatctattgatttggcccgctgctaatactacatactatatttttatgccggtgcacacccggcaccccacataggtccgccgctgcaacattatattcaacaagaaaaagttacaacctcattcttacaaaagagatataaacaaaacttgccaactaaattacttattggcattgcttgtacttgggtttgctaacatcacgtcaccaaggaatgggtcttcatgcaactcaatcccagtgcgcaaaacaccgtcatttcttacttgaaactcctccaaaaatttgtctagcaatgaatcatcagccattcccaattcatcccagctaatactatatttattatcatccgcaacacttgcattgattattcctatatcaatgctttcatatatctcattttgctgatgatgctcaacatttgtttccctctcatgttcttcttgaccattgataactatagcagcaacatcactagcaacatccatggtgccactaatatctacaccctccggtatagcaacaattgtgtcattgttactatgtaagaacgaaggacatgatgactctcgaaggatagcagggttaaaacgtccagagggagcaagacttgcttgatttgcaacattaatgtcaccaatactagatccactaggatcactcgagttgatcatgttcattgtgcagatggaatgagagtttggtggatttagtgatgtccctgcaacttctagtaaagcaggactcatcatacttgcaagaactgtggggctactacaaccaacaatattgtctgggatattattgttggcgaacgtgctgatattgtttccttgtaagcctagaccccttgctatgttgtgaatgagcaacattgatctattcactatgggtgcagaagccatcatcggggacacttcttgtgataaggatggatattggaacggtatatagtgagaaattggtggcattaaactaggagtaatagggatggccggagtatatgtaggagcaaattgtggcagctgatgttggtagggcatgtgagatgtggaaggttgatcgactaacctacaacgctttgtagtaagtgtagaacaaggagtggatttgtgtttcacacgatgattatggaggatatcaacaagaaagtcataagactctgtggaggcaatggctttagcaatatccgtgtctagtatgatgcaacgattatgggattgagcagatgcccatgcacgcacagcaagttcttgtacgaagagctcacacatcttcgataagaatgctggcatgtcaaaggtcatcatcatgttacccttttgagaagatacgatcttcttcaagcgggccatagggatcgcatgctcgctaaagtcctttgttgtttcaatctccttttgtcgatccctccaaaattcatccatttgttgttgagcttttggcgccagtagtctcaacgatctaggtacgtccaaagtttgctccattccttcccttcgttgctctgaataatagacctacatagcaagcacacacttttgttacttctttttcttacttttctagttcaaaaattagcaaaacgatgttacattgcagtctaacaaaaagagatagctagcttaattacaaatcaaatagcattgctcaaatcacaaattttcacaagtaccagtacaaaaactaattaatactaggcacaagaataataagctagtaggtgcattaccttacttgagctgcaactacagaaaatgctacctattagcactaattggttggtagtatgaagatgaacacaatatgacacgaggatgaacatagtatgcaaggtggggtggtttatataggcctaaaagattctggtttctatgatatctgtattgttgagaagggagacgaaaaagagttgaagaaagaaaaaaaggtttattagtttcttgtgggtttggtgaaatcttttagccttgcgtgtatcttttccagtgaaacagctagctttaatatatgtggggctcacaaggctaaaccatgcattccacacttcttatgctaaagacaaccaagataaagtagtgcagtttatttgcgtaacatattagtcatgtcacgaattgacttgcttgttaattgaacatatatttgtttgtcctctcctataccatgcatatgcatcatgatttcaaattgatgtgtcatacatgctaatctatctctaagttagctagctgatcaacggacggttagctctagatgtgtgcaagatatatcgaggagtttgttttgctttagattcacgcatatatgtgatagcttgattccagccaatacatgctacgtggtttaatgatggatggatgcatggattgatgactagatcagtagataagtactcgatccattgctagcaaactaagtgtactttcggcgcctttcctgctggagaattttgtattttagcttaatatcctacatttcttttgtacattgtgtaacgcaagcaattgtctaatgacctatttaataataaaccatgatgtccatacatatatgcatgatggactttggctggcctacttgcttgcagtaagtgcatggtttgcatgcataccatgcatagatcatgtgttgtttgtggtcctagctacataacttatactccatgtacttaatactttattacttttgtatgttattcagcaaccactagctaacaagctttgtatgttagtactttacttttgaatgctaatatagagtttgtttgccacattgctctctctcatgactcgccatcttttcaattttatacatacttaattacttttgtatgttagcagttagctacaagcgacgcctaaggaaaacgggctaatcaaatataccactccaaattgtacattgataaataaactcatggaacttgctagcttaacaaagagtaccataccacatacaaataaatagtgaaacacaataaaagataaacgaaatagttcaaggcatatatagcactccctttattccccaaaaaacttgattcctagtcatcccaagtattttagtagttaaggataaaaacaaaaagtgcccctcactaatagaaaagtagtattttttttttgacatgaaaatagcaggagagactcctactgcaatatatatatatatatatatatatatatatatatatatatatattataagagagagatatttacaaaggaagggagagagggagaaaacagaaaacagaaaatttacataaagctatctatccatgattgccaaagtatagaaaagtagtattagtataaggggtatggaataaataaaacttcataatttatagaccgatggtaggtaagctaggggctataaatcaagtactttacccgcaaaaacaaaagaaaccaagtctttttttgaataaattttaaatgctagaaatcaagtctttctgggtggagaaaatcacataaactagagggacttacatgggtataggtagatcctgcctttggctcgatacatgcaagatgatgtagatggaaccttgtttgtaacccacaaattttcatgtttctagttcctactatagttgaactattacatgtgatattcctgtaaaattcctgcgtccccgacctaatcttcaccctcatgttataaaaaaaacatcacttgaattagtaaattaatattagagactaattattggttgcaaaaaaaaacttttgagttgaaaaactcataaggagaagataaaattaccttgtcatttcgatatatggcatgtatcaactttgcccatagataattataacactggtatcaaccacgaacagtatactcatcaataacgaaagagatccacgggtagcataaaaggctaaatatacacgaagaggaagagatgattgaggcctagtagcccttagagggtaagtataacaactgagcgctaggagatcaaggctagagaagctgctcaatccatcggtgctcctagtgcacattgtgggtcgacttttatagtgctttctatgctttgggacttcatctttctggagggttcggtttggcacgatatgccaattgtcatgtgctccgcccgttttgttttcaaagcatattgtatttcaatcattttgcgaatataagtatgcacataaatttactgtttttcctattttcccacaataaatcagatagcaattctcttctataatttaatgaggaacatcttcctcaccgatcacccatccataggttttactaagtttttttgaggtagtgaagtgtgcatgcacgatcattttatcacctatatattttttttactcatatataatcctctcaatacttgtgtggttgctaacgatggaaatgtctccatttggggcagggccctacaaagaccagggacatctagccctatatatctaattagatggttagccgaaatcatataggccatggatgagtccatgtacttttgatcggcgaggtcttggaagtataaaatgcatggaacaaagtggcataatagaccaaatagagatataaagatacaagtatagtcctaacctatgtggctcgtttagttgatattagtcccatatgatgtttacatggcactacaaggaaaaagtaaacgacaaaaaatcaatagcaccctgcatgtcaattggtgttagttaaaaaaatagtaaaaatgtttgtgaggcccacatgtttgttttagggcctgttcactttgatgccaaaaaaaaccttaccaatttttggcattgccaaaattttggcatagttgccgaaattttggcaacttgccaaaaattttggcaggatttcttatatagttaccaaaatttggcagtaaactaaatgcagccattttttttcgattttgctatatctcactcgaaagatttttttcttatctctcactcgattttctcactcaaatttacagtgcattttcttgtaagttacagtgtaatttatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcggattttaatccaaagattaaaaatctgtgtgatacgatcataaaaatctttcgaaagatgtataggtactcccttttttttgacaactttaccaaaacttggtaaggttgaaaatggcattaaagtgaacaggcccttaatgacacaataaacagtgcatgggctaactcggtgacctacgatgaaaattaaggcccaatatcatccaaaagtgcaatgccgccggctggcatagagataaattagcattttgattaatacatttgttgtgtgtgtctatatatatatatatatatccgtgtattaatacccttcagtcttatcaaattttcttccgtgtatatatatctgtgggcgatcgctactagtactacctagtagtaatagattagtattgtgatttatacatttgttgtattaatgaccttatggtcacaagacccatggctacctacctagccaggggcgggcccactagtgattcaagggtattcagatgtatacccaagatttttggacaaaaataagtatacgtgctctttacttcgtatatgtattcaaaaaattaaaaaagaacgcttaaattagtcatcttgagccctgtttcatcatttatactctattgggccgaaatttcccactcccctccactttcttcttagcctgcactcagtttagaccgcaactagtccatttcccctccccgcctaggcacagcaaacaaaatccttaattcccaaatcgggcaaaccctaaccgagtgaggagaggacgtgcggcgcggcgacggctcgggcgtgcggcggcgactacattgactgcggtgtgcacggccacgtcggcccgccaatccgccatggcgctagcgccactgcccactgagctgaaccgagcgctgaggagcaggcgagcagcctgcagccaagcccctcctgggctcctaacctccttcaccggtagtccggttcgtcctccttctcctgttccccagcttcctattgattgttgtttggtgaaagtgttgtttggtgaaatggattgggaactacattcagtgatttagtatacttgcttgcttgcttagtttgtagaattgtagttgcatagttgagtatttgagtaattgagtagtggtctagtggacactgggcagtagttcatagttcttac

SEQ ID NO: 63146 - DNA, 7360 bp, Oryza sativa
tctatattaatagatgatggtccatctatgcaagcggtccttctaccgccagtggttgcttaagtgggccgccagaaaaaataattgcattttccctaccggtctgtataacacaaccgctagcaaaaattatccatcttcgctggcggcacacataagtgaccgctagcgaaaatagacatatcttcactggcagctggtacaacgcgaccgccagcgaagatccattttcgctggcggtcggtgccccttaccccctcgttacaattttgctggcggttttggcatttctccgccagcgaaaatcatataccaatgccatgaaaaatcgtttttctagtagtgtaactttgttgttacttttaaccctacaaaatcgaatttggtagaattagatgtgtgtcgacggactatacccgcagacgatatttgtagagtatgatgatcgttggaaccagggtatacatgagattgaggcatatgagacgaaagacagagatttttatacagggtcagaccccttaactggcaggtaatagactaacagccatactcctattggttgaaaccggtgttgcttttatatatcagtatcatacaagttcaatatttgggatgacctaatctaatctagtcattgtcggcttggaggcatggagctctcacatgtagtcgatagctagtataggtttcttccttgaatatgaactcggtgaaattggagatagctctagatctctcatgtcgacctctgaaactcctacattgggtttgtctatttctgtattggcttgtattccgttgaattgtcctctcttctcctaggggttcttgtatttatagcgaagatcattttcctctctaagttgaacttgaagaaatataacaggatatagactaaggagaccttatcttccccaactaggattctaacaccttttatttcaggaagataatttccttctttatccgccgtattttcttaatcaaagtatatcttctcatatactattagatatatagtatttttgtatatcacgaacccatgtataagaggtatgccttatccttgacactagccatgtgttcttaaagtcttatcaaagtttttaaagtttttaagagtgaacttttgaaatttgataaaatatcaatattaagaatgtgtttattttgttgccctaccaaatttgaaagtgaagttggtaacaaagtgaacaacctgcaaaggattaagcaattcttagttaaaaaaccagttaaattagtggttatgaagcctaagataattgataagagtgcttaaagtgtacaaccgaataaggccttagaaattaaacaactcctatttttttttattttaatatataccctcacattatattggctttgttcggatgatatagttgcagtagcgttgcggctgtgctgtagccagctagccagcagttacatgagttgcttccatccagtattgagcagttgcttcttgcagctgtgtgtctgtgtagctgaatggctagaatgtataacataggctagaacgctgcaacaatggtctaccgaacaagcctattatgtttaaagatttctagctccatttttgttttttttaaatcactcttacaattttcagaataggttttttttcatggctatcttaaaaaaattaaggctcacgacaatgatataaacatgtgaaagatttcatttttttttataagaaacaaatcactacctcatgatgtaattctttggcaacgtgtaagaatgaagccggcaagaagcgaagctcgatggtcagcaacgacaggacacggctgctattccgcttctttccgctcggaccagcccactaccggcccactactgaagtgaaaccaccctccgccgccgccgccgctcgccgtagtcacctccgccgccaccctctcttcccagtgctacctccccgccccgccgctttgccgcctccggctgaggcgaatttccagtatccaagccagtcggacataagtaagggcggggaggaagccgtgcctgcgagtttcgaccatggaaggaggcggcgagcgcgcggcggaggcggaggagtaccactgccacgacttcgagtgggaggacctccgggcggaggtggaagccaaccctgccttctcctaccacctctccccatttcccacgaccgtcggcaccccggagacgccgccgccgccgccgccctcggaggcctggacgagcttccaccgtcgccacacatgcggcaagtttttcaaggtttcaatctccgctctcctccctgttaccctgcgcagatctgtcgtctactttttttttccggactgcgcaaatcgttaggaattaggatttctattgtgcgagatagatgttcttcgtcgtggagacctccagtcctccacacttgttgaagctgcgttgttgttgttgtgatgtgagctaggtaggcaggagatcgagggaatgacagtgccaccgtgttccactgtttctcgaggcatgaaattagaacggaactccccatggtaatgcaatcccttgcatagatcgacacgatggcctgtaataaattccatacatttgttaccagatcgtccaatcggagatgatggtttggaataatatgctgctctgtttattctcccatgttattcatggcttgaggggcatatatcatgatggatattacgggccttgtggacctcttcgcagcgcagcatcttgttcgtatgagttttgactctttgagtcctacactagtaactcataccacagggttgctatttacatcaatcgtgtttcctttgtgttaggtgatctagtgtttttctccacattttccacagtttgctgctattgtgcttgggtacaatgatatcaagaaaatgtgacctagactttttctgtgaataggtaaggataatatgaattgatgtagtaagacactataactaaattttaaggaaacaaataagtacttttaaggaaacaagtaactaacctgatcatctcattttgttaggaaagaaggtatttgctaaaggaatttccagaacttcttaacagcaaggatagtgcaaaggttttagaggtgggttgtgggaatggaagcactgttgttcccattttacggtaatgtcctccaaagcattgttgtatttagtaaaaaaatatctatttgtagttgcaaatgcaaatcgttcaatgcttattttttttgttatagagtaattaaacattgatgtaggattatagccgcaaatatatttggtactttggttatcaaagtaaataatctagacaaaataaaaagagaaaaaaaacaacatgcactttttaacacgcacactggtgattaaacagctaatggtcactagtttgctagtcaaattgccagtatgctggtcagacacatattctcgtgacatttcttacctgccaacgtgctgcataaaagaattgtacccaatacaaacaaaagtgatttcttgctttttgcttagacttcttggaattccatttccatgttaggcatgtgcatatttctcacttaagaaatcatccaatccagcacaaagtccatgaagtatacttcaatctccaccgatccagcataatatcaaagcaaatcaagcgatctccatgagatgcttttaatcgctcgttgccattggcatgcagctgatgtagtctggttctgaattttttccttgtttaactgccagttctgtactgtttaactattatgctttctagctcagagttggtttggaactttggatttgtcaagttcatgcatctttgaggataaagaatacttttgcctatgggcatttgaaaactgttgacacccagcatcaacaaatacttctcctttcaatttcttctgcttctgaagttatacataatcctggaatgtaaaattttctgtctttcttttctttctttgtttgtaacatctgatgatttcagtttactatatcatactttttgttaactagaaaacttgttaaatttcattcttttttatttttcccctgaaaagactatttttggtttgccacttttccaacattctgttctgtgcatggtgctttaatcagtactagtgatgtatttattaaggaattttatcgcaaactggatagctcaataatgctatgaacaatcattgtaatatcttcattgaagtgatgcatattggatcaactttcaattagcgatgaatatgcaactcaagcactttatggattaacacttatggcatgatactctaattatgtatttataattgggcgagagcaaaaagaatagaattaccgctatatacaaccttttaggagcatacatatatgggatggaagttgcagataaacttcagagttgaacgtgcttgccataacttgaagtttatgtagttcatggtttaagtgattgcctcgtcataactactaatgatgacatcgttgctatctactctttctacagctctagtccaagcacaactgtatatgcttgtgattgtagcaaagaaactctggagaaggcaaatgagattgtttgcagcacaaaaggagttgaagtcaaggataggttccatccttttttactggatgcttcgaaggaaacttttccagattggttgttctgcaaatcctgtcgaagtccatgtgcgaaggatgttgaccttttactagtttaattaattgttttgaaattttcttttacccgaattatctactccaataatgtttgattcgatggtaccttttcctttcaggctcaagtaattgtaatatgatagaagaataccctgcctttctcagagacaatccatgttgtgttgatggtgtggattttatcactatggttggtagcactatctttaccctattttttgtcaaagcacttccattagcattataatgttgccatgctgtgagttctgaatgtatattgtaaaagtcaaacctccactatttatgctcttgtttacatcaagtttgtatgtacgcttttcagatattcacattatcagccataccttttgacaatatgctagctacactagagcgttgtgtatctgttctaaaaccaggtggccttgttttgtttagggactacggtaatgccctggccatactattgtattatatatcattgatcaataatcttgctgacatctctttattgtattaggactctatgacatgacaatgcttcggtttttacctcaccaaagagtgggattccgggaatacatgcgctcagatggcaccctttcatacttcttcacattagatacagtgagagaactctttcatgcctctggactactagaggtaactcggattgttttgacatgttctcagttttctagttactttccacctttctttgcccctgcatgtgcccctcatggtagcattcaatattttatgaattaaagatgtatgccttagtcgattgtttcgttccttgttagaacttctgtgcagatcataataaatgcatcagaattgctcttatcactattaaaattactttgtaccaaaccaatgtatcataatttctgtttcgctccaaaataatccagctatatatgattaaaatcatgagatatatttcaggcttctgtatatttgagtcatctgaaatttttacatttttgtccttttcgaaaacttattttataaatggacccctggaaaaacttattccgggagtggtcctttttggtgcaccagagtggctggcgccgtactccaacatagcggcgctagccaccctggcaccgtgaccgtgccaccttggcacaagggcaagcgttgaaggggtgacgtggcaaatgggggcgccagccactttggcgccgcccctcataccatggcgccagtcaccctggcgcacccctcctagggggccaagctctaaccttctgacttaggcgggaggctggcgccacacaccccaagcacagcgccaggttggctggcgccggccccccacccacccccgaggacttctgcctcggccgaattgctggcgctgcccctcgaagcatggcaccagcgtgcttggcgctgctcccccaacccgtagatcttctgccttgggcgggtggatggcgctgccccctatagcacgacacaagggtgactagcgccgcccaccaccccccgaggccttctgcctcgaacgattagctggcgccgccccctaacacggcgccagggtggctggcgcccgacctcttcctccctgccaacttcaaatttcatttggacagtttgcaaacaatgcaaatatcgacaccaaatcacagtaaacatacatatcacaaaacaggttacacagcaaatattgacaccaaatcacatatcacatagtccacaagataactagattgacgaaaaagtccacaagtccacaactccatcacatattccacacatcaaacaatactacaaatccatcacgtacttcatacaaccaacaagtccaaaagtccgtgaaacaagttaacatatgacacatagatcaacttcatagaaatcactttttccgttggcgccgaatagcttgtgagcccggagtgtatctacatttgaaaaaccaatgtttaaaacatttaaaaaacaaagtgagggaaatcaaataacacttgagaatggtaagctcattttacctctttttcgctggccgagtggatcacaagttgtattgggtgggctgtgatgcatgaggtgcatcggagactgcgacatgcctatctcctcggcgtctggtgcgatgtagccctcatcctcctcctcctcctcctcctcgtcgtcgccgctaggtggagcctgtgccttcccctttccccttccctgtggaatgcgtgacgacgacgaaccaccaacttgttcacgctcttctatcctgatggagtgtcgagcagtacttggacacacggattgaggtagtggtggtggtactctccgcggttggtacacgtcgtccaatccaaccgacctgtaacctaatcttgcagcaagtttgcggcacctttggcgaactttttgaattaaaaaaatagaagtttgttaggcataagtcaagtaatgcaaagtgttaaatcatttttacctctaagacattgcgaagtgtgttctccgtatcttcaccaccccttggagatcagagggcatgtcccatttaattcatactcctaaggagctctctggactaaaagcatgagaagatgtatattagggtttagggtgcaaatggaaatcattttgacaaatgcaagaaacttacgactctgtctctaagtggggcgtgctccatttgatat

SEQ ID NO: 63147 - DNA, 60745 bp, Oryza sativa
tttgaagataatttcgtaacacttggggctagaaagtctggttagtacgaaggattttttttttttgttatgttcttgatttgtcctgttacattgctgacatatgtgttgttcaaacttgaaatttggaaataaaattaagatattaccagtaaacataaatgctaaaagcctaaaactaagaatggtttcctgtacttgtggttgtgtattcatctagttgcatgggtctcttcaatagctggagggtgaatactctttggaactgtatcttccataggtcatttcattaatggaatactggacttgtgtcagggaagctgaaaactaacaagaatctcaaactaaccacggtagttggttctttatattatacatatgaaataaggaggccgctagtaatatttcttaatgttaatggatgtttcttcttaatattctctgttaatggatgtttctcagttttgacaaagagatataacatacttaggttctcttaatgtttttggtcggagattgataactcaatatcactatttgtgaactgatgccaattttgattaaggttcctaatgcaataccagaaaacctatagtagaaagcataaatccacactgcactatgccactatgtactggttatcttctttgcttgaagctcaatggtctggtctgcagttggctatccatttctttcatgtgaagacagagcaccagatttttatatgaccttgaactaaccaaaatgcttctgtgttcttctatattttgagcttacttcatgtttgtttaggtgtgctagatactgcctatttattagaactgatcttggagtgattctgtccttccaagtatccaattgagaagtattcgcgggtgatgtgtttctgttttgtcctgaaattacagcttgatgatagaataggatggtcctggccttccagagcctggagacgattgcaggagaggtagtgccacactgtctgcttgggtggtgtgtgttctggtgttggagatgggagtgtgtgtgattgtgattgaattgatttgcaggtgtcgatagcgcccattccaggtaaaagggttgagcaccaaggtgtcaagattgagcttctgggtcagataggtatgatatgcgcccttgatctggtagattctgaatatgagtgccctaatgcctatggtgactgcatcaaattggtggtgtattataagacatgttagttcaggttgctgaaaatgtgatttgtttgtagacaaacaaatgtgaacggacaggttctttgttccgctgaaaattcattagagtatttacccagccaatgttgtttcaaattctcataaccatgataaagtataggatttaattgcttgagaaactggaaaaagtactcacatgagcacttcttttcttctaccattatcagcagcattgatcttcaatagttcaggtacttccaagttctaacattattattacctgtgatcttttatattgcagagctgtaccatgagagaggccacttctatgacttcacttcgttaggtagctctctcaagtgattttgaagagtcaaggaaaaagagctctctattaaggtagtcttgatctttttgcatctcttcttgtatgtcattgttcccttcaggttctttgcactcttcatatcttgataaattttgatgctttacattgttgattgaccccaagagcactatcttgcaagtttagcaggaaaattgaaccctctgaaaactttcctatctacaaataatggaatatgacttagagcttgctgttcagttgtaagccagtaaagctgttcagtatcttaagtatttttctccttttttttgtctgtgtagtgcgagaattagatgtcgctggtgaaatctatgaaaggaagacttatccatttgagttctctactgttgagatgccttatgattcgtataacggaacaaatgtcagattgaggtaagaaggccaagatgcttccgttatgcattgcacaggtcataacaagaacagcttgcatgacttgtagcatcgacgactttaataacactatcttaaagatcagccccccttggattttaggttcttaactaccgagcgaagaaaaggctggatcaagaaaagggggtactacgagccctctgccccacgcatctaaccagctcgcgtggttcaccggttccaccgacgtcacccttagatagagttattttgtcgatacagagatgcgcttgaaaagatcaaactgattattgatcaaaatttagggtttgaaacttaggtaattaacttcttctgcgtaacccaagaagaaattggatcgatttttgagaaatcgaattcagttaagacaagggaaattaagatagcaatttctgagccgtatgaggtaggaaactctcaagtacggttctaggggaaggaactacctattccaaaaagtcgtgtgtaatgcttgcaggtacatcctaaaagttaggattggcagaccatatgctactattgttgtggaatatcgagatttctgtgtaagtctgtaactcctacaatttcatttggcggaccatatgctacttctaaaagtcatgcttcatttcgctacctttatatatgttgataatctgtaactccagaaatttttgccattctagttggtcttggtaaaattagatgtatgttggcagtctcatatgcatccattgttctattttatcctttcttgttattaataggtttgaatggaattcgtttcagatttcatcattgaaaacatacaagggttaattagtttatgtttcttttttttttcaggtaagtaattacactcctcttccttcaattaatactccaatagcatcaagctgagtgctagtaattggatggctgtgttagatgtcagtttcggttatatttctttatttgtaaaggggttttctgcatatttgtatgcacctgtacatgtatgcacatatttgggcctttgccctgggatgaatacaagtgctattcacagcatggtatcaagagccaaactagggttagactcctcttgccttagatgatccaattttttcggcacttccgtgcatcgatttttctatcgagtacctgggttactgttgctgcctcattgtcggcgttgctcgtcacagccgccgtccgtggctagctctgctgctaccgtcgctcgtcgtcgccggccgcccgtcgccagccgttgctggccgtcggggcctcgtgggggcgggggctcgtcgccggctgtcgctggtcgttgcccgtcgccgagggccgctggccgtcgcccgtcgtcggcagccactcgccaccggctgcgcaagttcgcggctgctcgccttcgtgcgcggcttcgatctgtacggcttcgagccttcgacgtttcgttttcattttttttcttcttttgaccgatctggataagatccttaaaaaaaataaaagccacgcctctccggaaaggctaagggcgggcggcgggcgatcgcttcctggcctggcgcggtccccgcaccctccacctggttttttttttccaccgtattacttttctattttctattttagtgaaatgcacctaaagttctaaaagttctattttagagactaaaaatttataagtcaaaagtttatatatctgattcaaatttaattttgaattcaaatatttttatatatagtatttctatacatctaaagtttatacacctaaaatttatatacctaaagtttataagtcaaaagtttatatacccgtttcaaatttgaatttgaattatatctgattcaaatttgaatttgaattcaaatattttttatatatatagtatttctatgcatctaaagtttataacctaaagtctaaagtttatagacccaaagtttataagtgaaaagtttacataaccgattcaaatttgaatttgaattcaaatattagtttatagatctaaagtttataagtcaaaagtttacatacccgtttcaaatttaaatttaaattctaatattagtttatagacccaaagtttataagtcaaaagtttacatacccgtttcaaatttgaatttgaattcaaatattttttatagtatttctatacataaattttttctaactttatttttttctttttattttttgtggtgtactgtataggaagagaaggaggggaggaggaaggggagaaagcgcataggggggaggggaatgagggcgcgcattagcaacacccacgcctctcctagtcttttctgtgaccgaggcttaaaaaaacaaaacagaaaaaacatagccgcctctcctgatcttttctgtgaccgaggctataaaaaaagaaaagaaaaggaaaaagaaagaaaagaaagaatttcccgcttctctgcttgctaccgccgctttacttttgcgctctcgtcgtcagccattgctctttgatgatgtcatctttgtcggacatagtttcagtttcttgttgcccggttatttttgatggtgtcaactataatcattggactcagcatatgcgtcttcacatgcgtggtcagcgtctttgggatgttatttctggtgagctactttttctggcttgccccgaggttccttctgcctgttctttcgggttagcctactgatgaggacagagcaaaggtgcgaaagacttatgctgatgttatggagacttatcagagtcaatatgctatgtacaaggcttggttagatgaggatgctcgtgcttctgctattcttgtggctagtatggaggttcatcttactggcgatgtggtcatccttgcttctgctcatcttgtgtggacacaccttcgtgatcgttatgtgtctatcggtgatgctctttatcttgctatggtgcgtcaagagcagtctttacagcagagggatgctttagtggatgagttctatacacagactacacagctatcctctatttggtgccagcttgattctttggtccctgatgtttgtcgtacctgtaagtgttgtcagcgtcagcgttctcacatggatcttcgtcgcatctatgactttctcactcgtcttcgctccgagtatgaatcgactcgtgcacagttgcttgctcgacaccctcgtgttactttgatggaagctcttccggagattcgtcttcgtgaagcgggtgctctagtgcttccttctggctgttcgtactacagcttcggtaccttcatcaccgacagccgcttcctttactttgccatcacgtacttcttcaccagttgtgctatctaccagtagtcatctttattacacttattatgataaggatggacatgtggaatcgttttgcttttggaagaaggatttgcgacgtggtcgttcttcacaggttaccagaggttcttctccgaagagtactccgaagagtactggtagttcttcttagaggagtgtactggaagctcagatacataggagaaccttacgttgctacgtcgcctcactgcctctgcttcgactggttcagttggttcagttgctttgccttctacacactcgggctctgttgtttctggttctcaccgttccactgagggatcaccatctgcttcattgttgcccttttcgcctggttcattggcgcgttcctgttgaacttgatatggtctccaagtcttagagatgtgctgctggctgcatgttgatttttcacccaaaatatccagcatggcttggtccaataaacactgtaaggatgtcgactctggctgtgttcagtggtgggtgttgggaatctatcacccacgcatggaaaacggagcagtccattagcgcgtgattaattaagtattagctaatttttttaaaaaaatgcatcaatatgatttttaagcaactttcgtatataattttttttttgcaaaaaacacaccgtttagtagtttgaaaaacgtgcacgtggaaaacgagaagagagagttgggaactcgtgataccgaacacagcctgaatgtttgcatgtgtatggtgagctatactgtgtttaagtcaatctgaggaacagcagcatagctgctttgggttaatcattcttcagaagagtccaaccatgacgagcacatgtttgaatcagtttgaactgaatatgtggatgtgtgattgaacaggtgttttgttggaatcagtacaaccatgatgagcgcagtattgttgactaaaattagatttgtgtttgtataatcaaaccctgttgcaattaattaagtcaagttagtgagaattgggcgtacggctatatataacggttctgtttcgtagcgtatcgattagagaaatggatcatgcgcacctcataaaaaaaaggggaaaaacgggatcctgctgccatgatgaacctcgtccccccgcacgtcttctcataaaaaagtctacctgttgctgtatacttggaaagtatttcaatatcagaaatgtataaagaagagtattctaaataaagtataaagcttacaaaagagaagagaagagctactagagccatacccaagctcttctgaagtcttctggactttgatttctactctattcctattccattagcttaagaacactaaactaaactttagagaatatgaaagagttttgcttgaggtgtgtgaagagagctcttctgaagtcttctggactttgatttctactctattcctattccattagcttaagaacactaaactaaactttagagaatatgaaagagctttgcttgaggtgtgtgaagagagtgaggaggtaaagtccttttatagctgctaatgacggttgtggcagttggaaatgtcctaattgccctgcaaccgttcatggggatgaatcctggacgtccacacaaaaccccaagatggacggcactaatgggggttcggccgaaccaccaggggctaggccaaaccagcccatccttggctggcgacctcctccactgcttctctccgtagacttgtgaatttttggcccaattggtcgtatcatttctgagttcttggcacattcatacataagtctggttttcgacatcgttcaattgatttattgtctgattcgatgtcaattctccttcactttatggttattctctgcaaaaaggttagtaaacataatactaatggaatattattattctaaattgaatatgcattgcaagaataactagttctcctctattttggtaatattgacggtcgaaactgatcgctaacgaccatcaacagtgggtcagctcccgccttgcccaccccttgacgaaggggacgtggggtggcttcgtgattgagcggtggagttgggcttgcctcaacggggattaggaaagcggcgagtttccgaacctcggtgaaaaatctcttgtctccttgtctcatttatttatcgcatttatatttgtgcaatttacattgatagagacatacttgagatcatatcaccctaggattgctaaactgaacttaggagtgtaatttactttcctagagatataattgagccactatcaccctaggtttgtaaaacataacttagttgcttagttagacttgaccctcaccgagcctagtaacttaggttagttttgattaggtgtcatttagttttaaatcgcctatgcaccccctctagtcgaaatctcgatcctacaccctaaaccgaaatactaatataaagcatccctgattttgcaaaactaggtcaagttaggtcccaaggaaacattgctcctcggttttggtgacgtggacgattgagtcagcgtgggccaatatgggccccacatgttagccgataatcttcttccacctatctcctgtctcttcccatctcaacccaaaactccagggcagccggcaacatgtgaggagaaaagtggtggctaacggccgcgtcatgcacatgcgcgtgcaaagagcggccgagctcggtgaagagtgcggagaagcgaagtaggaagggctcccggcacgtcgtcccctcagggcacaccgccacgccgttgtgcggcagctcgcgcgcatctgcgtcttggtcacgtgtcagccacaccatcgggattggtgagaggatctcctaagagacgggagatggagtacattgagatgcctgagcacggtcacgagcaccaccggctccatgagtgtccgtgcgtgcacatgaagaggacgtcgaatgttgaatcaagggagagctactcggtggccggcggcggtaggtagaagctcgacagcgacgaccaacgatgggcggggagaaggctggcagctgtcgagaagcttgatagtggcgggcgacagggagaagggcgtaggcatcgaggatgatgtaaccacatcgtggtgtaaatggagttgatctcgaagatgatgcggcggagccgcgcgtgctcctccgcggaggagaggcagagctcggggacacctgaacacatcgacttttgagtagctcagcagggatggccctgagctcgagggataggagcttggccagcgtgacgaggcggaagccctagccctcgcgcacataggtgaagacgacgttgctgttgtagttgggacctgcccgtaccacgcgtgcacaagtccatgacgcgagcgctccaggccgttgggagcttttccccaccggctaacaccattctccccaccgattcacggctgccctagaggtttgggttgagatgggaagaaaggggagtgaggtggaagaaaattgccggctgacatgtggtgtccacgtgggtaccatactgactcagccgtcacgttaacaaaaccggagagcataccttgagatcaaatgtgacccgttttacaatattagggatacattacatctggtcttccggttagggacagttttaaaactcgacgacaagataagggaccttaggtgaacttcttccgagatgaaaaatttccagcctcatgggcctgtgcatatgatatgacccataggcaagcgggcactgcggcagcagagcgctgcacaatcgacctccgcctccccaatccatcccgtctcgtcgcccgccgccgtcgacgactcccgtctcctccgcctgccgccggcgccgatctccatcctgctagcagaggtggcgccggcgttctcctgctcccgccgcatcatcgctcaccggtgagcatcctaatccatcccgtccggcctcgaatttcggtctcctcgcccgccgcttgtgccgaaccaccccaatccggcgagcagaggtcggcgcccgtggtcctcctgcagtcctgcttccgccgcatcgtcgctcgcctgtgagcatccttcataaggtattttgtgtttttctcgagacatcgaaccagcctcgtcgtcgccggcgaccgccgccgaggatgccggtgagggtggtagacaccgcaaccccttcctcccagccctcatcaggttcgtccacctcccctaccttctctatgctaatgcacccaacccctaatttgctgtgtaatccaagtttttttggatctgatatagcctaatcaggtatcttctagggtttgatttagtgcgattttaaggtctattggtaatctagattggtctgagttgtactggggtatatgtgttttgatccttttggaatactcaattgttataattttggccactgacgcaatgcattatttggggagagctcggatggttttgtagctaagttgccaactgcttgtaatgtattgtatgtttttaaggcgttgcaatgcttgtggttttgtgtcaagtgttttctgtttcaggaggccttctaaataaataaaccaattgttgttttagttcacctgcaattgaaattcattagttattttgtatgaatttctggcaatagatagcccaccatgccaatgtgccatactgattaaaatgttgcaggtcaagatgcaaatgctgggcatccgtctcctcctagctgttccctcttaagtgctggaagagtaagtctttttgtgttgttatttggaacttgaccaaggatcaaatcttcttatcggtgtggtttatggaactgaccatatgcttgtaccatctttcagtgttatgctggaacccagaatgtctctaatatacaaaaagaagaagcttggaaagttaatgtgcggatccatggctgtgatcttgaacagggttatttatgtggaacaatggaagcacttaatgttcccttagctgatacccctgtgagcaacctacttcattttccactttgactctgatctttatgttccaaaattgttcaactttgttttccactttgactctgatctttatgttccaaaattgttcattaagaatacatttgtatactaattcagtaggcaaacagtttgtccgataaaattttaaaatatgctatgctttacttcttgttcccattatctgatttgcatagcaatttgcaaataatttccataggtggtaacgttctgggagggggagatagtggatgctaaaaattatacatttttcactggcaagtgggaagcatcgtgagtatttaactatttacgttttatccttgatactatcatctacttgttttattaatagatgcccaagtgtatggtaacagtccaaacttactcatgaaacattactcctgcttctgcttttgcagcccagaggatgatattagacactggtccaagttcccatcatttacgcctcttctggtattctgttgcctatcttcgtgttgttagttgccacgatttttttggatacatttctcacttatgtttttccacagagtcagattgagacagatggtggcaagtccgtggacctcagcaactatgcttacatattcatggtactgcaccatctgacctttcatgtatgtgcaccatttattgaattacaaagccataacaacttagcattattctgatgctacatgtagagatggaaagagcagtactttgtcaatgttggagtggactgtgggttgaccatagctggtttctactatgtctgcttttcatgtagcgacggttccattagcgggtattattatgatccaaacagcaggtaatgtatattttgctggcactttttattgcgatgttacaactaaattctatcgaggaattgaagtgatataaatatttcctgctctctcaatttacagtccgtttcagaagcttgaactgaagtgtaccaatgagaaagattctggatttaccttttcgtcctacgagctgcagtgagagactgacaggcctgctgtcattatagtatgtgcggatgttaatatacacaatgtatgtactgaactcataattctgaatggtgtcccattaaaagggctgagatggcatgtttgtaacagtgatttggagcaagatgtattttattttctttgtaatatgaatataagctggtaaactttctagtttgaactacttgtgtgttctttttgtgctaatcatggcatggttatgtccaaaataaataagacaagaatgtgagggctagttgctcgttcaaagaaatatatacttctttccagagtaattgtagttctgcagttggaggattttcgttttgtttcaatatttctgttctgcctacattgtggaatttgtggtcactgattgtgaatctaatctctggtactgagctttatctgaagagacacttaagattgcaatcttgtacattagtttctggtacacagccacataaacctccttttggtttcacatgcagcctgccattgtaaggtatgatgtaattctatgaacaaagtatacttggggcaaacactctgtcttcgcctccggtcttcggacattgtaaggtaaacatctctctctacttatgttgtttcatagagtcttgatctcgtgcttcaagccgtagtcaattctctaatgagaattcttctgcatcttcattgcacaggcttcaagttattgctaaaccctataataatattctgcagataggactacccttgcatacttggtgaaacttaccttcataaacacaaggatgggtggacagtgcaacaggatggaggtaactcttctctcctttctggcagaaaccaagaaaacacttctttgccctctgtaccaaaggcctctcaacattcacacaccaggcataaaacatatcgagggcagcctcagtaatgacttttgagagtactttatcaccttctccaggtgccagcttcagcatcaggtatctattgaacgatatgatcttctctaacatttgccttctgccaatattatatgataacattgcgtcttggattatagagaccatcctgaggactgcctcatagactatagcatatgcatgactgaatatctcggttgctgtttcccacagttcttttctgtgccaatcattttttacagtttctgccccctgttctaagattggcgcaaatgttacagtcttcggtttggttgtgttgacacgcagctgcttcgattccctcagcatggcttccttcatttctgacttaaacctgctgctgatcttgaagtattgttgttcattgtgtgcagttgggctcgggagtggtgaattttgccttggtgatgcttccatgtatacctcaggtgcacatgctgattcacacgctacaattcacatggaaaacacatgtattactcttcatcataacaaaattatactggaattgatatcttgactgaatttaactggagaagaggtggtgctcttcttttttttttttcatttcaattaacagattgtccaatgtatgcaatattgtgaagtctggcagacatacaggaatggggatggatgtcgagctgtgcttggggatccgtagtctgcattgttgtgctcattgctgctgctgccgtctgcactgggtcctgcatgtcctcttgcggcttcttcttgtgatgcagtaggtgcatccatttcttagccttgctcttcaccttgccgagaaccggcttcttctggctcccatttggggtccgcggtgatcccatcggactctccggctgctgttgatttggatgacgtggatgaaccacagtacaggaaattgagttagtggggatcacttgtaaagtattataggataaaaaaagaaatagcagtcaaaactttcagtcttttttatgggccttctggctttagatcggcctgaacaagggccatgaaagtccccgaggactggcctagtaatcaacattcttgaagacccatatggcaagtatcagcccaacagggcgactggacatgaagctttttacattgaaaaaagttcacttttacggcgagtttgaatcgcgtttctcaaccataaaaccaaggtataactcatctcttatctcctaaaatcaatgaaaatgaggtcctaaggcggtactgaggtaggttttactgacatggtgcctgggtgacagtttgacttggcacttatcccatgtaacattgatgtgatagtggaaacaaaattatttgtttcaaaaaaaaatatgtggggcctatatatcaatcaaacaaaaagattataacccacatgccattgacatccacttcttcctattctacccctaccatcttttctctccaccagcgagcagaacgagtcgatgacgacggtaggctgggaaacgtgctcatcactgatgctggtgacaaggacggtggaagcttccacgcagtacaacatggtaattatatatagcctagagatccctcctccctctccccttttctctccctttatcccattatcccagtgaagagagagagagaaagagaggcagacgacggcaaggaggaatggagatttggggtgggggtgcattgttgatgtgacacaactcttctcgggccgatgttcctgttgagatcccacacggttggtgccctcatggaacaaggataggaggtggtgggatcacactgtggtcgatgggcccaaatccatgccgtgagcccatgacccacaagcctagtggacacaggatggtggcgctagcgttcggagaaggtggaggaagctcgtcggcctccccgctagtccctcagcagcgcttcctttatatgctggcctctcgtcagtgtcgtccttcatcgttgccaactccagcttgtttagcgcaccgaggtggatgccaccaccaagctcctccttctcgccccacctcatgccttcctcccgcagtggcaaggcttggggttctaggacaatggagtcctgtcgcgcgcccgatctaaggcctgctgccctccaccaccacgggcagtgctggggaacgagcttcacgcaacatagtctgccacttgccttgaacgtcgacgagagggggtctgataggctggcacctgcacctccaccatagggaagccatgagttgtgttgtcattgttgacatcaacgccaatgagcgccccatcaaacatgggcgaaatgtgtccaggcaatggtggtgatcctcctccaacgcaactcatgaggaggctgatgtatcgccggtgttggcgtcgacgccgacgagcacctctcgttgagctcaccaccttgaatacaacatgtgtaagaagagagggagaagtagatgaaggatatctcggtgacatgtaggtcccgaattagggattttatttttattttcgcatgtaatgccttgtaggataaagactaagtcaacaaaccatatagatgtcacgtgagttgaaactgaccttaataccgtttggaatctcgtttgcattgatttcgagagagaaaggatattaagggacacgattcaaactaaacacttagacaaagaacttaaaagtgaacttttccttttacgttaaccgggatcttatctgctgatcacacagaatacgtaagcacttacaacttgcaagttggaactctcacatctcacaatgtgacaccgaataaacattgcatgtctctctcaatctcaaaaaaggaaaaaaaacagcactgaatattaatataagtgcaaagaaaacgaagtgcatatttgcaagcaacttttttcttttgcttctcctttttttgcaagaagtgtgtatcttcttgttatcctagtgaagttaacagcacgatcccgcgcatgtacgtacgtactgcatctagtgataatccactcgccaaaggatctgcagcgtcccaagccaaatccaacatcacgcaagcaacttacctgctgcttttttttggccatggcataattttctaagataataaaaaatattaaaccccatcaattatataagatgatataatatcgtactaagaatactactagcctctctgtaactaagatgcacgcataaccaaactacttccttcgtacttgtaaaggaaattgtttagaaccatgtttaagtcaaaccttaggaatataaatcatgaataactcttaagttgttaagtttgaaaatgtaaaaattatatgaatagatttgtcttgatggaatgcgcaaatttaattccaacaacctagaacaatgtataaaacacaaaaatcccaacttgcacaaatcctttccatacttttcgaaaaactgtcgcattaatcctttccatagagcgtgacacttggggtgcgggcgtgtggctagcactgatgagacatgaccaagctatgcaaaaatggagtacacacttggaacattctgtcaaaggattaaaactcgttcccctattgtgaccacgcattgggagctggccatccgcagcatgcgagtaccctccatctcctagttgcagccataacagcgaatcattagctaatttggtctcgttgttttctgattaagatacatgttttctgattaagatacatatttgattcttgttagcacgttcttcaaactaaactgtatgtttcatattaaaactttttatataggttgctttaaaataccatataaatccaattctcaagcttaaaaatattaaaacttaattaatcatacgctaatggttttcttatgttacgtatatcggtatatgtatttaatttttatccattatccattgcaggtttgagccgggcgcaagtcgaagaaaagatcataaaacgatggatcgatcgacatcaatcttggggaggaggagaggagattggatcagtaggagtggagatgccaccgcaaatcaaaatatcaaatcgggaaaaaagatgatcgatcgatgagctatacaaagatagatagatagatagatagatagatactaggctgagagatgcacataatggcctccaaaagtgcaggcctaacggtgtacacggccccggtcgaaacggcgccatcgctgcacatacccccggatggattaattgttggattgtcaccaactcgatcgacggcgcaatcatgtcggggggtccaaagcaagccccggaacagtgcccggatcagcttgggcacaaaacctttttaagcgccaattagaaactggcctaaaagaataggaaatggagaaaagggcacacaagttaaagtttggttgctactttatactgttcatttttgggtacagatttgcatcggtaaagagtggactaggtttttttatggggttatgtagatactttcttcatgctaaaataaaataatctaggatgtcactctcattttattattgtaaatctggacagatagaatatgtataatctcatcttcttttgccatattctgtttagattcgtaataataagacgagtctattttttttttttggattttgttatattttgggacgaaggtattatatagtttgatccaaattttaatgtatgcaacaaactgaaactgttcaattgttgtcaggccaggacaactggaaagattgtaagcggcatatttaaaatttgtcaaatgcagtaaaacagccctccgaattaattcaaaaggcgacgcactgaagcagccattttttttaatttgaagaggaatcaaaccatccttttacacctcacatttctctaattttcttggttcctgattatttgaattttctaaacacaacattaatgcatacactcgtctctacaagcattatcaagattaaatcaacatatgttaagattaataaattcatcacatccattttgttatcgacgagtacatcactatcaatagatggaaaaataattagctataaatacaaacaggcatataaaaaattgaatacaatgaatatgttctacccccaaagaatctaacatgccgagctaactcagttcgtggaatttttattttcttggttctgaaatccacggtggccacatggatgctgttccaaatccaattgtatatctagctaataaagtgtgtgtgaatataattagctcggcgtgggagcacaaagataaaaagcacataaaaataaaacaaaaggcaaatgggcgcggtcgcatcagttaatccgacaatcactcttcacccattatgctaaaaacgagctttcgccactaatcaagcccaaaattagtgggaggcacaaaagaacataggctttaattaaaggaagagcagctcgttgttaaagtgtttaaaaattggccaaattgattgaaaacaacaagaaaaatgtttgaaatagacacatgcacaatcgccataattaaaagatcaggccaaagtaggcaactgagtgcaaaccttgccccgtagtatatatagtagcaaccattaattatttacactaattggcaccattatatatatagctagctaggagaaatgtagacaaaaataaaatttttaaaaaccaacaatgcatgcatgccaaacgaagaacacaacatccacaagggcacacacaaaagcttaagaaattcaaatctaataaaaactcgaaactttagatcaaaaaagttggcatcatcactgttcattcctctaaacaatatttacacttggcataaacatctctgatgatctatgaacaaccaaagaaccaacacattctttcttcttctaaaaaaacaaaaaaaaggcgagcagctcagtcgatctcacgaggtctcgatcgccgccgccggccggagcaggtcgtacttggcccagacggcgtcgagcgggcacggcttgccggcgtcgagcctgtcccatggcttccccttgccgctccagtgcaggaggctgacggcgccggcgtgcaggccgcggcagagcccccggtagttgtcgccgccgaggccgtgctggttccagcggtggtcgacggcggcgatgcggccggcgaacacgaggaggaacggcggcagcgagcccagctcgtagatgcgcacccgtctctgcagctccatccactcctcgatctgcgccgtgtaccccgcgcgccgccaccggggcaggtcgagcaccatcacccccgtgttgaagtagcacgcgcgccgccccgcgaacgccgcctccgacagcgcccgcgacgcccagaaccccggcgtgaagtaggccgtgaagttggcgccgcagtactcgggcgccgccacggccgcctcccccgggagcggcgtcgcggcgagcgccgcgatgtcgtcggtgaccacgacgtcggagtcgaggtagacgacgcggcggacgcaggcgggagcgtggtggcgaggtaggagcgggcgtagttgagcgggcggtcgagcgcgccgcggatggaggtggagatgagccccgcgacgcggactcgtcgaacgggtacacccggaacgccagcgacgggaacgacgcccgcacggtgtccctcagctcccgcaccgccgccgccgcctccggcgacgaggaggaggaggcgaggaagtggaagtggacggactccgggcaggaggcgtggcggaggacggagagcaccgcggccatggtgcccctcaggtacggcgcgtccagcgtcatggccacgtgcaccgccgcgtgcggcgagcacgccgcgtccgcgtccgtcgccggcagcggcggcgggcaccgcgccgccgccgagttggtgaagtgcggcgcctccctgtactccggcacggccaccgccgcgccgacccccagcatcagcagcaggacgagcagaggagcgcgcggcatctgagctagcttggccatgtcgtccatgtcctcgcgtgttcgcgtttgcgtgtgagagactgagaggagagcgcgcgcgcgcgcgttttatatacggcgcggcgcggcgtggcgtggcgtggcgtggcgtggcgtggcgtggcgcggcgcgtggagaggcgcgtcaaactggggggtcaaactgtcaaaggctttttgggaggggggaaagcgtgttcagacttcagacacgtgacgcgtacaggagtggtactaaacgggtttgagagaggacgcgtgattaatggaagggggttaaatgcttaacttcgcgtgaggatgggattaccggcacgtttggcgtttttactacaagtagcgcatagtatgctattttagggtaaaaaagaaagatttgcaagtggtgatgctattggaagggagtgtaattaatcatgcctaggatggttctcttctttttttaagtatagcttttacatgtttacctcatgttggtttgtttaattgggattgagaccatctgataaggagtggcacttgggttaactgtgagtaactcaacagaaattatgttagttccaaggttgtcaggatcgggatactaagtagtactccctccatctacttttgatagtcatatttcatcttgatacacagaccaatgataagtaattctacttatcattcatttaagcatgctactagtcattcctcgtaaacaagcgattcattaatatttacatttctcaaagcccatatagccaatcatgtgtggaagaatggagagtcacgcattaaattcgagaaaatcattaagatgataggttgttggattgaaatatgcctatcaaaaataaaattttcagatttggaaatatgactatcaaaaatagatggtgggagtatcattttgctcaaagtaatatcgaatcgtaggatcgtatcgtagtatcgggatactatgagattttttttaattttaattaatatttatattaattatatatagccattctatataaaaaatatagtaatgatatatgtcatgcaaataaagacatttatcaagagaaaccacgttggttttgatatattgaactgattttcatataaatttgagtatatttagttacattattttttaaaccatgttattttaaataatattgtagtattgtagggatcgtagaatcgggataccatataagattttgtaggatcgtgtagtaatgaatagtaggatcgcgatattataaaaattaggatactaggtgggatcggtatcgtttcgtctcggtaggatcataatatcgtaagatactagatacgaatcgggataatgacaaccttggttagttctaaaaaacagaaattatgttctgtttaaatttcgcatgaagttttgtcactaataaaaaaagacgtgaatattagggcatgacctaatattaaataattagaagaggtgagacatcgaactcaggttgtctagccaaccaccttgcgaagctagtcggaaaacccctaaatgtttctcgagttttgttcctagtaaatggtttaattttttcacatgactattttgttcttcgttgccctcaattataaggaacaacatcacacattttgccatcggttctcttcctgcgcttctagggcttctttaccacagttgcaacatagaacatacctgttctcatgttttttttactttgaatcaggtaaacttgcaatccctttgtctctagttaggctacatttgtcctttttgtcatcactatttcaagccaaccaacgaccaccattgcaagctacctgccacaaccttaggccttgtttagtttatgaaatttttttgggtttggttatcatatcggatatacaaacacacatttaaagtattaaacgtagcctaataacaaaacaaattacagatttcaccagaaaaccgcgagacggatttgttaagcctaattaatccgtcattagtaaatgtttaccgtagcactatattgtcaaatcatggcgcaattaagcttaaaagatttgtctcgtaatttacacacaaactgtgtaattggttttttttttctaaatttaatactctatgcatgtgtccaaacattcgatgtgatggttgaaaagtttttgtttttttttcctccaaatcaggcagaaccctatatttgaggacgatctcactgccatgctcttccaaacttccacaagcttgggcgcaatgccgcgaccttagtgataattccttcaaatcaggttgaaccccaagctctttctctccttcacatggttgcccctaatccgcatctttagcgctagccatggtggccgataagctcgatctctacttccacgagggccacttataaagaaatagaagctggtataatgtgcaatttattctttggaaagataggaatagaaaaggaacaatattgaaatatatgtgctcgcagatcccaaaggaatctaaaaacatagatgcaatccaaatgaattcggctatccttaatgctatcttccaaacaacctggataattagaaaaaaagaaaaaaagtacaaattacgtcccgaactatgacgacaatatgaattacccctgaaccacaaaatcagacattttatatcctgaaatatctatactggacgaataacccccctcgacccaatccaaatcggtattgtcctacataacgttcacgtggtaatctagtcatcatttttttaaaatgctggggcccacctgtcatactctcccacctctctcttcccctcttcctctcaatctctctctatctctgtctcagatatcgttgggagcgacaagttggtggccggcgatgggcgtgccaggggcgcggcaggcggtgggcgtggctgagcccgtgtccccctgctgccgcgccgccttgctgcccccctgtcgcgatggagggcggcgaagtggcgagggtggaggcggaggtcgtctccgcccttctgctccgagcccccggcgaccgccgccatcaccaccaccccgtctgagttcgtcatcatcatcttcaacctggggtcatcggtctctctctctctctctcacccctctctcgggccgtcgggtggtcagcgtgcacagcagcgggtcgacatggccgtgtctctcttcatcctcggcttctccctccgcgtgtggtgggcggcagcgacgggtcgacatggcctcatctctctttgtcctcagcttctccctccgcgtgtcgtcacctggctccgagtggtgggcggcgtcgaccagcgtggcggcagctgtcgacgtttgatgtcacgattccggtatttgcatagtatggggatcattgataccaggatatatgcgagattgaggtaaaagagacggagacgaggatttttatacaggttcgggccccctgaattgtcaggtaataacccttcatcctattggccgaagccggtattgctcttattcaccataatcacactcgtacaatatttggggtagcctatctaagtgttgtcgacatggcggtctgaatgtctgactcgtagtcgacaacagggtagccttcctcctcgaatccgcatccggcgagatcagagacaacgctatatctctcctgacggtatccgtaggcaccgtaggggactagtcatgcctatctctgaagtcgatatctagtgtcttgtcttggcgtatgttggcttgtatgttgtggcttctgttgttccgtgttcactctcctcctagggggctttgtatttatacccataggtgtcctcttgtccaagtagaactagggaaaccaatatggatacaatccgagtagtccttgtcattttcatgtagaactctagttatccttccttatgcggaactcctcctatattcgaatattgtttccgtataagacatggtatgtggtgggtcctgccgagatttagtcaactactattaagtatgtggtatccataaccctgacagcagcggcggcgacgttcttgatagggtttgggtcgtccagtgcaggtcgagcacacggcgttgcgcgcgggcgggggtgggggggggtgggcggagggagggtgcgggacgcggaccgcgggctacgggcgtcggcgaggagggcgctagaggcgatggggctatagtgttgcggactcacggagagggcgcgagaggcggcgggttgcggcgaggagggcgctccctcgctggtgcatcctccaacctcatctgcccctctccccacgacgatgacaacgaagcccgcctcctccaacgccctcctcaccgcttgccgcccgcgtgccattctcgcgctttgtcgccaccccccgcatgccaaccgcccgttcgcgcgccgccgccgccgcccatagcccgtccacgcacgcccgagggagtgaggggggaggggaagagaggtaatgataggtgggccctatattttcttttatttctttttgctgattggatttccacgtcgacgtcatgtgtatgccacgtaggagaaaaacagctcaggattgagtcggaggggggaggggggcgggggagttcatccggtatcaatagtttaaggtgtaatatgtctggttttgtggtttatgtggtaattcgtactgtcgcaatagttaggggggaggggggtaattcgtacattttttttcttagagaaacaaacatctaaggatttgaattctttgaaactcctgtgaaaaccttcaaatcgaaaggtacattcaggaggccattattcatgtgccaaaaaaaggcgaccattattcgtttcatttcgtagcattcgtcggtgaggaattgggatcaggtgcagtgaggggaggcatactgcacagcagctgtaggtgggaccctgtaagaacgtgccacgtggtcatctgatacatccatatgaagtctacagtcagatgccttgacttcagctgcatagaaagtcgttttgaacagcgatgcgatctctaaaacataattttaattttttgtttctataaaaatatttattgaaaagtggcatatatatttttatgaaagctaaatctattcatatagtttttatattttcagactcaataatttaaaaactattcatgatttatatttttaagattttacttaaatattatcttaaacgacttcctttaatagtacgagaggagtatgtatactagtaccagtacccctgtacagtagtagtaatgaaattcttaaaaaaaaagaaagaattgatcgagaagcaatcatgagccaagatcaacgttggatcgtgagggacgacaacgtggcgttttcagatgccaaagcactgtcccaattcttcgtgtgcattgcaagcaaaatggcctgtcggtgtgcacatgtcaaaagacttccttttttttgaaagtctcgtcgtctgattattgtcttacaaatcacaccaatttcaaatttagaacctacatttttttttaaaaaaaacttataaatttgttctcttcatttttctacggcttattagtcgttgctcgtaatttaacacataacttgatcagagctggaataatccatatatttgctgaaacttctctggccctgtcaaacatgtttttttaaaaaagaagaagaacttgaaaattttatgataatctaaatgctgtcattaactcctcgtgacatggccgcgtagttcaacaggtaatgtgaaatcttcaatgccacaccgtttataccagtatggctctccatgccctgcaaaaacatctatccattcacatcagccttcattatgtgccggctctagttaatgcctcctccctacttaatctcaaattcacacaggcaaattaatcggtgaaatgagattaattaacctaaatgcatggttaaaaaaagaaaaccatactggctgctgcaccgacacaagcgtagctacaaggagacgagatgacgaacacatcacacaactatacacaaagcatcttcattatgaggtgacagtgagaggaagctgctgctcccttggaaagctctacagatctgaatgatctcgtgaaaaactgaaaatgatgtggagattttaaaaaaaaaagaaagcaaaggcaaaagtaataagatcgaatcagaggtggagaggtgctaaacagagtaaaaaatggtggctttttcacatggaagatcagcaagttcaggaaggaatggtaaatatatcgttttcaggtggatcaagtcgatctctcgatgatatctccgtcgatgctcaactaaattaagcaagaaagcaaagtcaagatctctcctcactcttcatcctcggtaaaaaaataaaaataaattacaggaagtcaaagacatctaaaaccgtgtaaaacatgaaacaagtaattaaaaagaatgaattacaggaagtcaaagatctctcgaaaggtgtaaaacacaaagcaagtaaattaatcatccccaccgtcaattgtcataaaaactactccctccgtctcagaatatagcaacctagaatcggatggaacgtattctaaatcggatgaaatatgaatacgttccatccgattctaggttgctatattttgggagggagggagtaattgattataaaaactgaacggtatcagtatcagtagagataacggtaaaacactggtaggaatgttcatgagctaataactcatccctgttcgcattcaaaaaataaaactcaaccgtgttaatgtgtactatgtacaaccgggttcaaatattaggtctgtgcgaattgtgcatgactcaactggttatgttttctttaatcaacccacatgtatttaagttttagacttgatacggatgctcttatttacggttaattatttttttcagtggtaagtaacgtacccatcaatagcgaaatgttcatgatgactaggtcaattttaagatataacgacccatcattttgaaggcgctcataggggtaaggtgcggggatgtgcgtttataggggtgatcatgcccgtgttataagcgactacgcttgtactgtgttactgaaaaaatattgggtctatggtcatatggataatgcagaggtcaaatatacttttatatatacggtattgctagatttcaaaatttcagtaaaaaaaaattacacatccataagccgaaattacattggtatgtaatatacaattttacttaattttgtggttacatatatggttttactttattttatctgagtttgaatacttgtttacatctagtaatattgtaaatctgtataaattgtaagtttctttcatgtagtttggtgttttttttaaaaaactttttgtatgttagactagtttattgcttaacttgttatctaagaaagagctaggtgtgatgagaaccattagattaaataagaaaagtgactgaaatttaattcaggttgcccatctcttgaagatcaccttccttgcaaagcttctgtttaatttgccccgttcactctacaaattcagattgatttagagattgtccccttccctctacaatttcctattgaattcgagattgtctacaactgaagataatcaattatccccaaaaagttgtccaactcgttaatcacaaagacgcttaacaaactaactaactaaccagctccgtctaaaaccgatcgagtttttcatgtacagctaggtcatagcatgccaaatttctgtgcatcaccgcactaaccaaagcacacctaccaaaaccatttcctagtacacgaacgacgtcgcggtctccgcaacttgtctcccattactgtgacctgtacctgaaccagctgctgctgctgccgccgcctacaattccaaacccaattccaacacatgaatgtctcaccaagagcaagcagcaatgcaaccagggttcgcaacagggacggatctagcgtggaacggcgagggttcaaacttcgaacccttcactatcaacaccgtgaccaggagagccctctgaaattttctgtcatacgtaccttaaaagaagtgttggagttttaactaatttattcagtctctcttgctatctttctgaatccgcctctagttcacaatctcaatactagataaaaatcacttgcaagcggtatctccattaataaaccaataaagacagataaaatccagacatatcttgtcaaaagttttaaatctacttcgatttttctttaacttaataaaaaattaagccgatcccaaaaaataataatccggatttcgtggtttctagatagatcgtaaacctgaatgcaactatgcaaactaaagccaatgagtccaaagatggctttgacgggcaggtcaaacaggtaaactcgccgtcaactattaggctcggaattaggtacgtgcaccaccactgtgtgattaggatctcaggatgatctgctaaaattagtcgcccatttgtaaattcgaagtcagagttggggtcagaggctggacgatggtgcgaccacgagcctgagaaactggacagttttttttgccttttgaagcgtctaattttggagccgtcgtttgcagaaaagaaagttcacaggtaagccagctgttagaccggactagcatacatctcaccgtcaagaaagctctgttcgtcaactgatttcagttcatcaaccacgaagctgattgacccgacaagctgcagaaaaagggaccaaagcagtcgtaaaatcatgctggtaaaccaaagtaatgtagtagttatattacttacatatgcagctggattacttgctgataagttttatatacgattcaccgtgttgatctggcatcacgcacagctaggattagcggctgatcagatccttccaaactgactaggataattaaagctggtattgttgtccactaagcacacatcaacttaatctatttctatgattagtaagagttgatatcgccggactgataaggctgtgtttcggcgcattaggtttctaacatccactccctcgttgtccacacatgcttctgaaactgataagcggtgttttttttaaaaaaaaaaactatatgaaaaagttgtttttaaaaattatattattttttaattttttaactaatgtttaataattatgcgttaatggatttttcataagggaaagcggagtttccaacctcaacctctaaatgcagaattaatgcagttataggcccagtttagttccaaaatttttcttcaaacttttaactttttcatcgcatcaaaactttcctacacacacaaacatctaatttttctgttacatcgtttcaatttcaacaaaacttttaattttgacgtgaaaaacacacccatagtcttgtagtactacaaggaagcaaaacgcagacagcccagtcacgcagcatagcaaagcaaagcagaggtagtcgatgagttggtcacaaggaaggcaggcagaggcagtggcgtctccactaaacccaagcccagccaaggctatagttgcccaacccacttgcccattgcagatttgcaggtccaaaccccgtacgtacttacccgcgtccgtctcgtctcgccttccctttccaagaagcttcccgccgcgacgcgcagccgcgcccgcgccatcgttgctgccttgctggctttgctgctgcgtggacgtcgctttttccttgctcagttcagccctttcaaccgattgaccaaaaactcttcgcggtatttgtaaatttgccaccgattttttcaatattacaagtatgtcactcgaacgatagttctagtagcatttttgcaattttctagtgacagtcttgtaataacgattcaaaatagtggtaaatttgtaattgcctcaaactctttataaggggaagctatgggtgtaaagttttagcgtgtcatattaggttattatatatggtgttgtttagggtgctgggcaattatgggcctgtttagtttccaccccaaaatttttcaccccgttacatcgaacgtttgaacacctgcatgaagtaaatataggctaaaaaagtagctaattgcacatattgcaactaatttacgagacgaatttttaagcctaattgctccattatttgacaatgtggtactacagtaaatattgctaatgatggattaattaggcttaataaatttgtctcgcggtttattgacggattctgtaattagtttttttactagtgcccaaacaccccatgcgacaccctatataatatccgatgtgacacgccaaaactttacacctctggatctaaacaccctctatgacacgaaagtactactgtgttcttagcgacttaggttgcgttagtttccctaggttgggaacgctatcttctggcacagaaaacggaacggtccattaacctgtgattgattaaatatttactatttttttaaaaaaaatgtgtcaatatgattttttttaaactttcgtatataaactttttacaaaacacacaccatttagcagtttgcgtgtgtgcggaaaacaagagagaggggttgggaaccagctggatcgaacgcaaccttagaaatcaatgaaaattattatattaaaattattattaaattagctacaaaattaagttttagaatttaaattttggcttcggctgattcttaacgctcttcagcttgtattgcgatcggtggcgtggtttctgcagtggtagcagcggcagctttcctcagtagctttacggtcacaatcaagaattccagatatggcaggctgctgttccatccatcggtggtttttggggatcggccgaattttcaacgcccttcacatccaaacggatgcgcacaggaacaaacaatgctctgcttgcttttctggagggagaagaattgtctcgactgctcttcttctttgcagatttggaccattttggtgcttcaaaagtttgtggcatcgaggtcaaactggctggccctatgattgtcaaaaagtttcagaatcgtctataaataaatacgcactcagacagttccaagcctctcgttaagaaaatactagtactaatattagataatcttcttagagcaagtttaatagtatagcccactactagctccaattcatttatagccaattcatacaatagttgcttactatactattaatatatggtcctacctgtcatatatacagtgtgtcttgtagtccgtgctgcagctggctatagatctgtagcccgctgctcttctctctcatcatttatctcattaaaatatgtttatagttagctaatagtttgctattgtacctgctcttagctaagggcacaagttgtgatttgggaatgacctagatggaggcgactaacatttttggaaataggaggaactgactgatacatgatgctttggatccaatccaagcacactagcacagagcacattcatgtgctaccaacacagcgtttcttctcctctcgaacaaacaaccgtctcattcgatacgagtttaatgagcttagagattcatcattgaccctcgtcttttagcatgctaggaggccacattcgagagtgtgtgttttgtaacatgtaactgcgaaaaaaaaaagaacaatctcactcccaatcacaaaaaattgcagactgaaacggtaccagaagagttgttttgactgtttgagagagctgccgagcatgtcactgacactgttagtagtattctcttgacacatggccactccatgatggacgtcacattgtcactacctgattggtagtactcctttgccagacgtactgcgactcttcctctgtgcacattttgaggtcttaaaatatccggtatttatcttttcgtttatacttatatttattagctaaaatttaatttttaaccttaaatttgtagtcgatcttgaaattttttcatcgtaatttattttcagcctttacttctagatcattaaaaacacacatataaaagttttattcataaattattcttcgtttacggcgggggcttcaagcatgcaagcaagcaaaattggccagatcacttaggccttgtttagataaaaaaattttagcaaaaaagatcacatcaaatgtttggacacatgcataaggcattaaatgtggggaaaaaaaaccaatagcatagtttgtatgtaaattgtgaaacaaatctttttagcctaattacgccatgatttgacaatgtgatgctatagtaaatatttactaataacagataaattaggcttaataaattcgtctcgcagtttacaggtgaaatctgtaatttgttttcttattagtctacgttaatttgttttgttattagtctatgtttaatacttcaaatttccgtctgtatacttcaaaaactttaggcctgttcactttgattgaaaaaaaaaccttaccaaaatttggcattgccaaaattgctaaaattttgataagatttcttatatagttactaaaatttggcaacaaactaaatgtagccacttttttgataattttaacaaaatttggtaaggttgaaaataacatcaaagtgaacatcaaagtgaaaaataacatcaaagtgaacagaccctttacacccaaataaaactaaacacaccctcactcccgtacaagggtagtacaacccattttctgagagagccgtactacacgttacatgattgagagaggatcgaaaccgactccaaatgagtagtcgaccattcattttttttgcgaatctctcctgttgataatcttatgagagggcacaaactgcaaatgatctgtccacgtacattctggataaagaaggcgatcaacatttttttggataggcatccaagcgcagagccagtgcacatcctgcgtgacaaaatatctcatttcctgatcacagattgcgggcagaaacatcccagaatagtttgtcatttccagatcacagattgcgagcagaaacatcccagaatagtttggagaaaacagccgaggggcaacaatccaaactcaaacctgatcggccatcatattttcttaccattcttcaaatattcaactgacattggcactccctgacataatgacatatatcaaataactcttaccaagaattatattgtatcttctgttcaagactataataatatcagcacactgactgtcaagcatcaatgtatataaactggaaattggtgcaaattgcaagcaagagtttgggaagaactattcttacatgtatacaacacatggagacaacatcccaataattgtacatcatatccatcaaaacagtcaaaactaaaaaaagaaaagaaaataaaatggctcctcctaattatagtactacatatgaggctataaaaagccagatgcttatcctacatctacatgcaaatattctatgaacacttcatgtaaatacgcaaaataacttatgccacatttggcaggaagaaactgcacgcaccacaacgccacagggatatgctggcaattcttttaccatcttctatcaccaggtgaatctgttaacaatcttaaaatgcaagaaggcttgcaaccacaagaaatccaaccatgattagcagggccttcaggtagatgtctgcctgctgcggttgctccagtggtccttgtcgagggacaccgtgggcggcatgacccatatgtccgccatggaatccatgaccatggccatacccatagtgaaacccagcaggctgtgcataaggatttgcatctggaaatccatgcacttggaagctaagcatagggaataggcctccaaacgcagctgagaatgcataattcccccaccgtgcattagccaatggtactccagtgcccatgaaccatggattggcattagcattaggattggcatgggcaaaattgttgttaggatcggcctgtggagctgtggcaggcctctggccagttgggcggttaggaatgtcagcctcgggtatgttctttgaccttggatcgacgcggtccttgccacgcccataaaggggaacgagcttatcctcttcaacgacagctttgcacaccgggcactctggagagtgtgcgtggatgtgcaaccacctgtaaatacatggccagcagaagaggtggccacagagagtaactattggttcttgtggcaattcaaagcagatattgcattcaaagctccccccagctgcatcgccattggtgccgctgcttgtagattccccaacattggctgccatcttgctgtttcttcaaagtgcaagaagctgcaattgccaatgaaactacaatcaccaacaatgctagaaatagctatgcaaaactgatagaatatattaggagtactatgtaatataatggctactagcaacaattacgaagttgctccgccagctactagcatgtggtcatacataaggatccagcattaaacgataaaaatctcatgagtttgagcaaaacataaaaaaggtataagccaacaagaacacaaccaagaaagattccccaaattcgtgccggtaaagaggacagctgatgatcagaaaccctcccaacaacctcaattttgtttcacacaattatataggatcatctagaataagatgctgacgatccacaaggatggaatcaacaatctaagcataaataaacaacacaaggaaataaaacatctaggaatatctcccacgttggaggataaaatcacacgctagaagaagacgggattatccataagcccgatctatttctaccgtaatcgcagaacaattaaaaaaaatcccaattctctaggaaaaccaacccgcgtatgaacaactagcaaacaacagatcgccataaacaaacaaaccaaatctacgcctgaatcggccagtgccccctccgaatcgaccaccggccccgaacccaaatccgaatcgcacaaacccagcatacaagcacccaagcaaccgcgagacgagaggagagggtgggggcaagcgggaagcggcatcacctcctcctcctctcggcgagcgtggggatccgcgacgcggcggcggcggcggcgtggctcgatccgacggcgaggccacgcgggggaaggcgaggcgaggcgaggcgacgacgatgacctggacgcggccgcgtggggggaggacgaggagtataaagttaggggtcgcgcggggggcccacatggaagaatctagaatccggggacgctttcgcggcggttcacccccgctttaccctgcgaaattccggggcgggaggcgttttccgtgaagggaaacggaaactctcccccgctggatcgaagaaagtacagtacttgttgaaagttgaaactgccttcacactcgctcacgcaaggtatcacgctgatcgtgcttttcgaatgctggaagcgtgtgttgcaagggatatgatgctctgtcgatggtactaatattcagccccaccgtttgccttattctaagaaataaatccaaatcaatatatttgcaaacgtaaaataatttataaataaaatttttatacacatgttcttagcgatttaaaacaaagactgaaaaataaactacgatgaaaaaactctaaaattaactcccaatttaaaatgaaaactttaaattatagctgataagtataaatataagcgaaaagatgagatcgattgttacccatcaatgttattagaaaaacaaacattatatactccctttatatcttctttttaacgttatatacatttagaaattaccgtagtattttcggtactcatcggttgcctatattttttaataagtcaaaatggtttattagaaaataaaaattaatttacatgtacaatttttatatatgtgttattagtgcgacttaaaagtcaatgtagaaaataaaccacattgaaattatcttaaaattaactttaaaaattaaatttaaaaatttaaaatttgactttcactttaacttattagggcaatccatggagctctcaataattctatgaatttatccgttgtccaacttatatatatcggacacgaaaactatcgcacccctcccatcgctacgagcacgagttatattgtgaactattttattaacaaccatgttagtctcccattacttttacagcagattgttattagtatataccagttataaaagaaaagattaattgttactataccagactatttaacggcacaaactttgatataatctctaatatgtttgatatatacctatgaacattattagtttcatcgagtattttccagctagcaatagcatgccgcatcacattcttgggcagaactaggctcaatctcatcatcttgcaagcaattccaaatgcctcccgttcatatgtactatagactataattttgttgtcatttgatagatttgatatgtctatcaaatgacaacaaacaaagagcagtactgccgttaacaattcaatacttgaagaaaaataattcttcaacaaacaaagagcagggcgcgttcgttgttggctctctgtgtgatatcagtctataaatttaaccaaaagttgggcaactaccatgtacttgtcaaggaccttcgttataagttcttggcaattggtccgtgtgaccattaagtatttccttgtccaatgtcaaagactatcgctttttacctgtcttaatttcctaaaaaacattagttgattatatctcatgacccaagtacaaattccttgctgctctgtaatgctcaagagggaataaacacatgcattgctggtgaacaaaatattcagaagttaaaaaaatgatatatgcagacagatggtaataataaattaatgataattatttaattaaaatcgtatattacaatgcacgagtgatatgctaagtataatttaaaacattgtaggcttatgacaaaagcaccggtgatatctactgcaatatttcctaaatatgactagcgagatttttttttctcaacagcatcaaaacaaatatgtcccgccgttaagttttcgatcgtttcacctgtgtctagggtgataaaggacctaacaaagttagtatataaaatttaagagctaatctaaaatagaataggctgaattttaattaatttttgaccttaaaaatattcgagagcctggtacatgggtcttgacccattgccaccgctacctgtgtggctgtcatggaagcataggggcatttgattttaaggaaacttgtaaaaacaccacaaatatcaccttgagtttgttgcaaatacccctctcgtaagtcatttttgtttgagattacccccaagtgccgttactcgtccattcttggggccacaaacccacgaccgtggtggtcattgtgtctagcgtggacgatgacatgatcgtggaatccctacttatggtgtctagcatgtagttggacggtgatagtccagagtcttcgctcttaagcattgagattgctggaagatgagctattacacttgtctcatgggattcaacagtgacttgtttctttggttagattcaaaatgagaaagatgagctcagtatagcacacattattgggaaagaaaatgtatatgtccatcgaaaagtgcgctgagtcatgtaacacacatgaaaagatgcaagactgcgagatctgccttcaaccaatccatttggaaagcgtggcccccaccaaaatgcaaattcttttcctggctcgtcacccaaaatagactttggacaactgacagactcaagaaaagaggttggcaaaatcagaagatttgtccgctgtgctacataatcaatgaatcatcggtccaccttctgacacactgtagagttaccaagagggtatggatagaaatacaaaggtggaccaaactgacctccaaatgagcaaatggagtgactacgactcggtggaacaatggtggagccttgtggtagactcccttaacaattcccgcattcctttgcgaatattggtgatcttggtttcctaggaaatttggtgcaaacgaaacacaaaaatcttccaaaacaccgcctcaacgccgatttccatcatcgccaagatcaaggaggaagctcgagcttgggtcaaggctggagcctcaaagcttcaagagtttggaatttttcgcggattcttgcgggtttagctttcgaggcttgccctgtacatattactttgatctattttttctccatctctattaatatacgaggcaaagcttttgccctcctttaaaaaaaacaaagaaaagatgcaagaaaaaacacaaaaaatggtaattgcttattgggaaggaacatcaaaccaaaatagattgaaaggggctgtttgcaacaaatcgttttataataagaatctcaaactcaagctgatatttggggtgttttttttttcaaatttcccttgatttcatgccttcctcatcttaagctggcactgaaggtgtttgatgagctgcttgatgtggtcgtactggtcgctgcaaacacttcaggagttgctcttgtcgatggatccttctttccacactccacagcaagcagcgaggcgaaacgtggcacaccatcgtccttctcagagcctcccattcccgcagcttagctatcttgtggtcatcaagcacagagaacaagtttggaccaaagcaaatgcgtcaaaagtgtagttcactcaacctctctgctcaagctaatgttgagtcgtgtttctttcaaaattttgggcttgggcttacaggtttccattacttggaaccaatactcctagtgtttccttcatcttgtattggatgtatcatgtatggctgacaaaattttggggcatttataacaaagtaaatttaagtagcatgtactgtatatggactgaaagagacaattacaacgatgtacttttgtaatatataattcatttgttgtaaaacatacatgaattttgaaaaatttatgatcaaagataaaagtatatgacataggacaaaactagaatgagaagtaatgtgaaatggaaggaatatatgatacttgattttctttcaaactttgaccaataatattgatggtggcgctaatactcgcaatgcgcgcataatattagtttgagcgttgcacaacgtttccttcttctggtttttccctttttttaccacccaccttaatttcctctgtcgcgtttcttttgttttttaccaccccaccttccatgtttcttttttttttacttttccatctcatccgtgctccatcaaagggcccggtaaaatattaaccatccagatttttccctctttcattccttctttctggttcttctgttttcacgttttagtaaaatatttaccgtctattttttctttggaaattttctgttttcctagtgtctccccacgtttaaaaagtaatgaatttactttgtggagttttccatttactctcagcctcccacatctgcccattaaaaagtaacaaatttactcgcatgaatgtcccattcaaaagtaacaaatttacttgcatgaatgccccccattgtacaacaccattcctagacggcagtaaaagaattactaccagcttacaatactagtaattcttttaccagtattataaatatttagacttcgtggtctgtgagtaaaacaattaccactttcctctcgatatagcccatgatctcgtagccaccgtgtagtaatatgtttattgatgtgttcaatatatagtataagagcaaaaactgatactaagagtattgttaatctgttcacaaaatggtcgtacgaatgaaaaaaattacaggctcaattacacacgagtgataaaattactcacaggtgaatcaaactagaaaagaagaaaaatgattcagccaaaaatccatggtgaagttgggatcctggtggctttgcttgatcttgctataaggatgtaaatgctggtgtgtgtcttgtgactggtactggagattggagagggcaaccgagtggcgagcggtagtcgacgatggaatcatggaaggatgtagcggcatggtatagacatgagctcgacgttatgcagtagcagccatctatcatctagcaagcacgaaaaaaatgtaaaaacattcttgttcatgtcatacagacgacgagaaaaagaaaaatagctaacaaccttcatcacaggcagactccaccctatcctttgcaaccagccacatggagcacgatgtgcaaatgtaggacttgtgcagcccatcagttcagatcgggtaatattggagattgcacgttaatttgatttgcaaaaagaaatttgggcttcatgcgtgaaggtgaaggagagtatgcagatgcaaattggagtttcgtttccttacttgcttgttttgtcaatgtcgccgacgtggaacagccgccggttgttgctcttggcccaggtgaacacctccttgctggttaaggtgttgtccggtgttcggtagcgaggcccgaagtagcgccttcgcctcaaccgccgctggccaccgccatcaaccgccatggtgatgtcctcctcctccatggtgcgtcaccaatctgtgggttgtgatggtgggtcgattcagatccaagaaaaaggaaaaaatgaagtgggggcaagagtggttggtttgtacggaaaaaatagaatatatactggaaacagggaagttgtttttatcaaagtaaatcgtttacttcgataatggtgggagcgggatgacgggacgtggcgtaggatcggaagcatggaaattgtttttatcgtagtaaatcgtttattctgataactgtgggagcgggatgacgggacgtggggtgaggtggacctgagctgatacatgtttggcgctcggaatactgcgctcctagtagtatctctataatatttatccaattacttagttaactaaattgaaaatagtaccactagatctatcatcaaaattactttcaccatgtctagtatgttagtctatttatacaaatatttctaaaaaaggacgaatactcaaataattttaaaaagtcaatttcatgatatattaaaaaacaaagggtgtgtgggcatgttatcgttaagctatactacaacgaggttcccttacaaaaactttaccactagaaattaacatgctagttgttaagtcaaatattattatgtaaaagaaattaagttgtttagtcaaatatcggttcttcctttgaagaggcatgtacattcctccgcttttgatcagcataagcacctaacaacgagtttgaaaaccgagtaatatgcagtgagccagtgaggctacccatgcatgccggtgatactaaactcccgtgtgcctcccatttccatcagtgttctgaacatttgaaactagcaaccacatccgcatgacaaatcaaaccatggaaccttttgaggaaacggccatgagtgaagctctgaaggagaaacaaacttaagctagtacaggtgtacatcaatcgatcagtttcttcttgttcttgtataaatatattatttttgaaaccaaagctaggctaagctggtgttatattcagaagaggatcagaaagtatttaaagttcaccaaacaatgatggaaacagaaggaaggggaagaacaaaacaagaacagaaacacgctaatacagaaatttaagccgatattctcacgatggttcttttataaatatatatcatgctggctgtgtatatcgtggccaccttaattaattatttcaagtaggtggctacctttaaattaagattgtctctctgctactaggggattcacgtagtacatattggtgtatgcagctgtaaagaagagtttgtggaagatattgtggtacaacaaatgagagctgtgtgctacatcggaggaaaaagatctatcgtttgtagcgaaaacgggtaaatgtgtctctcaactgtagaggatgcctctgcttgtgctctttccctattcagatgagccttaatcttgtctcatccccgttttttctctcacatctatactttctataaagttaaagcccagtaaatctaaagctcaatatgcaaccatgccacatcatcaccaactagcaataattgcatatttaatctcatgcaagtaaacaacatcatctataatttatttaattttataaatcaaaatgcaagcatatccaatcatcaccccttatatcatttgcacagtattttaacaaatctatatatcactttttacaatatttaacatatatttatcaatatgtttcacactaaagcacaggtatcatttgactgataaaccctaatgttttattttttttctttttacacctaaattgattgtcaaaaaaaatatattaagaattgcttagtaatttctgcagcaaagcgcggggaatcacctagtattatgaattacagtggacatgcttcctaagtttatgttttttgaaaaaaaatatctatatataaattacttagagtacattttagaataacttttgagcttcataataattaattcactcaattgtaccctcaaatatttctactatcttacaagtggagtcatccttctccttccaacccctactcccaatgctcagcgtgtccatacacgaaatgtaagtaccattccttcctagttttatgggcccgacccatcaacgtacgggctccaagtctattcctaattatatggacctgatccgtgataacgcatggcataaaactagttataaaaagaaaatcaaataatcctcacccattcatccgttcagcccttctgaaccggacaacactatctgctgagttgttccactatgttgtctgttgcctattgcccactttgttgtgcgttgcccacaatagaaggagcactgccaatggaaggaacatatgtcttcttcgcaggtggtgctaggtaacttgctcggccttctcgccagcgatcgttgcctcgcaccatggaagttcacagcagctgtcgtcggcacaatcggcacgaagaattcctgtatgcctcccatttccaatggtgccctcaacacaacagatcaattaatgttatttatggattcctttgaagaaatgggagggactgtaaaacaagcttatacaaggaaccgactgctgattgctcgctgcattttttttattgcacttccattgcattgtttgatcttcttttcttgttttcacttccacatgtgtgtaggaagagttctgttagacagtgccaccggcatatggcaatggtgtaaattgtgccatacgggctagtaattgtaagtggtagttgtggtgataaatgatggctaactcaacatgaacagataactgatctgtcatattttggtcatccatacaaatctatttattttgtgccaaaatataacaatttaggtatgaattagactctttcttgtactacgaatctgggcaggaggtctatccacattcgttgtagtaggatgtatctaatttatgcctaaattgttatattttagaacaaagggaataacaaattgtagcatcttataattacaatgtttcatttgttttgtgtatcaaatggtggatgtctcaaatgtttttgctgaacatgccacttatacaacaattggaaagctgaccgtgttctctctttctctttttttttttcactgtatctcctcgtattgtcttgtataaggattttccatgcgtgttcatctattctaccgtgcaaatacaaacagcatgaaagcaaaaaaattgctactcctatgtcccatctggggtttcattgtgtgtgtgtgtaatacaccagaggaagcttaggttaggtttgtagtgactgtcccatttccccatttgggaattgatcaccacctacacctatcttgtggctccaaacacggaaaacgaattgaagcaacagatcatatagttgatttttccagtacaagtgcgtcaaaagtatagagtttcattgtgcgtctcttgcacttatgcaaatgttgtgctggtttgtcagcctttgtcttactacatccgtttcatattataagactttctagccgtaacaaaaaaaattctgacaaatttttgcctttaaaactgtcatatttttttacttttttttgctacggctaaaatgtaatgaatttaaatatgagactttgtcgatatgtgtagtactattaagagcaaatgtccaaccttttgtggaatttttcgtgatatttgctagttggtgtgtatggagtgtgcacgagaagtttgtgtgtataggatatgttcccttttaaaagagtatagaaagtgacaaacttaggtatacttggcatttgccataattaagtgccaggccataggtaaagaaatattgaagtaactgcctagtactccacatgtctttttcttaggtcaaagtctctaaattgtactacttcaacaataatttatactacaatatatttacagcatccaacaagtttgtaatatatggtgaatgtatgtttagggatgaatctcgtaacatgactttcatgtgtgcaatcaaataatttagaaatatatttaatctcaatcttttacagatatgttcgaaggtatgtctaaaagatatttaatctcaatgttttttttggtttacaaaacataactttctgctgaacctagagcttcccatcagtaatatggaaaatcacaactgtacatagaacacaaccaagcaaaaactaatagtggtctttcttttgttttccccaataaaaaggagatctggaaactgaagttatcgtcaaccacgtaggtaaagtcagcacttaaattggtgcgagtgcagtacatgagtgtttcttgcaaattttaccaccgagaaaaagctacacccaacgtcccaaccttagagaagtttgttaagtcaaagatggagtatcgagaacagcacctagctcacctagcatgctggcctaagttcgacttcgtttgaaagcaagttttctcaccattttcttctctatcaataccggatgctaggttcctcctttgtattccaaacattttttttcttttttttttaaaaaagatggagtatcaaacttgcgatataacgcatacatcttcttggcttaaagcctaccgttccagctattaccagatggaacctcagaatccggagtagtgatgaattaatgtgcacatcgataccatgaactcccaatttacctcctatttccataagtgttttcaagtcgacaccgaacattgcaaccataaccacatgagaaatcaacaacggatccaagttctcttagaagaatggggctattgaagttaatgtcatgaaggagaaatgagcttaagctagtaaaagaaacctcctcctttcctagacccttctgggtgcatatatatcttggccaccttctgtgccattgggccaaatctttggagtaataagaagattcattattatgagctataagaaagagttggcgagaaatatgtttagagtatggacatgtgggcaatagctcgatctttgattgcatttatttttctagagaaaaatggttgatcacaattaataagtgataagcaggtgcaattatagatggccaaatgggttgcttggcccgggcacaaccgggctcgggcctgagatcagtcgggccagcacggctccacctacacgctgggggtgggccaggcctacccacctgcagcaccaacggcctagacatggccctataaggcttgggccatgtcgggccagcctgaaggcacgcatgtgtactgtgctcctcattgaaaaaagtctgttttgcctcccttatttctttgggccctctaatatgcctaataagtctattttgcttccgtcaactatttgcctccttggtctttggaccgtgccgttccaggcaacccaccgtgccgaggcagaggccctggcacgggcttgacaccagtcaggcggtgccatgcctgggtcgggccaaaaccttatgccatgggctaggccatcgggcctcacgccttttggccaactatgggtgcaaaatggtagatgacagacaactcaaaattacaacttagcatgtagctgtccagtgtctgttgtacttgcctcttgcacgtagtagaattaatttttatggtactaggccatccaaactgaaataaaagaataaaatcacagagtgcatgagtaaccattacatctccctgaggaagagatcgagatcagagtactgataacttaatttttgcatgttgtctaatccaaatatttcactcataatctcatccaaaaggggacagagatagaatgagccaagtcaaaaacttataatcttttcctaatctttcctatggaatgagcatggcggccactacggttctccctgtttctttctaattcatctttcatttttcttcggaatttccgctttagatgattttctgtccttcggtgttagcatttcgtgttgtccttcttcgaaattattattgattttctatttcttaggtaactgtacatacttttttctggaattacttttgttggtttctaccttctagttagcacggtgatacatggccgtggcccgcgggtacggggtacgatagtcgacggaagagcccacagatatccaatcacctgctgtcgcactcgaacggctgtcaatttcttgtgggattgtagaatggaccttttgagcagcctatggggaattttttacatgacggattcccatatgcctcctatttccattgctgctctcactcaacatgctatggggattaaccacacagaagatcagcaatggatccaattgctctttcaagaaacaggagtgaatgtaaatcgaggtaacacaagaatccttgcagagtcgctcgctgtattatgtctccactgccaggagactagaagcttaggtttgcaagtatatataagaggagttggtcagacattgccagtgtcaatagcacaatcatgcatcttatacttctcccgtacacaaatacaacaaattaaacgaagggtttaaattttttccataattaccaggaatcccatggagtactacttccacccaactattcctcatttaggtgttgtttgaatcttctgaagatgaagatgaagattaactgtttcacgcaaaacgaggtggtaatagcgtgtgctcaattgagttttaattattataaacttgaaaaacggattaatctgatattttagaacaatttttatatagaaaattttcgcacgacgaaacgcacagtttaacagtttgaaaagtgtgccatgaaaatccaaaacttcatccagtgtttgcagtggaaacaaacggggccttaattgttcatctatttttatccctaaacaccctttcgctccccatcatgggttctgtcaaggggatttcgcgagatggccgagcaatgatgtgatttgcccgcaacacttccgtaatcatgattatggagtaatacacatgataaatgatgaaactatccttgataaatgacgtttagtccattaagtagcttctaaatggggtctcccatattctttaaagtccgtgtagaaatttttgaagagtatagagcacacatcatataaacttgtactgctggtaaactccatcataaaacttgtcccatattaaacattagaaactgaatttgtcttgattgaacgttaacagagacggaggaccccatacgacagggtgggccagctggccagctagccaccagcccaaatccccaccccccaaatgtgtgtactccctcccataaaaaaatacgaatcctacaagcccgaggtaaatttagaacagatagcgaaaaattaaaatgtcctcaccaaagtacaaagtatacccattaattaacactaaaaaagacaacaaggaaattcaaagtggctctgcttccatcgccgaccctctccctccgccgcagctgcattgcatctgagcaagttctatccatccgcgcatacaaggctgcttcagttgcatacaacagcatgcatgcaaggccgcttcccacagcaatgaagccgcacaggcacactgtctcgtgcatcacatcctcccctgctatgtcgtgtgccagtagaaactccgatggctccgctgcatccggctgcatccgggccgtctccatctgtcgccgtcgctggaagcggatcaaccgtcccaaaacactgccaccgcggcaccgccacggccacatccgagcttatggctgtgtttagattggtccaaagtttaaaatttggttaaaattgaagacgatgtgaccgaaaagttgtgtatgtatgaaaggtttgatgtgatggaaagttggaagtttggaaaaaaattttggctgtgtttagttcaatccaaagtttggattttggttaaaattggagatgatgtgactgaaaagttgtgtgtgtatgacaggttgatgtgatgaaaaagtactgaagtttggatctaaattttgaatctaaacacagcctttacaactaaacacaccctatgcatccaggtcgtcgtgcaaggtcgtgaggagggtgggagggactctggctgggaacttaaccacatagcaaacaaccagctctagatttctcccattgtatctttcacggtgaacacaaaccgaggcttttcgaaacagatggtacgaatagcaaagaaataacacatggaacaaaaaattaagttaatcaaccaaaaaatttagttcccacaatatactctccatgcagccacatttgaatgagctaataggggcaaattatcgcgattactatttgtgcaacgaagatttcttttaaaaacacattattcatcactatttcctagataactgttttccaaactatctgttaactttataatatattagtttgtccctataaacaattaactatccctgacaagctgcattgtctaacaagaacaggtcccctattcagccaacgatttgatcagaaccatcgagtcatagctagtaatattttttgatcaaaagctcaatgcttgcacaagcacaagtggcactgtacgcacggtgcccatctagagacagtgtgactggatcttccaaaggggcacccactcgtgtgggagaccaattgagatcccctactgtagacgacctacatccgtgggagaccgctcggcgtggcagaggtaattcacgagagagtccgtccgcaacaatgagccttttctccttggccagcaggcacagatgtgacttgtgagccaccggaatcgtttccagagcctcccgttccgatgtactttttctgtcctaaaaaaataaaatatattagacgtaacacattctagtaatacgaatctcattctataatagattttgttttttctttgtgagatgcaagtctatcccataaaaaaatctaacttatggtaacgcagattgcgagcagagagcaccggctgccacgatactggtctatatgatctttttgtgggcagcaaactgaagcgttggacagtgttgatttgattattgtgctgaaggctaacaatgtgtttggtttttaagcgcccaccttctaggtttgcgctccctagagccaaaacatacagccttttcccttcattttatagtgaaggatgcgcttatatgcttttgcaatgaaaaaactgcatggatattaaacctcatgagtggcccatattaaaagttacgttttatacttataagttatttttgactttttcttaagtctagcttaaaagtacttcctccgtcccaaaaaaaaagacaaaccctggtttccgtgcccaacgtttgaccgtccgtcttatttgaaaaaaatatgaaaaaaattaaaaagacaagtcacgcacaaagtattaatcatgttttatcatctaacaataataaaaatatgaattataaaaaaatttcatataagacggacaatcaaagttggacacggaaatccaaggtttgtcttttttttgggacggagggagtaagtttataaaaaaacatagaaacatttttatacaaaataaacataatattaaaatatattcaacattatatttaatgaaattaatttgatgctataactattgctacattttttttatatactttatcaaatttagagaagtttgatttataaaataatcaaatcgactgaaatggagataatccttagcaaattaattatcgttaggaaggggcaattttgtccttaagaaagttatccagttactccgtctctcgatggaagcttatcccttcgccggctcggtgcaccaaatcgcgatagcagcgtcatcggcttcctccgccgcgccaaggatgtgaagcaatgatggcattctcagccttggcccttggggaaacaattggcttcaagaaggtgtgtttttacgttaaaattgaaagtttggttgaaattgaaatgatgtgacagaaaattggaagtttatgtgtgtagaaaagttttgacgtgataaaaaagttgaaagtttgaaaaaatgtttggaactaaactcggcctcaattaatgtctgctttctacaaaaggattaaattcggcccagcgttcggcagttggagccgcgcgtgggcgcggggctggcggcgctgcctcgcgtcgcgacctcaacctcccacattgatcaatcgcggccccatcttttccggaataaaacaaaccggcatattcataaataaaaaataatttgtgaaatttttttatatacgtaccaaaagtaaatgctgaaaaataaacaacgatgaagaaaatcctaaaatttaagattgaaaatttgagttttgacagataagtataaacataaagcggaaatatgtctccaaaagaacaacattgagttactatcggccaaattaacttttacttcagaccactcgtgagctttaatatccgtgcattttttttctctaagaagtatagaagcataacttttaaacaatatcataaaaaaatcaaatataaaaatattttacactaatcgtattgattagaaactcggtaaacgtgtgcatttattcattcatcaaccttcagcaatcatttcaccaaataatcttttcagttgtcactcatttagactttaatttatgaaagtattttgaacccactatcatattacaaacaaggttttaattgttatatattattatgtctcgttttcttttctcttccgattgtctcatttaaagtaatccaaatgttatattatatttttttctccaatccatttgttttcctattctccaaatcctgcattaccttggctatctgttttggcattaggaaagcacgagggaccacctggggacgtggtgcaacaggttggtcattagagaagcctaagaaggagcctcttattttggaggacgagacttctctgatcgtaaaataagaagtacatgaccattggcgtgtgagcctatgaatgtgggccccacctatcagggacccatgttcctttaactttacgtcagatgagctcggtccctcttataaaggttgcacaaaacaagttccagactcctcctgttcccatattcacacacctgttcgtcaggggttaactcttaactgaaggcagcatggcagaccagaagctggactcacatctcacaatgtgaatggagaacactattcttctcaaagtcatagggccaccatattgcgctcaatctcacgatattttgtttctaggagtagctagcacgggaaccaccattgcccggttgctcgctccatatgatattttaattttttggatgagagctcactccatatgtttgcaaggccaacctttatttatggcagtcaagtagtttgtttgttgttttcttgagagctcggtcatagtagtttgatgtactcaatgactatagatgaagaggaaatgtctggtgctctattttacagtgataatatttaaagttgtattagaataaatgtcgaatatattagccctaatagatccattacaattggacttagagttataatagatggtaggcttaacaatagaagactttttctgtccttttcccaatgttatgcttagcagtcacagatctctgctagtaacctaaacccacactagcgccacagagcaatcacgcatatgacggtgctaattaattcgttaaattcatcgcgatatttttatctgctgcagttgtgctgtgagtttgatcaaccatcattgctgggactcgtcgtaccagctctccaccatccggtgacccctgcctggctgctgctcgtcggcgccgatcctcagatgatcgccgcagccattttacgacgcatgtatcgctgctcgacgggattcgccgttcctcctcgagcagcaggcgtccaggagagcgacacgacggtatcggatgatttccaaaggcagcgtcccattcccatcgatctgaggcacgagcatcagttgccggccgtgctacctagctaagtagtcggtcgatcggacagtgtgtgttgaggcgatcgatggctagctagctccagaatgaatgcatgcgtcagatgaggagcaaacgatcgagtgtgtgtttcttctgccgttttgttctaaccttccaggcctgcactgcctgtacagtactcctggaaacaacacacagctagctagcttgtgtgttacattcattttatagtgaaggagttatatcatcttgaaacagagtaatgcgtgaaactgctcctacatctgagtacatggggccttgggctcttgcacccaatatatgattgattatatataggccacgtttggtataattctggatcccagatttcttagagctgatcagtattcccagttttataaatctatatatttgaatatacgactaagttgataacatttagatgattcattttgtttttaatttaaatgaaatataaaattttaaaccactgtagtttgcgtacaaacttcaaatcctacgtggatttaggatctggagctatgccataatctgggctttcactgatggagaagtggtttttactcccagttcgtaatcccctatagtcctggttttccaaccgggactaaatatcgctatctttagtcccgggtgaaataactgggagtaaaaatacatttttagtcccgaaagataaagccaggctagatccggttgctcatttattttttttcttcattgtttttaatatattaatttcactccatccccgtccccaaaatcacaaatcaattatccccgaatcgtaaaatctcaaatcgattagggatcgattatcacctccaaattctcaaatcgatcatctccaaatacatcacaaaatctttaaaaaattacatcacaacttctaaaaaattcatcataaatacatcacacacaaatcaaatacatcttagatccgaatcacaaattctcaaaaaaaaagaaaataacctaaatacggtgcctacgccctctgccgcgtcggccgccccctcgccggctgctagcgcgccgcccgccgccacgccgccgcctgcagatcagaagtggggaggagggggagggagaggagaaggagagaaagagatagggtgtgaggagaggagatagaaccgggaagaaggaggagatatgtacctcgatccgatccgcgcgcacgcctctccgcgtatgtcgatcttttttcggtaacaccaatcagaactacaaataaatctttagtcatggttggtaacaccaacaaggagtaaagaaaatatagggggtctgacaccgcctgtcctcttttgaactgggactaaaaatgatcttgactaaagatcaaaaagtacccctgaacttataagccgggactaaaggtgctttttagtcccggtttttaatacaaccaggactattgtgaaatctggtcgaccgaccaaagatggtctactcagcaattttctttctccttttttttttgttgcataatacaaccgtttacctactgatttgttttttaataatgaaagtgtgttgcatccctggcttatatgtcatagggcacctaaccacctagcgactgaacaatgaaaaaggtatattctgacttcaatgatcaggatgcaaattggaaagttaaattgccgggtagcattagaatggggcccagacgcccagtactattgaaaattcatccgatccgcttcagcatattttcatcagtttgcccagtagtactattgaaatttgtgactcatatatacatgttttaatttagcctggtttaataattcacaatcgatggtgtatgagcaatgaacgcgtgcttagaggcttggtcacttaatgctcccgaatcaaacattccatgaatccatgccaaagaaccgagtgctggcctaattaaaagtcatggatacattgctccatggtcagtacatgtgaaaaacttgcagactaaaactttagttcaaaaaacgactgaacgataaaagagtccacatcattgtgctttgattttgttttctcctcatgctatcctagctacaattcatctttccttaaatttgtaaacaatacgaagtttgctccacttagaactcaaccactgaaacgtctgtaaattaaattagcgatcttgacaaattcacgagtatatgtgtccatcaatggcgagctccatggactaattcccatgggagacaaagtcggcgcagcatgtggaactccggcaaccgtcccgtgcgtgggagtggcagagactccggcctccggctcgatccaggtattacaactggagctggtacttgatcgagaatgctgtactcgtccatggcaagaataatcagcgcggggggcactatcagttcgtcacacaggtgagaaaaaatgcttgttgaaatgcacttgatagtgcagtggtaaggggtgtgtgattttaaccccgaggttacatgtttagttctcaacatatttacaatttttttttaaaaaatatttggaaagatgtctctccctccaaatctcgattttttgagaagaaactacttgtcagggagaccagttcgttcccaccatcatcattcccagtgcttctcattctcacatacatagccgcggcgttaatatttggtagaaaagtaagagaataaccaaagcgttaacatttggtgaaattcgaaagaacatttggagcgagcaccaacacatggagctgatgagatgtagacatctgcacacttgtgcttttatgccaatgttgtgtcgtgaatgcctctgtatttaatttccactcctcattcctcgcagcccttttgcttcatttaatttagggtgtgtttagttcacaccaaaattgaaaatttggttgaaattagaacaatgttcaacaaaccaataaagctactatgagtaataggaccggtggccccttacctaaagctttattgaaaatttggttgaaattattgtgggtccgattaatgtgagaatttctaggctatgagagcgaatgtgtaggctcctttttctattcctttaataatataatagatagatggaatataacatcccggcctttgctaaaaaaagctacaacccaatattacagtctagcactcaaaataagtgtagtccaaaaataatatcaaccagcatataaagataaaaatatccaataaaatatatggagaacacattattgaagtctatttatgaatctccatccataattggtaaaaagctacataaccatcgactcaagctttctgcatgcaacttttaaaagatctatcagatccattttgtttaataccaaacttgtcttgccattttttctagttgcttcaacaatacttgctagctactatagccgttggcttttcacataacatttgatcattcattttattttaaaatttattataatatgtaaaaatatatgttaagattatagtttcttttatgataaaaaaattcacaaaaaataaatgatatttctatatttttaataagatgaatgatcaaacgtcacatcaaaagttaacggtgtcatacattaaaaaacagagtgtatatttgtattacaaccaatactaaaccataccaatatggttgatacaaaccggcccttagcactctttttttagttttgtcccaagtcaagtttgaccatttttatagagaaatatcaacgtttacaatattaaattagttttattaaatgcatcattaaatatgtattttatagtatatttgtttttaatttagaaatattgctaactcctataaatttaatcgaacttaaagaatttaacttaaaacaaacccaacatgttagaaaggaggaaagcacacaaaacttgttacgtgatacacatatacaagtttttagccaagctatatatgacctattccaacctttgatccaggctccaatccaaacaaatgtagtggctccaatcgatccctcagtcaatattgggctggtgcaggaagatgcagacggccccaagtagcctcttgatgctactccaatcaatgctatggcaattcacaaaagaacgttgcaaagcctaactctacagtcgatcggactgcgctcagatcattcccaaagtctcccaatctcaaaacagaaaaatattgatcaaaagcccgggtaatgtttaacagaatataatgccaaagagcgagcaacagatcgatgctggtgatgatatatcttacagtgcttcacttctgcttttatgcttaggatgtgttgtttggtgttgcttcatatcttctactcttttggagccaggacatcctctagttgcttaatctctcctctaatcaaaggtcctatacttctatttatggagatatatatggagtaactagctagatagttgtactttgagcatacatttgattgattattgacactagcagatttttagatgagactcatgcatatataggagggtaggattggttgtggtattaattaattcctaaatatacagattaacatatgttgaagttttgaatatttcgcatgaaacattttcatacatatatacatacactactgatccatcttatctaaagaaaatacactactgatgcatatttccttttaattttgaaacatttttgcaatggttgtatttgaaaaaatttgcaacccgaagtgcatgttcaacagtagcgagctctctatagtgttaaattatctatagtctacaccatacatgtccaggctgaacagagtcagcacggaggagaaactaatcctgctcggaccttgcgagccagcactccgtgcaaggttgcaggctacgccaggtgcaagaacgattggaaggtagatgttgcaattcagcaaaaagttttgtttaagacttcggcaaactgcagtttgccatgatgtccttcctgcagatgatcattctcaaagcttttcattctcacatatacttgtcagcattgacttagtgggtgatatatatgtatggagcgaggcagcgagcaacacgtctagcttgatggtaatgttatgtggtgaatgcctttatattttgcacgagtttccccgcctgaatagctttcattcagctttgtagaaaaggtaaattacacatggtagtactgctagggaagtaggaacacaacattcagagagtttgtagaggggtggaaattagatatctttcaattatgatatacaatataacattctccaggctttaggagctcagttacctaggttgagtcttctatacattgttctaagatacgtcgtagtgagggtgccaccgtccaaaagacaacatcatgtttgtgattggaaagcctccaaaaagtagaatcgtatgagtgatatgaaacgttttgctgaatttgtaggagaaatggttaccattgcaatttttctattgaggggattcccttaatgttttgttgtcatctgtgtcttgtcgagtctttctggagggtttgttttctaagcctatcaggctggcgcaaatttcttgtatatactttgcttatgatttttttctttttaatgatttgacataactcctttcttatgttaaagaaaatgttgagggcttgttatttctctcctcgaatatatgaaatggcagagctcctgtctgttccctcgaaaaaaaagaaagacatgatgaacagatgatttgcattttcttaaccttgtatgcaaattggacaatataaatgatattttgctgccatgatgtgatgatgtccttttactaaaggtcctattacatttatatatggagaaacaaagtcacgcgtatataaaatgtacttttgtaaaatttaagagtaacgagctctaaatattttgttcaaaacattttggtattcttgaacccttgtagccttctagttttgcagtgatcatggcaacacatattttcagcggcactgaatgattttttttttgaataaatcgaagagcatcaatttcattgaatggagcaggaaacggcactgaaatatcaagaacactggaactttttttggtgctggtaccctggttgagattccacatgcttcccatttctacagccacttgagtaatagtatgggtcctctcttcctcttcttattttcattcccaaatatggagtgaaggaaaatagcaaggaactgagcagcttgccggtatatatgatattgatatatataactcaccatgcatcatgtaggtagtgatagccatagactataaatgacataccaacaagaaacataaagagcattcccaaatcaggaacacacatgacatgattttgatggttagcacttaactttgtagtaagcatagttaacagtaaccaagttatgtaatgtcgttgggctagactatgaggctagtgggcctgttcgtctgcctgtgctgcggctgcggtgcagccggcaccaacggtgccacacacacatggcgcagccgcagccgccgcagatagacagccgaataggcccagtatttgttatcttaaaaataaataaaagaagataggtgctacggagttgtgttgctttggatagacgtgtgatagtgcgagcctagctttgccttgctagttttccggcagctggtaggtcttgccttcgttacaacttgactatgaagtcatacaaccagcggtggagcgaggcccagcaaatcctaggttgatgcgacactgctcaagcgggtggtagaatatgcaagcccctttcaacgcaagaagtagaaggtgagggcttcgttcttgatgccagtgcaatcgatactcctggtccatggctgtagcaatttaccacacaatgttgcaaatcctacacctacaactacccgttctgcattggaattattcccgaagccttccattctcatgctcgtcgaagaatttgactttcatactagtgggaagagaaggagaagaacaatcaaaagggctaggtaatatttcacaggatgtctggagtgagaaccgtatatataatacaacacaacccatctgcagtatagtatgtctatatatatcctactacattttctcacttatgtaatgtgctaattaaagatgtgttgttggtgttgccttatatcttccactctgtagagccaagattatccccgtttacttcttttattgtacaaaagtaactgcatcattgtacaaaagtaactgcatcgtttggttcttgccagtcctcgaggtggtaccattcgcttggccagctcttgccactccttctagcgagacaactatatttccgtgtttttgtttttaaaaagggtatattcttgcaaaacacgtgagaaaataatatattttcagaaaaaaaaaagtgctacataccaaacatccatgtatgatgcatgagtaaaattttactccctgtgtgtttgtaaaactgaatatatccacaagtacagtttgactaagacatgatatactacagcataatagcacacgatacatgtggtttagcactatgtaccatgcatttaacgcttgcttctaggaaagtactacaagaccattcactccgagcaagtgtaccaatttactatttagctaacaagctagtttcaaacaaattaatagagctaaatcaagtaagaaaattctataaagtttttatattccaagtaaggacctctaagaattctcaagttttgaatggagcacaatcaaccagtgaccctatgtcacggaagatggcacgccatgttccaacctttgactgtggctccaatcaataatgcagttagtggttccaatcaattcctcagtcaacaaaccagtttcaggaaggagaagagggcgccaagtagcttcttgattccagtcttatcaatgctatggctattcactaaagaatgatgcaaagcctatatatacaactatccaaccagcactgaaaccattcccaaagccttccattctcatgttcgtcagagaactagaatttcaaaattagtgggaagagaaggataagatcataacaaccaaaagggctaggtaatatttgataggatgtatggagtgagcaacatgtacgggagatgacatcctaggtattgtactttcacttattctttttgctaacgttgtgttggtggtgttgccttcatatctttcactccatggagccaagacaatcccctttttcttcatttattgtacaacaatagctgcacccttttgttgctcaccattatttcctcaatattaaaaggcatatactcctaaccatagaaaaataaaggcatgcataaactctgtggttgtgcaggtagctaggcccattggttcttggtagtaactaaaacataatgaagccacacattgcaagtgttacatgccttcgtatgcgtgtctttcactagcagattattaggacaaggataatacatatatagtacggtaggattggctagcacggtgtattaattcctaatagtatacatgctaacacatattaagaatagtttgctcgaaatatttgaataaacattgatcctgattgccttttaattttgaattggacaacggttgtaaagtgtacttggggaagaaagttcaatggcacaggaagtcgtccgacactaaggagcggtagggacaaattggtgcccctcgtgccgttgaatgagagggaaatctccatcgaagctgaacagaagtgagaaatggctgccgctctgacctccatgtttgctagctcttagctgcggtcacactgaacaagatcgaggaagagatcaaggagcttgccattaagattgattagtatccaataggcatcacaattggagaatccaatattacaaaattttcttccatgtttaatgcttgtaattctgttgagattccacatgcctcctatttcccattggccacgttgagaaatagtactctgtgttatcttccactacctaagcaatgagtacaactatacacaagatgatataaatgtaagtcattgtgcatatcttgtagttgtagccagtgatgggtggagtcatggaaacgataaataaacgtaccg

SEQ ID NO: 63148 - DNA, 10225 bp, Oryza sativa
tgtccttgtgggttgggcagagtcgcagagacaaccttagaaattactacacgaagaaaaaaattgcgaccacacttctttgagaaataaagtatgctgtttctaaaaaaaagtctggatctttttttggaaaatacaggattagaaaaaaaaagtgttagaaatacaacgtgtaatgtaggagttctgaaaagtactggaagatagcccgctcatttacacgggaatgcatcacggctgcatttcatatcttataaggtataatattgaccacataatacaatttcttcacaattttttgtcaacattgcttagatattttttctatcatattagttagctttacatcgtcaatatttaattaatccctataagcaattatctataatcttcatcgtaggtaacctaagtttgtttagaagaatatgtaacaaattaagtgtaatttaaaagtatggtgtttttgtttatgaattggattcttatgggttaactttttctaatttttaagatgtgatatgattcgacttaaagatttttctaaaagtaaatttaaaggttgaaaataatattaataggtcattgatttatgggattgaggattgggtcccgactgggatgttcactggggacctcttcggcgacatggttcctcgcacctcactctccatcacggggtgctggagggcaagaagggccttgagctattggtcctattgtagccaagaaggtgttgttgaggtcggctattgtagaatgtatctatccgacccagtggtctgcctcagggaaaatgactggattgaacggagtttgtctcaatagcaagttgaccgcaataaggcgttcgacaggagttcgaacggggtccgagggttctctaagagcaccaagagctagatcacgcggtttatcccctgaacgaagttcaccatcttcgcgtctatcatgagtgactccggattaaaaatgacaaggtattataaccttgttcttacaataaaagaaacccaaagacatagcaacaaagaaaaggaggctctggatcaaaaaataccacaataccacaatagatataagcagacaagtatgcaaaattaaaattaaataaaaaggcattagcccccatctttattcctctcacaaatcaagaaacccaattagttaatcaatgacctgacatacgagcattttcaaaccttcattggagaacttacaaacaaaataaccgctgacaaaatcataggaaaagcactaagagactaacaaaatctaatttcataaacattgtgaagaacaaaccctagactcttgacatatttaaatctttctaaagactttaattaaaaatgcatagaaacttattgaacatatgaagagatctcctatttcctcgccgctaacatgggcactagagaggggagaaggaatgggacgaaaggacagtaatagctaagggcccccccaaaacccggagccatacattctttttacataatagattgaaaaaacggtctcgatattacagtgagaatcttaaactcaaggtgacaaggagacattggaggtggtttttcaaatttacatggtatttagatgatacaaagcaagcaagataaagatacattgttgatatcaaataatcctgatttcgcccctcggccggcgtgacaacgctgcgtccaaaaaagttccaattttcgcaatgagtttggaagagattttgtttctaaattcaaaaaaatgaaaaagaaaataaaaatgttggatcactgccatgcatgggaatgaaaaagtccgatcctgcatgcagccatcactggttggttagtggttacgttacggttggtggatggcaatgctagggaaatgaatcgtgcatacgtgcacgcatcatgtatctctcggctctcgcagtggtggcctggtgggtggggaggatgtacttacagtgataagagtatgttatggtggtgtttgaaagttctgaagatgaagatgaagatggagattaagtgtttcacgcaaaacgtggttgtaataacatgtgattaattaagttttaattatttcaaacttgaaaaatagattaatatgatattttagagcaactttcatatagaaagttttcacacgaaacgcaccgtttagtagtttgaaaagcgtgccacgagtatccaaaatttaatccaattttagttggagaaaagaacagggccatagtctccaagtggaaaagaagataattttgagttgtgcccacacatggcatatggtgtggtgctcgctttcatttatcactttcctcgattagtagtgcccatcctatgggaaagcggaagtacgtacctacatagccgatcctgtgggagaaaataactttttgtcgtgtttttctcgactggtttctgcttttattcgaacgagtagtcaagtaggagtatatatagcatccttgtattgttacacgctacacgggtgacacagagaaatagttttttttagccgggccggcctaagaaagacggaccaaatttacttaataaaaggagtatttacacatatacaagtttcagtatcgaagtgaaaggatgttgccaccgcagcaacttcctaaaagaaaaaacaagttacagaaggttgttactctcctaaaacattgaaaaccccagcttctttccagattaccgcttcatctttaattgcgccaaacaggaaccccgttgttcggctctgattctggaatactcgcgcgttttgcagcaaatagttacacacaacacagattacattaagcattctattgcaaaaagaaaaaaaagtaccgtatgtaaccaaattgagaaatgttatgggccttcagcaataggagaattatcacgagtcattagtttatttgatttcatttacctgatacattctgcaattccatagcaaagatacagtatacatgatgcaaatgaggaaattatatacccccagaaaactgctccatgacttgtggtaactaaaagaaggtcgttcttggcaggtatttcggtgtgcgctattctgctgcttagctgcatttttgcacaaatgatcgaatgccagaaaagaaagctgatgaaagaaaaaaggaaaggttctttcaacaaaatggggatctgctgctgtatgagcaaatccggtcaaagcaagttgatactgtgagaatattcacaaaagaagaactagagaatgcaacagacaattttgactcaagcagagaactaggggcctgtttagttggtgaaatgaaaatttttggatatcacatcggacgtttgaccggatgtcggaaggggtttttggacacaaatgaaaaaactaatttcataactcgcctggaaaccgcgagacgaatcttttgaacctaattaattcgtcattaacacgtgtgggttaccgtagcacttatggctaatcatggcctaattaggctcaaaagattcgtctcgcgatttacatacaaactgtgcaattggtttttctttttatctatatttaatgttccatatatgtgtctaaagattcgatgtgatgtttttgataaaagtttttgggaactaaacaggccctaggaagaggcggtcatggcactgtatataaggggattctcaaagacaacagataaagcgctcaaagagtatgaatatgatttgagaaagatgaatttgtgcaagagatgattatactttcacagatcaaccacaggaatgtggtaaaggcttctaggttgttgcttagaagtggaagttcccatgctggtctatgaattcatcccaaatggcaccttgttcgagcttatacatggtaaatatagtagaataacatccatttcattggatgctcgtctacggattgctcaggaatctgcagaagctccagcatatctacattcatcagcatcccctccaatcgttcatggcgatgtcaaatctccaaatattctcctaggtgacaagtacatagcaaaagtgactgattttggagcatcaaggatgcttccaaaagatgaaatacaatttatgaaaatggtacaggggactccaggctacctagacccagaatacttaaaaagttacaagagcgccagctaacagagaaaagtgatgtttatagttttggagttgtgattctagagctaattacaggaaagacggcaatttattctgacagtgctgatgaaaacaaaagccttgcatcatccttttccttctggcactgaaagagaacaggcttcaatctatcttggacaagaacatattaggtgttggaacagagctgttccaagatgttgctcaactggcaaaatgttgcttgagtacaacggggggagaacggacattgacgacagaagtagctgaaaggttaaaagcaataagaagcacctggcgtgaacaattgattgagagtgctaacggtgaaactgtatgtttgcttgaaaactcatgacagtatgacccttccatcactggacaaagtggaagcttgatgacactacatttagaaactggtagacgatgagtatgaaagtaccaatgaaaggttatagcagagtttcgattagcatttcctgacataaatatcttgtaaaaatgtatcgttcatgttcaacaataaaaactacaggaaatcaatgagaacttacatttgacatgattttaacttacatttgacatgattttatgaggttcagtatgtccgcacaaagatttgccatggaatgatctgtcccctttttgttttgcctgatggtttgtcctactttcaccatggaagatcttcagagaaagacatagttggcacttcaatactggaagtggatgacttcagtgatgcagaggaagattggaaagatgctgggaggtcaagatggagagttggactgttggagactatgaagagttcctggaaaacaaccaccttttgcctctttgttacttgctcacttttgaaacttggttgagatggatggaatggaacttgttcctgaagagctggttgggatggcgccagtttctctagaagaggagctctgctcgtctcttgtcttcgttttgttaaacctctaaaacttcttcacacctctagttatggaaatgattttttttttgtgaaaacatggaagttggcgctaatacatagaaatagaattacatcacaaaggatgggaaaaaatcaatatatcaaaataaaggcccaaactatagatcatttctcgaatgataaattaaagtagggtgaaacatgattagaaatgttagacaagatagtacactaacgagccttttctgccacagtgatcacaatacactcttctgtgaataaacaacaactgacgattgaaggtctctatcaaccttgaagtgggagtgaaaaaatctcctaacctgccaaacaggacacacgttatgatgttagggaatgggaaaaactaagaataagagagaaaatattttaattatcatgtcatcatgcaatgtagtgctacctatctgtttttaacattttaagagagagctaattcacaaattgtaactacaataaactattaactacctgagtgcaacaaacaataaccttattgtatttttgccatcaattgcaaagcaaaatagaacttatgtcagatgctcacctttcaacctgatgacaattctttctaggaagacataaattcacaaaagaatttagtaatacactggacacataattcttgagaacaggatacttgggagtcatctgatcgtgcataaaaaaaagaactaaaacatgaagggggcaaagacaacttaaaaatgcagcccatctttttattttagacatttctttattttagttgaatcaactaaattgtaagccttatagaagaacttgccaatctggacaatagctttgattttttccccacttttttattagaaataatcagttccctctggacatcagcagtccaatatctgactttgatattaattttcatatgcatatgctagtgcaaaattatattgcaaatctaacggtatcaattccacattactaatttaaaaggcattttagacaattactggtcgaacttagagaatttagggtattactaaaacatcatatatttataaacaggctactaaataaatgcgtatacctattgaactgagggaagaagagatttttaagattcaacagtgttttacctcttgaaatgaattgcgcagaagcaacttgacatgcctttcttcagattcaaataatacaatatgactgaacgaagataaatttccaaaaacctcgcccacaaaatctgctgggttcatgaggaaacggtctgactcatccaaggtccctttgttttcactggtaacatgcaaactaagtcaggataattggctatgatgggtacaacatggtaaaaagaaatgctatatctactggactagaaacaatgaaagaataatcacctaggagtacagtccaaaaagcgcataggtaggttgtaatgtaatgtagagtaataaggtgtcgaatggcaaggcataaggaagaggacactctttactcttccatcatgggcttctcgtgatagataaagcatagcatcttcagttcctctctgacataatgaaaaggtacacatacacataacagaagtaaaggaatcttgaaaagaaaagttaactaggcacaaatagaaagcaaccaaattaacccaaaacacacacataaagaacatgtttacttaaagtagtacttacttgatggtataaggacatatataaagccattggaacatttgttaggatgagcagaatgacagagagcttcaacctcgaaagtcgtcctttctcattgtgaccttttcccttgagttgtgccattgcagctaagttatgtcctgagaacatgaacataaaaggaagcaccgggagaacaaacctgttgtatccgatccatttatatcagggcatgtgtgtactagtctagtgataagagattgaacattacaaacttgtgcgaagagataagtacctgaattctttatgtccaagtatgctataaaccactaatacccagacaataagacctgcaagcctccattctcgagacttcaaaattccagaaatggaaaacggtaagaaagtccaaatcatcgatggaaaaccttggctgaagtaccagtggaacacatgtgttccatagtagtctcctcctgaagagaagaggttaaatttcaaaaaattaagtggcactatgatccgggaaccatacatccaacaatcaagaaacgttgtcacggcaaggacaaagaccctgcagacagattagaaagcatgtaaggtttataaaagtattcctcaattgtgagaaaaagaaaacatgaccttacaagaaaagcaatgcttcaatcatcaagcgtttggataacaaggcaatcctaattctaacaaaataaactgaagggatcaagagagctcatctaagaaatgatatgcataatgctgatgacacgataaacaatctatcgcacgtgtcctaaagctagtgtttgtgcataaccatcttacttatgaccatatggtaatcaaccatgcattcttccttttggtgccatttggcatgacagatggtaatgctgatccttcctgtcttgaacaatgtgaatgactttcttaacaacggtgcagcatgtggaaacacatacctactatccaatatgtttggtgtgtttttcagaaaacctactagcgagacaacttaccatgggcaacaacatcctaaatatcaccagcataatgcttattcaatgcgaaatttcaataaataataggcattagcgttatgatgcaaaaattcaagaaataacagagataagggcattataaaaatttgccatagacagcatcctaaattcatccaatttatacatatccagtgcaaaaaaccgagaacgaaatatactgtgagaataagtttgacatgaattttaaaatagtttcatacccgagcggaacgacctcgagaaaaataaaccgggattttgatttcatctgaataaaatccaaaagaccaacatatagccatgttatggcacttgttggccgaatagcacaagctaaggctgctatgagtagagccatttttcttgatggagggctttgcttgctggcagcctgctgctttgaaacaaccgaatttccctttacagactctattgcaacaaaccaatagtaaagtccagtaacagtcaaaactgtctccatgctgtttgagagagtccgtgtaatacagaagaacatgaaccagttaacaagctgtgaaaatagctggaaatgacttgttaaggtcaccattcaccaggaaaatggacttgtttatttacgaaaaaggaacatcatatctacataaatgagttcaaggatactgcccactgggcaacgtgattattgaaaatgagttttgaaagtttatataagtagagatccccaaaagatgcaaagactgattgtagaagacgtggagccatcgcctgtggggaaaaaaaaacaaagaaaaaataagaaaattctgcttctcagtgcgtaaaaaaaataaagccatgcagagaggagtgatatttgattcacatatatataggtttcctatccttttatagtgaaggacttgtttgcttaggattgagattgaacatagaacaggatacaaattgtggattggttagaattaagaacccaactgtaagctatcccaatcaattcccaactaagaatctagttacatgagaaactgttgatactgagcacttctatttcttttacatgtgacttaacaccatgactcaaaccagaatcctataactctaagcttcatttctaatcttcattcagagaaatacacaagaattttttggcgtgaattcaaaaaatagttaccatgaaccatggggaatccaagtggagcagcgaaagaatcttgtagagagcagcaaagatgaaggggtggaggtaacttcgaagaccacgcttccactcccaagtaaggtggccatacctgcaacgaacgaacagagaaggctcacaaaatgcagcagcttaagcatcccactcccttggactggagtgcccgctggattcgaagctaaacaccggcgaagagggcggcgagttttacccgaagacgatgcggtgggcgacctcgaggcactgccagtgctcgtcggggttgaagtaggtgcgcaccagcagcgcgttcgccgcgcggaaggccagcgccagcgcgagcacccttcgctccgatcccagcgcccacgcccacggcagatccggcctctcctcccccgtcgaagaggcctctgcggtggacgagccgccgatgccttcgggaggcggcgggccagcggcgttacgtcgcctgcggtggctcatttgcagcgaggcagccaccaccttccgcgctttgtctagcgcaaggctagcgatggggagtggaaggaggacgaggaggaggcgcagccgtcgccgtcgccggagtcgcggaggaggagaaggagccgcttatcgccgtcgccggagtcgaggaggagagtgaatttctccctatggtttgggccttttgggctgtggaaattcactctccggcccatttcaactgcattttcggcctgcagaaaaaaatattaaattcgaaatctatgggattacatcctgaaaaaaaaaagagattgaattcgaaatctttcaaaaccaacagaagcagcataagggatgatcatcctgaacagttgttgtaatcatatctgataagaatatcctcacaactaggcattaccaaccttgcatcgtgccgtgaatcatataggtttctgcaaatacaccacagggtattttttttgtctctgattttttctatgttatatacaatatgttgctgggtttgccaagttctaatatgccattgcatttttctgaatttttatgatatactatagtcgtctggtttgtctttgttaaaattgtacaattttattataatgaccaaaataccgcttggatgaaaaattccaaatatcagacaacaacttttttgcatagtttataatatgatatttaagttgagcgtatgattgaaatcatcagtgagaaaatcagggaaatttctttttcgtgcggtttgagtttcgacaaatggttttgaaatccccctgtga

SEQ ID NO: 63149 - DNA, 14394 bp, Oryza sativa
  unsure (1)..(14394): unsure at all n locations
tattgatccccacaagccatctatcctacatctgctcaaagaccaggcctcatcatcgacaagtacaccgcgcgacgtgtatgctatcgatggaaccggcacatctggaggcggccacacgggaacggcggatcaattggttacaccgacgctggcccaacatatcaaaactctcaatgcgatattgaacaaaagcccttttgatcccgtcctgtacgctgatctcgatcactgggcagaatgactacgggaatcagtggctaatctcaataacgcgttcgcagaggccgccgccagggcaccactagaacaaccgcggatcgatggcgctaatagggaacaacgagatggagacctgcccgaggacagtgatccaactcagcggtcgccacctcgtcaacctactcctccaccccgcggcactagtgatctccgcgagcacctaaatggccgccgagaagcacgactcgctcgagataatgaaaaccgttgccgacatcgtgcctcttcacgacattgcaagaacgaagaacaaggaggacgtccgagccagaaccgagaccgtgatgattgccacaaccgccgcgaacatgctaatcgtgaacagcggatgccgagtgataccagtcgaggtcgacgccgtgacgacagtgacaacagagatcgacaccgggacaacaacgatggacgacgacgaggttcacgagaacccgagcatcgtccttgaagccgtgcctcggaaccaagtgacccatcgtcgtcatcatcatcttcatcatcggacagacatccacgatgagcgcgtgatcgccaacaacctactacccctggcggtgggtgcagggctttcactcgtaccctgcgagatgttcgatggcttgagaagttccgaccgggagcaatagagaaatacgatggaagcaccgaccctgaagaatttctccaggtctactccacggtcctctaggctgctggagcagacgacaacgcactggcaaactatttgtcggctgcgttgaagggatctgcacgttcatggctggttcacctcccgccctactcaatttcttcatgaacagatttgtggcaacagttcatcgccaacttccaaggaacatacaagcgccacgtgatcgaggacgacttgcacgcgttgacgcagaaaccgggcgaatcattgagggaatatattcggcgctttaatgagtgtagaaatacgatccccgagatcaccgatgcttctgtaatccgtgccttcaagtccggtgtccgagatcgctacacaacccaggagttagcgacaagacggatcacaactactcgcaaggtgttcgaaattgtcgactgatgcgctcacgcgaacgacgccctgagacgcaaggaaggcaagtcgaagataggagaggagtggaaaccagccaaggacgcacctgagtcaagcaagaaaaagagccgcaggagtgggaaacggaaagctcaagcggaggtcctcgcaacagaacatgttgacccgcccaagaacccagacccacaaggcgacgatacgaataaaatatggtgccttatacacaagacggacaagcactctctggagacttgtttcatcttcgaaaaggcactcacaaagaaactagcgttggagaggggcaagcgagtacatgtagtcgagaaggccgcagaagcgactacttaggtctcagattcagcttacccggactccgacctccatgtttcgcacatcttcgtaggttccacggcgtactcctcaaagagagagtacaagaaagtggagcacgaagtttgttcgacatcacagggggctgcatccaagatgaattggtcagagcagaagatcgagttctcagaagtcgaccacccaaagactaccgtcacaccagggcgatatccgatcgtggtcgagcccactattcggaatatcaacgtagcacgggttctcatcgacggcggcaactccatcaacttactcttcgccagcaccttggacgcgatggggattccacgaagcgagttgatgcccactgatcaacccttccatggaattactcctgagtcatcgtccaagccattgggcaagatcacgctactcatgactttcggccaagcaaacaacttccgaacggagcaaatcacctttgatgtcgctgagttcgacacggcatataacaccatcatcaggaggactgctctcgcgaagttcatggccgcatctcactacgcgtatcaagtgcttaagatgcctggaccgaagagaacaatcactattcagggaaacgcgaagctggcggtgcagtgcaacaagcgaagcctcgacatggtcgagcacactcccaacccacccgccgcagctgagccgcccaggaaagtgaacaaaaccaacaagacgccgaagtcagacggcgcaatcaagattgttccgctctccagtgccaaccccgataagaccatcaagatcggggcttcactggacgaaaaataggaactcgtgctcatcatcttcctccgcgataatgcagacgtgttcgcttggcagccgtctgacatgccgggggtccccagggaggtgattgagcacaaactcatggtgcgacccgatgccaagccagtaaaccaaaaactgcagagatttgcaccggatcgaaaacaagccatacgggaagagctcgatgagcttctcaaagctggcttcatcagagaggttctacatcgagagtggctagccaacctagtcatggtgcgcaaggccaacgggaagtagaggatgtgtgtcgacttcactgatctcaacaaggcgtgtcccaagggtcacttccctcttcctcgaatagaccaattagtggactcaacggccggttgtgagttgttaagttttcttgatgcctactccggctaccaccagatcagcatggcaaaagaggacgaggagaaaacatcattcatcatgccattcggtgtattctgctacgtcaagatgccgtttggactgataaccgtaggaaatactttccagcgcacggttcaaggggcactcaacgaccaacttgggcaaaatgtcgaggcttacgtcgatgacatcgttgtcaaaacgaagacaagcgactcattgatcgacgacctccgggaaacgttcgacaacctccgacgataccgcctcatgctcaacccagagaagtgcacgttcggagtaccgtcgggcaagctcctcggattcctcgtctccggaagagggatcgaagcaaaatcccgagaagatcaaggcgatcgagaacatgaagtagccgacaagactaaaggaggtccagaagttaactggatgcatggcagcactgagcagattcgtcgctaagatgggagagcgatgacaactcttcttcgccctcctgaagaaacaagacaaatatgtgtggacacaggaagccaaagacgcatttatcgcgctcaaacgctacctgtcaaatccccctatacttgttgctccccaacctaatgaagaattgttcctttatatcgttgccacgccatattctgtgagtactgtcattgttgtcgagagagagaaggtgcaaagaccggtttactacatcagcaaagctctccacgacgcaaagacaagataccaacagatctaaaagctgctttacgcagtagttatgacatcaagaaagctacgccactactttcaagcccacagagtcacagttgtttcctccttcccccttggagaagtcgtgagaaacaaagacgttgtcggccgcattgcgaaatgggtagtcgagctaagccagtttgatgtccactttgtgccacgaatagctatcaattcccaggttctcgctgattttatagctgactggactatgtctgagaacaggccaaacagtcaaacagacagcgaaacgtggacaatggcgttcgacggcgcacccaatagccaaggagcaagggcatggttcatcttgacatcaccttcgggagatcagttcagcaagcacgcaattcacctcaacttcagggcaaccaacaacacagccgagtacgaaggactactcgccagcataagagcagctgccacactcggagtcaagcgactaattgtgaagggggattcagaactagtcacgaaccaggtgcacaaagactacaagtgctccagccccgagttatccaagtacctcgcagaagtcaggaagctggagaagaggtttgatgggatcgaggtccgacacgtataccgtaaggacaatatcgaaccagacgacctcgcacggcgtgtgtcccgacgagagccactcgaacctggcacttttctagacgtcctgacaaagccatcggtgaagaaggtacacgacgaaggtagcacggtagtccccgacattagctagggggctacagaggcggtacacgtcgttgccgatatcgagactacagacgactggtgaaccccgctgatcaagttcctgagtagcgacgagttgcccgaggatgatgcagaagctgagaagattactcgacaagccaagatctattgtatgatcgataatgatctgtacaaaaaaagagccaaattgagtacttctcaaatgcatctcgtccgatgacggcaaacatctcctcctggacatacacgaagggatctgcaggtcacacgccagcggacggacgttggtgggaaaagctttccgacaagggtttttctggccgaacgccctcaaagacgcctgcgacatggtgcagcggtgtgaagcctgtcaattttacagcaaacacacaaaattgccagcgcaagcgctccagaccatccctcttacttggccattcacgtgctgggggctcgatatactcggaccattcccacgaggacagggcggctacaggttcctgttcgtggccatcgacaaattcaccaagtggattgaagcgacgcccacgggggaaatcaaggccgataaagctatcaagttcatcaaaggaatattctgcagatatggattgtctcaccgcatcataacagacaacggctcccagttcatcagtgccgacttctaggattacagcattggattgggagtcaagatttgcttcgcctcggtttctcaccctcagagcaatggacaagtcgaaagggcaaacggcatagtgctacaagggatcaagacccgcgtctatgacagactcatgtcacacgacaagaagtgggtcgaagaacttccctctgtcctatgggccgtgtgtaccacaccgataacatccaataaggagacacctttcttcctcgtgtatggctcggaggctatgctccccacagagctacgacatcagagcacatgagtacagaagtactccaacgaggagcaggaggagcggtgaagcgatgatgtgaatctactcgaggaacatcgagaaagagttgccgtcagagcagccagctaccagcaggccctttgccaatatcacgagaagcgcaccagagcacgtacactttcgatcggcgattacgtcctccgacgggttcaaagccaaacagggcgcaacaagctctcacccaaatgggaaggaccatacacgatcacgcaagtcttgcggccgggcgcattcaagattgcagacggcgatggccgcaagttagcaaattcttggaacattgatcaattacgtaaattttatgtataaatcaatagtatccatatttgtaagatatcttacgatttcaataaagttgatttcaggtaaagaatattgccaaagtgttcctttccaacgatcccttaccacgacgacacctagagttgaaacctatccttttgtccctttacgccgtcctggcaaggcctctgaggaacctaagggaacttcggctggggacgcccagagcggataaggccttgtcaggttatgcagagacaaacgaccatgtaagatctggtcatgtaagagttctcagttctcaccgtgcgtattaaccaagccgtgtaatcggaaattgagttttccaacttcacggctgggggctaaggtcagcgctttttcaaccaaggtaggtcaagggtccaagagtcttatcctcccaaaacaattctctgacgacaaggctggggtctagggagagtgtatggctcaagtgactgatcgaggtcgcaaagtgagaaaacactcgtacacaacatacccagagaaataaaaactaccaatatggccaacgccaatccatggagtagaagaccttctcggcaagtggcgccatcgactgcgcaagactgtcgatttcccaggcgtcctccgagaacgagagaacccttcacgaaagaactcgaggtgcagctgcgggctgtgatctcggatgcaggctagcacgtgtcctccgcgcgtagcggctcgctcgacggcactcctgcttcagggcctcgtcgatgcgcttgccaatcccatcgagttcggcacaggcccccttcatccacgagatgtaaccagcagcggactcctcgggatcttcacggggaactcggagctccctacaaactcacgccatggctgtgcagcaactcttgaggtatgagttgaaccacacctcgtgaactcggagagcttctatgccctggtccttcttcgcttccacaacggctctttcgagttcagccacctcgaatttcgtcttccaatactgcattcgacgatctcggtcagccaacgcgttctcgaaatctacccaacacggaaaggactaagtcaagctactcctctctttcgagaacacagctaattaagtcaatccaaatacgaggagcgaaagaaatcaagacacaaacctaaagaagtcatcgccatgttcgcccccgtggacggaacctgatcgacttcgacctccggcacgtgcggctcaggcgtgagcgccggaacaactaccggcgtatcgggctgcccgcactgctggacatcctcgacatcaacatatctacaataaagaaggtactcggaatcacacgctgaggaaacaagggaaacggttgtttaaataaaaacagtgtcgacccacagaaagttttacagcatgaagattaaggagtacaagggaaagtaaaaaccctactcttcaaaaaggggaggacatactcccccaagtcgccgacttcctccatcgtacccttgcgcgcgttatcggtggctccccgatccaacgcctctttgaggttcaagtcgggatgcgccagccttatgcacgcaaggacttggcacgccccggtgtatataccgttggacgtctcctcgctgatcctagccgcgtggcgggaggggatcgcctccatcaccttagccaacttggtgagcgatgacgtcaatgaccactcgtcagggtgcgccgggattgaaatcacgacgccacattccctggcaagttggtgcaggccagtgaatgatgtccgcagcgatccccggatgtctgtcagatggtccttgagctccgacatctggtgctcgagcctgcgccactgcgtctcgttgctagctaccagctccttcatcttttggaggtcctcgcgggcctccgccaatcacgcgccagctgatcggcgcgctggtttgccgacgacgccgccgcccgggcttcttcgatctcgcggcccacgccgcgggcgcccgcttggaggatgcgctccatctcagcctggagctctccccaagtgagggcatcggcggacagaggctgggcggtcacgaggctggcgataggactatgtggtgccgcctcctggtccttggtagcgaccacggctcccgtcgaggtcgccacaggggacacactggaagcagcatcagccccattgtgcgcatctttcgcccgcgccatcctgcgaagatttttctcttctctgtgaggataggtgatcaagactttgagaacgaaaaaacctcaaagacatttacttacttctcaccgatcgtcaccaacctctgccttcgcggaggcggtggagacgcacccgagtcctaagttggatgatatgatgtgaggttaagtcgttctgattatgtactctaggacgaaagagaagcttaccgccgggtccgtcgccttccggtgggtcccgagcacacaggagaactctcttcccctcttcggaacattgctgccactcgtggtggcagcagcagcgtctaatgcttccttggcggcgccctccttcagcgacgtcacagcctggtgatccacgagtggtccgatgacgtccgtcagagggagagcctgcacaacatgaagtcacgacgcgatctcgagaagaaagatgaaaaggaatcatcgagtacactcacgttaatcgcggcagcgcgttcggctgagcccttgtcgcagagtgggacagggatgttacccacctccgagggtccactgatcattatctggatgacgcggcgctgcacagtgtcactgtccagacctgtaaatcgagaatgagaactcgataagtcaggagaaacagatgcacttaaaacaaaattggaaatgcgaggataaataccccgagaagagacccgggtcacgtcatttggccctgagtaatcgaaggccggatgggtgcaggcctgtagcggctaaatccaccgacctatgaagtcggtagcgacttcatatcccgacaacccccgttctcggaggtcatcgatgatgtcgataaaggattggagggagggagccagggcgggtttagcagtccactctgggatcttttctgactggtcctcaggaataacaaggacggggtccgagttctctatctggagatagaaccatctcgtccgccacttgctgcgagaagaagggcactggaaggggatgtaacgcgactttaggccatcccgaagtcggaatccgacgcatccagataccctgttggattccatccaacgcagctcgtaataaaaatggaagaggtcaagaaaaggctctaccccaatgtaggcctcgcaaagatgagaaaagatgctcagaaaggcgatggagttggggttcaagtggagtaaagaaaggccgtagaaattcaagacaagaagaagaaactcggaaggtggaggcagaaaaccgcaagaaacataatcttcaactacaaccatgcggcccaaggtgggttcaggttctatacctccagcctccctctgcatggtcccgtgaccggggagggcaccatcgtcctgtagcttcttcatggacgcggtgtttgaggaagacttctcgaggtccatcgtcgccggaggatcgccggagaataggactaaggaagtgagttatggtttttgcggtgagcggagaagacgaagagcgctagaaggcaggagagttttctggcaagcggacttcaagtgaatccccaaaattcccttaaataagcgcactaccgacggtgcgtattccaaggaaaggagagagattgccgccggaaaattctgggtctgttgcgcatggtagtttctcagacttcaatttaaattcactcatgaccgttgaacttcatgcggtgttgtcgatggctctttgtctttatgatttttacaccgggatcgaccagatgagaacggcaacaattccgaaatcagaagtcgcgatcgataacatgagttcatttaagtagaagtcgggggctactgtcagggttacggataaggtataccctctatccttggatgtataccgtatactaatacggtatacctgcgcgtatatggacagtttccgtatacattaaggaaatctatcacgtgataggggtggtatctacagatggaaggagttctactcggacaagattgggttttagccatatcgtgaggggtccgatgtcttcgagtcctacttggagatcaactgacccgtggtatataagggaccccctgggcaggacctaaggcattgaatcttactgccaacacaaccaccacagcctgcggagcgcgcaggagccaagtcgccgggagacctagtcgaaccaactcgactacgatcttgtcggtatcatcgagttctgctattccctttgtaatctgtggtttccatcatataatcccataccaactggattagggctattacccatcaatgggcctgaaccagtataattcttgtcttttatctgcctgatgtcgtcttacatagatcctcgtatcaacggaccccaataccctatatatccggtctgcgggtatcccccgtcgacacatatatcattgcacttcccatttgtactttaagatgttgattgctctctctccttgtatgtaggccccactggatccttcttgcgatccatttaaacgatggattccaagatagttgtcttcgatggactgaggaccccgcaagccaagttccaatacatcattgacactctcaataaggcacttgtgaggtataagaataagtgtatttgacacgctccgtgtgcaaatacattccaggtttgggcccacccttattgcttacgccaggatccgggcacgagtacatgtggattctacctaatgaaatttatgtagattttcatggatgacaacaacgggacatntatgnatgcgatgttcgcccatcctcttaagacgtaaatccaaatttctaaacacacaatacgttttcacatcttcaatccttccatttgcaaaaattaaagctcccaacaagtaaattgctaccacatgcttgctttggccttgctgaacaactatgtggattcatctccaatcatatcatctcgtcagacggcttatacaacatttcaaaagctcctattgggctcgtgggtttcattgaggctggttgccatagtgacattttagatagccgttcaacaaccaaggatacgcagacttataattagtgggcataatgtaccctttaaaacctgcagtttgttaacaagctagtaaactgttcttccttttttctagggtgaactgaggcttacctgtatttttgttttcaccataagtagattacaagtaaactgttcttcctttttttctagggtgaacgaggatttgagcaactgaggcttactgaagtttgagcagagtgaactgagaaacaccatgctggtaagaaccattttttcttctaatggaatcatgcggagatggaattgatgtacgataacttgaatgtggagatgaattgcatttatgtgtgtatgtttggaaatttttggatgtgggatgacgtgaatttgtgaattgatgtttggagatgaattacatatattgtgaatggataatctgtgaactagcttttttttctacaagattataggtgccggctataaacttagaaccgacatgtattatactaatcctacataggtgccggttggtgttaataacggtacatataggcttgcgagggcatccattatttgctggttctttaaaagaaccagtacctataatacctcttaggtgtcagctcatactaattggtgccggtgtcgaaaccgacattaataggcccttccgaaccaacagctatggtaattcaccgttccgtttcacggaccaaaggaatgtttcctaaccccctcaaaagaaacggggcctagtacaggctgcaaaacgcatcatccggttctagaatctgcagtattagctagtagtatctccattctataatataaatatttttagagttggacacagttactaaaaaaatggtaaaagtgaatgatggatagttgtgattggttgaatagtggaggtaggtgaaaaaagtgaatggtggaggattgtaattggttgggaaaagaatgttggcgaagaagttgttatattttaggacaaatctttaggactaaaaattgttatattttggaaaggatggagtacaaacttatgatgctgattgtctacctgcaacgcaatcataaaaaggaagaaaaagctttttttacagtatggactgtactactctataaaaaataaactctagctactaatctagacatatatctagattcgtactactctgttccaaaaaatataaaccctagctacgaatctagatacgtatatatctaggttcatagctaggattaggtttttttttttacggaggagtagctatgattagacttttttttgcgatagaggggtatggtagttgacgtgtgatgtgcttttacactgaggtctggtttagttcccaactttttcttcgaactttcaacttttccatcacatcaaaactttcctagacacacaaacttccaactttcaacttttccgttacatcgttccaatttcaatcaaaattctaattttgacgtgtactaaacacaccctgagtgcgtccaattgtactaataaaaaaaaatcagctgatcaatctgcctcactctacaaggctctacaaggtaggctgtacgatgtttctgttgaacaacattgccacttcgtactgcatctcctgtaacctgacagggctcatacctgcacccctaacctaacatgattgtactttgtacctttgccattgatcatgagagagtggacaccccctaagacatccctcgttatttgaaagttatttaaatacataaaattttctttccctcgtaaaaaggaaaaaacaattataaaagaatttaaaaacatttgagaaggtagattaatatgtgatatatcatgatcaatcctcaaacatacaagttaaaatttaacttctataaagtataaaaaggaacaaattaaattataactaatattcaccatcaaatttattttaaaaaattgcagaagttaaatttgctattgtatgttggtggggtattaatatgtcttgttgatttttgaaataaaactataactattttataactatttaagtgccatacaaataacgagaagtatccttaagagtgtagaatcgttttcatgatcattgcatatcactatagacgtaacaagtgtaacctattagggtttcccttactgtcagtgttggggttaccgtacctggcgacaagcacagttaccatgcggtaaccatgacaaaccatacaaaatttatcaaaaatttaaattatttttaaaatttatttggatttaatagggttaccacagttttatctttaacttatcccagcagtaagaatgattgctgctataaccgtgccggttttttaaaccctgtaacctactagtgacgatagatttgcatgttcctaatgtcgacagtttcagattttacctcggttttcgttagcacgtttttcaaactattaaacggtgagtccagtgtgaaaacattctatataaaagttgttttaaaataccaaaaatattcatgtgttaagtttataataattaaaacttaattaatcatgtgccaatgattttttttcattttacgtgcgtcaacttgatcatcttcgtcttcatccgtttcatcaatcagattcgcaggttacaagaaacggtccacatcttgctgggttcaggaacctcatcatgatattccctccatcccattttaaggctgtgtttggagggaacccctcctcccggcacgcaaaacgaagtttattttattgcataattaattaagtattttttaaaacaacttttatatagaaatttttcgtataaatcacaccgtttagcagtttgaaaagcgtgcgcgcggaaaacgagagaggtgggttgagaaaatggaggaaagaacacagcctaagtgtagctatggttttccgcacataagtttgaccatccatcttatttaaattttttttaaaaaaaaagttaaaaacataagtcaagagtaaagtactattcatgttttatcatctgacaacaacaaagatactaattataaaaaattttcaaataagacatacggtcaaagttaggcgcgaaaagttatggttgcatttaaaatgggacggatggagtagtaaaaattgagcgctatttgaattttgaaaagcaaaagtttcaccccaagctgtttgatttacgtactattgcaaactaggaaacccgtactctaaattggccctacttttgtcgctaaattaggctgtgtttagttcacgataaaattagaagtttggttgaattggaacgatgtgatggaaaagttaaaagtttatgtgtgtagaaaaattttgatgtgatggaaaagttggaagtttgaagaaatatttttgaaactaaacacggcgttaatgtatggccactagtgcaaaaacccctgtaggcaatagataccggttttccagccggcaccaatgactaggtcatagaaccgacactttgtgctctctcggatttacaaaaaaatgaagccgtgtgctctctcggatttaaaaaaaaaaaagaagccggctccaagcatggagccgagcc

SEQ ID NO: 63150 - DNA, 49768 bp, Oryza sativa
  unsure (1)..(49768): unsure at all n locations
tatatagtacacagctttacatgtgagattacaattgcgctctttgttgggcccacatgaaattacaatcgtgcccctgccatatcaacagaccctaagggcattttggtacattatgggggtcattatagtcttttggtgcaagctagatggagtggttgagtggtccctgggaatattctcttggcatctttattgtccaagtcgccttcttcatggccaagagtctttttcaccaacatggatcttctcctcgaccaagggtcttttccaccactatgggtcttttccatggcaaatagtctttaccatctcgaccaccctttccgacttatccgatagctgacctgttattaactcatgaaaaactcaaaacggataatgagacttagtgacaaggactcactcgaacggtattttccgactcgaatagtgttttccaactcgaacaacattttaccgtttccttgttcgaatgaccatttgccactcggatacttagaataaaaactcaatcttacccaatctcttcctctacagtgttttgggccaaatagagaggaacggtggtgacccctagctacaacataatttcaagaaaaatcctgaaaatcccgagaaaattctagagagtataattaaccacaaagagtttaataaaaattaaatccagccatgctttatatttaggaaattttatttctcacatttaaattcacttgtaaattaatgaacatttaatataaattctgaaaataatttattaaataatttataaaacctgaaacgaaaatcaggatgtgacagctcctcatcagagctagctcgatatcatcgatacagcctaaagggggtcctgggatgctcaagagcatgtccatcatgagagctgatgtaatttccccgctggtttggatcttgtctacaaaaaataagctaatcggcaattggcctattccaagctgcctggcagcgctcgttggatgatagaactcatatgaaacctaaatattcctgccttgatggatgccgacagggagtatgcagggggaaatggctgctgtaagaacttcatgattgatttgtcaaatctaaaattagccggaagctcaaaattttcggaatgatcataagcaaaccatattctggagtccctggatacccatcacaaaaattaccgaaccaatcagaaaaaagctcagccgacaactctgatccagcataagatgccgcctctccaaagnacatgcatcgactggtggaacttttatttccgtcatcatcttcagttggatcgtcggcagaaggaaatcttgcttcagtcagggctgacctttttgataccttgatggtatgcaaattcaaacaaacttggaaaagccaccagggaccaccagtgccgatgacggtatcgacaacagtcttagctgatgcagaaccaagagtttgatacagagccaccaggaggtacttgcccaaaggaagttgcttcttgtccactagagccacaccagatgctgccagttggaggtaggcccacaacttggaccacaaaacaggaacttttgtaaccacatcatcaggaaggccacatgttccctaggggttacaagaccagaccccatgttcgaagtaacaaagccagaccagcctccaatgctcttggttttataggaaaactagcttttggtgctcaaactgattgggttggctgacgacgtgacatccaaactcgtaatcatgacaacgtccaagagagttggagtcatcggtccctggccgaacaagaaggcattcaaggtattggaccagaagtaagcggctgcctacagcatgggctcatcatttttcatatcggctatggtgaggggctaggcattgtgaaatcccaagctcatcccagtgagtctgttcgctagccaatatcctcctataccaatccggtcaagttttgacattggaggaaggccaagacttgaaggtaccagtccaatggcctaaaatagggttagtccgtctaaagaggactttgttggtcttggcattgataaactgagtaggatctgtgtcactgattgggtccaaaaagaattggtgctggttttgcaagctaggaactgcaacttgacgggataggtgctacaatagaaggaagaagagatcagggaagggagcacaaagtggtaaagagacagaaagggcctagccgatggtgcttacctcggggaactcgaccaccggagcgcttgagggattggcagaagacattgccgaagtcgggccgccgccgaaacaagggatcgcctgcagagtcgctgagcgaattactggagtgattgggggaagtttttggccaaggcaattgaagcgggggagacgccgtgaaattttcaaggtggttgacactatttaaaagggcgcgttgacggccgaaacagaaaagaaaccctagatgcaagcggaaacaaaatcgagcacatccgcaacatcgcaaatatcacggacttgaggggcatgtgttaatgatcaaaattggtaaatcaaagattggatccgaagtcagaaccaaagtggatttggtggaaatctgtagcctcagaaacagaacccacatcagctacgggttgcatcggctgctaccaaatcgggcaaggaggagccgatataactgatcccggcaaggcgatcaggagattgttgtctagatcggttcaagtgctacaccagtattgccaagtgtggattgagtccggagaaggcaattgtacctattaattaggatattctaatagtttccttatagatattttcagtaagagtccacaggacttgttcgtatttttgagttgtaatagagatagagtcgtgttcggcaaggacatatcatgtattttgggtataaatataacccaggaccctgtaaacaaacaacatcagttcgataacactttcggcgcatcgccacccttttttcattgtttcgacgagttcttgctttcgagttgggctgcatagttttcgatctccgacgaaaagtgtggagattatggataccccatacctacacggcatgtatatccgactgggtatggggtgccctgtatagatagaatatctttaaaaggactcgggttaattaccaaacttgtatgtcaaggaaatacccgggatcctagtcggttacgattgtattttatctggaattatctattccgttagggatatggtttgtactttgtaatacggaccccttcccctatataaggaggggtccgggtgcctctaggggcacgattttctcccagatcatacgatcaataatacactctgcggatcaatccccggacaggagtagggtattacttcttggttaagaaggcctgaacctgtataaaatcccttgtctctgaacccatccacttttccagcttgatagccacccccttttagtattgccgaaatcttgtttcgacagttggcgcgccaggtaggggcagcgtcaagttcttcgccgactagtgtgatgggttccgtctccggcatcgacgacttcgtcttccctcccggacaggcgttccggttcggcagcctcgacttcatcaccaacgacttcggcaagatttctctcctcgactcggattcgaaccagtcgggaagaggtcagatctccgccccgttcggtaccccgaactcggccgaggtctaccccaagatcatctctgccgagttggcttcaaaccactcgtacgagatccaatctactcggacacgaccagatcaagatgatgggtcctatcccccaatcctgatgagacttcccgatgatctggctgctgtcttcacgaccaaggcatctcccacccgaagacctagacgggatccggcttcggcttcgatccaatctagttctagggaggtaggcgttatatttcagcctctcgggacggtctcgacggaagaattggattgctacctcagctcccccggcgtcagttctcgaccaacggagatcctcgagtacgacgacttcggctatcgctacgactacggtaacttcgacgacagctacgaggacgactacacgcctctctttttcggtgtattcatggccaacaacgagacggcagaacagtgctgagcccgagaagcggaagaagaacgcacacgacaagaagctgaatgtcgccgactggaggaagaatgacaacgacaagagcgagaacgactacagcgtgaacaacaagatcgcgaacgggctgcaaaggaggctgaggatcgacgacagcgcgccttggaatccgggcgacgagcacgagatctcatcgggcaacaagtcgtcgacgggacagcggttttccgcacaccctaacagaacgcggttgcagcgatcaccctcctcgacaccctcctcaaggaagacgcgctcaatcaggctgatcacgtcgtcaacatcttaaaccagacaaagaccatgatcgccgcctcggtcccggctaactccgcaagcacccgcacgccgactggcagccgagttccccctcttcgatctcaagactatcaccaaccaagcctcagcgtcatcggcgcgggatccagtcgcaggagcaggggtcacgacgagcgatctgtccattcgcctcccgaacgacacagggagcgtcgagttgaacgacctcgtaggcaccccatcgatcttcgcgataccatcaaccagcgccgcgcggcaagaggctgtgctcccaaccattcaccagaccgctacgacgacgacgtggatggagttgctgccttcacgactgacctgcgtcgagtggattggccagccggcttcaagccgagtggaatcgagaagtatgacggcaccactaacccggagtcttggctcaccgtctacggtctcgcaatccgcgcagcaggaggaggtagcaaagccatgatgaattatttgcctatggccctagcagattctgcccggtcctagcttcacaggctaccccgtggcacaatcggatcttgggcgaaacttcgcgaccacttcatcgccaatttccagggcacctttgaacgccctggcactcagacgatctctacaacgttgtccagaagtccggagaatcccttcgagattacatccggcgtttttccgagcaacgcaacaagatctccgacatcaccgacgacgtcatcatcgccgccttcaccaagggcattcgccacgacgacctagtcggcaagttcgggcgcaagcctcccaggacggtcaagcagatgttcgagaaagccaacgagtatgccaaagccgaagatgctattaccgcgtccaagcagtcgggcaccacttggaagctgaagaaaaatatgccgaacacaggggggagtggaagtaccaatcacaaggatcgcaagcgtaagcccgaggaacttgtggcaaccactacaccatcctcccgacaacgttcgcgcgtcaatacttttgataagatcatgaactcccaatatccgcatcatccaaattccaatcacgcggccaaagattgcttcgtctacaaacagtttgcagagcaatacgccaagaacgcacgcaagaccgctgacggagatcaaagcacgtcaaagaagaaggatgatgaagacgatgccccgactggttttcaagaccatcgcaaggaactaaaccacatctttggcggacccctggcttatgaatccaagagaaagcaaaagttgactgaacgggagatcaatgctgtccagcccgacacgccccaatatcttcggtggtcagagacgacaatcaagtttgaccgctcggatcatcctgaccgagtggtccacccggggcggtaccccctggtactagaccctgtggttcgcaacgtcaagcttcgcagatccctcatcgatggtggcagtgcgctcagcatccttttcgccaagactctggacaacatgcagatccctcgcacggaattaaaaccgagtaatgcgccctttcacggagtcatcccagggctatctgctacaccacttggccagatcactcttccggttactttcggcactcgggagaacttccgcacagaaaacgtttgttttgaagttgctgatttcgagacagcgtctcatgccatactcggacgcccggcgttagccaagtttatggctgtcccgcactatacctacatgatgatgaagatgcctggtcctcgaggagtcatatccctgcggagcgacattaaataagccgtcacatgcgacaaggaaagctgcaagatggcccagacccgcgagatcaccctcgctcgagaagaaatccgactggctgcgtccacagcaagcgaaggagaagtgcctgcaaccaaggtgccaaagagcggagaaagcgacgccaagaccaagaaaattcctctagatccctctgatcctactaagactgctgtaataggcgctgagttagattgtaaataggaaagcgcgctcatcacctttcttcaaaataataaagatatctttgcgtggaaaccatctgatatgccaggtattcccagagaggtgattgagcactctttacatgttaaggaagacgctaaacctatcaagcaacaactccaccgtttcgcacaggataggaaggatgcgatcaaggaagaattgactaagctgttagcagcgggcttcatcaaagaagtccttcatcccgactggctggctaacccagtcctggttcggaagaagacggggcaatggcgcatgtgtgtcgattataccgacctcaacaagtctagtcccaaagacccttttgggttacctcgcattgaccaggtagttgactcaacggccggctgcgagctactcagtttttttggattgctactcaggatatcatcagatccgactaaaagaatcctactgcttgaagacttcattcattacgcccttcggggcctactgctacatcaccatgccctttggattaaagaacgcaggagcaacttatcaacgcatgatccagagatgtttttcaactcagatcggccgcaatgatgaagcttatgtggatgatgtaatcgtgaagaccaaacagaaggatgatttgatcgcggatctagaagagacctttgcaagcatccgcgccttcaggatgaaactaaaccctaaaaagtgcatcttcggagtaccgtcagggaagctgcttggatttatggtgtcccatagaggcatacaagccaacccggagaaaatcaacgccatcctcaacatgaaaccgccgagctcacaaaaagatgtccaaaagctgactggttgcatggcggcgcttagcaggtttgtttcgcgactcgacgagcgggggatgccctttttcaagctgttgaagaagacagacaatttccagtggggactcgaagcacagaaagcctttgaagacttcaaaaaacttctcactactccaccagtcctagcttcaccacatccgcaagagccgctgttgttatacatgtcggcaacttcccaggttgtaagcacagtcctggttgttgagcgtgaagaagaaggccatgttcaaaaagtccaacgaccaatctacttcgttagcgaggttttggctaattccaagacaagatatcctcgggttcagaagctattatatggtgttttaattaccgtccggaaattatctcactacttctaaggtcactcggtcacggtggtcacatcgtttccactcggggatatacttcataatcgcgaagcaaatggatgaatcgcaaagtgggccttagaattgatgtctttagatatatccttcaagccgcgaacttcgatcaagtcccaagctttagccgaatttgtcgccgagtggactgagtgccaagaagacatgcccgaggagaagatggagtattggaccatgcattttgacaggtcgaagaggctttcaggcactggagccggggttgttttaatctccccgactggagaaaagattgagctacgtattgtggatacatttttccgcgtcccataacgtggcagaatatgagtcgctgcttcacggattaaggatcgcgatctccttgggcattcggcgtctgatagttcgtggagattctcagttggttgttgatcaagtcatgaaagagtggtcctgccttgatgataacatgaccgcttatcggcaggaggtacgtaagttggaagacaaattcgatagacttgaactcactcatgttcttcggcacaataacgaggcagccgacagactggctaattttggttcaaaacgagaagtagctccttccgacgtgttcgttgaacatctttacgaaccaaccgtgccaaggaaagaaacaattgaagccacggatactcaagacgtaagtatgattgaagccgactagagagagcccctcataagatttctgatcaaacaagaactcccccaagataaagatgaagccgagcggatttccaggcgcagcaaactctatgttattcatgagaccgagttgtacaagaaaagtccatcaggaatcctgcaacgctgtgtgtctttggaggagggaaggcaattgctaaaagatatacattcaggcatctgtggtaatcacgctgctgcacgaaccatcgttggcaaggcttatcggcagggttttttctagcccacagctgtgtccgacactgacaaaattgtgtgaacatgtgagggttgtcaatttttcgcccgacaaactcatttaccagctcaggagttgcaaaccatcctgttgtcttggccgtttgcggtttgggggcttgacatggtcggcccattcaaaaaggcagtcggtggttatactcacctctttgtggctgttgacaaattttccaagtggattgaagctaaaccggtcattacaatcatggcagacaaggctagagatttcttcatcaacattgtgcaccggtttggggtacctaatcgtatcatcactgataatggcacttaattcaccggcggagtatttaaagacttttgtgaagacttcggcattaaaatttgttatgcctccgtagcgcaccccatgagcaatggacaggtcgaacgtgccaatggtatggtacttcaaggaataaaagcgcgagttttcgaccgactgcatccttatgccggcaagtgggtagaacagctgtcgtccgtactttggtccctgcgcaccactcccagtcgagctacgggccagtcgccgtttttcctagtctatggagcagaagcaatgtttccgagtgaggtggaatttgaatctctacgatttcgcaacttcagcgaggagcgctacggagaagaccgagtagatgatatcaaccgactggaagaggcccgtgaagcagccttaattcagtcggctcggtacttgcaaggggtgcgtcattatcacaatcgcaatgttcgctcacgagcttttttagtcggcgacctagttctgagaaaaattcaaactacacgggatcggcacaagttatctcccttgtgggaaggaccgttcataatttctgaagtcactcggccaggttcttatcgactcaagcgtgaggacggtactcatatcgacaactcttggaatattgaacatcttcgtcgtttttatgcttaggcattacttttgtatcttcagctttgactgctaacatcaagcttttccttgagttatcagtcgggggctactataataataatggagtgtgacttttatcaattcaatttgcttacttgatttatcattgccttgtttgattttttggcttagtcaatgaggactgaaagttttttaacaacttttgtgggttttaggctcaaaaaggtttgacaaaaacttttaagaaatcgggagctaagtttgaaatatcaagcacaacataaattcatcagtattgtacaaattgtgcctccatcatcatcatcatcatcagaatcactgttacagtataatatcaatcagtatcagttttctcatcatcggaattattagatccagtcggccggaggtcgttgtcctggaatctctcaactacatcaatggctatcttgtcggcggctttctacgcatcgttgatgaggtcaagggcggcttcttcgctcgtcccgtctgcaaatccatcaatggtgtcaacatcaatcttcggttataaagacttggtcattgccaacgccaggcttgctcccatacttccggcctctttgatattcttaaagtatgtatccggagcgattctcagcttgtcgaagatttcggaagcatcaaatgtactcggaccattgttattgaagaacatggcttggacgagtggggtagcagcgttggcgacttcatccctagccccttcaagccttttgattttattgaccaagacatcgaattgagcctgagacttgattttgcgatctgcgtaaatagatttatatcaacgagtaggcataaagataagaggtattagtcaccagtaccttcaacatctttcagagccgaatccctctgtttcgccaatttggccttgtcattctccagagtttggatccgcttttctagttcagatatcttggcggcttgcactgtattgcttcttgattaattgatattacaaggatggcagcataagtaagttagacatagattgtatttaccttttgacgaaccgctcagttcaaagttggattcttgaagctcggcgatccgatccctcagatcatgctcagttttcctggcaagctccttagccttgtgcagctggtttctggtggtctcaagggttccaagatgaggaactaaattctcaagagtcgcggtcttcgcctcgttcctgagatggattctctgcaatgcgaatttatcggcatttgagcaaagtgggaaacaggatagttgaagctatgtataaggagacttatatttacgatgcgagtagcctggctgagtgcctttttcagcaagcatacttcctcatcttccttttgcttgtttatcacgattccctaaggttgcatatcatcgtcccaccatttgactaaaataggtggacgagaatcctcagctgactgtatccggaggacttcttcttcgtcgccgaccattgggccttaggcatttatgaataaaggtgaaacaattgaagaaagtctgtcagatcaaaatgggttcggaggatgtgtttacttgtgattatttccggtcggggacgagtaggcccttgtaatttaacaagagagccggaccctagatcgacgctggcatcctttttaggagggctgtcagcttgagtttctacttcaggaatatctttgtttggttctgtacccgactggtttccagtcgggggctcctgattagcaccaaccccagtttcggccgactggttcccagtcgggggctcgttgctgggttctacattgtcggtcgccggttgattgtcactcgggtgatcttctgcagtcgggtgatcttcttttgaagaacccgtctccatgtcagtcggttcagagtcttttccagaaagatctatgtcagatggcttcctacgagtttgagttatgctatcagtacaaatcggagcgtcgtttcgtcttccccgccgagactctcgccactttccccatttcccgctacagtgcaaaaccacaccggcggaagctagggttaacaaatccactccaatccatcctcctgagctccacaaaaaccctccacgcaaccaccgcaccgaatccccatccatttccagccatatctcggaccaaatcacaccatccagttcgtattcatgacggaagagagagaaagcttcgagagtcagtgggcgccctccgatgtaacagaggagaatttgaaagagatggtggcgcacggcgttcttctggcgaaggagatcattggatggcgtccagcattcggcgaagcattcccgacccccgacacacatgaagtcgtggtattttctcatttcttctatggcggattttctcttccaacctcgagattcttccgggggatttttgatttctatgggattagtttgcatcacttaaacccgaactccatagttcacatcgccaacttcatacacgcctgcgaagcttttttggacgtcaggccacattttgccttattccgtcgcatcttcttcctcaagccccaaccaaacaagagtaaaccatgcgtagttgggggggctggatttcaattgaggggaactctgagccaaaagtatttctccatgcccttcaaaacctcaaacaaaggctggcatgcaaattggttctatgtacaaaaccccgagcctgcactccccgagtactcctgtctccctccagtttatcaggactcttggaactcacttccaatgggagaggaagccgctcaggcgcttgccctgatggaccgtatgctgaagctgaaggagcaaggtctgcaaggagaacagatcacccggcattttatcaagagccggctagctccaattaaagagagatcctgtacagccttcaaatttgatggcaaacatgacaccaaccgtgaagatcctgaatctcttgaattcaaggttatgaaggaaagaatgtataaaatcttctcgaatgcaattgtagttagttattcgcacttgctgccagtggtgccatacaacgccttcaatccttctccaccggtatgtattcaaacatttcagcctttctcaaaagcatgcctttatctgctgttaagctaattgaaaactcgaaatgttatacccaggaattcgctttgatgaagtcggatcctccaattgctcaacgccgatcaccccgctggcgaactggtcaggcgagtggaggaccaaaaattcagtctgacactcaaacaaacacctcgaaatcaaccagtcagtcggactcccgcaagaggaaattggttctgagtgatgatgaaggcgataatgctagaaaatctggcaataaagaggtgaccgggaaacaaccaaggcaaaccaatccgaagaagaaaacatccagtcgtcccatgccgatttggtccgagatatggctggaaatggatggggattcggtgcggtggttgcgtggagggtttttgtggagctcaggaggatggattggagtggatttgttaacccttgcttccgccggtgtgcttgcttctgccggtgtggttttgcactgtagcggaaaatggggaaagtggcgagagtctcggcggggaagacgaaacgacgctccgattttggcgtttatttcgctagggtatcgggagtactaatgggcctaggcctaaacagtacttcagcccagttttgctatcagcgtgattaagttgtgatccatagggacttaggcatttgtttttgtttcgtcaacacttgctcacaacagtatagcccaatgctgttaaaatcctttttgacgcagttagataattctttggaattactacgatgcaaataaaaaggtgcataacataaaagtgttatactaattttgtaggcctttttaggctgcaaagattgtttgggttttcttgagatgactggttttaatacagtcatccactcggcatgttatatgcttattttgattatgtcatgagtcatagcctaggctatttagactcgtcttttatcagattttatgccacatttgataggtcttttgagagtttttactcggacttttatcatctgtgctgatttatgaacctttggagtgcttctcacttgggtttttctttatatttctttggcacattaaagcagtcggcgggaggtttaccagatgctgcatatgcttggccttgagatatttatcctggaatcctttaaagggtgtcgaaggcatattttttggcctaggcctaatatgtctgcagcccatattttcaggtgtggcctatcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttacatagctgccctactgacttttttatatagtcaaggtgctgtttgggtttataaagcagttgattggatataatatcattgctttttgccacgtaagtgtgcatttttattaactaatattatggctttggctgattatatattgtggtcattttccaggcggttggtaaatcgtttacgagtttatttactcggatgttacaccacatatgccatatattttcaggtgtggtgaaatcatgtgtcttttagggacttaagcacatctgttaaagaagtgtgctcatggtgtatgcccaatactttggaaatttctttattcacaacatcaagctcttctttatagctgttttgctatgtgaatttccaaaaatgttgtcaactttaggttgcacgcatcatattctgcaaagcagtcggtatatcacttggatcatattatttgggggattcacactgcatatgctatatattgatatcaagtcacttggttgataacaattatcaaaaaccactcggttggttggattatttattccttgactatatgcttagtttgttcaactaaccatatagtcgagggctacacctaattaggtgcatctagtcgatgcacctgattttttctatttttcagcccttcacagtctttgattatattactcgggagatcaaaacagatgaagctaaagcactcggattgtcttttcggattatgagagaagattattccgtcgactgtaaaggtctcaggggctactgtggagattatggataccccattcctacacggcatgtatatccgactgggtatggggtgtcatgtatagatagaatatctttaaaaggactcgggttaattaccaaacttgtatgtcaaggaaatacccgggatcctagtcggttacgattgtattttatctgtaattacctattccgttagggatatggtttgtactttgtaatacggaccccttcccctatataaggaggggtccgggtgcctctaggggcacgattttctcccagatcatacgatcaataatacactcggcggatcaatccccggacaggagtagggtattacttcttgattaagaaggcctgaacctgtataaaatcccttgtctctgaacccatccacttttctagcttgatagccacccccttttagtattgccaaaatcttgtttcgacaaaaaggtaaagcttgttatagcggcttgcgttctcgggattagtgcttacatcttcatgacactctaatcctgtttatataaatcgtcgagttatcatatatgctatgtaatctaggtcgatcttgctacctaacctcagcggctagcctctatcatcgaaaacagtcgacatggttagatactgacttcgaattagattacatagtgcatctaccatcttcaaaaggttgccatcgacttgtttaaattttatgcttctttctatgtttaatgttgtatcagttaagtttgatccattaaagcattacctggaatcgtaatatctagcttgtttcatgactgctactagagatactattggggtttcagccgatcttgcctgatttagttgtctcgttacttatatgcttactcgacatactgaatctaccctttatattaagatctcttttgaatgaaatatattaaatttgttggtttattctaatgagtaacgagtggtatcggagtattagtcgatacgcattagatttaccctatcagctatgctatgaatatgtataatctttactccaaagcacttttaagcgcaagtaatttatactgtctcggcacactgcccgatctatcccaatcgcttagcttaaatatattcttgaaatatagattatatatcattgatatctacagccgatcgagtggatctaactcttttctcgttacttacttcattgccgatctgacctgcgttacatcggcttggtgctaaatgatatgtcatcggcagtccagccgatcggctatcgtttatggatttaactttggattctttgtttcttgttggttgcaggatcaaactaactagcacgccctgaacctgaaggcaaatctttggacctgcactagagtaaagcaaacctcgccagtgtgtgtttttcacatcaacaccttccaatccttgtacacatgtatgattagcaggaggttcattttatcgcatgtcgggtgcatttttatccgtaaatggcctgcatacgtatatttaccaaaactagtggaaggggcagtgatgtcgacgcataatgggcgtagctgccaacatgaatttgccgcgttgaacgacggacttgacgcatgcattgcgaacggcacgggtgcagccgcaactacaagccatagctcctttcctttcttcttcttcttcttcttcttccttctttcttctttcttccttctttcttttcttctctctccctccatggctgatgccaaaaagtggctcggtcggccaatgacagcgtgacgaccgatggctcgatgcacgaaggtgcactcgaccatgatgggatgagctcgcacgggcttgtgtctcgcgaacgacgaggccacaagacgagcgtggaggccgactgctagtgcgtgatggcttgctcttttgcctgtccctgtctggaacgatacgacacatcttgtgtggagataccccaatcggcttgcgccggcgactccaagtcgacagttgcggtgttcaccaggaacggcaaaaacaaaacgggatggagagagtatttcattttcgtaattagatcagcgaatgcaaaacggatctacgagttgtcatccttctatgtgaattagaaaaatgtgacggtgatgtcatagatctaattttacaaaatttcagtggcacccagccaatatcacgaatagtagtggtatttttctaatatagaaaatttacgatgatatggatccaatctatactttttataaagttaaagttatagtccactaagttcaacatgctaccacgccacatcattacccactaccaaaaattacatattcaacctcatgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctgatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcggaatggcggcgccgcccaaggccttgaaggcggagtacgccaagtccgggcggtcctcgtgcaagtcgtgcaggtcccccatcgggaaggaccagctccggctcggcaagatggtccaggccacgcagttcgacggattaatgcccgtccgtatcctctccctccacccgctctcctcgccgacgatctttctccgttcagttgatgaatcttgctttgatctttagggtctgggagggtagggttttggtgtggcaggcatcgtgttcttgagggttttttgtaggttggtttggattctgagaattttctggattgatgggtgatcggttttcatcctgatttgcattgcgggtgtgggttttgtggtcatctgccacaagaatcttctgctttcatgggtggttggttttcatcttgatgtgcattgctaatgtgggttttgcgggcatttgccataagaatcttctgctttggtgggtggttggttttaaatcttgatgcccgaaaaaaatatgtttctgagggtaatttcgcatgattttgtggggtatgatcgaaccaatcttcttcgaatgcggagttcttgatgcatttggtttggtgctctgtcgatttgtcgatgatccgtcaattccagcattgggtttattgctgtttctaatccattatgcaatctatatgtgtaacgcaagaatagatagaggtgcttttgtgggcaccaactttgacatatgcaatttaactggtatttctcctaagttgtttgatatattagttattatgcggacctgccagttggttgtgctgttttaggcttttagcatggcaatggtcctaagttgtttgatatattagttattatgcggacctgccagttggttgtgctgttttaggcttttagcatggcaatggggcataccaatgacaatgttagtaatctagtgtgttcgctaatctgtttttgttcttatctgatgtgtagtttgcaaattataatctaggtattcgtttgcccgctttattttctagtttgcctcttgtaattgttttgtgggtgcatgtgtattataagtgcttacctgtattaggcaagataaaacttggaggggagtccttattctatttttcattttttatattgcacatttggataatgaatctttatttcttttggtcggatcaactcagtactcatgtggttatgtggactagacactcaaattatttcactgggaaatgtaggatcgtttagggcaacttagggggtacttttggatctgcatgccatttttcacctgaccatatctttttattttctgtgatggcccttattttttacctgaccatgttctttaatatggagtgtttataacgttgtaccttttctatgtttatagtaattgttttattcaagaactataactgtttggaacttttttttggtcatggtagattctcgatggtgcagaagagaaaactcgatggttatatgacatatctttccatatcaattttacgaattgaccacttccaattaattttagtgcccttttctctttttcagatgtggaacatgccagttgcatcctcagtaagaaaaaccagataaaatcgtatgcaactttatcttttactgtttgcatgagtttcacgctatagtattatggtttattaatctttattgcatctattggaaatctgacctaactcaaagtgtcgattcttcatttcaaattagtgttgatgatgttgaaggaatagacacactcagatgggatgaccaagagaagataagaaattatgttggaagtgcaccagctactgcaagttctgcagctgctatttcagataaatgcaccattgaggttgctaaatctgcccgtacttcctgtagacggtgtggtgaaaagataaaaaagggaacggtctgtatcttttgatctattaattttttatatgctttctaattcgtcccttgaggataggaagttttatgccatgaaaattttatgtttgtactttgttgcttttcaaattatagtcatgaaaataacctcctcttgatgattaacaccttacagtcttatatgagcattcagctaacaatcatagataatcagaagtttcacattcttgaatgaaccttgatgcagcatgtaagaataattaatcataacatgtttcctattccttatagttactccctgggaaaaatactgtattgtccaaaattctgcatgttactttgttgttctatactttatttatttagaacatgaactttagcgctcactaaggatgaaatggatacccgacttggtcctagcacttgaacacttgtagctggggaggttaaatagcttccctaccactatgccattggcatgttcttttattttctgaacttgcatctgggaaatgtatggttctgatacgcagggacaccataggttcttttctgtaccctattccctgtggcctgcatcatgttgcatataatgcccaagcttttgcactggaattccaagtgaccagaaagcctaaaggccacagtttcccatttattttgtagttactctgctacgtgccactagcaagcattagaactctgaattttgtgttaagtttactttatcaaatgaagtaacctgcaaatgtattaattggaagagtatttattatgttcatatttcttattcatccacactcctagttgagtactcctaatgaattacaataattaccgtggagaattatatacaggaaaatgtttgatgatccagaagtactattagtcatgcacttagctaataatgtatgttttgaaaacatatgaattgtaactgtgatatggcaacttgtaatgtaaaaacatggtctttgtcttcactctaagttgtttctgtaatagtattattatttgtttgtctaggttcgtgtttcatctaagcttgaagggcaaggttggtatcacgccagctgttttctggagatgtccccagctgcaactgttgagaatttctcaggctgggagatcctgtcgcatgaggataaaagagctgttcttgatcttgttaagaaagatgcccccagctcaggtaatgaaacatgggcatcaaattttcttcgcgccacttcgtaatctgacttgatattttgtattgttgtttctcaagggcaaacatcttctaagggttccaagcgcaagaataatcagaatgatatacacgactgcaaagctcccaagataatcaggagtatatcagaaggcacagcagaagataaagggaaagctgttgtatcacatgattccaatgctaattcttctgatcttcaagaaaagcttaaagagcagagtgacacactttggaaattgaaggatgaacttaagaagcatgtgtcaactgctgaactaaggaacatgctcgaagcaaatggcaggatacatctgggccagagcggcatctattagaccgttggtaatattgcatgctatttgtgaaatggtttttaacttcctggcttcctgcactacattatttccatccaatgagtaattgatatttaaacaaactgcactacaaggatcccgcatataaatatatccttggccagttggccgatgctacttgatagaggagggtacgattataactgatgatgaatggtactagtgtacgaaatttgtcaggatagttgttccccaagaccccaattggtcatctatgtaattttttgtcgctagatttattttctgcttgctttctggatcccaaatcccagttgtaacatcctggttatagggtttgtgatactgatcgcttagtggaattcagaattgtcaccgtaacctaatgattgcacactatttgctttggttcttttgtaatctggttcatgtatacaattattatttccttaaaagtggctataccttttctttctaaaaaacacattttaaaaatttgatgtgtgcagagaaatttcaaagtcaggcagcacttaagatatttgttttcaggcaaaaattgttcaatagtatttaggtctgaattttttatgtataattcaaggaagacaaacattattgattgcataataagctttacaatattgttggttgcgtagacctgcttgtggcatttccttgtttcatctcacatagaagtcagtacacttcgtcgctaactttcttcctcgtctggcagtgctgatgggatgctttttggagcattgggtacttgcccagtttgttctagcttcctatactatcatggtggccagtatcattgcagtggctatgtgtcagaatggtccaagtgtacatactctacgacagaacccgtgcgcagtaaaaagaaatggaaaattcctgacgaaatggataatggttatcttacaaaggtatgactatggctccccacccccacccccacccccacccaaacccaaaagaatatcgttcttaatgcttggtttctacagttgaggtaagcaaatatgtatgtatcttgcagtggttcaagtctcaaaaggctaagaaaccagagagagttcttccgccaatgtcacctgagaaatcattgtgccaatcaacccagcaaaaccgatctttccttagtgaaggactggataaattgagagtttctatagtaggacaatctaaagatgtggttgtaagtgatcttttactttttggtacagttatcctcaggttctcttgtgagttgtgttcgttaaagcaagcaccaattatgccatgaccttgctgcatgttgtggcatgcaccagacgccctttattttttccaatcacagttactttgcttacattgttatccagattgattcttaccatattatacagattatatatattatgcatatttgttgtgtggcttgttgacatgaaattggaaagtgctcaactgtacatgcttcatatatttgtttgtttaagtcaattccttgaagatagctagtttagtttgttaatttattccttgagttcctcgattatttctttaatctccaaaaattttaatccatggaatatgcagagtgaccacatttagattgcagagcaaaggttaggagagtgtaggttttttccctatgtacttgattcagttcatgttaaattcatgtcatttgttgaataatagatcaaattttatatgatctagcatgctgcttttgcatcaagtggtaagatagatttgcaattatttgcatgggatactgttttcttttattttttcttctctgctgatcagttattgggctatacatttttctttttcttgttttttggtttgtactttgtacattcctctaaactaatcatgtaatccaactactgtaggatggatggaaacagaagctgaaagatgctggtgccaactttaatgccacagttaccaaaggtttttcctcgtgttatcttttttttttctgaactacacaggatttcctcgtgttatccagaactggaactatcttgttcagacatttgaacctttcatatttggttacgtatgacattggaacctatatcttcacccaagtgggtgagcagtttgacaccaccccatgaccaaaagccaccactcaaattcctaaaattggctggctctcacgtatgtgtaattttagactaatacatgacacttaatctaactgatgttttgaaagtataagtaaaatgcattgtctaactcatgattttttatgggagagatggattatggatcacttatgtgcaggtgataattttatgttatctatctgactgtctctatttctgtaagaacatatgggcattgagccagtatttttgtgcagctgatataatgaactgagtcatgtgacttggtcattgtttcataggttaggtaagctcttagtgtttggtgaaatcttttcgcattattttcacatggaagtcttgcactgcagacagcagctgcttagttttatgtagtgagcttgagagtgagaatgctgaagtcaagaaagcaaggtatcacattttactttgcccttatccttttacacttacagtttgacctattgttttgcgaactactgtgttacctattgttttgcgaactactgtgttaaaataccattatatatgctacttcatttcaggaggttgaagataccaattctgcgagaaggttaccttggagaatgcattagaaaaaacagagtgcttccatttgatttgtataaagtagaagctgcattggaatcttcgaaaggaggcacaatgactgttaaagttaaagggcgaagtgctgttcatgagtcctctggtttgcaagatacaggtcatattcttgaagatggaaaaagcatatacaatacaaccctgaacatgtctgacctgacacgaggtgtgaacaggcaaggattttgctcacagcatttcttgtcaaattcaggatttgcacttttaggagtgattgtcaaggcatatttcatatgagtgatatggataaaccgataaaccctccagcaattttagtcaccaaacaaagaacgtggattgcttctcaaatccaacttcccggtcttcccttgaactaacagaatgatataatgctaaatttcccatggttgttaagttataatgttgagtcaagtgcaaccatataaaatagcatgaacattttggaagtactttggtctggtttggtttggtttggttttcattacatatgcccctgaagtcatagccctcgtctcttgttcaagcccaacttagctttggttgtcaatcattccacgatgtctcgtatacatatatgaatcacccgatctagaatgtcttatttactgccattctgcaataaaaaatgttggagcttgcacaaatttctgtttcctttcctctcaatttatgttcgggagcataacacactgttgaaatgagggggaacttttcttctgtagtattaccagttgctaaatttctgttaggttattgcaaataatggtgaccctgcttgccctacttaatcttttaacagttctctctctctctctttttgtctgtgaagctattatatacttcaggtcattgaagaggataatgggtctgattgttatgtattccgaaagtggggacgagttgggaatgaaaaaattggaggcactaagttggaggagatgtcgaaaattcatgctattcaggaatttagaagattgtttcttgagaagactggaaacccctgggaagcatgggaacaaaaaacaaatttccaaaagcagcctgggaaattttatccacttgacattgtatgttgtgggataatgtttttacctgctggatttttttcccctttttagtggatcatgtggattcaatctgatgtgtttaatatattgcaggactatggtgtaaggcaaggaccaaagcggaaagacattgacaaaatgaaaagttcacttcctccccagttgctggagctcatgaatatgcttttcaatattgaaacatacaggtgcgattttactgttctattttcaggttttgcatgtgcacatgctttgtttttagtattagaaaagaatttcacattattttgtaccagggctgctatgctggaattcaaaattaacatgtctgagatgcccctgggtaaactaagcaaggaaaatatccaaaaaggtgtgatactttgctcattgtggaactcattttgttgatctgtaagtccaaacatatcatgattctcttgcctgcactgcatgcaggttttgaagcattaactgagatacagaatctattgggtaacactaataatcaagaactggcggttagagagagcttgatcgttgccgcgagcaatcgtttcttcacccttattccttctattcatcctcacattatacaagatgaggatgatttgatggtgaaagtatgtgttcattaccttgtgttatattcctgtatattgggaagatattccatgactattcttattttttaaaatcacgacagttttaagtgaaatattttgctataaaaccttccttttgcaaaagaataaaggcgttctatgatcattgctgaaattgaaatgggtccattccacgcacagatcgtacatgacttgtaatgatatcttggcagttaggcatgttccataatgctcaaatggaatcgaaggaacacaaaattgttatttattttgtcatatataaatttggcttccagtaaactatgttattgaagtaaaaaaatgtattttcgcactactttcatttatggttcaagttctcaatgactctcattttgctatctagttggaacattttagaggatgttataataaaaaactaacatacctatggcatttttccttttcttttcctttggttcttcacatgttctccttgccattagatacagtgctgttcttaaatgcaatgatatctcctgcatattcaaggaaaaatgtgttataactgtccaccgtttaaagggctgttttggttcttgtgttattttcattcttattttctttgactgatcagatgtatttcttattgccaattgtaactttattcagagacccaattgactgtaactttggtgcaatggtgcaggtgaaaatgcttgaagctctgcaagatattgaaattgcttctaaacttgttggcttcgatagtgacaatgatgagtctcttgatgacaagtacaagaaacttcgatgtgccattacgccactccctcatgattgtgaagattacaagctagttgagaagtatcttcttaacactcatgctcctacccacaaggcatgtattttcttctgtatacaaaaaccttatagttttttttttctcttttgtagatagtacaatacagacgattgtttctgttttcttctgtataggtattgacatgtcctctttttaaatcttttttgaaggagtggtcactggaattagaggaagtcttttcgcttgatcgagatggagaattcagcaagtactcaagatataagaataatctacataacaagatgttgttatggcatggtaagcaatctatccaagtaatgcaaacacatttggcttacgcaatatttgaaaaggtttttatactctcagtatttagtgccaaaatctaggtttgagatgaaacttattatccatgcgcagtctttgccatggcagtgcgtaggtgaacagagggttcacagtcaatccaacagttgtaaatgtttattttactagttcttcgtgtggtttactcgtgttgtatgttatgttgttatgtcagtatttaaaaggctactttttttgtaattgtactggagatctacttaacgtccctaagtaactctttccttcctaccatttgaatgattccatgattgcaaaacttaatttataggttcaaggttgaccaattatgttggaatacttagtcaaggactaagaatagcacctcctgaggctcccgtgacaggctatatggtttgctctttgttcacttcataaatggttcaactgtagcactggcaaaagattggttgaatttgattaagctattttcctttcaatcaacagtttgggaaaggcctctactttgcagatttagtaagcaagagtgcacaatattgttacgtggataggaagaatccagttggtttgatgcttctttccgaggttgctctaggtgacatgtatgaactgaagaaagccacggtaagatataaagcctctcactaccaaaagagaaattctggttataacattaacttgaacttctatctttgctttgaaatatgatcctgctttaaggaattgaccatggcatttctttcctgatttttttattgtgatctatatttctttgctgattcataattataagaaaaagctcaacgagttactcgagtgcaattacttgttttttttccccatgtttatcttggcttggcaccacactcactggcttactgctggctgctgcagtccatggacaaacctccaagagggaaacactcgaccaagggcttaggcaaaaccgtgccgctcgagtctgagtttgcgaaatggagggatgatgttgtggtgccatgcggaaagccagtgccagcatctatcaagacatctgagcttatgtacaatgagtatattgtctacaatacatcccaggttcagtcaaattgttatccatactcttttgcgcgcttctgttcatcagaagttcagttccttacctttcacgaaaccttatctctggcaggtgaagatgcagtacttgttgaaggttaggttccatcacaagaggtgactagaagacttgaggtaggagtagaaatgtagaattaatcagtggaagtatctccatcgttatcagtagtctgtggtggctacgcttttgatgtgttagaatgatttatccagtagtttcaggttggtaggaggttatgtgctgctcgcgtatgatccgttttggggtatgttgcatgggcatcgcgcgagtggcgcaagtaaatcccctgcgcatgccatgggcatttgatagatgtttgcctaattttctgtggcaatgtgcgcatttggcatctctgtttagcttgctattttatcatcactcgcgttatttgtgcgttgttgcgttttggctatctttctttgtattttgattcgaggtctatgttaggatactgcaatcgaaataaactgaacagcattagtgaatagtgccgtctgtaggatcaaagatagaggcgtgtgactgtctagcggaagtaatattcttctatcctataagtaacggttagtctagcacgacaattcgatgagcatagattgcaatagtttttccccaggtattagtgatttggtaatctccgcttgttttgtgcccttctttcactctggtttgtcgtcgtccttcacccttcgctcggggtgctcccacttcctcttagagagatcacttgacttgatagccacaaagacacgttatgaccagcatttagcctcaaagtaatatttaaccatatgatcaacaatatatagaacttatcattcttgaggtgtggccgtcatgagtttattccaatcatattattagaaaacagtaggcaccgcacgtgaggctcaggcgtccacgggaactgccgacggcgcagcaggggcatgcaggatggccttgggctcgtgctcttccttctcctcgtcctcctccgcctcggcctcatacgcgtcacgttcctggacccagagctccgcgaactcgcagttcttgtactgctcgaaccacggcccgccggaagtgtagtggatggcgcgcggcgccgtcccggccgtgtcggcggggtcgacgcggttgtgccccacgaggaagttccacacgaagggcacctcgccgatgtcggcgtcgtccagccacatgaagcggtgcaggtacgcgccgctctgcgtgctcacggcctcgggcgtcagcgcggcgcggttctttgggtgggcgcagttgaagagcaccatggacgaccagttcttgcgcgggtacaccgtctgcacggcgccgtccatcttggtggcctccttgggcgcgtagtcgtggtgcacgcacagcaccgcgtagcgcgggtcggccatgcgcgccagctccgcgacgtcggcgacgaagaggaagtcgcagtcgacgaagagcgcccagccgcggtagccggccaggtggggcgtcaggaagcgggtgaaggagaactcggtgctctccgtgggcccgcgctcccgccagtacagccccgcagaccggagctcctgctgcacgatcgggatcacggccaccggcacggaggagcgctgcagcagggagcgccggcacacgcggtacgcgatgtcctcgcgcgagtcgtacccgacgaacacgcggaacgtctcagcggcctgcacgtcgccggcgccagctacagggccagtcatcacgacgtcgttggtaggcgtgaccgacatagtatttgttggtgatatataagcagaaggttagtagtactgtttgctagcttccccgcaaaaaaagaaaaaaagagtagtgtttgctagctcctggtgctacgtacgcataggccgtgcgagttatcacaaactcctccgcctttttaataagagcctaagagccctttgtcctttgagtgtggggagcgaattgaaacgaggacatgcgtatatgacgacatgtacgtcaacagcgttacgcttgcattattaggcccagggagatcgatgtccagaattatgcatatgtgtttctcttcttttgttgccaaaatcaacaaaattagataaaggaatcctatagctaaccgattgctgtgtggtccggcgccggcggatgcatggcgacactgcactgtggtgtgggcagcgcgcgggcgggaccgacgacagcgcgcgcgcggttgctaatttgtacgggtaatacgtggtcctgtcgtgtgaactaccacagcagcacggcaggaacacgcgcagctgcatgggcagttgggcactctgcctccctgcgtcgattgctccacagtcgtcgtcatgtcccgatcctaattatcacgtcaaaacagctaggcaagtgttgcttgtttttttttttagataataagtgttgcttgttgctccatcgttttcctttttcaattatatatgttattattcacattttcactcagtattttattactaccttgtagaagtttatcgagaatgcatatagtcaaaaatgtcttattttggatgtccagaaatgtttataatttgagaagatgtagtaaaatttacatccaaaatggacaattataccttcctttcgtggcttcacttccatgtgtataccttatggttgtaaatatttaacatttagaaaaaatattggttaaacctccaattttacaatagcataagtttataaaatatactacatcctattcttttttacttgccgttttagacattgatacggatataatttacatattttatcattactttttctaaacatattttttacaagctataaaaacaataattatatgaaagttttttttacaaatatctactgataccattttcacgtgtcaactcctaatattttagaattaactaattaattaatatttgattttaccattaattttaagacatcatctacttgagaatctacttgagaaacggatagtaataagtttaaagaatggtggtggttttgaaatcgggatcctctggattacagtttgtaatgcatatgaccaagagcagatcatgtcatgcgcttcggtactcaatagtggattacaataaatacagttcgcatgaataatgagcctctgcattactgcagaggatccagatctatggctttgacgcacgtttatgcatgcatactaattttttaaacctaaacatttgataaactattattaatagtgagattacaccagtaccaggcttattttttggtactaacctccgcctcatggaatttttttttcttgtagcacgcatgtaattttttttcttgtcccgagatggctgcgttgcctctcgtacgtttggatggatccgcgagggagaagcgtgaccctcgtggtagcatcccgatgatggaggagcgatgccagttgcttcccttgtcaccatcggaaaacaggtgtgtggtttgagctagggatgacaacgggtcagatcgggcacggcagagtaaaatcatgcctgaacccatgcccatcgtcgcttgtccaaaccttacccactagggttagcgggcaaaactctgtgcccgtacccatgcccgacgggcacgggtatacccggcgggtacttaatggatctcatatgaatagtaactcgaaagatatacagtttaacaaagagaaataaaatcaacaatttaacaatttattagttatcaacaataatttgaattacatcataacttattacagtggcgaatccagaatgaaaatagaggcggtgctctaatgaccagtgtcaacgttgggaactagaatatatcgataagtgaaccatgtatatctcactatgtttgtagaaaaatctcacttttttagctctaagaccgtcaatcaaagatcattcatatttgctaatatgaaattaatggtgaagaaccacgttgtctcgttgatttcacacctctctctagccatcaggtctctgcccccatatataactacagctaaaataatttgaaatgtgccatatcatagcaactgtgactggagcacaaaacatccgagaaaacaaagcatgaaagcagtagtccaagtaccatctagtcattttcttcctccaaacggtagctagtcataactactgcagcattagtgacatagggatacttaggacctagtagatggagctggggcttgcgccccaacaagccccaatactaaattcgcccctgacttattattagttagtatcacaaatgaaccaagagaaaggggcataacaattaagagataagtcgaaattagctaatacatatgtatcgggtcgaacatgggttacccagaggcaaaaaaatgaaacccggttgttacccacgatgtctacgggtttcgggcggacgtgcccacgggtaaaaattcacacccacgcccatgcccattgggtcaggtatccgcggatacccggacccataggcaaaattaccatccctagtgcccacgggtaaaaattcacacccacgctcatacctattgggtcaggtatctgcggatacccggacccatgggcaaaattgtcatccctagtttgagctatactcctagttaacaaacaattataggttagcctggtgatcactcgatcagatatactagtaccgcatatgccacctaccacacacgtacggccgcacccgaccgattgatctttaactgtgttgaggactcggcgacgacatgtcgctgtgggaccacttcgattgatcgatacccggttgttggtcagatcagtttcagcgtcttatcttgatagtcatctttaatttgatagctcgtatgtaggatcaaatcaagtgaactaagctagaggtgaatagtaggaacaccgaaaattagtttttagtgtaactaaaagttacgctcaaaatccgatgacgttaattaactggtatgaccggtctaatcaccctctaaaccactgtcatcgatcgccaccgctggtctagccgctgtgaagccactggtgtgaccaccgtgccctcacaggtgtgatcaccgaaactgagaaaaacacaaatcgaaaaactcttgaaactagatcaactttattgtttctaattgtttttacaaagtgcaacaacagtactactctctcaagtttcgactaaacttgaaatttatactaaactctattttttctctcaactaaactctcaaaattgataccaatagatctcaacccatcttctatttatccccgaaagtagcaacccaaaagccataaatccacattaataagtagtcctaatccactagggaacctacccatatgcacgtacacacactacgccagatcaattcatgtgacggaccaaaatatctcgtcacaaacaatatcacctttgacgggttaaataaatctcgtcatagatgaggctaaaaaaaatgacccgtcacaggtaaatagtatttacctgtgacgggtatatataaggacacgacacatgacgtttgtgacatgtccacgtataaacccatcattgatgagtacttatatgtgacgggttttaagtttgcacccgtcaaaggtgagtaacctcacctcagatattccatcaattttgacttataaataaggaaaccccaaccctcccccactgcccactgcccatctcttttctctcttctctcttctctcttttctcttcctccaccatcgcctctcccccaattgtgcaccagctgccgcggtctccttcccatagcagcgtcgccgcctcctttgcccgccgtcgtcctctaggagctcagggtcgccgcctccttcgcccgccatcggcctccaggaggtcgggcccggtggccttaacatcgacgccgccgccaccttctgaccgccagtcaccagattcgactgccggtgccttctcccgcctcccggtcgctgacgccgtcgcctcccgaccgccgggcttcaacactgacgccgtcaccgcctcctgaccgccgatcgccagatctggcccccgagaagccggatctggccgccggcgccttccctcgcctcccggccgccgacgccgccaagtctggcctccaggacgcggatccagccgccgacaccttcgccacctccgcaacctcttcctcgactgccggacaccgcctccttcgccgccaaccgctgaccaccagatccgacctccacgaggttgtgggatgcggatccagcatccgcagcctttccttgactgccggacgccgctgcctccgccaccgaccgccggccgccggatttgtttgtgcttgatgtcgtttgtgcttgatttgctaatgtttgttgcttgtgtggatgtgtagtttgttaaaattgatatgggtacttgtgtgatgtatattgttagattgcttcatgtgtagttttttgttgagatgtatttgatttaaaatacaaagttgttgtatcgtgtgcatcttgagatgtatttgatttttcttcatttcgtacatttggggtgaggaacttctttttttctgggtggtttttgacatctgtgacaggtgggaattaaaaccagtcacagctgttttgtcacctttgatgagttggaaagagtcatccgtcacaggtgtgagtcacgtgtgacgggctatatttttctgcccgtcaaaggttttaattaccagtgacgggctttcacccgtcaaagatgaagtgtagtcattagtgaccactaatctctgaccaggactaaatccgtcaaaggtgagggttagaacccatcacagatgaccggatctggcctagtgacaacttatccctttacaattcaaactttaatcttcctacatttggactctttccaaatttgactctgcttttcattcgcacataatctctcttgtatgccgtatggaatcttcacaaccacgcgtattgttattcagtctgagcattccacatgatctcctgatcatccgaacattaacgtctcccaagtcggctttcaatccatcaccgccaatgttctttcgaggcatcaagacacacctgcacatgaatcaaataacaaaccatattcgagcacaagttatttcccaacttgactcaacattaagataaaacagtattacacacgtatagaaatcataaacatgagataatcgcgagtatccaaagaaaacataaaaccgactctaaacaaagtccaaccgatcttaccgtagccacaacaccagtctaaccggcacaccctagtcgatctgatcgcaagagccaaacaaaaatccctgttttcgtactatcactattcaatatattgcataacagaacttcaccaattatccaccaaatttcaaaaccaatataaatcacatatcaattgttcatcacagaatatataaatgaaaaacattgattttacacgcacgtctacgattcatgagctgccagcaacagatgcacatggaaatatagaaggaaaggatccggtcgatcgaagttttcactaaaacttcaaagtcgttcatgtgaatatatacaatcataaatcatgtagcaaagtcccttcataaatttatgtcatgatgatatatagccacgttgccaacgcactgtgcaactactatatatagtgttattacagccatttttatacgttttatttttgctatttatcattaattagttgaccttttttttctcttgtctgttattcaccccgactgtagtttagacatgcaacttaattttgaatacagataaattgccatttttgtttgctttattttttaataccctaaatttatctagatgtatttatagttatatagataatattctaagtgcttttgtatcactttggtgtaattggttaagttcaacaaaatctttcattatttaaaaagagtaaaatgtgcgggtggtctctaaagttatacatgggtgtcatctaggtctctaaactcttctcaatatatatttttggatccacaaacttatcatgtgtgtcatataggtccaaacgggtttcaacccactctctgtgcactgacgtgacatgacatgaagtatatagatgttctgcatagcacatagacaacaataaattgtttcaaatgggactttctttttttccccttaaagggatatcgtcatatctacttttacgagcccacaacaaatcgggacctccacattcatgcatcattagattccccacccacatatgcactttattagcaaattataaactattttttcttacgaattaattatccgatatgtgatctgattgtattattaaatttattgcaattaaattttacagagagatcccacatgaaaatattttggataaaaaatattcgtaacagaaatatttttatatgatatatgaaacattgagttataaccgatgaaacatcacaaaatacttgctgaaacatccaaagaatagcacgtgtaacaatctaaaatgacccattaaagcatcacaaaatacatcccgagacatccccaaaaatagcacgtgcaacattctgaaatgatatagtgaaacatcagctacaattaaacatcgcgaaatacctcctacaacatccaaagaacaccctgtgcaacattcaataatgacatagtgaaacatcctaaaatacttattgtaacattttaaatccattgcaacaaaaaaaaacttctaaaagcaaatcatcaaaatatagtcatgtgagatctaaaaatgtttgtgcggtgcagttgaatggtaccattgcaattgtgaatgatgactccgaccctaggtctttcgagtaggacgggcagtagggagatatcgatgactattcatcactatcttccttagatgatgaaggcccaacttcattttataccgaggaagagttgcagaatcttaagaggacgaaagatgtcttggttgaaattcctattttaggtgattgcttacaatggatttagccatttctgtccttttaaattgcagtgaaaacaaagaacaaggaatcgaatatgcttgaaccattcatatcttcaacagataaatcaagtccatcaaaaccactctaaaatggattcctccaaaccattcattactatggagtttactaatagtaccaattttctaaatacaaacttgttatgttcatcataaaccacaatggtcatgaaattaataaacaaataatcctaacacatgaaattttctaagtgaacaatggaaattatttcttaaaagacacaaaataaatggggctagctgaactgccacggcaacgagctgggcgtggcagttttcagctgccatgtcacggagcctgacgtggcaataggtgctacgtcgaagccggcttgaccttgtcaatgccaatgattgccacggggcaccgttgcccatgccaagaccggtggtgtggcaaggtagtttggccacaccggttacaaatggcatggcaaaaaggttcatttttgaaaataagttcctgggaggccgttaaggttcatttatgttatgttgaaataagtgaaaattatttattaaaatggtctaaaataaaaagattccaccacatgccacctaccacatttttcgtgggatatactagcatccgacgccatttaattaatctaagcatcatgctcacattaataaataatgatactaattaccccgggactccaaccctttagatagactagttagaactagtgcaacatattaaaataattagaccgaagccgtggcatagatcagctagtccaatcaagtgaagcacaaactattcctataacacataactaataaagtagtatatgaactataaacactaataagtgcaaaagataattcctttatgaaactcatagtcttacaaagagagtaaagtactaagaacatacccgaatctccaagaagactatggaaccgaagactattctaagcttatctccactactaaagagaaaacaagtatatgaataagaaaactgctctctaagtgtgtattttgagagtgaaggagtgatttctatttataggctgcttatgacgattgttaagtcggtaatcaagtgcaaccgcctttgagaagaaatcatgagttgccacgtggaggatggagatgagaggtggcgatggtgttggttcgagtgacccatgcatgggccccatctctctctaccacctttctccaaggattgacatgtgggcctctaaggaggtgcacggtggtttggcctcactttaagtcggtttgagctgacttatggggcatcaatccatgtgctcacacatgattcaccggagatgtgtttctttgtatgccggtttatttctccttcactttattgtacaattactgcatccgtagtaattctccgagacaagtgaaactacattatttacaactaatattcatgtaagaaatattagttctccttttattatttgaggaaattgatggttgaaatcggtacttaataaccgtcaatgtaaactattattaacagtaatagtaaaagattacaccatactagacttattttttagccacacgtagcatggtacgtactagattcgttttaaaataaagctatttttaagtatagtactttgtcgtaaaaaagaagaaattttctagcccagtctctcatctaaaccaatgataacattttctatttgatttcttcattcactctcttttcttaatcattcaatcacaatcttactctaaccattaagacctatatttctaatagttatgtttatattaaaatacctatattttagaatattttagaacaaaggtagtagtgagagggattgttgcagcacgcatggaattatttttttctcatcccgacatggctgcgttgcctctcgtttggatggatccgctagggaaagtgtgaccggcgtgtgtggtgcatcccacgatgatggagctagccatgccagttgcttccctaccttgtcaccgtcagaaaaggtgtgtggttcgagctatacgactaattaactgaagtactgtaacaattataggttaccctggtgatcactcgatcagatctactagatcacaccacacgtccgcacccggtcgattctttaactgtgtagaggtctccgacatgtcggtgggaacaactgaccacatcgatcgatccccggccagtcggtcagagatcagtttcagcatcttatcatggtgtgtaatcagtgttatggaaacggaatacggatgtcggatgaagaagatactgacaaacgattaatagaaatacggatgattaatcaaaatttgacgaaaattcaatgtttgtgaatatgtaaatattgttatgcatattatagactcatatattgggaattcactacatataatacgctagaattaattaggaaaaggtgaaaacgatgagagctactatatatatagatatagaaatctgactagtattagtattagtgcattggaaaaatattctataaagattacgaagagaaatttccgctccctgtcgtccacgcgggcgcagggagcgaaccctagtcccaaccgacaccatcctcccttcctctcccctgcctcactgccgctagaaaccgcgcggccgctaggatggcagcgatagggctgaaaccccagcggtggcccattcttcggcgtgaggagacggcacgcgcggcggatccaccgccgcgggatgtagccccctccccctgcccccgcggatggatctggtgctcctaccgccagatctgaccggagtgcactagcgacgacgtggacgatggcggagggacgacgactggaggcgctagcaatgggaggccgcgaggttattggcttgctgtggccggtaggaggcacaggagatgacgggaggagcgggtgacgactccagctgcccaacgggaggcgccgacgacaacagtggtcggctgatgggaggcgtgggcaacagcagcggttcaccggagggaggtgcgactggtgccggcggacgatggcgcgacacaacgaggagcggctgaaggcggtggtggagctcctggtatcagcgcatgcgagcggcagtggtggttgcactctcggtagttgttgggggtggttgcggtcggtgaagcgatggccgatgtaggtcgcaccgggggctatgaggccaacccggcaacgggctaaccgctggtgcgcagcggtggagaggttgccgtgatgggaggacggaggcgacggtgatgcgactaggcagctggttgtgaacacgagcagcctggtcgaggcggcgacaacggtagcgccatgaggggtatgttgaagcctgcaacgagcttcctttccaatcgtttgtccttttgcagcgctggcttgccaccgtaagatggccacgctggacgggctagtgcagggcagaggggatccttctctctcaccattttctatctccaacccaacaacacggatggagttgaagcgcgatgggtgttgagattcttcttagatggctggccaacggcgaggtgtcggcgcagtggctgtgcatcgaaggtggattagcgggtggttttgctgaagctgacatgcactctttggcgcgggagagtataacaatgggtgaaggcctagccttcgggccggcaatggcgatgactgtgggcgcgttttccccttggggtgttgtcgtgttttctgtcctctcccatgggttcttcaggtgaaaactgttaacggtcgttatcgatcagtttcgaccatcaatattaccaaaacaggagagaactagtgatgcttgcaatgcataaatatgttagaataataatattccactagtacaggtctactgaccttttgcaaagaatgatcataaagtggaggagaatcgacatcaacaccaacgataaatcaatcagacgatgtcgaggatcagacttatgtatgaatgggccaagaacacagaattgacacgatgaattgggccaaaattcacaagtctgcggagtggagcaatagaggaggccaccagccgaaattgggctggattgggccagccccgggttcggctgaacctggtggtttggccgaaccaatcctggcgccgttggatccaggttttggcgtggacgtccaggattgcatcccaatgacggttggagggtacttcggacaattccccttccacaaccgccatacctacctctatataaggagctcactctcttcacttcaacacacacctcaagcaagagctctctcattcctcttaagtttagtttagtagtatctagctggtggaatagaattagaataggaatcaggagtccggaagtcttcgaaagagttcaggtatggctctagtagctttcctttcctcttttgtaagctttgtacttttattagaatactcttctaaatacatttctggtattgaaatactttccgagtatatgagtaccaactttacattatgttcttgttatactgaatatacggctagtttatctgggagatgctttggtgcgggtataatgtttctttatgcaattactctttgtcatgacgatggtattagagtagtatctagtagtttaggcgtggtgtctagattacgggatatcattatttggggttatatattgcggatgagaggtgggccgctgatggtgacagcttagtacgggtattcctccgcgcctatatataatcctaagttaatttcctaggggggtattcctctgtatttagccccggttggatggccatgacgggctgtcgtaaggaactcggcagtcaggggtggcttctcgaagtaccaggagagcatcggatatagggtattagctagtatatcaattaactagaatgtatgtatactatgtatattagaagtataggaattgattctctttctcttttctttccacctagcttagattatttattataaggatgagtagaaatgcttgtgtgccactctacccttggattatcttaacccctgcttagaatatgattatcacatgtaatatataaattattagttgagttctctctacatgatcttcccatgggataaaataaatatgatacccttggaatactctcgggtgaaatgctacaatggtatatccgtgcgcttgcggatgaactctgtaaccataatataccagaagtatttctgcgccattgctgggaattatatttctagtaatgtcgttaagaaataccaacaaaaaccacgtcctggatctctaggacaggcggtgacgaagctattggcatcgtttcctccttggaggcgtcgtttagaagacttatttcttaggggtattgtgtgcttgtcctgtatttagcagtaagatcagacatagacgagtggtgtggatgcatattttcttttttcttactatagtcttccaagattatagacttgtgttttattcctactttattaatataaatgtcgcactatcttgtatgggttgttttaaaaaaatatatatggattatcttctgttcttctatttgagtggattgtctatacatttgtcaacaaattttcttctaaaattttgtcagatgtaaatatagtataacaatactataattacattctaactaacttacatgtaataactacagtgtaactgatattataactttcgcgtaattttgaaatcgttagatttgctttaagattggtgcaagctgagaagatatataaaagtcgcaacgcacacaagtgaggggatttggtctcgtgacctccgcttcatgaaaatagcaatgttatcgtaagatttttgaaagttgcatacaaattatactgtgttatatgcaagttacaatgtacgtaattacactaccattacactatatttacatttgtaaaaaaaattggagaatttgttgataaatgtatagcaaaactgctatttgagatatacatgaaacatcaaaatgaattttgagatcaagaaaatatggtagattggatttgaaagaggattagatggaaagaactaaccctaacaggttgcagcgacatcagaggaatttagaagggtaatcaacaacgtactggtacagctagcctttatactagaggacaacaaatatgctgggatagtcgttgtgggttggttcggccttttgatcaggccgattagacggaagcggccggggagattatcggaggtgacgggaattttacgttctggaatgattaacgaaggacgccgttttgcaaaaacgtgaccggcttatcaccatcaacgtttcaatggctgtatcaagcgttttccacaacactgtatgtaatcagtgggagtacgttttagacgtgctggtgctaccgaaattgcgactgctaccatcccggctgtacgtctttgatagtcatctttaattcaatttatagcccgtatgtctacgtcgtaattaattcatgaaaatcgatcggtttttttgaaccatgagctttcgatccaggcacatggaaatataaaaggaaaggatccggtcgatcgaagttttcgatataacttcatgtcgttcatgtgaatatataatcataaatcacgtacagcaaagtcctttcataaatttatgtcatgataactgcacataaggtgtagtttagacatgcaaaactttagtatacaaatagattgccatttttgtttgctttattattttaacaccctgattttatctaaatgtatttatagttacatggatcatatttttgtgtgctcagtgttttttttattactttagtgtaattgattgagttcaataaaagctttctaggtttctgaactgttacaatatatttttctggtctctgaacttatcatgagtgttatataggaccaaacgggctccaagccattctatacgctaacgcacacagacagtaatatctatcaaatgtgaacttctatttttttcccattagagggatgccgtcatatatatttttagctctaaaatacaatacaaatagtattgaaaatctgtaaaaatttatagatagtattaacatctaccactcgaaaaaaataaagtctaagaagggccaatctacaacatcagaacctaaaagataagcgaacttttaccattcttgagaaggtaccaccactccacccggtgctagataccaagaagtaccttttagggcattggcaccgaatgcggtgatgagctggcataaggccagatttgaggcgtctcaattcattcttgatttgcagccgcagcgaggtacacttgaggctgtggtggataaaccgatagaagcaagggtatatgcgaaagttcaattttaccctctcacccacaacacctcctctctcgggagagcagtaccacccggtacaaagcaattctagctcttagattgtacgagatggatggtctagattagtaccatctccactcaaggatgataaaaactctcaaaagataaatacattacatgtacttggtcgtatcattttcatttctcaatgtgcgcattgatttaatttaggcttccatttttagatagtagatacgtactccctccgttttttaatagatgacgccgttgacttttgaacatatatttgaccattcgttttattaaaaaattatatacaaatgtataagatataaattatgcttaaagtactttgagtgataaaacaactcacaacaaaataaattataattatggttttttttaataaaacgaatggtcaaacgtgtgaaaaaaaagtatattgtatcgatgatcaattttgaaaaaaagaagattgtaactatatatttagatctacttttagaaaatgaaagaacgaattaaccacgtagtgtggtccattaatctgcaccatctaggcatctattggtcctctccagtctccaggactcagctaggaaggaaagaacagagccagatacccagcaaacaggaggcaacaaaacaatttgctggagtacgagtcattcggccacaagcccacaacatgacgctagggccactaattcaccccgtgaccgtcctagagcaatgccatgtctcgccatctccggcgccggcggccggccagccacggtcgctgccgctcacgttcttcgacctcgtcttcttggacttcccgcccgtgcagcgcctcttcttctacgacaacgccgacctccgcgacgcccatgacttcctcctccgcgagcttcccctcttcagggagtccctggccgctgccctgcaccatttctaccccttggtcgggaagctgccgtgcgggatacgggagcgcatgtcgccgccggaggtcgcgtactcggatggctactccgtctgcctgaccgtcgccgtcagcagcgacgacttccaggacctcgccggcgaccacccgcgcgacaccgcgaggctacgcccgctgctgcctccgctgcccaagcatggtagctcgcaggacgtgctcgccgtccaggtcaccgtgttccctcgcgccggcatctgcgtcggcacgacgctgcaccacgccgtggccgacggttccagctacgtgcacttcctcaagacgtgggccgccattcaccgcctcggcgacgagcgcaggaaagcggtggtggtggaccacacgccgccgctgttcgaccgtggcgtcgtgcaggacggcgacggactccgggaggcgtttatccgcgaccaccgggatctcgtggagtccggtgacaagcggctcgacgactgggacctcagccggaggccggacaccgtgctcgcgacgttcaggttcacggacgagctgctccgcaagctggggaggcatgtcgaggcggagacctcggcgcggtgctcgccctacgcgctggcgtgcggcgccgcgtgggccggcatcgtgcgcgcgcaaggcgtgggcggcggcgacgtcgcgcggttcgggttcgtgaccgggtgcaagccccgcgtgagcccgccgataccgtcgagctacttcggcaactgcctggggctgtgcttcgtggaggccaagcggagacacctcaccgcggccagcgcatcggcggccatctggcgcgtgatcgcggggctcgccgagcaggggcgggcgctccgtgacgcccacggctgggtgcgcggcgcgcgggagtacgcggcggcgcgcgcggtgacggtggcgggttcaccgaagctgggcgtgtacgcggcggcggatctcggcgcgacgtgggggggtcggccccggaaggtggagatagcgtcggtggagcggacgggcgcgctggcgctggcggagagcggccgccgtggcgaccgggacggcggcggcatcgaggtcggggtggcgctgccgcgcgcggagatggaggcgttccgcgcgttccacgtcgagctggtccggctgctagacgccactacccactagtgctgagtggtgacgcggcctcccccttgccgccagtgtaaaaaaatcgtgccattattccctctgcttcggtgtttctggaactgggaccagtcctttgccttctgctgtttctgtttgccagttgccatgtgtccgtagtagactagtagtacggttcgtctactccctccgttattaaaaaaacaaatcatgagttttcgtatccaacgtttgactgtttatcttatataaatttttttataattagtattttcattattgttagatgataaaacatgattaatactttatacgtgactgtctttttaatttttttcttaattttttacaaataagacggacgatcaaacactggacacggaaacctagggtttgtctttttttttggacggaaggagtattactctactactccattagtcccataatataatgtaggaacttaataccggatgtgatatttcatagtataatgaatctagacaccctcctgtccagatttgttgtactataaaatatcccatccggtattagattgctatattatgagacggaaggagtactagttactcccgttctagaatatattttaaagacctgcttgggagcaatcaaaaaaatattgacttgtaattttatttcgcccgtaattgtcgggcaccaaaaataaagtgaaattaaaacccgtgcattcatggtgtttgggaaggaacatcaagaagttcgaattctgatttgacgaaatagggtatcttacgaattcaatcaatggatcaaatcagcatgaccaatcgaggaatcaaatctgaacaaacaatttagaccaaaacatcaaacagaaatcgattggaaaaaaacaacaaaattgatccgatcctgaataaaaatgagctgttcgtgcattattcatcaaacagttccgagcacaacatgaaagagaaaaacaacagagagattgatgagaaatattgggcaaaattatcaaaacgatatacactgatctcttctcactacccccaacgagaaatttagaagaagcagaagctgtactcagattgaaagctgtacttaacgagaaatcaaatcaagggcctctttgaagagtttctgtcagctgtagctttttccgaaatcagaagctcatcaaaacagtttagcttttcgtttagattctaagaaactgtggttgttgaatccagaaaataaactagagttaggaaactcagttttttcatattctcaaaatctggctatgaacggaggtatttttataagacccaagactacatctagaagtaggtcgtttcaatttggagagagctgatgccaacagcatgcactgaggttgcgatgacgccagaaactgtgaagatgtcggtcgcatgtgagggtgagacggtgccggaaatgcagatcgacagtaggggctgatctacagtagaatggtcggtgtcaggcgacactgacgactttcggcaaaatctatagcaaaactgtttatctatatgttataacaccatgatctaaatataattagcatactgtgacaccgatagatatgttatgataccaattctctgatccgccactgatcggcagtcgagaagatgttgtagatgcagatcgagactgacaccatgacgagaagaggaggccaacgacctggacggattccggccgacccacagggcaaggtcgtagcggcggtgcatggagacggagctaagttcacggtggcggcgcgtggagccggagttgagttcacggggacaacatgtggagctaggtggagcggactgcggagtacggctgaagctgagaacaagcccgactttcgtcgttttctagtgtgattgataggagataatctatttcccggtgtaatgggcctctacgaacgaatttcaatctgacatccggcccatccaagcgcgcaatttcagtccggctcaacaaattttatgggcctgtgaattacacctgttttggaccaaatacaagccttccaaggaggttctaacttcaaccttcaaaatatatttttttctcaatcgatcacaatatttttatcattcaaattccacatttagatttttcttctcaactaatcataacattcttctatttaattccttcaactttcttgatactcatatggaacctaaaactcgtatatgttttggaaggtatttgaaggcggaggaaggtgacgaggagcggatgctacgaggtaggtttgggagaaatcgaaacgcaagtggagattggatagatacttgagctagagagatcagcaaaatggtcgggaagaagaatacagactctagagtaagagcggggatggccatccaaactactcccctccgtttcacaatgtaagtcattctagcatttttcacattcatattaatgttaatgaatctagacatatatatctatctagaatcattaatatcaatacgaatgtgggaaatactagaatgacttacattatgaaatggaggaaggagttgggtttgctcaggtgcacaactaacagcattatcaatatttcgttcaaccaaatatgtttcttaggccttttttagaacgcaagaatttcatagacattttatagtatttttcacgagaacaattcagttccccggaattcacaaacaaaaggctcaccttcggaaggtggccttgaccattaaaaattttaacgttcaaaacagtaagtttacctgcagcaagctttgtagttacagtgtctcaatttcaataagtttaccaggccacgatttctcctctcagggcccacaggaaacaaacggcaagatctaaaaccctacaatctaagttgccttagcattactacatgtactggcggtagttatcatatcaacttaacaactttagggtttttgaaatttgccatgcacccaaacccgttgcatcttcttccccttttttctattcactgatatgacacaacaataccccagttccaactgcacaatgataggcaaatgcaagtcaatggtttcataagttacagacatacaaggaaactggaccaaagcaccaatgacacaaactgaaatttttacatttttggtccttttttaaaacttattttacaaatggccccttgaaaaacttattacaggaatgatcctttctggtgcaccagagtggctggcgccgtactccaacatggcggcgccagccaccctggcgccgtgaccgtgccaccgtggcacaagggcgagcgtggagagggtgacgtggcaaaggggggcgccaaccacactggcgccgaccctcataccacggcgccagcgtgcctggcgcactcctcctaggtaggggccaagccctaaccttctgcctcgggcgggaagctggcaccccaaccac

SEQ ID NO: 63151 - DNA, 2672 bp, Oryza sativa
ctaaataagggcctttaaacaactctacttttcttaaacaaaatgcacgggaacttacgttcactaactggatactaaaacggacaaaggaagtggagatcaggcgatgtagactcgaaatgacagcttctcgcacggtttgcaaggccgaaacaacatgagttttactattatcgtcatcattagaagtatgttcctttacctgtcgctgctagttgttttctattttaatgtaatctactgtatagcttatcgctcacatgtttagtacgtaatgctatgaaatgctggacagattgttgatattctcaagatggactcggaatcactatcaacaaaatactgctctggacccaacactgcagctgatgctggtctaaaaccagatgtgtatgaacttattcataggttattgttgcatatacaccaaaatgagccagacattgggaagagtattttggtgttccttcctacatactatgctttggagcagcaatggattcgtctgctatctgctagttcaatgttcaaagtacacattctccatcgcagcattgacaccgatgaagctcttcaaactatgaaggtctcaaagtcctgtcgtaaggtacaattttctgcattgaaattcagctttgtgttttagttaaatgtttctgaactgttaagattttctcctatgaacagacacaatgatagacattatatagacagtgcatagaattattgctgtcctgttatcactatccttgttttctacttgcaggtacatagctgcaagcctgcaatactcttcagcataaattgcaaatttatttaaaacccattgcatgtttttaattacctttaaagttgtgttctgaatatattaatgaggtttgccactttgccatcatctgcaaaaagcaagttctgatttattttcctttccaacattgttttccactagcactagctttagaacacaggattcagtccccggctacaggggctctgtccactgcatcctcccacagcaacagatccagagaccaggagtaccaagtgaccctgataatcatataatttgcacttaaaaataatgtaacattgatttggcctgtaatgttcaaaatttacatgattgaatattctcctctgtctaattggtttcgattgaactcactcaaatgcgattgaactataatcttcttgtttgtatctttgttgcaggttatactggcaacaaacattgcagaatcatcagtcactattccaggagttgcttatgttattgactcctgtagatcactgcaagtttattgggatccaatcaggaaaacagactcagctgagcttgtatgggtttccaaatctcaggtatatctcacaaatatactgatgtttttcgtttgcaactaaagtttgaccctaaagattgtacgttacaatttttttgtaattatttctaggctgaacagcggaaaggcaggacagggcgaacctgtgatggtcaaatttatcgcttggtaactgggccattttataacagtttaactgatcatgagtatcctgccattttaagattgtccttaagagagcaagtactcatgatttgttgtgcagagtccagagctatgaacgatcctcatggtaattcttttcatgcatatatttcattcgtgtcttttttctgacaagttcagcctttgttacatttgcataaatttatgctccatgttttttaatgttttgtgatggagcaccattagcattatttatattcttgagaagctacaattgattttccttcttttatttactaaggttctgtccactcttttttacttgtcatctaggatatcgatagtcttagcacatgtttttatcattagtttaatactttttttttctaattgagtgtttataaaaaatatcgatactatagctaaatgaagtatttttcatgaaaaatctactaatatcatgtacatatttaatatatatttgttttgcatatattagtgatttaagatgaaggtttgcctgcatgcattttagaacagcatctttttgtaaatgcaggatactaagttatgataaaatcatgtcctgtagtataattaagcactgtacagttggttaactatttttctttcaatgataattgtttgtatcatgcattcgatactttccagtgaaaatagttctagtgtctatgcagccagttctaggaagttaagggtttgcatctaaacttggttatcttgcatttagtctggactctggacacatgtaaatgatagtatatttgttctacaaacacaaatctggtgaaccgtacataagtatcttagccactgttgcactattttattctaaaaaactgagtgcaagtagtttctggtgttttggcataacatgtcaaggttaatttatagtaattagaaattactattctttctgtatttgtacattttcccttttatttaattttcaggattccatattactttctcatcatattaaaactttacattgtattgtttatatttggtgtacttaattgttcctttttaactttcaatggccttccatacacaaatttgatcacttcacttaaaaatcaagccaattttgttacgattcaattgcattatatttatgaaagtatagaaaaatataataccatg

SEQ ID NO: 63152 - DNA, 18390 bp, Oryza sativa
gctttcctcgcatccggaaaagggctaagtgtatcatgaaaacataggactttaatcctgttactgcttcggttaatctagcattttcgtatatattttatttagttgtaatattatactccctccatcccataatataagggattattcctttttgggtaagattaaggatagcatgcaaatactagaatacctctattaaatgaggtttgcttatggtgagtgggtagtggggggttaaagtaggtagaaatttgaattggagttgatagacatgacaagtagtataccaaaatcccttatattgtgggataactagaaggggcaaatcccttatattatgggacgaagggagtatgtactgatgaacccatgatagtcttattgaactcaacatgataataggtggcaaatctcaaactgatgcccatcggagtatttgaacatgacatactagtttaattttacaagctgtgttaattttcaagtgtttctactttctaattgactccagtaacatgagagaaatcctaccttccatcgcttctcaaaccttgtaggaggttaaaattttcccttagtaaattggatttgttaaatagaagagagttagcatccagccatccgtagacatgacgggtggaattgttcattatattttatcttttatccttagctgacacttatctgccatcttgtttgctattgtggagcgtgtacataccatttttgtaaaccatggatagttttagtctttgccgactatctagatggcctcaacttctcaaggcttgtgtgatatgaaataccacagtgtaactagtccggtctgttatggattagtttggttcctgttggttaatctataagaaaaagaaaaggtggggtctcagtttctatggctcatgatccgaggggttagcctccaaagcttgtattattctctggaattcattgaccttatggcttatgcttgcttggtaatgaaaagccaagatgaaaaacactataatggaattgaattcactttttatcctattcctttggttggtttatgggagatgtgatcatgggagttggctgacttctcagcatgattgggaaaacctaagtacctaactgctgaaattgtagaacacttaacttaaaactgagctatttttccattcttcctatttctattatgtcattgtattataagccgtcttcagtaggtttgtggtgcattcaggtatttaatgttgctatggtgtgtcgatttctgaaatggttggcaaatataaatctgtactcaactactttatctgatctcctggtttctctgttctctctaagatgctcttgtatgcaaccaattccaaaaggacaaaatatccttgatctgaaacagctccatttcgctggttacataatctacttcacaactttagtaatgaatttatgcccttgtttccatttgatgcgtattgaatgttatgccctgcaatttcacccaagcctttttgcctggtgcagggtcctacgtaacacacgagacgaactactttgtgtatttttacatcgattctaaagccgtcttgctattcaaatctgggtgattggcgtagctaatatcccctgcgcttgttgtcttgtatgcctctttcctccgcgttgtctgcaaccaaagctggaagcctggaattctgagagcctgcatgttgttgatgtatcagccgcggatcttttccatattccagcaaatgtgagattagattgtgtgtctattttacgtctgatacatctaggtggtgtcctgacattgccttattgtaatctgattgccggaaagtcagacagaggttgtcatcaacaaggtaaaacttgtgctgatctgcttatattatgcattctctggccaccgggttgcagaaattgcaatgatttcaatgaatgataccctacatgaactgcctatatatgatatgccaatgtggattaagttacaaaaagggaaaatactttttgcattgttgcatcatgtgaaattctactagaccataacatggccattttttgctgagcaatccctgtgaaaatcgtactaaattattattgatggatgcctatgataaatccatggtatcacttaaatttctggttaagcttaattgtatgtgtgattatggatagtaggaattgaatttggtgggtgcactatactgatctgcttaaattatgactgtctggaaagaggttttcattctctggcatggtttccatgaatgacatgaactgcctacatatgatttgtctcgtgggttaggttccacagaggaaaaaaaaaatactacgtatccttttggttgcatcatttgaaattgctacaataaatctatgatgtcagtattttctgcaatttatgggtatcaggaattgacctatacaatcacgactctaccgctacactgtactgtttgtgttaaagtcaagttgtactgttcattcgtgtacaaccagaaacatagcgcattctcagaatttttattatttttaaaacctttttaatttcacaaaataaatcatcttaaacttatttctgaaatctaaactttttagccatgccccgcatgatgtggtaaaataatatagctatgtcaaccatgctggcatggcaaaataacactgttacgttagtctatgtcagcattgtttcgccacataaatttggctggtgtggttgaaaggttcatatttgaatataaaaaatttaaaagttttagaaaacttaaaaaagatcgcattctcatccttgcaaaagccaaagtttgcgactttgcgttcgtcttacgacaaagaatacggaattccctagtactttccacgattccatcctccatcaattttgtagagcaagtatcatgtgcgcatatataaacaacctgtccctggattctttgcctacaatcatatcgtactgactcctctagggaattgagccctccccctaccctaaaattattcatgacctacccacacaaaagatggccgtccccatcacccgcgcggatgacgatggccttgtaaagagaagaaaaaaaaaacgaagcgaaggtgataaggctcgttcatggacggcgacagcttgacctaacttcgcgccgtgatgcgcccacatgctggagccctccgccgtccacgtgtccagatcactagcaacgtggcaccaggatcacgcgcgagggtgcactggtttactagtggttactagtggccccggcggcccagctgagccgagagagaagaaaacgagttcaagtttgcagctcgaaatgaaatctcctcgtgccaaagctcaagatggcgattgcgaaatgttacatcgacaccgcaaaatgtccagattcaggcatcgtttgatatatgcacagtaatgtccgtaatgtttaaaatgattcaacacaaatttgacgtgaagcagatgaaattgaaaggaaattaaactgatttattacttgttccattaaaaccatcacactcgggtacgtggtgaaaccgtgaaagttaaaaaacaaaaacagtagtagtagagtgaggccctgctcgctgttacatgagaggtgcacgaagaaccagcacacgagcagagcatccagcccacacgcagcaaggaaacggtagggatgccgccgccgccgccggccgatccgccgcccggcgatgatgcgtcgtcgtcgtcgttcaggtgcacgcggaggcggagcggcgtgcggcgcggcgcggtcgagaggtgatgagtagttgacgcggagcagatatatatggatggatggcgtcgtcgtcggtcggacgacggcgaggtcgcgcgcatcacgcgcgggcgtagctgcgggcgaggtgggcggcgcggaggtcggcggcgtcggcgccgccggcgaagttggagggccggtagtggcccgtcacggggtcgggcacccacgacacctccctcgccgccgacgacgacgacccgtccttcgcctgcgtcatccccgcagcgcccttcccttccaccgccgccgccgcccgcctcatcgccgacgacgccgccgacgcggcgtaacccctcgtcgtcgtcaccctcgccgcgagcgcccgcgccgcggcggcagcggcagcagcagcagaggtggagagagcgagagccatcggatcactcgatcggacggctgatggcgctccgctcctctccttctctactctgcttcggtgcgacgcgacttgggcttgtgagctctgtgtggggaggagggaggcggaggcggacgcgcatttaaagaggcgagaccgggggggagggggctcgattttattattttttataaaatattttttggtggggtgccacgtggcgtgggaaagcacgtgacgggtcgagggaaacgtcgccgcgggttcgggctgtcggcgacgcgacgcgccgcggagacggtggacgggtcgagtcgtggtctggctatgcagcggtttgcgggtcggtggacgtggtccaccacgccaacgtgagtaaaccgatgatgatgagcgtctctggtttgtctttgtccactgtgaggaagtgagggcatcacattgtgatccataggtaaattataatattttattcacgttgtgtaattagttcctataaaaaacaaccaaagatacctatatacatatattgaataaaaaaaatagtagtattatctatgtctacttctctcttcagataatattacttcgtgtctatatacaatgttgggattgctatagttaaaatctatttacatagattctgtctatattgatcacatttgccatataaattggtgatgccttattattggtggctttttatataagctaaccgatgagtacatttacgttttttaagctgctaaacgatactcccttcatcccaatatataagagattttagatggatgtgatatatcctagtaccatattcagattcgtattactagtgtgttttacatccacctaaaatctcttatattgttggacggaaagaatatattgcaacgtgaaaattttctgtgtagaagttcttttaaaatatcaaatagttttatttaagtttgtaataattaaaattagattaatcatgtgttaatgattttttttcatcgctttatcttccctagaaaaacgaagaccacgtagcatttctctttattctctccatttcaaattacttgtttaaaatactagttattattataattttaaatttctaagcactttttactaaaatgtttcctgtttgctcctcataaatgcattaacacctgtgaccgtaatgtacaggggttgtttcttttgttgcttgatttagatcggcgcaaagtttggcttttggttgaaattagatataatgtgactgaaaagttaggtgtgtatgataggttgatgtgatagaaaatgactgaagtttggatccaaactttggatctaaacacagccttgctatatctctgtgttgtatctaaaagttgatcgaatggtagtacgcaggagtaactaaattgaaacggagggagtttatggtggtgagtcgcgtttgcgttgaaggggggaagttgagttggtgctcttgttcggttttgataggtgatgggggtgtttaattagtctatgtaaggtagagattgagttgacttgcggcatgaataaaaattcaatcttatctcccttgttgtttgcgtattttagccgaaacagctccttcacgataacattaactatacttcagatgaatacaatttggccaccccataacacttaaatatcgaaaattatcaacactaaatgagcactttttattatgcattgtgaccatcaccaccgcccgcgtaaaataaccaggagaaagggcttgtttgtttcgttgctagaatcagccttatcaatttttttttatatatagatgaatgtgcatttagtttaatatccttttaaactttactagtagtgtctttatgagagaatctatggaaccactaaattttgataacgcatcattggcaaaccttacctaaaataggtgggttaaaaagtgacaataaaatggacatgtggatgtggtagggttaaaagtggtaataatgtgaacatatccaaagtagcaataatgttatgataatggaagttcaaccagtgactgggcaagctcccggcaggtcgggcagccactcgggctccattatcgccatctccattgctgaatgccatcaatgtttgtaaaaatcggtcaatcgcggtaaaaagtattagtcacttatagctcggtaacgccatctctttctcaaccatctccatcatctcagcaagacagaagttgatttgcagcattcaagtgctccatcgttgaaggttggctactcttcggattcacccttcctattgttctctaacagaagaaaccatgctggatttatcattcgggttgagctcggaccacctgcacaatttcggttgacagggttgatgttagagctcctcagattcaatgatgagcctcgtggggatccttcgctaagtccggtgacgcacacaccaaaatctacagctcaacaacaaacctcagtcttgtgccgtttccgtggaggcagccgatggggatcaacggtttgtcaagcggagtgcacatcttttgaggcccagggtagcggtcgtcgcggcttcgtcgcagatccctgccgacttgctcatttttctaatgttaggttatttcaggaagattgtttccgtagttcagttaaccctcccttctcaggggtggctcttttgctttcagtttttatccttggttatgtattggggtttatcctctaattctgctcttgcttaataaagttgatgtgtttttttaaaaaaaaaaacctcaacctgtgcagctggccatgttaagattaaggctgtgtttttttttcaagttttcaactcatttcctctttttcgcacgtccattgctgagtgccatcgatgtttaaatcggtcaatcgcggtaaaaagtattagtcactcaggctcggtaatgccgctagcttcgtcactgagtccaacctcaacctgtgcagctggccatattaagggcaagtacaacgggtcggcgagacctataggtgtccaaacgggcggcacggcccggcccggcacgggcacggttccggcacgggcacggttccggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaagggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttaaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgttgcgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagcgagacccgtcgacatgcactgcttttttgcaaaaaacaccccccacggtgctagcttcgacccatccgtcgtctcgttcgtcgacgatgccagcgcgtgctcccaggcgacgcgacggcgatgaagcccgttgtacgacgcgatgcggggaggcgacggaagtgcgggatcagctgcgtgggatcagctctctcgcgcgcggaatatttaaatgtactatgcattgtcttatgtatgcaacaaaataactacaaagatcaattatacactagatcatcatgatttgtgtgtcaaaggatgaattaaacactctacggacagccaaaccaacaacccattatataagccgtctgtttaagctgtctatctgtgtaaaaagacagcaagctgtctacacggttgtacttgccctaaggctgtgtttttcttttccaagttctcaactcatttactcgtttttcgtacgtactttttccaaactgctaaacgctgtgtttttttttaaaaaaagaatttttgcggaaagtgctttaaaaaatcatattaatttatccttttaaaaaataactcttaattagttaagtgctaataagtcgttctattttatgtgtgagagattattttccaaccgcatggattgagaacatagcctaaaggaatgtagcagactagcagcagtggaagtaagatcaggtacaataacaggctataagccaactataaacataatttaaagatataaaggaagagaaataagatcagcgggctacagatctgtagccagctgcagcacggactccaaagcgtactatgtgtatgacaggtaggaccaggtattaataggatagtaagcaactattatatgaattggctattatattggttatagatgatttggagttagtagttggctacgctattaaacttgctctaaggccatctgaagattaaggaatgtagcagcagcggaagtaaaggccgtggatgttaggaatgtagcaggctagcagcacagcgttccgcaggaaaatccacggcgctaattggtgacgcgccgagggaatggaaatcacggcggacggcgatcgaatcgaatcgaatcgacgcgacgcgggcgtttttgtcgggtcgccatcgacgggaggacaggacacagccgcgggcccgcgccggcgaagacgctgctgcatctgcatctggacaggccgcaaccggccgccccctcgcccgccgacggccatcggaaaaaggaaaatgctgaagcgaatcaagtagggccgccgcgcggcgcgtctagtgcaggaaatcgggacgacgacgtgcgtgcgatgcgaccgcgatacctcgcttggttgttgttttcggccattcaaaaaccttttacagaagatgggagaagatgccaagcagcgacgcatgccaaactaaacgtggccatgaattgtactaatactatttctcatgtatttgcttgcaacatcgtccaactaaacgtgcccattggttataatgcttcttctattcgctcgcaacatcattggaataataattcattccaatcatgtccatgcggaaaaccagcaaacgtgtccttgccaactaaatgttcacgctctccgccgcagcagcaacaacaacaaaaacgttcaaccagaagcaggctcagctttgcttctcagatgagaacatcaccatcttgtgccaatggttcagtgaccgcttcctaccaatgcacatcatcacatgaattcgaacatatcagaattaagatacaaaagtctccggtatcaacatccataacactatttgatgataacattgaaattgaatcgcaagctccttcgtaacactaaatgatgagttgctcctacatatctttcatgatccgtgctcactaaattgtaagtacaactttgccaataattacgaaaactctttcaagggagcatatgagtaaagttaccgatgataaaataacttttttttgtcccagtagtcaatagtacaaaatcctttattcaccaggaacatctccacataggccatctagccctcaataccgaaatgaaaatttcctgtctgatccgacatctttcagattttgcctgagattcagaggaacaagcttgcagaaattttaataaaagattctactgttttagagactacaacagcttgactccagcttctctaacagagtcaatgacagccctgaccttcccatggtacttctgctctctcttcatgtggatgcacacagcgggtatgcccttctgcagcagccgctcgccgagcagcttaccgatcttggcagcggcagcgacatcgcgagtggactccatgttcggcctcagcagcttctcctgcgagctcgcggaacaggcgaccgtcgccgttggggtgtgaaccacctgagcggatacatacttgttcgagaaatgcatcctcagaaggtagggcttcagaaagcgcgtgatcctagccgccctttccggtggagggatcaccatagttgctaggatctctctctgcagcaaaataacaagcgagacaggggacaatttcagttggcgaaaaatgcatacaggtattcacattaagacaacacaagtgaataatggtttaccactgatttgtaaacaatttgaattgtaagctgaaattcaaaaccaggagacaaacaaacagtacatatgaaaaggaacagtgtttagtccggccatgctgatcgacgataaacagttaagtattccaaaaaggttctacttcaatcagcactgcaattgcatatttgaatggccatatagcatcagcagcagcagcagcaacttatgcttactaaagctcacaaaaaaatgcatcaattccaccatggcgttattatccaagattattacaacaaattcaggcctgaaccagcgcatcaaaaacagattcgggcatgtccaccagacgcaggtgaaagctcacctcgagactcagaggctaacttaacgtgcgggcatggccatggcggatcagccaaactaatcccccacccgaaaagaacctccttggaaacaaacagctaatagtagtagttgggttaggcaaagatttagcttttccagatatagaagagaagctagggatggcaacacgttcccgcccctgcgaaatgcaacggggcatagttttctcccatcgccccccatggattctccatccccgctgtcaggaacaacaaactcaataggtacatttcacatctcaaataataacaatattcagtcaagagatattattgccatccaaaagaaaaaaaaaacaaaaactgctagtattttcagccggagcatgaccatcagtccaaaatcaacaatactaataatcaacatgaagtaagttcacatctcacatctagatgagtaagttcacatctcacatgcaagcaagcagcgggatcaaatctagacaggcgtacacacacggtaggagcgaccagccgacgacggagaggggggcgagcatgcgaggagaaagggagcgaggcgaggcgatgcctgacgactgccgcccgcgccgccctgctcgccgcgtcggcccctccctcggccgctcggcgggttaacgcgaggagaaaaaggggtatgggaggagaggcatgaggaggagtatgtgcgtacgtgcgtgtgcccaccggcggctgggtgtggggagcaggacgacgccggcgccgcttgcccgccggggtgggtggggatcggcgctgctcggcggcggcggcggcggcgcgaggagacgggaggggagtcggaggccgaagggatacacgggggagatcgagatcgactaatgctgggctgtttgaggtccagcgatatgggctttttctatggccggcctgggcctggctgaaaaacaatggtgaagaaagcccttcatcttttgatctatctatatgagggaataagtttacataaagtcctcacttacctctcccgattgaataaactgagccccatcgtttggcctaaacagtcaaagaataaggagtaaattccttgtgtgcccctgaaaagttacccaatcccttacatgcccctgaaacttactcgattccttctatacccctgaattttcgattggatcccctacatacccctaccgtttgggttccgtcagatgtttgtgttcatgtgtgtgttagcttgtcagtattttcataaaatgcgaaaatgcccctgtcaaccctaggtaacacagggccacatccgatccccaaatcctccaaaatagttcccacacgcacggtgccgcacatcgccagctttcagccatcgttgcacgcgcatcgccgcccttctcccacatcccggcggcggcagcggctctgcatcccgccgcggtctcggctctgcttgcggtcggcggcggcggctgggtccgcatcccatcggtggcgtggcggggtccgtatctggtgggcggcggcggctttgcatcctgccgcggcgacgagtccgcatcccgccgcggcctcgactctgcttgcggtcatggcgacgccgtctcctccctgcctcctccgcgccctccctcttgtcacctcaccctcttctcgggggctccgacgccggcctattacctccttgctccgctgctcctcgccgtcggtaagatacacccttgcgttgattagcaaaatgcgaatagctgctgctgctagtgtttcttcattaatttgtttgactttatgcaggcagatgccttgaactgttatgggcttgtgccattatgctcatgatgtaaaaagtaatatatttgtgtactgctgatggtgtatgaatgcttttagatgtattttcattttcttcctattaaatggtgctaccgatgctcttgatatgctgatgaattgcaatggtgtttgagtaaacgggtaggggtactgtcttttacccccaggctgtatcggttagtggtcatgaaagatccaatgtcatgttatatttttttataaaatactgaatgctataacaaaagaaaatgaaattaattttatgcactatttttttagtctcacggaatacatactgtgcagtcatgaatgtttcaaacccagctgccaaacatgttcttagttttcagctcctccaacctcaagggtattatagacattttcaaccaaactaaccagggaatgctgctaaatctaacggtaggggtatgtaggggatccaatcaaaaattcaagggtatagaaggaatcgagtaagtttcaggggcatgtaagagattgaataacttttcaggggcactcaaggaatttactcaagaataagccaaaatttgaatttttgaacttgattttgaagtgattttgaaatgcttttaacgtaatttttgttaatgttggcttttaagtcgctacgaacaaatctataaaagttttacttataaattaattttaattttctaataagccaaataagccattttggccaaatgggcaaccgatgggagcctgagtataacatattttccctttttttgaaaagaggagcaaattgactggtttcgaaagctgtttatgatgacgtgccaagtttaacatggttgatttgttgagtcaacaggttggacccacgtatgagtcacctctcttcccgtctttccatccctcccggtgatatccaggatggccaccgggggaagaggagcaggcatggaagcatcagccacagtttcaatggccaccaccatagcctgatgctacaactcgcccgactattcgccatcactgcgcgtcctctgcaccacataaaactaggggtgctagtgggcaaggttacccacttatttgtactataggtggtttcgtgtacctgcccgtttttacccctacatacaatataaacacgctggacccggcggcgcaccccggagttggtgttcgtcgccttgccgtcctacaccatcgaagtgtccgggtgcgcccccgacgcgctcgcggagtcggagccagcagcgttggtcggcggcatgcatggtcatcctcagtgcgcacaaggctgagctttgcctcggcctggggttggaaatttcggaccgaaatttccgaaatttcggaaattccggtcatttcggtcacctccgatacgatattattttggccgaaaattttcatttttttcatgaatttggataatatttgttcaaattcaactaaagtttactcaaaatttcggatatttcagaccgaaattttagaatttcggtgaccccctatacaaacgcctctaccgatagagtaaaccctggctgcacgtacgatatggctcagcgatacagatgccaccactgtccactgtgagtatcaggcgtacatgttcaacccagccaattaagtacgctccacttcatcaacgagtaaaatggccaacaaaagtgtactggctctctcagtagaaacctaaacaaactcctctggcacagtggtcaacacgttcgatgctcgctagcagcagcaacagccgccgtctggccctttctccgtcgcccatcggtaagagcgatggatggaaaaaaaaaagaaaagaaaggaaaatagagaggaaggggagggaagtggatcctacagatttttttttttcgttgagaggcttacacgcgagtctttgatgtgtgggtccagcttgctgatttaacgaatcaattgtgattaacttaccacgtcagtagaaaccgctttaaaaataactgaaggagtttaatttgcactggtttttaaaaatgggcgagaagttatacccagttttatggttgagagaggcgattcgatcgggagcagtagctaagggaagcaaaattgacttatttcatctatgtgaagccatagaaaaaatgaacaaagtaactaaaaataatttaatttagagcacatttcatagcatacacaaagtaactaaaaataatttaatttcatagcatacacatttcatagcatataaccaaccccagatattatgtttttaaagttttacaaaatctcacccttgagtatgaatttacttaaaattttaaaacataaagcgtatatagtttcactctgcactacttttaaaaagtattgtttcaaatatgctgaaattaattgagatttgaataaagatagttttatgtataataaagttatataatgaagtctgatcgtaatcattagactaagttgtggggccctgtccgcaccttcagtatcatcagactgtccttcaattttgttttaatccctggctgacatattatcagacgaaacttttctcattagaatatgaccatgaggtcaataaaccaaatccatgaggtcaaagaaacatatccacatcagtgccacgtttgatgatacagttgaggatgaaaaaaagttaagttactgatgttacggaatgataagggattgcacattaacataacaagctttcagttcaggaaatttggcatcaatttaagttcggaaccaacatttaaaacagcatcccttcagttaaagttccctagtgaattctaattcagatagcactcaagtaagccttacacttctgtaaaagctgaactgaccaaaaaattacagttcgcaaaatggcttgaccaaagctattcacatgtggaaataa

SEQ ID NO: 63153 - DNA, 9195 bp, Oryza sativa
ttaaggagatcccctgcttcagtgagactggtgacttgtacaccactgcttctaccttctcattggtcaaggtgactatgcgattcgcacaatcaatgacacccttgaacttggtaagccaatccatcccaagaatgacatctaggtctttggattcgagaaggatgaggttggctagaaatggtgatctttggatttctattagcacggaagggctataactgacctaggttgaactatttcccggggtatgaaccctcattggtgtactaagctcttcttttcttaacccatgcaccccaacaaacttctttgaaatgaatgaatgcattgcaccagaatcgaaaagtactgttgcagggatcgagttaacaggaaacgtacccagtacgacctctggtgctgcttgcgcctcttctgcggacgcgtggttaacacgggcttgggcaaaccttggcccggcacgcctgggcttcgggcacttgtcagcaaagtggccatgctcgccacagttgaagcaggaccctggctttgccctagtctccttggcttgggctgatggagctgattgtgttggtgccattggtgggcgcggagctgcactgcggttgggctgacctcccgggtggttctggctaccactggcgccctggtggaagctgcttgagttgaaaggacgatgctggcggacaatcatagggtaggtccaccctgctatccggaagtgaagcgtggtcgctggtgacttcctgggttggaccggaactgagccgcctttctcttcctgtccattttgtttcgctgatcctcctgacggattgccttgtcaaccagcttctcaaagtcggcgtagtctctagaaatcagctggttggtaagctcgttatccaggcccactaggaacttctcctgtttctctgcgttagtgcggacatcctctggtgcgtatcgcactaggcgattgaactcatgcaggtactcggttactgtcctgttgccctggtggagtgcgcggaattctctcttcttttgtgccacaaccccgtctggcacctgcgccttcctgaagctgcgacagaactccgcccaagtgacctccgtacctggcggacgggtagccatgtgattgtcccaccaagctgacgcggaaccctggagctagtgtgtggcgaaggcgaccttctcctgatcattgcactacagaagattgagcttcttctctatggcatggagccaatcattcgcctccatggggttggtggtgctagagaaggtgggtggcctgacgcatagaaactccggcagcttggactgagggggagggggaccaaactgctgctgctgctgctcggcttgctgctgcatcctctggtgcatctgctggtgctgctgctgcatctgctagtgctgctgctgcatctgctacatcatggctgccatcatctgagtctgatgggccatcacttgtgcaagagtcgggttctcggggagcggtggcggaccgttgccagaggcgctgttgggatatccaccatcggtacgttctttgccgttgctgccctcacctgctgcgcagctgccattcctggtgtttaccatctaaaggaagagcagacggaggaggtggaaaagaagaaaaacagatgctcaggaactaagctttcttatataggaatataaactgcaattgttctgatctgaattaaaacacttaaaacagcaaacaaatctttattaagacagccacatcataggcacatgatgtcgaccgtcgactgacccacaagcgaacaaacctaaacacacaagctgacaggcaattactaagcagtcgataaactaagggaaaacgagcctaattctcggaacggctcctacggttggtggagtcgaaggcgtcctcctgcttgtcgctaggtccctctaagcggctcctggagtctggcagatacgtctcgccattgcccggctctgagccactggaactgctgctgctgtggtcgcggctgccactggagttagcaggcaaccaacctccgttaccactggctggacccctggtggctgacgctggagtgaaggagagagcggacatcggagctgacactggaacaggagctggggctggagctggagctgcgggtgctgcgggaactgcgggaggtgctggaggagttgcgggaggaactgcgggaggtggtgggttcctgggcgcaagctgaatatgcacgggagcagtcgtcgacttgcgaggcgtggtgcggatccggactcctctaggagcagggagacccttcagctgagcgttctccttcttcagtcgtgctatctcatccttcagaactatgatcctcacaagcttcccatcattcaaggccttggatgccttgcgcaggtcggagtgcatcctatccattcccctcatcacggcgcacatgtggccaaaggtggtgtcgttcttgccggctatcgggcggaaggtgctaatgtcgtcgccacttgcttggcgagggtggaagcggtacgccgtgttgcagaagatgtagttgtggcgatcgcgaagcctggccatcatcagatatgctgcctcctgacaggcgtgatctgcggtgcctccagatgcctcaaccaccatgttagcgaggcaggtgcccacatagcgatgcaccaccagacgaatacggtgaggaagctcgccactgagcggccgaatagtcgagtactctggcgcgttggggtagcccaccaccagggtcatgcgagccaactctgccacaaaatcgtccatgccttctccgcggtggttgggtgggtggtcagccatctagagaagacaagggggtaggatcaatgcatgctcaaatccaatttaaatgaagcagtaaaggactcaaataaaataggcgaataagagcggaattttatgcatagatcatttttgcatgagagcgaataaatgagacggacttacatagcgataaaataataagaaattagatactgactaataataacaataagagcataaataccttgcaacccatattcctgagttaggacctaatgcattcctcccatcaaataccgactgactgtccaataaatctcaaataattttactaaaaccctaagcagacctaatttgataaatctcgcctaaacgcacgaccaagatttttcccattgaaccacagaaacaaatccccaatttttcccggaacaaatccaattgcaaagtacatatgcaatgaaaaggattcatagggctcttaggttttccatttggcttgtcctacggtcaaggtcggctctgataccaacttgtcacgcccagaaattcccgaatagaattccaagcagaatgtgcataaaaacccccgtccaggaccggccggggtacacaaacgacaaagttgacatacagatccacgtcttacaaacatcataaaagtcttacataaatgcagcggaaaattaaaagataactggagctaagccttgacttggaccgcagcgggatcaccactccacaggcatcctcgacggcacggacgaagcctactcctcggagaaaccgccatctgacacatactcaaattctggggtttggggaaaatagagcaagactgagtacaaccaccgtactcagcaggtcataccggaataggggggtatgatgcagggtataatcaaaggataggtagagcggttcatttgcataaagcgagcatttataaacagtagttgaaaacagtaaaaccgttgtaacaattaatcaatattaactatccactgtccaatgctataccacgttgcaacaggcccaaccatccacctaaactaatcaattccattagactagactagggtgagactaatcacggtgaatctggttgaccgcccgtaaccgcgggcatggctattcgaatagttttactctgatcagaggtgtacaactgtacccacaagacacagccccacaacaagtttttgtgtgtcgacatgccaccacgacataccggatagaggccgtgacaggacccttcgcataaccccctctaaccaagcacaccacacctcaggtttcacccccactcctcggaaggcagcgggcagtcccctctcgtgcctaggtgaatccggaagccgcaaaaggccgtcgcagggcccatccaaactccatcacgcccacccttgcctggatgcgtcagctagaggaaagctacactacaagcccagccgttgcccacgctggcttgtgataagtacgatgaattcttccagggtttcccgcgaaccggtccttaagagccatgggcgcgaccaacaaaaccatgcacccacagcccaccatttagttcattttaatttaccaacaccggagcggtggcactaaaccaacatcaacactaaaacctgacgtttaatcattaatgtgatttcccccatggtgtgctggttgaactaagcatggctaagcaatctctagaccaacatctagtcttgttatatcccaagctatcaaaggagcaaggtacaaaaatatcatggctgtaacagtaggtaaacatcccatagtaacattataaaacaatgcggtatttaagggaaaacggtagagcatttgcaatataggatcaacatgttcaagtgacaagcatgacttaccttgctctgctgctagaggagcctcggcgactatttcaaagtacaccggagcgtcaggagagccggaatctaagcgacatacaaagcaaacaatacaaataggctataagactactgaaacagagaacaaaaccattttaatggattctatgcatttttcttgattttctaagacttgaatgggcttaaacggagctcggatgaattttctatgaattttagaagattcactatgttttactataaacagaaaaattcttaattgatttattgcgcaataattaaattcccgggaagagatggggcggcgccgacatgcgggccccacgtggcagtgactcggggggggtgtccacggtggaccgggtccacggaccggggaggagcggcgcaccacgtggtgcacacatggcgccgacgcggcgcacacgtggcggccacgtggcagccgtgcgggcggcggggttggatggccccgatctaccgcccggtagatcagacggtggaggcgtctcgcggccgggcgcgcacgagcacggcccaagccgacccggcggccgtggcgcgcggcagcgcagcgcgacacgacggcgtcgcaaggtggcgaggggccaacggtggagagcagcggcgaccgacgacgagtggcggcgcacggcgagcgacggcggcgcggccccgagtggaaaggcagcggcgctaagagggagagggggaaagacgacggggagatgctcaccggggttcagccggcacgagggggcgatggcgaacggcggtgagggatgacctggggacgacggcgactggcggacggtctccggaaccacctagcgaacaagatgagaggggttagagggagagaggaaaatgggagagggcgaagacgacggccgaaggcggcggccatggcggtgctcaccagcgcacggggcggagagggttccggcagcggattccgacagaggagaggtggacgggacgacccgcaccacggcgagcgcgacggcgttgatggcgcggctcggcacggtggctagcggcggctagcggcgaccggagcggtggcggcggtggcggagaggagggcaacggcgctagggcgatggagggcatgggagcgggtggttgcaaaacgaaaaagagataagaggagacagggacgctttatatagacccacgggggtcgatcgtggccgggatggccgcaatttcgccggcggagtggggagaagtggggaggaattcgaatcccggccgtctcgagcgcagcgcgggcgggagagagagggagtgggcgcgggggacacgggcgtgggtggcgacgtgggcgacgtggcccggaagacgcgggagcgagggcgcggcggcgccggctggaggttgggggggacccgataggtaggccccacctgtcggcgaccccaggagagaggaggggggcggccggctcagctgtgcctcggccttcggccggcccagtgggaagggggaggaaggagagaatgggccggtggccctttccgaaaagaaaaagagggaaaaagaaagaaaaagaaggaaaagaatttccagggaattaaatattgcttgttctcatttttaattggttaaaattatttctagagctctgaaaattccactaaaaatcttgttagcgtatttcgacatgtagaactcaggaaaaatcccacatgctagttccgattattatttgcattaattcctttagggtttctctcttgcttttacaccggtattttcttgagaccatttataacgtcaatttaggcttgagaaagaactttagggtgtgacaattaacataggaacttatgacaatacctgtctataagttcgaaagccttgtcaaacgtagactcttttttatccattgagtcatatacgttgacggtggaggcctccaagtcgaagagtaaaaggacccagtggaatctgcattgtgcgtcggatgcattacatatgaaacacttagcatgttcgtacgggaatgaaatttggtataggaagacagtaaaaactaacactgtgttgtacgacaatagtatgaatgtcttgtaatgctgcgccttcaggagatggacgagattttcctctgtagcttgcggatactggtcgagtattgcgacgtttactttccgagggtcgatgaatccagtatcgaaaaccccctgccgtcgggccctttgaatctccattctacaacgataaaaggaagtatatattatatatagtaaatgtaataagaaatctaactgaacgatacttacaaaatccagcaactcataatagagacgtcgagggcgtccagctggtatagttcgtaaatacccttgaaattgatccagagaatatcatctccttgcaagaagtccgtgtccctaatcctcgctccgatcatctctctaccggtggcgctcatctccatgtacagttgatggaacttgtacatttgtgtgggtagggactgcagctgctcaggcttgacaagcggtttaccgagttcgtacatgtatttcacttccgccctttcgattggtgcgcctcgtagcaattgatccgtagttagcccggtgtcattaataaattcttgtattccaaaatcttcaccggtcaccaacggctctatctcctggtttggttgctctccaagctgagggactggtttggactttccagaagatgctttcttaagtgttcgctcatagtccgatagctttatggcctccttggcaggtgtagacatacccctgaagaagttcctggcactcgggtctataggaatcttcttttctggacttcgaggcttcaattgtctcctgacttctgatgccacataagtgtcaagctcctcttgcgtgcaatcgtaccccgggtccttgttttttgcggcgtcaactttcgccttcttcgttgcccttgtgggggcaggcggtggagcttggagggcccttgacttggaaggtgccggtgcaggagcctgaggaggagtcggtgcaggagcctgaggaggagatggtggagccggaggagatggtgcacgagacaccgcttgtcgcccagggaggatgatgtaccacttgcgccatagtataatggcgtggcttgtgtctcgtagatgcgtctcaccgtctcctccagggtaatccaactcgaggtcctcgtacgcgccttccaccaactcaacttcgaccttggagtatcctgctggaatcagcctgcagtggtaagtacctgaacggtccgttgggatggccatgcccgatgccaccttcacatggtgagaggttatttattagtaatcaacatatgtaagcaacaacttgcggaatggacaagtctaaaatctataaatactacaagctttcctttattgataagttcttgaagggaatatgcagctcacatggtgtccgctgagtgatgtcatcaacggggcaggtggtttcgtcctgggtttgcatggcgtccatgctctgtgatcctacctgccccgttgaggcgcagctgctacaattgcctgaagggctcaccattgcaggaggaatggtcggctggggatcatgggactgatgtgcggccatgcgttcatcaaccttccttgccacctcctcttgcatgctgagctcgtagctcgataccctatacttaagatctgcaatcttcgcctcggtatctctctcgctcctcatccgactcctgtacatgtggatgtcctccttgaatccaatcttccaaggaatcacccctttccctcgtgttcgtcccagatgctctggagtctgcagggcgagtgatagctcgtccttctctctgtcggtcagaacgtgccctgagaagaggcttccacagctcgtccgttagtcgacgcgcagcctcgcgtatctgatcgctaaggaccagggagccatcaactaggttgagcgttccaccgtgagcatagtaccagaacttcgatcgatctggccatttagcggtggctggttcgatacccctctcaaacaatcttgcctccatctcctcccacttcggcatcgcgacgctatagccgcctgaccccacgtggtgatagtacttcttcttggcggcattttctttgttttttccatcatcgcctacccttgttgacctgtcttatatgcaacgaactcgtcccagtgatcccttagctttgagattgtgtcgaagttcggtgtctgtcccttcaggatatatttctggtacagatctcccttgaagctctgaaactgttctgccattttctttagagtccaccttttcactttgtcctctatacccgcgggaagggtgaatgtctcgagcattgtggtccacagcatctctttctccgaatctgggacaaagctctcatgatctccgcgtgcccttgttctgcgccagtacacagtactgacaggcacgttatcccgcacaacccaaccgttgtgtcgtacgtagttcttggctgcttccgccggggcactaggtcggccgtcttcgtccact

SEQ ID NO: 63154 - DNA, 6581 bp, Oryza sativa
ttttaatttagtcctcaataaaactcgcacccaaaagaaacccaagaaataccaaattagactcggagttcgactttgtgatctgaccggccacctcgcatggcaagacaggtctcttccaaatttagccacgtttttttttttttggctttccgggaaggatgatagcactatcatatgatccggattcatatagtacaatcctacggtaccaaatctatttctgaatcctattgtttttcattctatgaaacaagagaaactaaccttccatccatatattacttatctgggcgatcacatacgtgtgagaagtgctactaagagttaatagtagtgctaactactagctataggcacatttaaacctaacattttataatagattaggtataaggtgagctctactttttcctccatgtttcttccatataggtttatagtatatttatagtatacttatagctcactattgtccttgttctaattaactaaaagtatacagcaagcttaaatatctgatttgcttgctaggtcatgcattttttttcatatagagttttctattaaaatacttatccgatttacgattctattacaccattataaaaatagattttttaaattatttatagcataatgtaaattacttttagatttgattaaattacttcttatacatcaatgaatgtaaattcaataaagcctaaaagtaattatgtatatgctattaattactactctaatctcggtaccacgcttataaaagattaaggtattctatctaagcggagcgatgagaatatattttacttaaataataagagtaaataccataaagcagtcacaaacacttatatgaaggcaaagcatccgtcgaggtacaagctttgagaagagcgccaacagactcagcacttccccatacttccccctcactctctcctactctaagcattagctatatagagcttcacccttacaatatagcttataattttgtatcttggtgtgtgttgagaatgaggagtatgaagccaatagtgtggaggtgacttgagagagtggagatggcaagagaatattcttcctccagctgtctcaagcccccacttgtcctcaaaccgtcattggatggcagtttccttccatgagccttgcgccatcagctttaggagggcgatgagtggtcccctggtgggttctactgaaccctgggcaagcctcctcgtgccacctttcatctgggtcgctacttggtggaccctcatggcggtttgggatgtttgcgccaatttgaggtaattcgatcttctcctggtgtaggccctttgatctatatatgtactctcctctcgttgattggagttgtgtcttcttacttatgtaatcacctacatacaaatatttaccaacacttgtggaaatagttggtaataaaccactaccagcatatatgtttggtggtagacattgataagttttatgcaagaattgacggtcaaatttagtagttaaggaccatcaaagtacaatcaatagctgttgacactaaccataagcaatttttactcaccttgtcttggttcatttcatacctccccttcatcctaagaaactcataaacgtaatacccacaaagattgatagaatcaagttacttctggcactccatgaagcaatgcaagcaatatgtaattgtttcattgtttgtatcatcgtaatattaaggtagaaggtttggaaatgttgtcttacccaagagtgtacgttgaccatcatttgagctggatacttgggatcatgttgcccattcctttgttggatgcaccactcgcaagccctggtattgaaaatatcaagagtcattataaaaccatgtacgaagcacaatgattatttttatagttggaggcaatattcttacccattgatgatgtagataaattccttctataatttttcatcagaattgacggagttaattactattattctgctctccttaggatagagtactaataataaaataaaatgtagtgctcaatataaatctataaaacttatgttagtttctgggttgtcggatttagtaggtgcaaaatactacctccatcccaaaatgtttgacgccgttgacttttttaaaaatgtttgaccgttcgtcttattcaaaaaatttaagtaattgttaattctttttctatcatttgatttattgttaaatatacttttatgtatacatatagttttacacatatcacaaaagtttttgaataaaatgaatggtcaaacatgtttaaaaaagtcaacggtgtcaaacatttagggaaggagggagtaatttgtatgactagctatttgaattaatggaattatctaaagtgatagggagtaaatattttgtccttgactatcagtggacccattaattgagcttcctatgtacaccgatctccttcctttttttcccattgagaaatgtttttccttccttacttattggcttctttttttgtgaacgtgcaaaaatattgcatgttagtacttattgttagaataaatgagttaggcccaatttatttctactaaaatctcaagggcccataataaatgttaaagataataataccacattggggattaaatgtggagtatatcaacttaaagagagagttatcggagattccccgttgaccggttgaggtgggggtcggatagccacacacgcgtgcgccgagccaagcaggccggcccgtggcgagcgtgcggcttggctctctctctctctctctctctctccttttgcaatggttcagaattcaactccgcgagattacctctgtaacaggcgggcgattcaatattgattgatcgcgtcattacgctattaggacgagacacagagaccgacattcagtttttccacgaattctctccatcgctggttcgaggttacctctgtaatgggcgggcgattcaatattgattgatcgcgtcattacgctattaggacgagacacagagatcgacgttcagtttttccacgaattctctccatcgctggtttctcccctgtgcctgtgctgcttctgttcttcttcggttctgatcgcttgcgcacacaagtgattgggacgagcagggcctccggaaccacaccctcgcctgagatctgcacgggtaggcgggtgatcaggtttttggggagtgcttccgcacgactgctcgcttcttcgtcgtcgtacggttccgtctgcatcgcgtgatgtctactggtggtggcgcacccggagcggcaggggttggtgcgccaggagcaggaggtggcgcaccaatcgacaacaccaatggaggcaattctgactcacaatccagtggagggacattcacagggtatagcattcttctgttacctttcattttgttaaagctgtcagtcgcaaatattattgcgttgtctcaatgctgatgcttattttaccttaagcatgctcatggttatgtttagttttatcactagaccacttcacattgtgcatgtcatgtttattgtcttaatattttggattaaaatatgccgattttttaccatatttccaacacttattaccttcctctgatgattggtctcaagttaatcctctaacaaatacattgagatcaaggaagccgaccttgtatcccttcgtctctgcaggatcatgctgcattctaaaaacactgaaagtaaaaacattaaaaaaggtcacaatttaatgaataaaactaatacatgaaatggtagttttattagagtaaatacaatagcagactatatgccagttataaacacatttcgaggagataaaagataagagagaagagcagcgggctacaaatatgtagccaactgaaacacggactctaagatgcacacactggtggggaaagcatttgcagtcccggttcgtaacccccctttagtcccggttttcaaaccgggactaccaatccaggactaaagatcgctatctttagtcccggttggaaataaccgggactaaagatcgagctgaccttttttttttgcatggccctgttgctacatggtttatatatatatatatattgaacttccgcccaagtctttctctccatttgccgcggaccaaatgacggaaccgataccaagccctacatggagtttaaagctatgattcatagtagcaattaattataacaagattcttaattaatgtcacgcccagaaattcccgaatagaattccaagcagaatgtgcataaaaacccccatccaggaccggccggggtacacaaacaacaaagttaacatacagatccatgtcttacaaacatcatataagtcttacatatatgcagcggaaaattaaaagataattggagcaaagccttgacttggaccgtagcgggatcaccactccacaggcatcctcgacggcacggacgaagcctactcctcggagaaaccgccatctgacgcatactcaaattctggggtttggggaaaatagagcaagactgagtacaaccaccgtactcaacaggtcatatcggaatagggggtatgatgtagggtataatcaaaggataggtagagcggttcatttgcataaagcgagcatttataaacagtagttgaaaacagtaaaaccgttgtaacaattaatcaatattaaccatccactgtccaatgctataccacgttgcaacaggcccaaccatccacctaaactaatcaattccattagactagactagggtgagactcatcacggtgaatctggttgaccgcccgtaaccgcgggcacggctattcgaatagttttactctgatcagaggtgtataactgtacccacaagacatagccccacaacacgtttctgtgcgccgacatgccaccacgacataccggatagaggccgtgacaggacacttcacataaccccctctaaccaagcacaccacacctcaggtttcacccccactcctcgcaaggcagcgggcagtcccctctcgtgcctaggtgaatccggaagccgcataagccgtcgtagggcccatccaaactccatcacgcccatccttgcctggatgcgtcagctagaggaaagctacactacaagcccagccgttgcccacgctggcttgtggtaagtacgatgaattcttccagggtttcccgcgaaccggtccttaagtgccataggcgcgaccaacaaaaccatgcacccagagcccaccatttagttcattttaatttaccaacaccggagcggtggcactaaaccaacatcaacactaaaacctgaagtctaatcattaatgtgatttcccccatggtgtgctagttgaactaagcatggctaagcaatctctaattcaacatctagtcatgttatatcccaagctaacaaaggagaaaggtacaaaaatagcatggctgtaacagtaggtaaacatcccatagtaacattataaaacaatgcggtatttaagggaaaacggtagagcatttgcaatataggatcaacatgttcaagtgacaagtatgacttgccttgctctgctgctggaggagcctcggcgactatttcaaagtacaccggagcgtcgagagagccggaatctaagcaacatacaaagaaaacaatacaaacaggctataatactacagaaacagagaacaaaaccatttttaatagattctatgcatttttcttgattttctgagacttgaatgggcttaaacagagctcggatgaattttctatgaattctagaagattcactgtgttttactataaacagaaaaatccttaattaatttattgcgcaataattaaattcccggggagagaggggcggcgccgacatgcgggccccacatggcaatgactcgggggggcggttcacggtggaccgggtccacggaccggggaggagcggcgcaccacgtggtgcacacgtggcgccgacgcggcgcacacgtggcggccacgtggcagccacgtgggcggcggggttgaacggccccgatctaccgcccggtagatcggacggcggaggcggctcgcggccgggcgcgcacgagcagggcccaagccgacccggcggcagtggcgcgcggcggcgcagcgcgacgcgacggtgacgcaaggcggcgagcggccaacggcggagagcggcggcgatcgacgacgagcggcggcgagggatgactggggagatgctcacaggggttcggccgacacgagggggcgacggtgaacggcggcgagggatgactgggggacgacggggaacggcggacggtctccggaaccacctagcgaacaagatgagaggggttagagggagaaaggaaaatgggagagggcgaggacgccggccgaaggcggcggccatggtggtgctcaccggcgcacggggcggagagggttctggcggcggattttgacggaggagaggtggacgtgacgacccgcacgacggcgagcgcgacgacgttgatggcgcggcttggcacggtggctagcggcgctagcggctatgcggc

SEQ ID NO: 63155 - DNA, 3331 bp, Oryza sativa
ttttctggaattagactaatgtacacctgcaaacacacctatgttgacctattccatacttcaaagggaaggcattttcatccgaagtttcagcttatctaacatttttcttcagcataaagcaacagtccaccatggtccaagccagcttaatcatagttgaccaaccatggatacattataaaatgacttagagttaaactagaatttaccgtacaattggatggctggatactaaaatatgtttgcatctagaataacaagaattgcatgtttgttactgaaaatacttgtaatgcagcagatctaataaatatctaattagtctatatcgttgcaatctaggcccaccatggtaaatggcatacattttctcttatttttccattatggcagtgatttctagatcttgagggtgaacagtgccaacttcttttaaccttttccttaatagtacaataggccagtggcgaatccatgtgttagatatgggatgatttaactttgcatgtaaaataaggaaaaattaaagaaatggccccactaacatatggaatagcgataattgacccccagtgtaaaatttgactcttccactgtaataggttgattgatttcaaataatatctcaccaaagcaaaggtcatatgggtcttttggcaatgtgtatacttgactgacgtcttagtttgaaaatgcaaatcttgagcatctgttctccagttacagcaatcatacttatccttggtaacatgaagtatacagtttgagtacttcacacagctactggacatcacaacatactagttctatctaaaaacacatcccactagttgttagttcccaacttcctatcacattattttcttgaattaagaaagtaaagaatttgttatgaactagatggagcaaagcaatttgggatgaaaataaaacaagatgcagttttgaatccccatggcaacaagaaccttgctgaaaagttgaaaaagaaaatttatgataactctttcaaggacacatgagctataaaccttaaagaatacagcaaccagtcaaggttgagctgttcaaatgcaaacaattctggcaaaacaaggattggtggaaaaccccaacatagagcaattttcatagagtttctttctttggtctcatttttttaaatgcaacccatccaagcgtcacatattatttattgcaggcctaagtcgaattatcctcagtctaattatgcaccaatggagaacctacacaaccaaaaattcatgtttcaatatgctaatgtcatgggtgcatcttcaatcatccatttcagtcttatagaagtcactaccattcagatgatgatgtggccatgagcaggctgcaaaggctgctagaaagcaacagaaagcccgggcaatgcaaagggtgactactaaggataactcctggaaaagaaagaaacaagaggaaacccatagttgaaaagttcttatgttataccataagacattatgctagttaatgtatgcagtgaaaatttttatcttgttatttgatcatgccctgctgtgagcttgttacagaggacatatgagaagagggtgtagagcacaccaatcaccaactcaatcatgtaagctggaaaagttgcgtcctgacaaaatcatggactaagagtctagctaattactactccctccttcccaaattgatcatcatataagtttatgcacaaagaccaagaacaaaataaatcacatcaatcaatacaccataatgcatgcatcgattaaaaccctaggccaattacaccctagcatgcacacattctcccatactgcattaattgtattctgataaaatccgtgtccatgtagttatatgatgatcaatttgagaaattttgaattctattacatgatgatcaatttgggaaggagggagtaattagcaatatgaactatgtgaaagctctacctgtgttattctacagtggctcaaacaacaaatcaacaaatagaaaagcaaaattagaataggaaggagccatcatattaaaatccggcaaaagtccaaacaagcggaaaagactttttgttgatgtgccttgaccagaatttttttcttcaaaaaaatcagttcatggagagaagatatgaccatattgtattaggtaatttgctgatttgcagagagtatgctgcaacctgtgagcatatatccagatcatggaagaggcttactatcaatagagacttgggattgtgtactgaacaaaccttagggctgatgccagggctgacatctgtagtaacatgtacatctttacaactgctgtcacagcattgcatctctccaacagggttttcattgatttcagggttgatacgaattttacttaacttatcttgaatctcattaacaacagtgctcaactgagatgattcttcttccaatattttcataatgtcatccctttgttgtatatgcaacttttgaagagttgaaaggccatttctcataaactcatcatagagtgcctgcattccaaagtgtactacacaaattaaagatgtcatgacaaagaaatataatctcagttttcatacctgtcttttctctaatactcgtgcatttctttgcaaatgttgctcaatttcaaggccctaaacatccaaaaacaaatacgtcagcaaagccaaaagattacgcttctcctaccatttaaaaaaaaatcgtcttaccattcttagattgttttgaagcttagctattttagctctcagtgaatctttctcttcttctagagatgcctataaaaaagaatagttacttagccaatggggcatgttcttacaaactactgcctctaattctgaatgtaagtcattttagactttgcatcctttgtcaaagaacaaattgaaaactgtagcataatttaacttaacaaattagaaaaagcaaagttgtttaacaccacaatcatcaagtatccgagtagtatgtatacaaagggggttatataagaaagcttaagatcaaagcataaatgcctctaaaaagagaaaaaaagagagagtatcaacatggccctcatttttgcactattttcaccatagaattggagcgtacgccaggataaatgtctcctaaatagtggatatagaatcaaacaattcatagatgtgtaataactcaatttgaattcaattattgaaatggataaagggctttaagtttacaatgtacttcgaagttgaggttcctccatctgagctgaaactccaattatcagcagaatcgtccagaagaactgaacatttttcttcaagagtaatgt

SEQ ID NO: 63156 - DNA, 7984 bp, Oryza sativa
taatgaaaagaaaatcattgggtgtcacatcggatgtttaatcggatgtcggaagggcttttcagacataaataaaaaaaataatttcataactcgcttggaaaacgcgagacgaatcttttgagcataattaatccgtcattagcacatgtgggttactgtagcacttatggctaatcatggattaattaggctcaaaagattcgtctcgcgattttctccctaactgtgcaattagttttttcatttatctatatttaatgcttcatgcatgtgtctaaagattcgatgtgatgtttttggaaaaaaaaatttagggaactaaacggggcctaagtagataaggcaagtcatacacgatgacctaccgaaaacgttattaactgctctgttctcaacagggccggccctgggcctaggccggttgtgcaaccgcctagggcctaggccggagggggcccatcatttacccccccagcagcccactagatcaggtcatcaggtgatcagttaggaggcaaggagcacgtcgattcatctgccggcccacaccgcgagtcccgagaagaaacaaagcgccagagcatcacccgcgccgcgtcgcttcgttgtctcatcaccgcgccgatgccctagtccgcgaccagcgaccgcgagtccatcagtccgcctgtaggctccagcgcctgccgcggtgccgccgtgcatttcaaatgttataatgttacctaaaaaacatttatcgggtgctaaaaaagaaactgtcccaggaaagattgaatggattggctatgtgtagcattgagaaaaatatcttggacaacattgatcttcaaactgtcattgatgatttcgcttcaagaaatgctcgaagaagctcttttttataagggacacgggatatttgtattaaggtatttatactactttgtttctatggcattttttagttgttaattatattatagttattatttatcgagaataaattattatattgcagcttgcaaattgcttcatttattatttaccatgttaggaatgtttatttgtgttactatatggtatatggtatatgtgcttatagagtataaatattagaagtaaaaaaatagcattaattttttaagggtccatacactgtgtttagttcacactgaagtttagaagtttggttgaaattggtacgatgtgatagaaaagttgtgtgtgtatgaaagatttgatgtgatggaaagttagatgtttggaaaaaaaaaactttggaactaaacaaggccatagtgccccccaaatgtcaggaccagccctggttctcaaatggaagaatcaatttcagatgagttatatgtacacatgcttatgttattagtacttttgaagtattatatctattactccgtccgttttatattataagatattcttttggttttaactaaatttataaaagaacataacaaaatttttaatacaaaataaacttaatatcaacatatgttcagtgttagatgttgctaaacttttatagaaactttaatttcgaaaaaaaatatataaaactttgtgaaacggagtacaaaaccgaacgtcctcaacagagcagcccttctagaatctagactttcagtttcacggcatgttgtagtaatctcttttcacatgcatattctccgtctactggcgattttatgggctgtcgtttgctgcggttgtcaaattgtcaaaaagtccctttcacgaagaccttgcgttaaccggcagatacatgcttccatccaacccattaagttggtgtttaatgacctgccggtactgtgctgctgcgtcttctgatcggtggaatgcacggaaagcctgggcgccgcccgcgcaagaatggccgcgtacgccaatcctgacgacggtttggaattcttcttttccccgacgtactgtcaatttattagtatcgggttactatgatatttttctatttttaagtgtaatttaatattcatattaattatatatatagccatttcataaaaaatagaataataataatatacagcattaaaaagagagaacacaaatgtattaagatagttttgatttttgaatattgtctagtttgaaatagttagctaatatcccgatagtaacacgattttaacgatcctatgctcccgtattccgatactagggcgataccataaaaaacaatcttaggatcgatacagacaactttgcgtaggtccaagcaaattaggttggttagtattgagcatctagaacaattaacaaactggcagttcccatcaatattttttttcctagggccgcagtcatagaatttggcaattaagtaccgattaatcattgctgcttattctaaatgaagtgtagcgtatactttttacatccctaaaaaagcaaactgatcttttctttttacaagtggaagtataacttgctacagttacaaaatgatgagcagtagcttctagtatgatttaatgtactaacaggttagaatcatacaatcgacatatggattaaatattaaggtgactatacgcctttaattgaaggtatttggatgcaagctaatattatctacgtacctatatatccaatacaacttttttttaattttttagaggaatacaactctttccttataacaagtattatgcaccaaaacccttcctttcctcactctctccataagctatccataagctagaaggggcggagccacgtgtaaggtagcttggtgttcaacctcatcacacgtggtagaaaatcacgtgtaaggtggattacagccagggttggattgtccaggctcattcgtgaatggataatgcgattttagtacgtatagagattgaaaatagtgttccatagttagattagttacggctcaaaaaaattgctttagctgaggttcaacctgagattaaacattgttttagacctcaaggagagttggaggtgtagattatttatattataaaatgagtattagatgtgtacacctttgttggtatagattccgggttttaatccattatagaaaaaaaaacttacatatagatcggcaaccgatcacagtaattaagcaacaaccattaattgtactgcacacttcttcgattggttctcttcagggtagccacacatcgaaaggggctgatctgaccaatgcacattacaaaccaagttcaaaaagacaaaaaaaaaaaaacatcacattaacaaagctgaaaaagaaacaaaaggtgacctgaaacaaaaaattgaagatcccctttcttccagctaccccagtaattactactactccaattaattaagattccacataaacacacattactggcttactgcaactcacttcaggtgcccttctttgtgtggcctctcggcgagctcccaacctcgcgcgtgccgcggcggccggccaacttcttgccgctcgccggcggcggcgacttcctcggggagcccagagggcggcgcgccgcgtcctcgccgccggcgcctccgttgctcagcagggtgggcgcgaggtaccaccagatggaggtgcagcagatggcgaacaccctcccgaacacggcgaggcacaccagcatcagcaccatcaccgccggccagtagcacgccggccgccgcatccgcccccacgagaacgacgacaccctgctcgccgccggcgcaggtggtggagccctggtcgcgcgcgcggcggaggcgccctgctgctgggcggcggcggtcgacggagacgacggcctgggtttcttggcggcggcgtcgtccttggggcgccgctgctcgtcggggagcttgacgatgatgggctccaacgcgccgttggactggacgaagcggaccatgacgaggccgccgccggagccgacgcggcggaggatcttgtcccggcgggcctcgagctcggagagcacggtggagaacttgtccagcccgcgctcggcgtaggggttgatcttaccgccgccgcctccgccgtgcttccgcctcggctgcctgggcgacccgccgccggtgccgcgcgccgccgggtcgtcgtcgtcgacgacgtgcttgaagctggccgtgccgcataacattttctaacgaaacgagctggtcctggtcgcgtacgtctctcgattttatcgatctggagtgtctgtccatgtgatccattaaaccagacgcttttaagtgctcgagccagtggtcaaagttttttttttctgtaagaaaaaaactttttaatacacgccgggtcaaatagaatcttctgttcatggtgacgtacttcgaatgtgcaatgatgagggtataattttctcagcatcagtgcatctcgtaaaagtaagtttaaccgaataagatataattaaataagttaatctagtatggaattggttatgtagatatcctctcgttgattacgtgtcatctgaatagttataaaaaaaataaaaaaaatcgacaacatagattaatataaaatatatcactccacaaatatacaagaccaaattcaacttttacaagttgcaacaaaagaataaaataaattgaaaatagttatcgtacattcgcagctatacttgttatttttgttacaacttgtaaagttgaattttaacttgtgtatttgtggagtgatatatttcatattaatccatcttaccaatttttttcaaaatttttatgactatttaggtggcatgcatgaaacgagagatatctccttgagagatgaaatcactttccctatggaatgtaatatatcttacattttatttgagaagtttaagattcttacaatctgttggttggtagccattttctgcgaatcttaagaagttggattttctagcttttgggttttagagcctgtttggggagcttctagctgctatagcgttttccacagaatcttcagctcctccaaacaattcagattgacaccttgattttgagaattcgcagttatagaatctagaaaatcaagaaagcaaaagctggaaaacccaacttctctagattcttagaaactggctaccaactagcatattcttataatcttaagcttccccaacatggcctagttcattttttgggttctaggtgataatctagattgtttgggggctaagtagactgtagttgatagaggctccctaagcagactctaaaatatgccacatctcgtgtcgtattagattaacttattctgagacagatggagtagtagactaatgtggattctgagacaggggagtagactaatgtggaaataggaagagtattatgtaacagcccttcctccaaaaccccgcagcccagcccaaccaacaagcgggcccacttacacataccactccacttacactttcgtcttcacttcgtgtaaaagggttaacccggttgtaatatggttagagggaagatgtcttataagttggttccacccttgctaaactagcaaggtgatactaaatatgtgcacacagtttacatgggctacacatgtctcatcctaattgggccaagatgtcacatacacccccctcaaagaattcaatgtccccatcggcttaacttacccatgtagccacacatgcttaaacaccatgtagtccacacatggcatataggtaaatgtccataaacatgccccctctcagcgcacgtcccatgtgcctcacacagagcccacatgcgctatgcgtcatatgtccgtacactgactcgtacgtgcaaccgcgagggtcggctgggataccatttgtagcagccctccctccaaaaccgtgtagccagcccattcgatgagcgggcccacttatacatgctacttcacttacactttcgtcctcgcttcgtgtaaaagggttaacccaggagtgatatggttataagaaagagaccttataagttggttccgcccttgctaaactagcaatgatactaaaatatgcacacagctcacatgggccacacaggcctcatcctaactggaccaggatgtcacatattaagcatctacttatagactttgcaagtaattatataaggacactatgattgaggcaaccttatacatgaggcctcgccatatgcaataaaaatatcacttttctctcactgctactttgtctctctacaatacaggtacttgccaccatacaggaggggagagcctgccatgggaaaggagaagaagccaggggagtgccaggatagtcgttgaagatccgcccacgacagcctactaccatcgtcaccaaatccgcatgtgacagtcgccgccgccgttggatccgctcacgactgtgtaccacgccgacgcacccgccatcgccgaagccgcccgagtttatcatcgctgaagatggtgtgggggaaaaatagggtaaaaacgacatgaagtgacatcctggtctatactaaaatatgcacacagctcatatggaccacataggtctcatcctaatttattataatgtgggatacatcttaataccctcgcttttcatatatgaaggtaacaatatacctcagtggaacctgtttgggatccaccataagactaacttaggaatatatattgctgatgccctacgcgaacatatattagctctcacgcaaaagctgtttctagacatgctataatataatgcattaattatataaattagagaaagagaaagaagaaaaaagatagagataattttatagttaatccatattatatattagctctaatataaatttatagctagtagttacctctacaattaaacttgctctagtcatggttatgaggaaatacaggcttactagtgtttacatcctctattataatggcactaccattacatgcattgacgtatggggcaataggagggtgggaccaggggcagagctagagtattgtaggagggtgggaccaggggcagagctagagtattgagggaggtacctaggaatccggtaaagaaaaatttgtagatatacctgacctattttcaccatgtgtgcaccccctcgatataaatttagatacccatattagtttaaaattgatataaagcagagtaaattaaacaagtggcactcccctccatctcgctctatctccgcctctgggtgggacccacatcggccatatttggtcttgaggtatccacttcaaaagaaacttctctcaaactaccgataggtggaagagggcgcgttatcgatgtgaaatggatccagagggatctcctcggcataatggttcgtgtatatattttacaaaaacacgaaatcaaagttggggactttttagtccattttttccaagagtctccgctagttgaaccgcgtccagtagacgacctcttccgctcatctccttcgtcaactctttgatagggatactataacctaggtccctaaacttggaatggatggcggagcgtattattgtaatggtactgacattatgatagaggattctcaccccacttaattactacacttactaccctgaccctgttaattttggtcataaggtttattcattcatcttaaaagaatattacaaacacgagaaaatatacgtacgataaaacaagttgcagcagaatgaaagtacttcgacgatggttttcttcaataagacaaatgatcaaaatatcacgtcaaaaattaattacatcatctttgatttatgccaaaacgtgccttatagctttagctttcggggcaaaactattgtttgggctaacaagtagtaactcttctagaagcaccttccgttctagtcacacatgaccatacagagctgcacataaaacctctttcagagttcatattaagtttttgttgatgtgaatccggatttaattcggtgtcaaactttaacttcaacaaaaccaattacgtgtcaatcaaaaccactatcataaacatggtacaagatgtt

SEQ ID NO: 63157 - DNA, 42530 bp, Oryza sativa
  unsure (1)..(42530): unsure at all n locations
gggggggacgacgcctgcggaggagacgacggccgccgtgggggaggcagagggctctgcgccgggcgtgtcgcgtgggtcgcgcctcggttggggttggggatcgaacggtgacacggtactaggcagaagggatgaaaacagatcgaatacggtcggaaactagctatatcatatttatttttattttttttctcggaatcgaaatcggaattggaaacccgaatacgaaaacggaatcaaatattatcgaatgcagatacagagtgaatacgaatcgaaacgaatacggtaacgaataattatcaaaatatcgacacccctcaaaataagtttcttaaatcgaggaagaaatatagccattagttttcaaaaacaaaacgtcagtattttcaaattttatctctatttataagggcaaggggagatagaaaatgttatgtttacttttcatacaatttatgttatcatgaaattaaataaattaatgtgtatcactgaaattttcgcagacgcattgaaatttttgaaaattggttgaatattttaaattttgggttgaacatttcaattgaaagtttttaaaaattcgagtgattatttttcagaattgaatttttttcatttgtttgtacgtggaccacttaaggacccacatggaaaaatcaatttttccatacgggtaacttaagaagccgtatgcaaaaataaatttgaaaatttgagactagtttatctcactcatatgaactccaaattagatgattcttttttctaaatgtttctaaaatcatactctatcatattattgtgttattactgctattattttggtcattttttcttgtgactttgttttatcaactaaaaatttgaatttcaaaacttcaaataatattttgaagctgtaattaatttcagctgaaaaagtcatcaacataaaagttgtagagctcatcaagacatacaacttttattttgactatttcttcatccgataaagtgatagtaacattgttcacaaagtttacatatctctcttatatagtttatagaaccagatgagacagatgtaaattttgtaaacaatattactatcactttgtcggatgaagaaacgaccaaaataaaagttatagatcttgatgagttatacaacttcgttgttgatgactttttcaattgaaatcatttagtattttaaaatattgtttgaagttgtcatattttgaaattcaaattcaaacggttcaaacaaaatcatattgaaaaatgtccaaaacaaaagttgtagatgttgatgtgttatacaactttgttgttgacaacattttcatttgaaatcagttactacccggaaaattatttgaatttcttatatttttaaattcaaattttatatggtttaatcaaactcggatggagaaatgaccaaaataaaaatggtagatctcaataaattatacaactttgtttttgacaactttttcttacgagttgattttaatgccttaaaattcattttaaagagccacatataaaaaaaattgatttttacattgaaaaaaaatccacctttttttaccccaaccttatctactcttctcttgacccttcctctcctctctctttctcagtttctactctctctctctctctctatctctcacttcctcatccacagcggcgccgggcggggtgggcggccgcagcggcgcggatctggcgccggccacgcggcggccggcggtgggcgggcacggccggctagggttccagtttttttttctaaaaaatattcccgaatatccaatgaaaaatcccggatagtttctgaccgttttccgattccgttggatatcacccttactgtattcgttttcatatccgagaaaaaaatccgaattcgtttccgaatccaagaaattccggatagttccgatcgaatttttctgaatccgaaaattggtccggatggacggaaactatccgaaccagtttcatccctactaggtagggccggatatcgagccgtttcagctcggctcggctcgatcctcgttacgatcctaaggacatccacaatctgggacacatctagacgtagggaaactcctatcacaatgaaagatacccctagaagcccaacgagtgtccctaacccaaaagcccacgtaggtattttactatactatccctctcttcttctctctccccctcatttactcccatctctctcgtccttgccatctctccctttctcgtctccctctctcccgttctcccgtcgctgcccgtcctcgcctctccctctcgctgctcagccgcttgccatcgccggcagctgcgagggccacctccctccaccaccgtcacctctccctctcgctgcgaggccgctcccaccgccgccgcccgctgccgcgcggtggccgacggagggccgcgcgcgggacgcactggtcgacggcgagcggcgcgagggacgggggtggccgacagcgtcgtcaccgtccgcctcctccgcctcaccggtctcctctacctcgcgccatccgcctccccgatctcctcctcctcgcgccgtcgccggtcgggggcggcagatccggcgccctagcgggcggatctgtccccccccctagccagatcggggaggagatggtggcggttgtcgccgtcgcctccgactcctccccactgctagcgacaagaccgagggtggaaggggaaatttgtggagcgggagccgtgtccacgagccacgccctcctccaacacgtagccccgagcggtgtctctagaaaagcagccgaggcgcgcgttcctctgctaggggtcacgcctctctcataatggatgacccggcgacggaaagcaggcgtcgtttgcaagggcacgggttgagggtaccgattatggatggcctaatgagctagtactccatagaagtttagctcggtcggctcgttggatagctcgagctggctcgtttagctcgtgagccagtgactaaaaaatacaactgcaggcaaattggtgaatcaataagacaaatcaacaaaaacaactacaagttccatccatgcatacatatttcaagctttcagcacaaagcagcaccacttctgcaagcacaagggcacacacaaccagtccaacctttgttccattgcattagctgacgacataaggacgatgtcatattattaggtgtttgcttcgggattccaagcttgttggtgttgaaagcacttcgtctttctcctccatggtgcacacaggcctgcggcaggtggcaggatgtgcaggtgacaagtggcgtggttagctggcggcaaggggcgaagggaggctagagatggcgtcgccgcgtccgctggactgcgtgaaaaggggatcgagagagagagagagagattgattgattgattcgagagtttgagatggtagatggatagggttttggaggtttatatttgggccttatgggccgcaagttgggagaaagattatatttgtaggcctgtagactactgaggtgtgtcacgatgtgtgctgtgtagtaaggtgcttatgggctaccctaacacgctaagctcacaagcagctcacgagtcagagctggctcgttatctctaacgagctaaaatgctagctcagctcgttagaaaaatacaacgagccgagttaagctgagcagagttagtcacgagccgagtgaactaacgagtcatgagtttttcgtccacccctagtactagggtgacgggtgaccatacgtctagacctgcccagttgtcggcgccacgtggtcgtggctacaactgcaagcctgcaacattgcgtgattgtatcacaagtcggctcatttaggtcacacccccagtatgccatatgtgctacaccacccacgagtgagccactcattcccacaaaaaaaaggttcatttgcatcccccatccaatgttcgagtttgaatggtttcccacaactataaaacccggtacagtataataaaacttgatatagcgcatccctcatgttgcaaaacaagcgaaaatgaggtccattggctgtttggatgatgtttttgtcctatatgtcatgttaactttgtccactcgagatgatgtgtcgcctacgtgacaattgtataaaagcaggggcggaggttcatgttaaaggggggacccaggaacccggttaagaaaatcttttagcattagtttatctattttcatcatatatgcaccctcctcagtgcaaacttaagcacccacaccagcttaaatttggtccaaaagagagtaaagcaagcatgtggcacccctctccatttcactcgcttccaaatgtcagtaaaggtaaatatttcactcgcttcctctctagagctcctcgccatgataggcattggacaacaatggtggtggcctcctcggtgttaacagcggcatgcgctcgctggagctaggaacgaactcgccgaagcccagtagctgcaccacaacacgtggctatttccatggcggagtccaaccggtggtggcttcatacaacaaggagaggaaaagggagaggacatcgagaaggggacgaggcggggctcaacaatgtggttcatcggtgtgcactactccatcaccagcaccagacccctagctcgcctttgccacgcccacaccagtcctagcgttggacccctctccgtcctcccactgccaagtgctcatggagaccacaaaggatgcgacgccatctcgctgagcagcagtcgccccagcagcaagaggagcctctccaccaccgatggcctttggctaatgtaggtccaatcaccgtcgttctcatcaattggctcctctcatcagtacaaagggaggagacagagatagagatctcgctcctagatccatgagacagtggtggtctttgttgcgggaggaggccgagactatagcatgtggtgggacaaggaggaggaggacctggcggacccgatccgaaacaacaataatgaggtgacacaagggagctttgaccggagcctagcagtgatgttaatcttgtcctttgtcaggcaagagctcctgtaatcctgcctactaggctaaggctgaggctgagtggctcagcggtgacaggggagcaccggggagcagcggcgggaggcgttgcttcaccacctcaccttcaatctagagcagaacttcaccaccaccgatgttgaggcacacgtgtcgtgctcaaccacgtcaagaagcaccgtctccaatgtcattctctttgtccatcgcatgtggatgcctcgtcagtcaaaaccgctatccaaactgccttaggactacatttgcactagtcttgaaagatgaggtatgtgttgtatcagttttgcgcttgaggaacatgaccaaaactatactgattatctagattttgtattgaagtcatgacactttatttacggaatcactctactacgaagtgcagtggcagacacacccattggacagggcgggtcggccgacccagctacagtccgtgtcgcccccacacccccaaacatcatttcagtcatatttctaacacattagttatcagtctactattgaataatcagataaatcaagtattttaagtaggaacaaaaacatttatgaaaatttatgtataagtagtatcattttgactgtttctgattttggccatacataaaatttgattttctttctatttctttagtgtataatacagtctacagttgtggggatacccggtttgagtatagtatcccgaaaccacccgcgaccgtctaggatttcgatcgcgcatagattgatatacagaacagctttcgatacatatacccaagtttttacagaaattattacataaaagataactaagacaggttttaggggccgaccggccaaacacactccctacaaacaaaagacccaaacacaaaataggataaaaacaccacaggcaacgcttgagagcagatcgacctagaacaagaactcgtctgcaccatagaattcttccccttcctgcgcctcctcagggaagaactgatcgtctgaaccacattttatgtaagaggtgagtaccgaggtacctaacaagccacattcataataatacaaatagaatatatgcaaggcgtacaaagaatatagttcatcaaggaggttgcataacaagcctattataaatagtgtttccctactttatcaaacattttattcgcaaacaattgtaaatcatcattttaaaacggtagcaatattaatcaccatttattctcatcttcatcatattccatattttaatttaaaatctactcataccatgataaataggaatcacccaatgacatagcttcttaaccggaagcacggcacattcgaatgatttaagactcatctctgcagagactgcccagctttacccacatgatgnnnnnnnnnnnnnnnnnnnnggacaacatagccgttcgagagtcccacttactactagttactgcccagtgggatattgatccgtcctagcagtcaggcacttgctgggcctaagcaaggctagacggtcgctgctttcacgggttccaccgttgtggatcatgtcaacctggccgaagccccttccacatgtccaccccagacctgctcatagagccaccctacagtctttcatacagtgggacaatgtactaggctaagtctaattactcagtcctgtggatgggcgcaaattacatcattttccatggcataagggggtagtccttatatccggggaaagccactgaaactagcacaggcccgtgcatactttaagtgtaaatatacactttccacaaaataattataacaacatgcacggcctcacacaccacaacatccatcttcacccggaattaaacttccatatcactccaggcgagtgactcatatcaaataacacattttatatcacccgatacgccaccacgtgacgacgggtaaaccatgtatatgagtatagatatttggtggtcttatccactagaatattattgtgaagtatataaatctacacctaggttatcaaaggacgtgatatagcaatccatggatttggccaataataacaatataacaatgggtaataattaaactaacaagtttattaaaaaataattcatacgcaaaataattttataaatactcaatgcataaaataactaagtggttctctactaggtttcaatatgatcaaagattggtactgtggcttgcctcgtggaacgtggccttcggaagcttcaacgtagccttcttggtccactttagttcctacgagtccagtgggatcttcaacgcgatctaacgtacgcacaagaagaaacgaccaaataagcctataagaaaaatactataaataaaaattaaaataaatggtgaaggttggagccagaactgtggaaagatgcactagaagttctatggtttcaaataacaaaatatcactgtaaagcaggggtttatggtgtatacaagaatggacatgatgcagaggtttgggtactggaaaccggaagaaattgtgtctagaggtggccgaaccaaaggtgaaccgaaggcaaaattattgaaccattaaacagagccttagccagatttgtttagctctgtttcctgtcttatggttggattcaaccatgatggcacagtaccacgtactactgttcatcttcttcagtgagacgaacctaggggcaagggaatagagaacagggaaaaagtaggaaggtggatgctaggctgtggtgggtgataggtaaggacatcatgagcaaaacacgttctcaagggtcgcgaactcgatgctgttgttagttttcagagacgacacccacaccggccggaacaggagttccagatctggagctatggtgacaccgggcatggaagtggcagctctggtggtgaacgcgggcgggtgagcgcgtcaaaacgcgttcccggatgagaaggttccatttttgtggttagttgataaagaggacattctggacgtgttggccacggtgatggctatgacagcccatgggagcttcggaaaagctcgatacaaaagcggaaaaagagggaaaatagagaaagaagcctcaccgatgagcggaaaagttgatggtgtgctgttgtggcagaaaaagggccggcgacggtggatttggccagtgaccttggcagcagtttggagaggtttgagggcagggatgagcttgagtgctcggtgtttccagagaaagaagaagaaggagaaaaaggaagggagaatagcctctcgctaagattcgcgcaacggctatcggagatcggcgcgtggctggtataaggcggcacgggcgagcgtgtgcgagcacgggaaaggcacgaggcggcacgcgtgtagcgcgagcggccctgagcggcgtcggcctgcagcggctcggctggagccggcctacctaggctgggccaggacatgggctagaacagcccaacacagagagtgaccagggaaaaggaaatccggaatatgggctggattgcaaggaactcggcccgagaagaaacacagtgttctatttgaatttttggagagatttttgtatggaattttgataggatatttttgaataggaattgatgggatttgggatcttagaacatttgcatgatgactccggtttaacttaaaataaacatgagctcttctgatgattttgggaattttctttgggatatctcggattttgtttggtgagggaaactaaacaaggttatgtgggagtcggaaacttagagggaacaaaagaagaattgggaggctccaattcgaaagaacgaagaacatcgactttaaatattttcgcaaaaaatttatcttgaaaaatctagtatgttacaacataatttaagtaatctcttaaattacttatttatctacattctttatgttcgttgtaattaaatctttataaaaatatctcatatgattatattttgatgaaagattacaaattacttttataataatatatataattataattacttttagattttattaaattacttcttagacatgtaaaagtaaattcaataaaaccaaaaagtaatttatatatattataaaagtaacttaaaaaaagaaaaaaaaatttggctgacatcggttcgcttttgcggttgctgttttgcagcagaagcccatcggttcgctgttacggcctaaatgcgaatagctattggtagtgggccctatacatgtcgggatctatctacggccacgcatctggagtcagtgctgacgagcacacaacgcacacagaggcaggcaaagcagaggcaatgcatcagttcaaaagttcacagaagatccagtaatcagccataagcaaaacaatggaattgctgatgcttataagcatcaggctagtactgctgaaaagcagcagcaactgcaaattgatggcgcccttgtaagttgttacggcaataaaagtaaatctattgttgggataaaaacattagccagtcaaaaaaataaatttaatcagcaacttaccaataaaataaactatttataactttatgaatattttaccagtaatttaatcaagtataaaagtaatttacctatgtaatacataaaagtaatttacacgtataataaaagtaattcacaacatatatattttcctttactctaattgtgtaatatcttgttgcgatatgtaattatcacgaacataatagtgtaattggactgtagattaaataagtaatttaaaagaatattttgtttgaatattaggtgtaagcagtggcggatccatagtgtaagcattggtgtcagctgacaccggtgacttcttgctaatctctttgctcatacactctagaaacaagaattactcttaacaccactatatttgtgtaatgattccaataactctatattctgatccgccactgtgtaaggaatcttttccttattacataaactaataatatgcccgtactaacgttacggcgtaacttaatttataattcacttaagaaagaaatgataaagatagttatatatatggagtgatatttgcattccctttctagatcttgagcaaagctatacacatccattaaggaacattgtgagatgagatctaacataatggtagtgcttttcattctgtaacattatctcagattcagtcaactctgttacacggtgtaaaacatcatccacagagtatgaaataatcactaaaagatggggagcaactcaaaaactcaaacacaattagtgggcttggctgatggcagtttgtgtcacatcctctggaattgtccaactcatcatttttctgtcggcaaacaatgcactcatatagtatgaaattcatactatccctcgtaacatttataataacaattagatgcataataaaatgcaatattttcattaaaacaatatatgatggtaaataaggacgacactttgtaatccacttcttttattgcgtcctctgtgttccactgtacttcttgctagattgacaatttatataaggacaacctttcctctgatattcctatcgagaagtagctccaacctaagcagctttggactgattcaggtatccatgtcatctacaccgaacatcagcatctcgccttttacatttgttcaatttcccgcaccttcaatgttaagatggtctcaagccggccaaacacggacacctattgaaaggatccttaggctcccagttcttccaaactatttttgtctactataaccactttttgatgattaacgcaaactgaataatgtgctgcaacaagaaggaagtggcattgcaaggtcatgtactctaagacattgaataattcaaggaaataaaaattttgcaaagatgagtattatttggggaccgacaaatatcaacagtaggatatgccttcaatgtgataagaggaaatcacatggattacaagcatatttagagcctccaatgacctgaaaactacaccttacatccaaccaaagaaaatttaatagaaccagccaaaattccttgcttacatagaaaaaaggagcaggtgccatggtgtaccactgcaaattaataagtcatttggagaaaaaaaaagcaactcaacacattacctgttcacatcgggatgcaacccaaagttattgtgttcctttagccattacaagttcaaattttcttcccaactgtgacttacaaaacatcaacagcctgcaacgagtcatataattaatttgaatcagttcttttcttcctttctattttaaagttatttgttcaagggaattagtcacatgacctcgaaaaatgctattttcacgctccatttgtttttaatgtatgacatgttggttagttcaaattgaactaacgttgatgccattactgttaattacaaagaagggtatataagatgccattacaaagaatttattttcaaactcaacagtgaatctgcatattgattatattattattattattacaaagatttctattattatttctgtggctattattactatcagttcggtgacaggattgatcacaacaagtgcctaataagcgagaattccccaaagcagtgccggctggcgaatgggaggattagcggaatcagtcacactgatccaccagcatccggcgaccggtgagctggtcgtggagttgcatttgcagtgcacaaattaagcaacgaaatccagtgtaaccaatcctaatttagcacaaattaaagcttcaaagcgtagataaatagagacaggtaaagcattgtgcattatactaattctggttcaatgtgatgctgagttgaacctatcagtcgcacaacgaatatataatatatgccatcagtccacattaatatatgccatcagtccaagatgatgcaataatctgaatttttgataaacaagatgatgcaataatctgaattttcaaaaagcatttaaaaaaaactgtagcgcttgattatatcatgtttacagcatagcagcagcagaaaagcatgagcatatggataggaacatgagcacgccattctcatcatcaaataatatatatatatgtactgaaataatctggaaacactgaaaaccaataaatatgttgcacatccccactgttaatgaaccataattctgaaaaaaaatgataggttaagctaagcaatgcctcatgtatgtagatatcagaggctgagtgaaatcaacatctaatacgtgcatagagaagtcacgatcattggttgatcatccaagaagtcacaatcaataagaaacaacgatagcagaccatattcttagggcattatgacttcgcttactccacatcaaaaattccattttttcataaaatcacttgcatagacagaatggataaaaccacctacaaattacaatgcaaccccagatttccagagaattgtagcaagcatgtcaccactatgaaacaacattttctgcatttggacctactgacccacataaaaacttgacattgtcagtcaaatagtctgttatctacaaaatatcagatagatcatataattgagtaatgcatatttctgattcaattcatgatgctaccgatcaacccaataatatggtgctcatttcaataatattttcataagataagatgcttagtttaatttcaattttcctgggtctgaaatcatgcacttaattgaccattgtaaagcaggtatatagggtcattgatactgcaaactaattttgattataaaaccaaagaaattcatctgttcgcaggatgtatattataccttcttgtaactggactctgtaaactgaggaatgagacgagggtacgtcgtgtcgaggcttcacttgatcccgcagaaattatctgaaatccgagtattggaattgattcaggttaaaataccgtgatcatcccaggcgtcaatttcaggttaaataccactaaccactaagcaattccatcgtatatatttagctcggtaaaaggaccagtaaaagtaataggagaaattgttgtctgatcctaattttccaacccaaattaaactgtttttaagtggagcatatcatcattaaatttattagtctgaacttccaagatatcatcaccatacagtatatttcaccaaaattatcagctgagagctatgtcatcatgagtatgaattcaccgacaatccaatgatccctacctgcctgtttggttggagggagtttttaggagggattcggagtttagagggatgtagctattaagtgtttttgtttggttgggagacatgagaattttggtgggatagggatggagaattgagcaaggaactccctccttttcaatacctgggtaggggtaggtaattaggagagaattcctcctttactttttctaagcaaatctcagccatccgtttttattaatgacctaatctccaactaaactccctatcaatttccatcacctctaccaaacaagatattgggattaaaaattaaattcccatcttaatctcatcatcaattccctcgtgtaaactcccaatccccttccctcgagttaccaaacaagccgtgcgattgcacggatcaaaaattcaaaatcgatcctacagtggaaaaaaaacctagacaaatccaactttagccgcaacaggacagacgtgaaaacacccaacaaattaaaaaactcccatccaatcctacaacagcccaaaaatccaggcaacgaacaaaacctaaatcgccccctacgcgaaaacaatgaccgatctgagcagtcggggaagaggaggaggagacgaaccagtgtgtgagagagataggcgccccgctcctcggccagtccccccacccccccaccctccgcgattcaggccatggaactcgcttcaatccggttgtgagtgctcggaatcggattcgccgaggcgaggcgaggcgaggcgaggcgaggatgagaggatcaaatggattttgggggaagccggaggtggaggagaggcggaggcgcggttgccattgcagaggaatgaagcggagtaaggggagatgattgattgcgctatcgatctcccaccgcgtgacctcgcatgagcccctgtcgttggatgtgaaacgttggatgatttttatccgttggatttaatgaatgaagtatctatatctatactaatataaaaagcaccagttcatcaaacacctatatatatatatatttatttattttttacccttatatctatttccaacggcttttatcaaaattggatcaatccctgcaattagcgatccacacagcggttataggaggcgatcgattgcgagaaagaagcgaaaaagaaaaaaaaaaaaccttcgctcccatcccataactcccgtactgcgctagcctaccgccgcctcccggagccgctcaccgcctcctcgcacgcgcccgccggacagccaggcgccgccgccagctccgagcgcgtgcccgccggagccgcgccccctaccccgccgcctcctcgcgcgcgcccgacgctcgccctaccccgccgggttcgccatcggccggcgccttctccaccgccgctgccgcctcctcgggcacgtcctctggagagctggggttgccgtcggccggttcctcctcctcgcgtgcgcccgccggggagccgtgatgggttacggccctacgcagcacatactccaggttaagttgatgtcctctcttcctataaatcctcaaacaataaagattttgtgcttttattattttgggttcagaaaattgtttacctagggtttgggcagatctgtgcaatttgtggcatggggattgatttggcttttcatgcaagaagagaaagctccccgcaaaaaaaaaaaatgcaagaagaaaaagcactaaaaacattttatatagagatgttttagtttaatctatgatgggaagccttgcaaccattaatttcatattttgctgaaactgagtgacaattgattattttgagaatttgccagtatatcagttccattttagaaagcatagaaataaaagagctggatttgggacttcatttgatttggggttgatatacggttatgtttcttagatttgagtgggaatttttgtttttgttcaatcagaggatggaggataatatgatgtgcccaatcaaggaccaagaaaccatgctgtgagttggccaacctctgttctcctgcaattacattttcctttttgcagtagatcttgcttccaattgattttgtagggtagtagcaatggacatgaacaggcagcaggatacggtttgctccaaggaaattttgcagcaccgaaacagtactatactggctagcatctcttgtttatttgcattctgatattctttttatcctgtgggacagattgatctagtctacgatcgaatgccacaatatatgtcaggcatataacacaggggagtgcagaaatcctgttattttcactcaatctggtaatctgctttaattcttttgctattctttgccttgaccatgtactggattgaattgaagatgtttatttcagcataatttttgttcagggttataggattgaaattcaagtatacaagattacaagattgcatataattgaaggattggagtgatcaatgtctagaattcaagcgtgcaagacctgctgagccgtgtcaccattgcgttgcatctgatctaagttggcgttcttggtttaaattgttgaccggtgtcaatgctaatcttttaccaactttttacgcaggggcacttcttggatgctttgatcttatgttcgtttagtgcctctcgatggctctacaagttagccatgttattgtaaagcacagtaactgcttgaatcagcccacaccacaagacaacgagatgctacatatatcaggtgcaaatgcaggtattgacttagctcatgtgtgtctttttatgcaaaatttgttttcctgcaagtgatatcaagatttgaccacatggcattatcaatgtaacagcaaagaatgcgggacaagcttgtggtatatgcatatgtagctgttgagctaatcatatttcactcaaaccggttcaagtagtcttccaaatttctctctatgctgaaacattctgctttatggttgagctcacatattttggtgacagcagaattctgttattctgaagcataaattttatgtcatgtgttcaacgagtccaatgataggaccataggaggctacataaactgaataaattgaatggcatcatagttaactatctccggatggcgctccatccatgcgttcatgtcgttgtgcaagtacttatcattgagtttcttagcaatcatgtcaacatttagctatgctggcaaccatggttgtgtacttgtgttagcctgtaatgtaaagattcatttccttttcatctgaatcaacatgatcaactcttgggtagattctttgtcaaatgtacatatgattggagggaccatgtgtgatttatcattcaatcagactagcaagatgttggtcagttagttctcatgaatactgtcatttagctatatttcttacctcaggaccatattcctgtttatttgtcactacaattcagacttgcatgtcataaaaaaaaactttgatatcatattagactagataagtgagctgtcaggagcaagatgttctctggttatgtatgtgtttgatgtcagggactccacgtccgcccatccgaagaggagcctggggaggaggcgtaggctggtggctgcggttgactggtatgcatattttagagcacatgaaggacacaaacatgacattggcgcagtttccataacctcaacttgtgatcaaagactgaaaaatggaatgaatggacaatgaagagtgtgttcccttggttttcatggatagaatcacacataatttgctaggaatttcatcgaacatttttgaacacgggaaaaacggcgctggggaaaaacggcagtgttccagcgccggatgtgggagtgcccaatctgacttctataaatttattcatgtagaaaggagagcgataagtttcatttgacgcaaccggcctcgactccaacacttcttcctcaatccaagtctcagccagattgatacccagatagactcccctcccaacagctccaagtctcagccagattgatacccagatagactcccctcccaatagctcccaacagcatgacatgtgttgtgatggcgctctctcacatagcgtaattcttctccaataacctcaacagctaggcgtgccggctcaagatccatatcgacccagtcactcatcctgggggcttttaactatttgccacttttagatttggtaaataactatttgtcactcctatctcaatgacacgtggttccacatgtgtctgacatgtgggtccagtgataaaaaattaattgctacatttaaatgtggcaaatggttaaatatctctttggtaggcccacccatatggccaagagtaggcattagcttattgttattacggctaaatatactcctcttcaaggtgcatgcacatattttatttttctgtttgaaatatacaaactaatatagtaccaaatgtattgatctatgttgatgtgcatcagcgatggatgtatttttctttaatttactctatcagtatatatcgacgtgccttgcaaggtaggcactatgtcaacaagttaaatagtttccttggtgtactactctttgaaaacgttattttggttcatctgtgtgattatatgaagccagggcctgaccgcctcacagattgttaatcgatcttgaaacaaaaaatgaaatctgaaaattatttagcactttaacaattatattatgtgttttatttattttattagcaacgtggattccacgtgcacatttactagtgaaggatgggtagatgtgtagtcctgcacaggaaacagattcatgttattttaacatttgtcgacatgttaggtagttagcactaattagaacacttgcactatatgtagttctgtccttaagagttgaatcaaagcttgctttttgattaatggttatataagatatgtcaccgtggtcgcatatcgatcttagggtgatttcgcgtttctcttcgtcgagctatgtctcggctttcgggcttggcctagcgtgagtcgcgttggtgtgaaattgcggaaaggagtacggcatgcatgcagtacttacaaaataatttttacaagggccataacagtttttttttaggctaccaaatactccgctagtatctaaaggcctgcgaaaattgactttcgcaagcggtcataggtctacttgcaaaaatcaattttagtaggtgggcccattaagaagaccgccggcgaaaagtatcttgtgccaaaaaaaagttttttcacaacatgcaaattcacatttaaatccgcatcattgcaaacacatagttcagagagttctttaaaatatactccctttatccataaaaaaaaccaacttctcactacgaatctggctgtaggctagacgactcctcttagaatgtgtgcctcgcgggagccaaggagggcagcaccggcacaatttttttttatttttgaacttttttattttttagtttaaaatatagacactttcaaaacttatttccataatctgaatctttggtgacactagcatgcctggtataataaaataataccgacacaccacacatagtgggtgtggtagttttatactatcactaccacgcgagtgagagtggtgtgaccaaataatgctgtcacaccagccagatcagtgtgataatgttattttgccacggctaatgtggctaaaagattcagatattggaaataagttttaaaagggtttattttaaaattaaaaatttaaaagttcaaaaaataaaaataaatccaccggcatagcgctgtctccatgcacaagagagaaagaggggaagttagtacaacaagaaggttaattagggactgacatgtgtggccaataagaatttcttaaagagaaaatttgtttcttttgcaccaggtttagcagatactttcattttacaccaggattcaataatttaaatttcacttaacaccaagatacgtcattaaatatacaagattttcatgacatttcatcaattttgaataaatcctcatcaaacatggtctaaattcaaaaaggttttataatttgtaaacatattttacaaggtttttctttaatatatgatacaacccccagtgcaaagtgaaacaggtacgctttacccagtgcaatgtgttatttattctttattaaatttagttgatatttggatggtataaaaccattttagcattttattttcagtttggcttcgtagagtgttgtgaaacctgtagcacgacacgagacatcgaagggtttgtcagcatatatctgttagaaaaccgccggcccataaaggcccgacccggttactcactaattggacccctcactaaacatggaaggtggaagagggaatgactataaatagagaagtagagaggaggattgtacaggtgaatgagaagatggccacaccctcatatctttgtgtaatccctcttggactaccttggtagcatgaggggttgcataatacgttatcagcacgacagtctaccggaggtaagaactcgtagatgaccgaggaagaagaagggtaataactcgtagatccgttttgcatctcgctgattcaatcgcgaaaacgacttcctctccctattcccgttccatttttgctgttcccgacgaaatccaccgcagcagacttggagtcgccggcatatgccgatcggtggaaaccgcggtcggcaaacacggcattagcgtgccggcgacgcgccatggccgcgaacccgagcgtcgcgacaccacggccgcaagatcacaccggcgacgcacactggaagcgctccgtgccggcgtgcaccgggcagcaacccgcgccacggccgcgacgagactgcatcaggacgaagtgctacgcactagcacggcgcctaagtcgcagccaatgctcgtgccgccgtgcgttgcactgagacgcactcgcactgtgctccttgccatgaaggcactggccggataggacagagaggaagaagaagaaaagaaacaagcagaaagcattagcgtagtattgacacacacaccagtgtctacgccgccgcacggccgctggcctggccgcagcatgtgcagccgcgcgctgccaccgaccacgtcggcgcccggtctgtcgcgccgcaccgccatcggctgccacgccgcaccgaccgtactcatggcaaccggtgccatcaggggagagaagaaaggaagaagaacgaaaaagaaaaaggggaaggcgcagccgccgcacggccgtccccccgccggccgtcggctttcgccgcgcaacgctgcacaccgtcttcgcgcggcagcacctcaccaccgcacgggcgcgccgccgccgcatggcatcgccgtagcccgcctgcgcctggtaccgctgcccggctgagccacgccaccgcaaggccaactggccaagctcctccgccgcaaggccaagcaccgccgccgcgcgccccgccgccgcatggccacctctcgccgccgcgccgtgccgcgcggctgtgcgccgctgcgccgtccttggtgccgtctcggccgcgcctcgccgcacgggtgcgccgccgccgctcaccgcgtcccacgccatccgtcagtaggcgtcaccgcgccgcgccgccttcgcatggccgccgcgcgcctcgccgtcccgccgcgccgccccgctgcgcgtcgcgccctggccgccgcgcgcccgcgccgctgcccggccacctcgccgtcgcatggccggccgctgccacatatggcaggagccccatccgggggaagaagagaaggaggaaaggcaagaaaaaggaaagaaaagaaagaaaaaaagaaaggaaagaaaaaagaaaaatggaaagattcccgtgattttgcaaaaagacccctgaagttttgcgaaactaagtgcattttcctttggataggaaatcttgccttttgaacccttaacttttcaggaaactcataaatagccctctgtacttgggatattcgttcgaacggcattcggaatttgcaaatatcaccaaaatcatattctcgcataaaaagggaccacgggacattggatttcgaccccgactttccatttcaggtacctttattgctgatatatatgattatgaaatttatttatcgcatttacaattattaattatttgtgatgttttattacttttaattaatatcgttgtggtaaaatgtatagaattgcatagaatatattggaattatttgcaggaatttttgtgtaccattatattgcaacaattgtgcatttttacctgaatctaattttacgcatatatgaaaaaatgacgtgcatcgcgaattagaaaatttgccgaatcttgaatatctttgacatatttattcgatgtcgaaattacaatagagcaagaagctctatgttaccgctaatccaatcgtgctataggcattgactcgatgagtttgatctagtatttcaaactctcgctagtgcctccaagctgctctcatgaatgagtacgctagacgaatgagcgcgctagcatttagaggattatggtacataccctacctcccgtagagcaagaactataagcaagaacgggtatttttcgactatgattcaccaagcagatgacccatagagagtatggtaatacgatgcattgcattggcattgaatgccgctgaaactcttaatgttctacccgaacgcgatgaaagtcgcacgcaagtatcactagtacacgtataagaagtatgcctaactagttgataatggaattacgtaacgttcgggatagtgttcactagaaaaacattgtcttccaaaaccaactagcatagttgatagcgagttcaacaggagtagctagcttggtgtacttacctcaacgaaagaaggggaaaagggggagtagaacacaagtcaagatgaacaatctagaattatgaacatgaaaagaaaaggacagatcctaatagcacaatcatcatgaattgagggggagaactccttagctatttgcatggctatggacgtagaatctcctatgctagattggatcggccctaaaatttatgtcgggatagtaaatcattgcgatagctgttgagtaagaagctcgctatgaagttaattgaatccgatgtagcggaatacttcgttgaatcaataaacttcgtcatcacatgttgcaattcttgaatagaacattgcattgaagaaatggtgtttgcccaagtagagcacatattttccctgcaatagagaattatttccagtataaaatagtatatttaaggcatttactatcttgttgctcttttctagcacatagttataatgctttgaattttgtgtagcacccaaacataaaagaaaaatgaattgtggtccgcataaccacaaataacactttaagagaaagaggtatttccatacccatagaactagaaaaaattatgatcgttactagtagcaacaactaaatttgtcggcctagaaagtgccacggtcatattacctatggaacaaatgatgcactttatagaagcatccattgtccgtcaaccccgttgaactttctaaaagtgtgatgatttgggctacaccttttagtaacgaattttcagccatttgggtcttagaattataagaataaatattacaactcgtatggtcatagcacttacatgcataattttcctaaatcatgaagacttgtgtgctagtatgcaccaacaggagattaatgcataaaccgcataatacaaaggtatagttcctgcatccctgaactggattaggaggaatatttgcggtcctatttggtactatatggataaatgcgcttccgaagcagcaaacatccagtgtctcttagacaccgtgtctttgccaagactgatccagcaatatcacgtgaactccaatataactcactaaatcatctttagaagtccgcgaggacaacgctagcattgtatttgatgattggtgaattggcagcacgaagtaccaaatatccgcataagcggactaagtataagctatgaattgcaatatttgctatatcattgttgtaatacacgcagtagaaaaggacatgtagtcctgaaaacagcagactctgatagaaaattcagaccatcgtcatgaactttcattctgcaactagtgctattgtatctgttttggtttatgtgcatatcccactaccataatgcgttgcaaaaggctctctccgaaagtcggaaaccttttacgaagatagttatgaagcctaaattccttaacaaataagaattatttccagtcatttagggggagagaatgaacccctagataggaaatgtcaggaaatatgatagtagaaagggactaatgcatgttacaccgcactagtaaatacagtttgcataaagaattaaaactgccaaaccactttgtaaatacttttgtgatttcgaagagtttgactaagttgcatgaatgcaccggaggagggttaaataccgaagaaagtaaatgtatccctcatcttgtctagaggcctcgaataaaaacaattggacaagaaacttcagctcctcatgaccctaaagtaaccggagacatctggtgaaaatagggcaagagggactatcatactcaaagtcacgaaaagtaccccaccaaatagaaggggagccagttgagatctggcaagtggtacggaacctcagaataggcgtgctgcaccttcccatcaaggaagaaaactagctattcgagtgcacactaacgctggtacatgcccacattaagaagtattaagcaattataggaagaagaagcatatgaaaatgcaactcctcgtatatccatggatactcgcatagagcctcatgcaaccaataggagttggcaatgagacctatcatgggcaatgtctttttttaagacaacaaaactcattggcagtcaaccaggagttgaatggaattaataaactagaagttgaaaagaagaactcaacccaaatgttgataagcattgaatatagaatcaataaatgcactttagaagcttggatcggacacttgcataatagtacatgaagaagtactaagtcctgaagcaacatagaacaaatagagtaatttgaaaaggattgaagaaacaaaatcgttcattttgaattagaatttggcttcatttggaatatttggctgaacccaaatcatgcttacgcttgcagctaaaggcatgcaacatatgaaagtctagtacatcagtccaactgcactttgaaatgttcatggtgcatggcttcggaatagtcaattatcgccaaaatgggacggaattcccaaacacaagagttatagcagcacatgaatatttggctaattgaactaaatcgttgaactgttcagtgcctcggcatggttttgagagatggttacccgcgacagcaattgcgatttgaaaactatctcaacccccaccatttatgatattaaagcagcatatgtcgcacatatgcaaatgagttacgtgagaagcaaactcactaagcatatgaacccccaagctattctatgtacatgaattgcatagaagcaacgaactaagttatgtggaagtcttgcagattcatccgctcattattgacatcttctctcttgaataggtgtttccgagaaatcggaataatgagacttagataaatgcaaaattcagggggagaattttgctgactcattcaagaatcttgatatagaaaatcaagtacccaaaaatcaatctagaaagattgaacgaagaattgggtggattgtactccttttctcttggataagttttcccagcaatttcttatcaaggtttttaatgaggcaattcatgcaatattgcaagcgtatgctatgtactctttccctaaatttttcccactgggtttttgttgagttttgatgaggcataggcatcacgcagtgagagcccaaggggaagtgttaggaaaccgctggcccatgaaggcccagcccggttacccagtaattgggcccatcactaaacatggaaggtagaagagagaatggctataaatagaggagtagagaggaggattgtacaggtgaatgaatgaatgaatgagaagatggccacaccctcatatctttgtgtctccaacttttgttatgcaatccctcttggactacctcggtagcaggaggggttgcataataatatcattgtacgactcttctgaccaaatcacgcgcataaacatgaggatttttttaacgactcgcacgagatggtgagaagttctattcatagagcagaaaaaaattacaacattacaaccctggagggtcgtaaccaggaaaaaggaaaaaaatataccaccaccacataccgacagcatcaacacacaagtctaggagaaggctagcgccggaccgaccgccgctagaccaacaaaggaacacagacgagggggtgccaaaacgacgtcttcaagaagagaagcgacggaaaactgccgccgctgtccgttggggcttaaaggagccaagactgggctttcgcccggcaaccacccttgaggggtgagacagcatgacaacgccctcaggagggggaattaaccattgttgcgctccggcaaaggccgagcttggttttcacccgctgctcaccacctgcgaatccacggttgacgcaccaatgctccaccaccactcaacctttgctgatatgtgggacccctgcaccggcgccccccgctggcaagccttcgtgcaccgaagaccgcgccacacccaccggcagctcctcctcgcaccaaggtcgcctcctccaccgccggccgcgcctctcgcaccaaccggcctcctccaccggacgtgcctctcgcgccaatccggcctccctccatcggcagcgcctctcgcgccaagccggcctccatctccgccgcccgtgcctcttgcctagccggcctccgctgccatcggccgcgcctctctgcaccaagccggtctccgacccctcctccatacgctgccgtgccggccagatgcagccatctgccacgccctcagctagccgtccgaggtcgccatgcctcctcccacaccaccaccgcagccgttgctgccgacggccaccttgccgccgtccagccgctacagcgaccgtcgccacaagctccgtgccgctgcctccgccgtgagtgcgccccgttgccacagcagccggcagccgccactaccgtcgaccagccaccgtgatgacgccgccgtcaagctgctgctgccgctgtcgccatcgccctgtgctcccgcgccgttgccgtcgacgccgtcgacgtgagctttgtagtgccgtcaccgccgcaagctcgccccgcactagatccgccctgggggtaggggggacggatccgcctccggcgtgactgagtcctgcctgccgtcgccatcctccaccaccttccatccccgccgccatctccatccccgccgccgctggcctggactccgccgcctccaccaccactcaccgccgccgccgctcctcagccccgccgccatcacctcgtccgcctcttccgcctgcgccacggcctcctccaacggcaactcgatctcctccgccggcctttgaagtggcgcggccggcgccgctccctcccgacttggccacgagggggctagatttgcctccatcggcgtcggatccgtcgcctccggccgccggcggcaccgaagaccaccgtctccgtctctctttccgttccccgtcggagctccatccgccgggaagaggtgcgagggagaagaaggccccgccgccgctgtccttgccgccgcccggctttgtcggcggctgctcgggcggtggcgaggcagaggaggcgatggagcgaggtgacacgggcgctggctaaaaacatgaggattatctggttacgtaaagacgccaaattcttagtttgttttactctgctaggtagggtggccatagcggcgtcaaatatgttatcatggattactttatcttattagtttaagaagttgtttgaaggacatatataacacattgttgggtaggcaaatggacatggaggtgctttcttcgttcttcgtatcctcattgaccgcatgatccatgtgcttgcgtggaccaaatactactattgtaattggtgtggctagtttcctggaaagtccagcactgagaacaagttcagcagttggctgaccaagacagacacttgtgtttagggttggtttagttccccaaatattttttctcaaaaacatcacatcaaatctttgacatatacatggagcattaaatatagataaaaacaaaaactaattacatagtttgcatggaaatcgcgagacgaatcttttgagcctaattagtcaatgattagccataagtgctatagtaacccatgtgtgctattgatggcttaattaggctaaaaagattcgtcttacggtttccagatgagttataaaattagttttttcattcatgtccgaaaaccccttccggcatccggtcaaacatccgatatcacacctaaaatttttcttttcgcgaactaaacacaccattaatctgagacgatgcgcacagacatgtttgatcaattaatcctaattaacatcaattaaaatctggtaacatatatacacgcagatgtacaagaggcgtatgacatttagcatttattattcgcatctatatcgttctgtgttactcccttcgtcttaaaaatatggtaacttttgcttttcaaaatttatcacatattttctccacttattcaataatctcaatcaagcattatcatctctcatttaatttttctacataattttcatttcattccatcgtaacagtgcccatttaatttcacctaattacttataatcaccatataaaactaaaacaaatccactaaatcctatcttgttatgtcggagggtgaactcctctgccagggaaccgtgaggtccccttttttgttcggccgggggcggtgactgagattcgaggactctgtggtggagtgtgaacaagagagggtcgggcccctcgggggagatgagacaataggggtttatacaggttccggccgctgagaaacgtaataccctactcctgtgctatgctgattgaggaagagagattacaagatctctttgttggagtagaaggtgttgatgataagaggcaggagactgctctcgtgaaaaagcgctcatcccctccctaagtaagcttggacctccttttatatctcaaggggttaccacatgggcccatggagcctatcttggaagtctcttgcatgcccgctgcagcgtggggactgtcaaatcatgccgcctgacacgagggacgcccgtgtcattcgccatttaatgggtgaagacttttgggttctcttcacaccgggaaacgagaaccctgcttgaccaaaacggatgaaccagctccggctgggaggagaggctaaaagcctctcatcatgacgacgtgacggggcaaggcaattgcacgccgcctgacgcgcggcagtgcgtaggcgcactaccctagtcccgtcaatcattcgaccggtcacatacctgtcaggcgtgttgcacgctggcgcgcccgttcggtccgctttaaatgtggttaagtgggcactgtgcgcacccacccaactcgcacgtgtaggctgatgcgctgagggggttgggacgggtccgaccctcgagcgaggagggggcagccgccactccaccccgggcccgaccctcctcggggaagtgccacgtgggtctgggggcaacctcctccctccaaactcggtaccccaagctgggagggggcagccgccgctccaccccggaagccaccccctcaggggatgccacggggattcggggggcgaccttctccctctaaacatgatacccccggccccatatcaccgatatgctataaagcaacaacccactaaatcctaaaattgaacacacaaagatgtcacatcattatcctttaacaattgttaaatataaaatatcatgcaaacaagctatattatttataattctataatttattaaattttagggcttttaatgtaagtatgttaaatcactacccaaataattcacataatatcttaatatatctctccatcgtttttataatatcatatatacctatatagttaatcttattaattaatgttatttcactcttttcttattaagccatatcacatcaattgtgcttaacccttattagatgattaatgtgtggtctaaattatcttcctcattttctcattaaaatatatcacctcaattgttttagcctttagataattaatctacggtccaaattatgttcctccttttcttctctcataattccatgtcaccttatttttgcatttgaatcaatattccatatactgtttgaattatcattctatatactattgttacatttaaattatcataaaccgtcaacttatataagcttatatcgtttaactattttacgtattattttaaattattgttattatactaaattcctgcagaaacacgccgggttttacctaggagacgaaggggtatatatgtcaacttgtctcctcgctgttcctttctctccgcttatctcttatcttccatgtcagcaaaaataagtaccacaaaacaccattttaatcggggtcgtgcgtgctcaaatctgttagtgtaaacaaaggccacatatatacgatagatttgcattccaggtagcatatgagcatatgtatctatgcatcgcttttagcagttttagcggggattgatattaaggtaaaatattttaatgcctctaagatcctacttgactgaagaaagatcatatctagccatgcaacaaaaattacagagaaccatatgaagtagttggattgagaaaaacagtatttgttgacatattttatatgctagaaaagtttatatttatgaacagaggagtatgagcaattttttatgtgtagatgatcttgatccactactcaacatctcgttatcacgcttgctcctccaatccaatcatgctggtacctttcacgcgagagaggtttttcttgttctgcaacttgtagacctaggtcgtccataatctctgcacactgttcagctacattaattccaagatatagaaatcgcagtctttttttccaatgaccaatttgcaaaatttaagattcgctagctagctagctcttgtcatcatgcctccaatcagtctgacgtggacgattttttttcttttataaaattatttattttggcaaaaaagaaatggacaagaatcaaagatggtacccacccacgcacgaggctcgattgatcgaagacaaggaagatctggcttggaatctaataaagcagagagcagtgacacgatcccgtgagcatcaggctcactgttctctcactgttctacggagaggtctttgccgggtatcatggccaatttgagctcaagtgtgtgctcttcattgcagtcttgtctctgctggagacgacgacaatggcgataatgttggtagagagatcaatgtcggaagggaactgggatttgatgttttcttttatcttcttgttctctatgatgggggcaggtcgatagatttacatcagcacgatttttctcccattttgcgtggatggagatgaagggaatcctaatgagggtgtcgaaccaggagaagtcgaacgaaatttgcggttttattctttttatttttaatggttattatggatactaaatgaaaaaaaagagtaaatatacgaacttgtcattttggtgcaatttagtatattaacttataaaaatcttatttttatacacgaacttgtttggtaggtgcaaaccaagatcaaaatagcatgactaggctaattttgcccagttggatgctaattattaggacatgatatgcacgtgtgaggtgggcatgagacatgttaaacttggtttctatattatccttcttttttatccatccttgcatcttagttcttctatgtctttctttatacaatatttatgtcttattttacatttattgaacatacctatgtttatgtggcatcttctcgcatacgcgtttatgtcgtatcctcatcaacacttaaataagagaaattagccatatcgtattcttttagccttggttcgcactcaccgaacaaatttatgtattaagatgagcgttttacaagtttatatactaaattgtatccaccttattagttcatgtactaccaaaacaatttatagaaaatgattgttgtaacttaacgggataaatagtgtgtaatctattcggactctacgcaacttcaacacggggtaatctgatgagtttcaaaaataaatagagataatccgttcaatccaatgcaacaaaataattttaaagatggtttttgaaatggaggtggtgggaatgggagagggatgatgaggatggctatagagggctgggtcgacggtgaggtgctagagcagtgaggatgtagacatagttagcgggaggggaaaagatatcagagatgaggaagaaaggtgacgtggtggtgttggaagatcataaggaggagcaaggaagatggtggggagatcttggctgaagggctcatcgaagtcatcgaagccggcgcaggtgttggcataggaagaaggtggggttagggtcatgatggtatgctgagcagtgttgattttgggtaaatagggagagatgagagctcgtacgaatctttaagcaattaggctaaatgttggttcgacgatgggaaaggcattcatcaagaggtcaccataatatgagagatcaccttaggaaaaaaaggaaaacatcacactatgagatattccccgggacccaataatctccattgatcctctcacttgtgtctgtgtactaccttagaagttagaatatatacatatgttcagtactaaaatatgttatatttaattttagggtttttttatgggatgaaaggagtatatattacggtagccactggaggctccaggtgccgtggcgtgcgccttgtagcggcggcgcccttccacgtgcgcagaggccgccagccggcgaccactcgcacacccaccacaaccagtgatcagacaccacctaccgcgcgcgtcgcgtactcgcgtgcccaaccccttgcctccccgtcactgcactgcaccggcgccttctcctcctgatcttcccagataaatgttgataaactacggcaatattgagtcatcaatagcgatcaccggaagaaggaggacagagaagaaaccgagagctagcgagaaaaagtccaacaccaaatccggcaccccccgaccaaaatcccgggcgtatttaaaacgccctccctcctcccttccccgccgcgacccacgccacaaccccgtcgtcgctgcgctgcgcgccaaatcactcgttccaccgctcgctctccctccctctctctctctctctgtctctctccccctcgctttccccgctccgctccattccattccattctcttctcgccgcgtacagattactactactactgctacagtactactacagaaggctcgtcgaccccttttgatggcggcggcggcgtcgctcgccgccgcgcgattcgccggcgaggcgtccccggcgccagctgcggcgggggcggggacggggacgtggcgggcgcggtgcgccgggagggtggtggcgatgccgatgcggcggcagtgcgccaggggcgtcgtcgtgcggtgcgcaggggcgggggcggggcggtcgttcggtggggcctcctgcgggggcgggggcgggggcgggggcggggcggaggatcaggaggaggaggggacgaggttcgtggggtggtttcgggaggcctggccctacgtccgtggccaccgggggagcaccttcgtcgtcgtcgtctccggtgaggtcgtcgccgggccccacctcgacggcattctccaggtatcgcctcgccctgctctctcttgtgctattaaaaccaacgatttgaatttgtgtggatttgttctttggtcgaatccgattcagggggcaatggaaaaaccgtcttggagaaggggcgattcgtgaaattgattaggaaaccagattattagcagatgatttgtgtctaccgacttttagtaactttttcttgtgaagttttatttgttccatttaagtggatggaatgaatcgatccatttcatactctgtagcaggctgtgtcgctgcctgatttcattacatcacagataaattttagaccatttgggtggcgtgtcccattatgggttttcattgtcgcgttgcttcaccgggtatcacttccatcattgtactgtttttgtgcttccatgagatcaacatcgttggaggatcttaggcgcttattcgatctgttagggaaaggttgaggtaattaaagttaacaagttccgccctctctattgaactaggaagatagataagattattagttgcacgtgtgttactttcccttgtttttttcaccacctatttcagtccttttcatgtgaacgcctccgttgaacttgtggcaaaatcttggataggttgaccagctccacttgctttgctcactgagaagagcttattaaaaaaagtcatgttgttttcataaagattaaaataaaagaagacatttctgggctatatataactaacttactgaaatttttcatcttgttgatatcacctgcctttttttggattttatcattttttttccttgtaagtagaatttatcgttcttgagtttttcagtcttgttgttttgttaattcaactcaaagcaagttccatgcattcttcttcttgtttttttttttgggtaccaactggtgacatttcgtttaacttgtctggtcctactattttgcaagttggtgtgatcaaccttatacatgctctatgtgcgtggtaggtaagtactgagttccatttttcaggtcaaactttctagtgtgcagttgttaaatgcctatttctaccggctacaggtttagataaagacagtgctaataagtatggtacatctaattgttgcttgcattggacaaataatttgttttgtcccgtctttgtggccattatgatggcaaattcccatgttcagttgtttgcccttcgtttccacttcccagtcaatattgtcctgttaagattgttataccagggttatatgtaaggtcgtttcgctaggtagaagagtttgctactttattttatgagttatggagatctgaactgttattttttcccctactacctgctaaattacagttgttttaatttacaggatatttcacttcttcatggtcttgggatcaaatttgttcttgttcctggaacacatgttcagattgataagctcctatctgagagaggttagctgaggctttggctgtttacacatgtatgcttaaatggatcaaacaactgacattgttgtgttttacaactcactagcactaaaacttttttagcataccctagttttcttttttgctttctacattcattttttgaatactagctgaatgctcgtgctttgctatggataaaagaaaatatattaccatattgttttaaatacaaaatatatattttccatgattatttttctctctatagggaatattcaccttaatttgaatttatatgttgttacccatttaggtttgattgttttttaatattaagaagttcaagggggtgtttgcaatgggagtaggtggggtggcagattcactaccaccaccactacattcttttcaaggaatatagatatagatgttatttttgcatgttgaaggaaaacatggtatggctagattatggttttttgcatgtgcaaagcaaaaacatatagcgagtctgacttaattattttatacattcattagattatgttgcatatgcatgtacgaatcaaaagcatttaccaagtaggcaactagatatttgaatacagtaatttggaataataaaagtaccagtagggaattccactcgttattactatagcactgattcttaattttatagtagtttttgtcattttgtgtcaatatacataaaatccaggactccaacagcttctgcttgtattagatttgcagttgatgcctgcatctgcaacctcacataaacatgcgactgttaattgaagttaaattttaggataatgtatgattttcccagtctgatattctgccattcacatgctagtgattactgaatgcccctcttttgttttctcagggaagaaggccaagtatgctggtcgttaccgtattactgattctgattcattagaggctgcaatggaggcagcaggcagaatacgcttaactatagaagcaaaactatcccctggtcccccaatgttgaatcttcgtcggcatggtgttaatggtcgttggcatgaaatatgtgataatgttgcaagtggaaactttcttggcgctaaggtgaatatacatactgaaccttccatcacttctaggatagtagaacgaattgagttgatttattttctcagccgtgtgcaatgaggacaatgatgactgtcagataatagacgcatagttcaataatacatgaggtcttatacaaattaatagctattgaatccaaaagtggaattaatgtttgcacttccattcccaactgtgtaatgtgaacatacttaagtgagaaagtgagactcaaaattggcaattagtaagcctctctagctagcaagtcatataaatccctttgtttcaattgtttcaaaagataatttttagtcatgaaatggtgaattgatttacctctctactcttttggcagagacggggggttgttggtggcattgattatggattcactggtgaagttaagaaaatagatgtttcacggataaaagaaagacttgatagagatagcatagttgttgtgagcaatatgggatattccagctctggcgaggtgttgaattgcaagtatgtttactgtattatttgaaattttgctgtgattaatgtgaatctgtgttcataattcttaagatatctaaaaatcagtatcatccatgtcatataccttatggagaatttcataagaaatagaagataattgcaccattttcctatagtaagtactgacataactattcttttgttactttcagcacatatgaagtcgctacagcttgtgctttagctatcgaggcagacaagcttatctgcattgttgatggtcaaatatttgatgaacatggtcgagtcaatcgtttcatgtctattgaagaagcggacatgttgatcagaacacgtgctaagcagagtgagattgctgcaaattatgtcgaagttgtaggtgaggaggatattagttatgctcgcaatcttcctatcaaagaggagaaagaattaggattgattggaagggacttcgttgatgggtatactgcatctttccggaatggtgtgggtttcaataacggaaatggtctgtctggtgagcaagggtttgcaattggtggggaagagcggttgagtaggtcaaatggttacctttcagagttagcagcagcagcatatgtatgcaatgtaagttttgagcttcttacagaatcccattccttaaaatttgcaattctttgctattgattgaaaaagtgtgaggttctttcagcaattagggaaaagttaaaccctgcacttcgccacattctgatgctcatattttctaaactgcttatgaatatgtttctagtggacttttttactcagtggtatgtgccattatgtttctattcatatattagaatattagaccaccattctgctggattatcttctattacagagtgatgtgccatttccttgtctaatattacttggatgcccattaacgtgttggaagtgatatttgccgtgatccttgggttattatgtttccatgaggcaacactatgtgatgtatatgtgtgccttagttgcatcagtaatgtgttcattttcttttgttactctgacatcctattttctaaatgtcagggaggcgttcaaagggttcacattatagatggcactgttggcggatcattgttgttggaattattcacaagagatggtgttggaacgatgatagctaggtcagaagtttggaactttctctatcctagatgccagttttaatgtacaaaccggcaaactttataactgcattatacctaatatatttcctgaacaagtgatttaatatattttcacaaaacatttgtttccctggtttttgctaaaagaaagacggccttctatccattttgtacatggcaatgtacaatattcgattatataataagtttatcttcttgccgctttctccattttatagttcatgtttcttggagacaaaatgttttggttcttatttgatattttgattaggaaaacaggatcttttgtccattgaatattttcttgtgactagtaatttcattttgtatatttcacaagcaacatgcaaggaaatgatgtttgtgtgcttcttctcacagagacatgtatgaaggaacaaggatggctagagaagaagatctttctggtattagaaagatcatccgacccttagaagaatctggtgtcctagtgcggcgaacagataaagaggtacatttactatctcgttttgtaaacatttagcaatggatataaatacattactgttcagtccagacattccctttatgcaactgaacatattttatgttttgttattagcttctagaagcattgaagtcatttatcgtcgtggaaagagatggttcaatcattgcatgtgctgctctctttccattcttgaggataaatctggggaagttgccgctattgctgtatctgaagaatgtcgaggacagggtcaaggggataagttacttggtacgatttctgcattttcatttctttagtagataccagtttggctatcaagtgtttgtacaacatcggtttggaaaaccagtgataactgactggttgcaacatgatttccctatcttgtcctgcatcattcgccctctgttttgtgttgtttaatccactttttttaaaaagaaatatgttgaaattccaaaaccgctgctttcttagaaggccagaaccaagcaggtttcagggtttgccacagtacaaaaaaaaaaaaggagaccctacgtacattagtacaacttgaatactttcataataaaatgagaaaaagaacaccttggcatgtctgctaccttgagtattgacaactttttcttcattttacatagatcatatagcatccatgagcaattaacatctgttgtggttggcatatatccttttggattttctaatgaacatggtgtcagtttttcaacaagtctcagtattaaagttaatgtttcccgaaatatttttgtttgctctacagtcaatcactatgcattatacttaccctggtgatctgtcctttagattacgtcgagaagaaggcattatcgcttggtcttgagaaaatattcttgctcaccacacgaacagcagactggtatgtacttatgctgtagcacggcgcaaattctatttatgttcaaggtccttttaacgaatcctgtcacatggtaatatgcattgccattaaggtgcttcccagtgctgtttcgacatgaattaaacttagtcaacctagtacctgctgtatttgttaacaattttgtggtgcaatttttctttttcttaacaaagttctggatgtacttccagtcattgtttagactttggatgacgcagaatgtcgctcatttataactacatttccacaggtttgttcggcgtggcttcaaggagtgttcgattgagtccctgcctgcgcagaggagaaaacgaatcgatctttcacgtggatcaaaatattacatcaagcggctccgggcagcagagattgggcagatggctgttaacaattttgctgtcagatgagatactgcacgcaatcccggtgttgctcatgaggtttctaactttctatgataacctcaaaagcgattgtacattgtataaattgtgtatggtatatatgtgagtaatcgatcaccaatgtggttttgtttctttagtagaagccgcatcaatgggtgcagtgcgagcaacatggcagcttcgcggcatctgggttcttgagcagtcatgttgaaatgccatgtgtaggacaaacataaaacgatcgataagtaatttaaaatggagggaatatactttgagatgaaatcatagagtttaaagtctgaaaaaaaagatgtctcgacgtgaggctcgatttgtagtcactaacacggggagagtgagatattacagtaaactagataaactaatccatcaaatacaatgatttcgttaagggggtatacacttatctggtgaacaggcaatacacacataattgtacgctgtgatggtagaaaaattctactaatcttatcaaagaaagtaaccaacacgacatgccaatcccaacaattccatatatttcttttcaaaggaacaataattccacatcaatcccagggtttgtgtccgatcgagactgcttggtcacacggacagacttgatcagaagcaagcctccaacaggcagcagcagcaaagtgcagccaagctgtgcaaaatcagagaaaaaaaaagcagattcggttagggcgccgaaaaggcgaaaaaggacaaaatacagctattacccgtgcaaatcccatactaattaacaaaacccagagggaccaacaagttgtgtgttcgctactcttggcagtatcaccaaccactaccgatcatatcccttccagctgcgctttacagagcgagagttgccggttagctagctagtggtggtggcgcattgctgtcaacgttcccaaatcgtgtgatttgttgttggtccactcgaactgctcaatcgtcgtgtgaaccaaccgtggaattaaaattaaccagtgaaaacatatcgcaagttgaaataaaaagacaaaaagagaacttattcactacaacttggtgaatatggtaaaatatcaaaaaaaaaaagaaagaaaaaaaaacacaatctgtgtgtcgctgtcagacgatgatccctcgaaattttacggttcgtatttgtgtggacctcgaaattttagtcgtcggttagaaggtcacattgggagcgagtgggcgcaaggacggataagaaaagagacgaaaaagaaaggtagaagttggcacagaagaggcgtggggcccgcgtgccagtgagccagacacagtcaggtcacgagccacatccaccacacccaactcgcctgcctaacccgtcgtcgtcgagccccccaccacccacccaacactccaccgccggcgagcatcgccgacgaggaggaaatctccaccagaaacccgaagcccgaactgtctgggataatagctagtagtaggtgagagaggaggaggaggaggacgtaccatccctccatgaaggaaggcccgctgctgtggtgctgctgctgctgcggcggcggtggctgcgcgtacggcggcgggtagccctgctgcggcgggtacccctgctgcggagggtatccctggggagggtacccctgcgccggcggtgggtagccggccggcgggtaccccggcggcgggtacgcgtccttccccgggtaccctgcaaaattcagatcgatcaaccaaccactacagttacaagaagatggggaggaggagtggaagggacggatctggataggaaaccttgcggcggcggcgcgcccaccggcggctgctgaccgtagtagctcatctctttctagtttagctggaggattacttttccccttctcttggcgttcgtcagtgagaggattggcggttatataggcacccaggtaggcagttggccacttggcctggacaagggagattggagtatcggagaggaggctgttgaattggaaaaaaaccaacaaaccgggtgggtcatgcactcatgctgctgcacatgcaggtggatggatggatggatatatagccgtttggtcatttggacgacctgcacaagtgcaaaatttagactaattaactatttgccactcttacaagtggcaaattaaatttgaaaatatacccccttttttctataattcgcgtttatatacatgcatggcaactatttgcgaaaatatacctaatccgcagccccacgctgcgggagcgaagcgcaaccgcggattggggacgcaggaccggtgcccagagcggtggcgcacgctggagaagcggaaccgcaacggtcccgcacattggccgtgcggaaccgcggtggtctgcgggaccaatcgggccaaattcggtcccgcatattgggcatgcggcaccgatacggtcccgcatatccaacctgcgagacgggcaacggtcccgggccacccctcccctcccccgaaagttccttaaattaatcctaaaatttagttgcagtcacttctaaaattttgtgtacatttaaacaagcaaaccactcctcaactttaggtccaatcactcctaaaattcagggaacagttaaaacaaaaaaaatgattggaacttgtaggtggtagtgctaaaattctgggaacagttaaaacaaataaatggattggaggtggcagtggcagggcggtcgcacgctctggctctgcgggaccgtggcggtcgcgcacgccgggagtgtgggaccgacagcccggccccaccctttgccctctcccgcgcatgcttcttttatcatctggtccacgtgaaattatctcccacaacccgtgctgctgctaaaagtagacaaaataggaatgtgcgccgtcaatacagtgaaaacgtcaatcatgtcttctttttttttttacttagctgacactataaaataagtgggcgagagacgcgatgcccctcacacaagagctgcgcaaaagagaggagacactcatgctgtagaagagagagtagcattgtgagagaggagagctagagaaaagatcttggtgagcttccagcagcaattgaagaaat

SEQ ID NO: 63158 - DNA, 676 bp, Oryza sativa
ttgggcgacaagtttaagccagaatctttaacaccacgccaacaccgcctcgtgcctcgctcctctccgactccagatcaaacgcctcctgataaaagcttcatctacaaatttacaggacgaattctaacacgacacgagtattcgaaggccaagttacaacataaactcctctacggttaagcaagattcttgattagaaaaaacagcacctatttaattcacaatgcaagttcacaactcagaatgcatgattaagccagataggccagctgacaacacaaacactgcggataagtaagattctttagtaggaaaacagtacgaggttatctttgcatttgcaacgcttcaaaactcccagaaggtacaataacaagcccaggaggtaaaactggacaattcatgagggatggacagaaaacaactccacacacatgtataagaatagacaagaaatgagaactgcaataatgtggattcatttgatcacagctaccagcatatcaaaatcgcgagccaaagccatgtcaaagatcgattgagttgttctccaggaaggatcaatagagcacaattcaggaaggatcttcctcaaaaaatcaggaaggatcaatgttaatgttccttctcctcacagggaaacagaagatctcctattcttcatcgatcctag

SEQ ID NO: 63159 - DNA, 2903 bp, Oryza sativa
caccagctctaagtcgcctttgctgcttgcgtggatcctgtcgtctctccgcctccctctcgcgtggatgcgtcgtcgatggcgatgggaggggaggatctggcgacctctcggcaatggcccaccggtagctacgatggccgagacgcgcgggcggtggatctggtgttagtggaggctcgagggcagtggcgaggctagcgggcgacggatccactggcaggggaggctcgaggacgcggaggcagttgagttctggtggcctcatcctgaagttactgcagccgcctgcttcctcgacatcgccacccatgggagtcgccgccgtagtgaatcgcctcccggtttcttcattgatgctccctcaatacctcaacacccaagaaccttgccgataagggccgccgccatgttagatccgtggaatcttgttgtaattatggggttgattccatcccttttgtgttgaacttgtatccctcttccctcgttttatttgattttgtttaagtggggaaggacgacgtacggactctcggacttacggccgaaaatacggaaaaaaagagaggtgatgatcagaaagttttgaattttttaaatagttaaggttaagatttttttttttgaaaaaccgacatctgttgtatatttataggtcccgtttttaatctatacaaatcttgtagcgtatgttccttaaaaaaaaaccgactcctattaaaaaaccggagccaaccttatccccacatgccatagctcacagacgccatccatccatccttatccacagaccacagccgccacactcccacccaccgtcagcgccaccgcacaccatctccttgccaccaccatccctacctctgtcgcatccacctactgccactggcccccgtcacgtggccacgcctcctcagcctcatcgccgccttcctcctccctctccctcttggtccagaggcagcagcggcgcaggggcgggttagcggctcccggcccagcggctgcattgcggctcctcgacgcagcggctgcccagcggcgcggcggctcaggacctccacgacggcgaggagcggcagcggcctccctctcacccctccctctccctcttggtccagaggcagcagtggcgcaggggctggtcagcgtctcccggcccaacggctgagctgcggcttctcgacgcaaaggcgccgcacggctcaggatctccatggcggcgacgagcggcggcggcctccctctcacccttctctctcctctcatatcctatgtgatgtgatttattttgtgatttccacctcttctctcatcttatgtgtgatctattttgtgatgtgattattggattgtctcctgtgcttgatttattttgggatgattttgtaatgattccgattggattgggatttagttcttgggttaaatttgtgatgatttgggattggttgtgggatgttcagagcggacgctcgttgacagatgaagcggaagaaggtgcttctgctttagtttttagggatttgggatttgtttgtgtatttctttgtagtgtcgatcttgtaacagcgaatgggaaactgattttctgggattatcggtcggttttgatgttgtgatttgtcctccaattataattttgtatcctctcagaattttttttctttggccgctgtacacgattgcgttcacacggagagagagggcaccgctcagtcagacatttacggatgaaaaatttgtgacgaaaggaaaaatactaatcttttagttagttaagatgtgacacatgctataggctatattcgttgaactaggatgtatcatatctcactaaaatctcttatatttagggacggagggagtataacttgatgaaggaattatcaacattattgctttgaaactgttgaatacaaaatgaaatcctagaatttgcgtatgtctgattagaaaatgtgacaatgccaatgtagcaggtaatttcttttagaaggtaatttcttttagagtaaatttcacaaaaccacatctctacccatactaatactacattcagtggttcaacaacagtggccgcattaaggtaacacaattggtgagattaaatttggcaattggttattactgtgattttgttgattgcgatgtcgtacctatgcatgctggctccttgctccttgctgttgggtagactttcacaatatgataaaaacacgttgcatcatggtagaacaaaatcaatactcctttgtgcataatagaaaaaaaattgtgttgcatcctatgactcttgaagctgtttttgagaatgatgttgctagagctaagaaagagaaaaatgttgagcatgctaaaagtgaaaatcagattgtagcaaaagaacttgtacaacataacaagaaagattctaaatctgaacatggtaaggacaatgtgattaaatcgaaaggtccttgtttgcttgccactaaatctgatattgtcaatttggatacgagtgacactatttgctatgctctcatttgtaaagaggccttgtttccttttgagaatatgcctatctcttttcttcttggggtcactaattttttgcagaagtattaggatgtgtttcccaaggacgtacccccagggctgccaccggtgcgtgaaattgagcatcagatcaacttgttggtaacaaagatagaaagggattgaattttgaacctggaaatttggtttggttgcgtttgcgaaaagaatggtttcctaatttgagaaaatctcaatggatgcctagagctgatggaccttttaaagtattagcaaagattaatgagaatgcatataagcttgatttgcctgtagattttggggttagtcccacatttcacattgcaaatttgaaaccg

SEQ ID NO: 63160 - DNA, 3202 bp, Oryza sativa
  unsure (1)..(3202): unsure at all n locations
acgtcctgttgaccctcttcagcgtgccatcgcatcatcctagcattccccttgttcctgaacaaacgccttatccggggtattataggaaaataccacatcaccttagcaggaattctcttctttgttagctgcccgtcaacttctcctggatcgtctcgtctaatcttgtatcgtagtgccttgcaaacagggcatgcttctaggttctcatactcctcaccgcgatataggatacaatcatttggacatgcgtgaatcttctgaacttccagtcctagcgggcagactatcttcttagcctcgtatgttgtctcgggcaatttatttccctccggaagaatgttcttgacgagtttcaataaatcgccaaatgccttgtcactaaccccattttttgccttccattgcaagaactccagagtggcatccaactttttgtgcccctgctcgcaacctgggtacaacgaagttctgtggtcctctaacatcttgtccaatttatgggctcccttttcactttcgcagtcctccttggtgtcctgcaacatctgaccaagatcatccgcaacgtcgttaccatcagcatccctttcctcctcgcccgtttgatttccttcaaatccaacgtactgagcaaagtccggaatattgtcgtttccacttcatcttcttccatttcaacaccttgctctccgtgggatgtccaaaaattatagcttggcatgaaccccgactcaaacaagtggaaatgaatagtccttgatgcagaatactccttctgattcttacacttattgcatggacaacaaataaaacccctttgcctgttagcttcggccactctcaaaaaatagtgcacgccgtcaataaactctttggaccaccggtcagcgtacatccattgccgatccatctacatgagtcgagaaaaaatcgtacaaaaataattattcttacaataatgacagtcatacaataattataagataattacaaactgtttcaacagtcatataataatgacatatctttattcatacaaaaatcataaaatattacaccaaataattcttatttactatttctaaagttttaaactaattttaatgtgttttacttcttttaattttcattttagtttgttttctagtattcaagattaactctcactatagttttccttctcaactattttataaaaccttctttagcaaatcaactaaatttctatatattctttcttccccacacaaattttctccctcatcaacttacaactaaattttggagacaaaaaagtatgccaaacatagctgcaaatgtaatatgacaaaaaaaaacattggaggatgaagatgcaaaccttttaggcacctccgatttgtatgtaatcaccaaaataaattcactagaaattttggcatgacctcccctcttttttgaagaaattttgaagcttgctcgggcagctggaggaggaagaagacatatatataggggtgggactttagtcccggttggtaagttacgatctttagtcccggttggtgggggtcctgacaggccctgtcagcatttgaaccgggactaaagatgaccttaccaaccgggactaaagatcaaatatgcccgttaccctttttaaccgggactaaagatcatctttagccccggtttttattgcatccgggactattgtggaattcggccgaccgacgaaagatggtttctccaccagtgataggccggagtacacgactcgctgcctctcattatatcgcatgcacatgaacacacacagaacgtcaatgctatagctacgactggctggttgtgctatggcctctctgatttggggggcctcaattttttttgtggggccctgtacgggcgctccgtttgcacgccctcatcgacgggcctaggtgagatgggagaaacttcgtcgccgatgcttccgaggagagggagcgactgccgctacagaggggattggaagtggtgagtatttggggccacggtagaggaggggtaaaggtgaaaaaagttaagggttaaggggcaccttntacaaagngtggnngngtacggtcgnnngtagattagaggtggtcagaattgtattagctagtatcctcaaagcaacctcatcctacatgacgtgttggaacccttacactgtttatggtcttacaatgtgcaggtttgtataatgcgaatggaattaaaatgttcaataatgcaacatgcaacataaattagcgcatgctgatcaatggaggacaaatatatgcaacaaatttagtgaatgttaataaacctgatcggtgtggcataattaaaatggtcacaaattgagcgtgaagatattatcctaccacccttgcagcataggcgtagggataagggactagtaagggtcatgagccatggctctctcatattttatatacctcactattttctctgacttagcttgcatcaaaattagttataaaaaaatttagcactgtaattagtcaaaatatatcgcctggcatataatttagtgctatgattcctagcacacatccactatctaggttcatattacaactggctacgtagtaacttgcagcatccatcaaggtgccctgaccaaatgagagagagagagagagagcgcaatcgctgttgtgtctaatatttttcaagtggtgcatgtgctttaaggactatttcaacattgtaaaaatacatggcttttccaataaatcaagggcggaatttttttttagctaaatactgagagaatcaacactcaccgataaaaaaaaactagttcaaataaatgaggctaactaaaattctatcattacattggtttgaatcatactagttatgcaatgtaaaaacacattattttgttgagaccaagttggtccaacgaagttttgttgttatagccttattttctgatctccttcctcgtagagcgttttgtagaaaggaattgaagcatagaatcaaagcaagaaaatgttgttaggcatgtgcgtgcacatgcatatggtagtaccaaaaataacttcctctaggatagaactgtgatggatcagatgaagataattattatggtgagtacgttggattgaccacttgagtctccgatactttgacttcttcaattttgtatgtagggccacataattttcctttt

SEQ ID NO: 63161 - DNA, 1127 bp, Oryza sativa
agtttccttttagagaaacatgctcgtttctagccataccagtgtaggataagagcgtgatacgtgctgaccacttacgttcctcctgaatgaatatctgattgatgatagttagctgcttcttgtttagggtggggggtatctatcgtaattcattttcagataggagaaaatttgtgggttggtacgataggttagcccaggcatactaaatttggctttggctaagctggttctatcctttcgtttgatcgcagggtgtagcttactatcatggcgtcagccactggagcgtctggatggctgaggggtaaggtgaagggtgtgacttctggggactgtcttctcatcatggggagcaccaaggcggatgtcccgccgcctgagaagtcgattactctgtcatacctcatggccccaaggctggtaagatttatatggacttgatgtagtcagacaatataacacattttctaggttcatttgtctcatgaatttgtggaagtgtttggtctgttccaaagtggacgacttttgtgtaacccctaaaactaatggaaatactccatccttccttttttatatgaccaatgtcaaacaaataaaaccagaggcagtataatagtgacaatcggactctttccaccaccgcatgcattaatattcctacgctatggttttatattttctcgtgtagttcaaaacttatgaatttattcttattctccagtctttccctccctttttgctttatgtattgaaactaaaactttgtgctgctcaaggctcgccgtggtggagtggatgaaccatttgcttgggaaagcagggagtttctaaggaaactctgcataggaaaggtactccatgtgaattttagatcttctttgaatttacttaaatgcatagatatcgattgtgtttgtagaaaacatgccagtttccctgttaccaatgaaaaattcaaacatggtacaggaggtcacattcagagtggactacacagctccaaatgttggacgagaatttggtactgtttacctcggtgacaagaatgttgcctactcgataattgctgcaccatgggcaagggtaaaggagcaagggcccaaaggcggcgaaccgag

SEQ ID NO: 63162 - DNA, 626 bp, Oryza sativa
cttggcatccaccggtcttatccaactttggtcacgcaaagctggccagggaatgggtcccactcttctctcttctccacacaagcgatttgtctacgtggattaatattaccatacgtcgtgtgtgtgcgttgtgaatggcctacgagtactctccgtgagtgcatgtctcattttcagtgctttccttgtctgcctctcgatcggatcaatgcttcatgcgggtccggcaacctaatcaagctagtgacagattctcttctttgtctcgcaaagttgcagacttgcagccgtactacgtacgactagacgtatacttgagccaaacagttttttactatacgattagatgggcggctaatgctagagagagatcgagatcaaggacagtgatttgcttaattaattgtggaccatcttaccttacgtaccagcgatcgatcgatcgacctatctatgctttgcttgatgatcgaattgcttgattgctttcttaaggaaaaagtacaaattatcccccgaactatcacggtcgggtcgtttgaatccccctgaaccacaaaaccgggtattcttcacccccaactatgtaaacaggataaattacccccctggacccaatccgc

SEQ ID NO: 63163 - DNA, 3321 bp, Oryza sativa
taaggcatactatttactcccttgtaagctgaaatgtgtacaacaagtattatgcaattagaacagacaattccacaaatatcaacagagttatgtcttgtatggacaagctagagacaggagtcctttaacaaaaaaaaaaaagggaataaaatgaagttaaaataaaatgttcacgcttagaaaaactaaaatctgcgagtgaaggatttgattttcaaaaacatgcgacaagggtatacagcatatgaaatattagtccatgagatatacctggaagggcctaacaacagattgaagtactctgagtgcgttgatagtattccattcaggatgctggcctggacttattatattgctgctgtggatcacttgcttcaactgggggacaagttcaggccacaaattttccttgacaaaatctttttctatgacttggcggaactgtttgatgcaaaccataaggatgtaagataacacccaaaaaaggcttggtagtgaggaatttagttgcagagaaattaagtagaaatgagacatacaacttcaatcaatactcgaagaaggaaaggttccacttgaagcaacgcctgggcgagccgatcacggaactctttataaagctcaggtgatgacaacccccagtcaatatttcggcgtgtgtaattcttcaagtatgttgctgcagcaacttttgttccttggtccccatcagctataagcacaattcaattataagggtcaggtgggctgcctgcctgagcattgattgctcaaaaagaacacatatactttcattcacaactaaatactggtatgacatttccatttttctgtacaatatctcaaaacaaaacaagaacatcaatatattcatctccatggacagagcaccaaccatttcccaaattatgtttctacatgcacataaatagtctccggcacttgctaactgcagtttagcaaaatcatgaattggattctgggtgctgcgtgtggcaatttaaaatagccagacaaacatcaaacatacataagcaatttgtccaaaaagcgttcatatttgcacggagttccactcttaagggacagtgttaggctgttagcacgccacaaattagtaaattactacaatccagactaccactgctcaaattccccagcagaagcaaaaaaatccacaagcttccgcagaaatcgaacaaggtaagcacttggcatggaaactccaccagcacagctacaaagataaaggggcgggtacctgcggcgacggcgaggagggagatggggaagcgggggtcggaggcggcggcgatcctggagagcccttccgtggcggcgtccaccgccgccttgtcggggctcagggtggcggagaggagcgaccggagctcgtcgccggccgccgccgcggcggccgaggtctgggcttcgacctccatggagcgtaaaccctagttcttttttcttttccttttttgaggatattttttgaccagcaagactccagagagaatggggttgagttggagggaatggaaaggaaaggaatttggcgggaaacattggcgccagatcagatgccatggaagaaggatccagccaagagtggtggagcaatcaatccccactatgcactcaattattagtacaatatttacatgctggattacacactaataatcatacaaaactacaattattttcttttcagaattatcactatagctttaactggtatttccccaaagctgcagcattaccaaagattttattaggaaactataattttatcttcctataagttttatgacgtgtatatgatatgtaagtgcaaatttatcattcaagtagagttgtattttttgtttatgaaatcatacgatatttttgtagttctctggaaaatgttgagctaacgttgtaacaaaatgatagtttttttttgacaaaaaatagttgtagctatatgaaatatactataaaaatccagtttaaaatatagaatgtgtttgcagattctgctcgtatataaatcaggcccaaatactaaccgggagcagcccaaatatttaagcccatacctactgtctgaacaatcacaggcccagagtgccacatttttttgggcccatatcatcgcgatttcgccggtttttggtaggaataatttcatctgaggtcccttaacttgtcaacgaatccgattttcatccctcgaatggaaaaccagatacaacgggtcccttaactatcaaaaccggctcagattaggtccctcggcggttttgagggtggttttggctgacgtggcgcctacgtggctaatttgactaggtctttgtctaacgtggcattgacgtggcgcttacgtggcaatttgatccaaaaaataataaaacccgtgggacccacatgtcagtttcatacacaaattaataaaaaaaatggtggggcccacgtgggccccacatgtcattctcaccccttttcttcctcctctctccccatctcccctctctctcccttctcccatccccgaggcagcgggcggtgtccgggtgagggatggcagctcgcggcggccgggagaggagggaggcggcgcacggcggcccggcgaggagggaggcacgctcgccgtcccggcgaggataggcggtgcgcgtcgcccgggcgaggagaggcgccacgcggcggccgggcgaggagggaggcggcgctcatcggccctccgaggagggaggtggcgctcggcggccgggcgaggagaggcggcgcgcggcgtccgggctgagggagacgacgcgcggcggcccagcgaggagggaggaggtgctcggtggcccgacgaggagggaggcggcgcacggcggccgggcgaggagaggcgacgcgcggcggccgggcgaggagggaggcggcgctcggcccggttaggagggaggcggtgctcggcagcccagcgaggagaggtggcgcgcggcggccgggcgaggagaagcggcgctcggcgaccgggcgacgaagggcagctccaacccggatgtgaccattgaggacgtcggcggaggtggccgggcgaggagggaggcggtgcgtgcgactaccgagcgaggaggggtcgtgccgtccggctgggcatcacgggcggagcggccgggcagcctccttgctccgatccggccgccccgctccaccggccgccgccgctccacccgcgtccgccctgctccggtccggccaccccgctccaccgacctctggtcgccgccgccccactccaccggtcagtgaggagaaagaggggagatgggg

SEQ ID NO: 63164 - DNA, 8616 bp, Oryza sativa
ggttttgataggtgaggaacccgttgtgtctagttttccattcgagggacgaaaattggattcgttgactagttaagggacctcagatgaacttattcctttttggtaggatgtgtggccagaaaaaggaataagttcatataaggtcccttaacttgtcaacgaatccgattttcgtccacctaaaaccagatataacgggtcccccaactatcaaaaccggtacacataaggtcctttggcggtttagatggtgtttttggctgacgtggcgcctacgtggcaaatttgactcggtcttcatctgacgtggcattgacgtggtgcttacgtggcaattcgaaaaaaaaaacccttagggcccacatatcagtttcatatacaaattaataaaaatagtgggatccacgtgggccccacgagtcattctcacccctcatcttctttctcctgatctctccccatctctcgtcgtcttcatctctctcccctctcctccctcctctcgctggcagagataagaagcggcgcacgagcgccggccggagggaggaaaggagcgcgcgcatgcgcaggaggcgaccggcgagaaaggaacggcgtcctccgctaggagaaggacgcacacctcaccatcgcggcccccgccaccgtttccaccgtcctccgcgctgctcaccgacctcgacagcgtcctcactatgggcggtggcgggcgagctcccgcttctctccacctgcttccccgccgccgctgtcgaagacgacgacaccgatggcgacgggtttgaggagggcaccgggccaccgatgcggcgattgggcgtcggcggcgcgggagcagtgcggtggcggcgcgcagggccacagggtgcaagcggcggcggcgtcaaggagggcatcggcggcgcgtggggccctagggcgcaagcggtagtgactagtgactggcggcagtggcgcaggagcagggcgtcgggacgcaagcggcgccgtggaggagggcgtcatcggcgtcgagcgccctttatctggtcggccgccagcttccggaagcgaacggtgagcacgtcgccattttctccttctcccctctccacgacttcacagggattggaaactgcttgctgcagttgctgttcgattctatttctacaattctactcacgatacaatccattatttccctcagtaaatcccgttgaaatttgaacaaaattcagtgccaaaatgttcgctcacatcacactgttgcagcatgacaaacaaatgttcgatctacacacttacgaaccaccggatttcggcggcggctactgcggcgtcggagtgcagattcatcaccctgacgaggctgctaccgtcctcgccgtacctgatgaggtggccgtacatccgcagccagtggtcggaggcctcgtcgacggtgcggtaggtccagatgtgtggtctgagccagaggcagtcgacgaggtcaccccacgcgcctcgttttccatgctcagcacacgacaccattgaaggtccgtgacgcgcctgtcgtcggaccggataccggcgacgccaaggccgggcaagtactcgacgaggtcagccgccgaagcaggtagaggggctggagatcatcgaagtggccaccggtgagcggttgtcccgctggcttcgtgcgccgccgctccagccaccgtcgccccactccgcccgccgccctagtccacatcgtaggaaagaagagagagaggatagcaggaagaagggagcagtgaggatgacatgtggggcccacgtgggtcccacttttttttaactgacatgtggggcccactaatttaattatttttctggatcgaattgccatgtaagcgccacaccagccaaaaccgccctctaaaccgccggaggaccttatctgtaccggttttgatagttgagggacccgttatatctggttttagggttcaaggacgaaaatcggattcgttgacaagttaagggacctcggatgaacttattccccagaaaaacaaaactgaacactgcagtagagcagaggaccaacagcaacacaagagaaaagaagtcatcacatctacctgctacctaactggagcacaacaaggctaccagcaagcaggcagattgtgcaactgccatctactcaccgaacaccaaactctccctctcgcttctcttgcaaaacaacctttccagaaccaaaccaaacaaacaaacaccggttcaacagtctaatcactagtcactagtctgtctggtgtgttgttctccttaataacgtaattaatccatccactgtcaaaccaagaaacaccaaaagatggaaaaggaaaccgaaggcagaaaccattaattctcgcacagcacaatgtatctggtccgattggtgtagttagctccagaccagctggtcataaacatggtctcatcctcatacagggtgtgcaaatcacaatatcttcagtagacaattaattcaggaggatgcatatcacaattagcagtagtttagtcaattaattaatgcttcttttctacactgatgctgcaggttgcttacttagtagatccaatctagaacacagcgagtcatcttctttatattcattccattcctcccaaagacgcaacgtgcacacaccaccaccaccttcatctcggtggcttcgttcactccgcctacctacctacctttgcagttggtttgctgaaccctcctcaagaacccacgcgcctctcgcggcagcagctaaccaagccatggcgcgcaagaagatccgggagtacgactccaagcgcctcctcaaggagcacctcaagcgcctcgccggtatcgacctccagatcctctccgcccaggttcgattctttcttcttcttcttcttgatctcaaagttttagcttttgtttccggtgatccctggctggtttggcgttttttcatttttggcctgatttgggcccgcgtgatttggcctggttgcgtgtaaagatctggtttttctttttttttgttcgctattcattactcaatgaggcattggcatctgtgaattcatgacaaaatagttctctgtttagggtaaaatgcgatgctttaagatgatagtatgaaatggggatctggctacaagtcgtatgaagatgcaatttttctgctgttgggcattgtggatgggctcacttacaggattttaattttagaatggaaatgttcttggttctgtatgcgagttatggcttgaactagtacgacttatggttgcttgcagtttggtacttgcagtagtattaggtgatactccatatagtgcaaaagcatcaattcctttgttagatctggagctttgtcttgcagcattgtttttgtttttttctatgtgtaaattgttagttaactctcgttactggtgtccgtatggtggtgaactggttatgatgttgacacttgaatgttgtcctgatgcaaagtgatttcctctgaaataaataacagtacatggactacgtacaagcagatatttccttttgttacattcacacatttggggtcactagggagccttcatacattttaaactgactgattttgaattatacaaactgtactatgtgtgaaattaatcgtaattacggttctcgtttgacatagcatatttttgtttgaagttaaaaatatcggtttggctgattctgggatttgtaaaaaggttacacaatcgacggacttcacagagctggtaaaccagcagccatggctgtcaaccatgaagttggtcgtgaagcccgacatgctgttcgggaagcgtggcaagagcggacttgtggccctcaacctagatattgctcaagtcaaggagtttgtgaaggagaggctgggagttgaggtagttcaattttgctatcgcctttaaaatctgacttattctctgttcgcttgataaattaagttgttctgtcctattgtggctattcaggtcgagatgggtggctgcaaggctccaatcaccaccttcattgtggagccatttgtaccccatgatcaagaatactacctttctattgtctcggagaggctgggcagcaccattagcttctcggaatgtggaggaatagaaattgaggagaactgggacaaggttaagacaatttttcttcccactgagaagccaatgacacctgatgcatgtgctcccttgattgctacccttccattggaggtatttgtactgttaaaattatttgccattgtaccttgttcagttgatttcatttgaggagtacttccatttgtcacatgcttataataattgaactgtacatttcgacatcaggcacgtggaaaaattggtgatttcattaaaggagtctttgctgttttccaaggtattaaagatgcatatagaattcacttttcatttgttgtaatgttttagttgtaaatgtaataaacgtattggtctatcatgtatccataacaatatgctcccattacagacttagatttctcatttctcgagatgaacccatttaccatcgtgaatggagagccgtatcctctggacatgagaggagaattagatgacacagcagctttcaaaaacttcaagaagtaagtcccattgcttctctagcatacatgcctctgtgcgaatattttattaagcatttcttgtcactgttcaggtggggaaatatcgaattcccactaccattcggtagagttctcagttctacagaaggctttatccatgacttggatgagaaggtatccacatctcaaattacacgtttcacatttcaagcctcctccccaatcttatttaagtatgagttgcctgtataatatcatcagtaggtttgcacatgaattcagataggagtgctggcagtctggctcagtactatatgtttttttgaattattttctaaatgtgatatgatgtccttattctttcagacaagtgcatctctgaagttcaccgttttgaacccaaaggggcgcatctggacaatggttgctggaggtggtgccagtgtcatatatgctgatacagtaagctttgagttcctcccttgttttaacttagctgttcagggatttcatgctactgtcatgaaattaacttttttttttcttatttaccaggtcggagatttgggatatgcttcagaattaggaaactatgcagagtatagcggtgctcccaatgaggaggaggttctgcagtatgctagagtagtacttgatgtaagcactcaagatataaccataaccacatttctctccactcccttgttatgtcaatttgttaatgataacattcaatgcagtgtgcgactgctgatcctgatggccgcaagagagctcttctcattggagggggtatagctaacttcaccgacgtcggggccacatttagcggcatcattcgggccttaagagagaaggtagctatgctgacccctaaatctagaattgtggccaatgttctctaaaacttatcaccagttccacatgttcatctgattgattgactgtcaactgaatctgaaacttgctttcaggaatccaagttgaaggctgcaaggatgcacatctatgtccgacgtggtggtccaaattaccaaactgggctggctaaaatgcgcaagcttggcgcagaactcggcgtcccgattgaggtacggatctactgtctcctactgcacctctctctttgctatgcaagacctgttatatctgaagttcataaatgcaaatgggcaaacctatcagtttgttgttggtggttctgaatcactatcctgaccatcccctcacacaacacggatgagctgatttctgtttgaacaacccatcactgcaggtgtatgggccagaagcgacgatgactggaatctgcaagcaagcaattgaatgcgttatggccgcagcataaatgaagatgcaagttctgggatctgcaggcaagatgctgaatgcgtgatgggtgcgacatggatgagagtgtggtgtagttgcagtagttctctgcagatggctgatttgtttcttgatacatgttatacttggacgagatctggataggttattgatgtactgaaactactactgcgatgcaataaaagtgagagtagcgtttcctgatttgttctcttcttgattgtgatattgttgcaatgcaatcgcgctgtatttcatctcacattgagatgtgttcctgattaagtttagcccctggttttggttcaagtttaagccatggtactgcacatgcattttacaggatctgaatcttgtcatcatgctcagcaacaagtagacgatggtcacgacagaagagttcaaacaacagcatttttgtgctgaaaaacttggtagtatctttttgttgtttctggcaataaactattgcaaatggtagattgtttgctaaaataggttttaatttttcgatttcgaagtaaaaaccgctcctcacaagtttaccaaaatccaatcgaaaaccggtaaaaaccggcgactttcagtgaataccatacgaaaattttcacaaccaagatcggttaatatcgaccggttttcacaaaccgagatttcatcggttttgtgaaccgtctaaaatcaagatcatgtttacaaatatagttcaaaaatattattttgtataaaaatatatgtaattaactgtggagtaaactaaatatatataattgttttgcaataatctcttaatcattatcgggaaaacagttatttaactggggagtaaattaacatcatgtccggctaatatcgaccggttttcacaaaccgagattccatcggttttgtgaaccgtctaaaatcaagatcgtgtttacaaatatagttcaagaaatattattttttataaaaatatatgtaattaactgtggagtaaactaaatatatataattgttttgcagtaatctcttaatcattatcggcaaaacagttatttagctggggagtaaattaacatcatgtccttacagtaaacattgtttggcagtgctgtttctaccattctagttttacagtaattataaagtaagaaaatccaatatatccaaccgctatccttttaaacataaaattatcgtatgattacccattaagcgaatatagattattctctaaatcaatcaatcaactatatttatgtctaagaaaatcaaatatatccaaccgctatccttttaaacataaaattatcgtatgattaccaattaagcgaatatagattattctctaaatcaatcaatcaactatatttatgtctaagaaaatcaaccagattatgggcatgtgtgttttagtactgccatataactctccctgcagttttgttccaatagcacatagtcatagtcataggtaacaacttatatctaaaatgggcaataatctttatatttatatatatatatatatatatatatatatatatatatatatatagaggtgtgcaagcaagtacggttcatacatacatataacgattgtcataagaaactttagtcgctcttccagaatccggaaactgaactactataccctactatactcacttccatttccaactttgagcatgcattttccattaccgaccttgagcatgcatgtattcatagctaccaatgtaatccaacagtttcattgtgtatgattttagtttcaataatttaatagcttatatataaaaagtgtaaacatgcatgttactatcgtccaataggcatgaacagcgtaaaaaacaaagcgcagcatcgttcgattctcaatgatgtgaagttattttcttaataaaaaaggcaaaatcctttcatgtcattttcattagatagagaaaaggcttttctttttccaaccgagttatggaaggtaagcaagaggagacatcgagatgtttacaattaaattccggcatgccttgtgtgtttgcgcttgtctgaaataaccgccaaaaatcatgataggcctccacctctggctgccaccgccacgcctccccacagggccgcatctcctcctccggcggccatcgctgcacgccgtcccttctccttgcctgccactgcccttctcccgagcaccactgccggatctcgatcgtcggcgctgctccggggggacctgccgccacccgggtcgatctgttcccaccgccgtcgccgacccccttttattgccccagcttcctcctccagctcgctgctctcgccggtgggcaccagtctcgccgccccctccagctcgctgctctcgccggcgggcgtcctcaccatcggaagaggagaggagaggggagagagatgaagagaggggagatggggagagagagtaaggaggagaggagagtgtgaaggacaggtggggctgggccccacctttcttaattttttttgtgtaactgagatgtgggcccacgggttttatatttttctgagatagaattgtcacgtaagcgccacgtcgatgccacgtgggacgaagatctagtcaaactagccacgtaggagtcacgctagccaaaactgccttctaacccgccgagggacctcttttgcaccg

SEQ ID NO: 63165 - DNA, 7777 bp, Oryza sativa
tagatttttatgtctgttcttatccattcttataccatctctcctataggtacgtccattttgcatgaaaaaaatcattctattcgttcaccaaaacagtagctatatcgatcagcaagcgtcctcttcttctccttcccatctacacctcctcctcatacccttcgccatagccacctcctccctcttctataagaaaatcagccctatgggcacatgtttcagtacggccatataactctacatttagttttgctccaatagctcatagtcagaggtattaactaatatctaaaatgggcaaaaacctttctatatgggtaagctatcaaattatggaatctaataaaatcatacacaatgaagctgttggattatattggtagctataatacatgcatgctcaaggttatggaagtgagtagctagtacagttcccggattccggaagagcgactaaagtttcttatgacaatcgttatatatatatatatatatatatgtatgaacagaactttctgccacaccaatgttatgtatcatataaaaagtataaacatgcatgttactatcatccaataggcatgaacagcataaaaaacaaagcacaacatcgttcgattctcaatgatacgaagttattttcttaataaaaaacgtaaaagcctttcatgtcatttccattagatagagaaaatgtttttctttttccaaccaagttccagaaggtaagcaagagtagacacatagacgtctacaattgaattccggcacgccttgtgcatttgcgcttgtctgaaataactgccaaaaatcattataggaccaaattgcccttaggtaatgtacaagattgggctttacgacatatgaaaggttgggctcctacaatctgatgattagttaagaaaaagtcaattttgtctccctcaacttcaaacactagtttcattcgtaccccctccctttgttgtcgtataaaagcaggtgtagaggctctcttaactgttaaaaccgagtcaatttacctccttcgatggttttatgctttatggcatgttgatatggtctttattttaggtggtactaccgtaagatctatttaggtggtactaccgtaatatatagtaatttattaaagtaatagaaaaagaaacctccacgttcgttctcacggcctagaaattctcatattaatcggagaaaaagaaaaacagagtccatatagaaatacagtttaaaaatatctgaaattaggaattaataaataaggaatattggaagaggagactaaaagttcatatacatgtatacaatttaggattaatggaaattcgtaattaaaagtagatgttatagtccatatctctactattataaaaattgaagatgtttttgccagtgttttggtacgtcatccgtatttgagtcggtttctaatttcgttcattttttgaattacagatccgtgtttgagttggattttaagtttgtttccttttggaagtataaaaggagcgtacaagaaatgttttgaaaaatctctcatgctaacttgagatgaaatatggactactaattgcagcttatgattttctaaaaaaatatccaatcgagttttcactgtgaattttaccctaactaaacggtataacaataataaaattaaaatagcatttacccattgcaacgcacgggcatttttctagtataaatataatttagaaataactaaaattcaaaattaaaaaaggaatattgaaagaagagtatagagtgcatatagaaatataatttataaatatctaaaattcggaattaagaaaataaggaatattagaagaagagcatagagtccatataggactaaaattcgaaattcaataaaatgttgaaagaaaatactagagtccatataggtatacaatttagaagtaactgaaattataaattaaaaaataaataatgttgaaagatgagtttagagtccgcataaaaatacaattagaaataataaaaattcaatttttttttcaaaaaaagaatatggaaagaagagcctagagtctatatagaaatataattcacaagtaacgaaaatctgaaattaaaaaataagaaatattagaagaggagtctagaggccatataggagtataattgagaaataagtcaaataactgaaattctaaatttaaaataagaaatataggaataaaatttataaataatagaaatttagaattaaaaaaaataaaaatattggaagataagtctaaagtccatatagaaatacaatttataaataactaaacttcgatattaaaaataactgataactatacgtatatacaaatacaatatgaatattacacatcagtagtttttgtaaatttagtgtaaattttaaaattatattgttattttaatagtaaataagaaaatatctattatgtaagagaagatgcaatctgtgcggattactatactaattaaaaaaataataaaactagtgagacctccatgtcacagcaaatttctttatcctctaccttttcttttccccttcctctctcttcaaggtgcagcggcgtcgaactcaagatgcaacacgcaaccacctcctttctcaaaaaaaaaaaaccttctccacagtctccaagctatgcggcacgctggcgcgtaggtaggtactacactacacacgactacagtccaatctggcccgagagaagtaaaagcccacagcggcctaaccgatatgttatcctttcacgttacatcgataaacaaccatattttttctgttgtttagattgttgtgtttgtttcacggtatgtttatcctatctaatctattctcataccatctcttctatatatacgtacgtccattttgcatgaaaaaaaaatcattctctcaatccaccgaaacaccacgtacgtagagtagatcagcgagaatggcctcctcttcttctccatcccatctgcacctcctcatactcttcttcttcgccatagccgcctcctctctattgtccaccgcgacctccacgcgcgcctcgccggccgacactgccgtcggcggcatcgccgccaaggtgtacaccaaggtgtgcgacgcgacgaggttcgccggcctgggcctgaacatgacggagttccgctactgcgacgcgtcgctgccgtacgccgaccgtgtccgcgacctcatcggccggatgaccgtggaggagaaggtcggcgccctcggcgactggaccgacggcgctgcccgcatcggcctgccggcgtacaggtggtggtcggaggcgctgcatggcctctccagcaccggccccaccaccaagttcgacgacctcgccacgccgcacctccactccggcgtctccgccgtctacaacgccaccgtcttcgccaacgtcatcaacagcgccgcctccttcaacgagaccctctggaaatccatcggccaggttggttacaatttacaattcatcgatcatctcttcatttcaatctatagatcatacaaatctatatgaattttgttcaaatttgtaggctgtgtcgacggaggcgagggcgatgtacaacatggggaagggagggctgacgtactggagccccaacatcaacgtggtgcgcgacccgaggtgggggagagctctggagacgcccggcgaggacccgtacgtcgtcggccgctacgccgtcaacttcgtccgcggcatgcaggacatccccgggcacgaggcggtcgccgccggcggcgaccctaacacgcggccgctcaagacgtcggcgtgctgcaagcactacgccgcctacgacctcgacgactggcacaaccacacgcggttcgagttcgacgcgcgcgtcgatgagcgcgacatggtggagacgttccagcggccattcgagatgtgcgtccgcgacggcgacgtgagcagcgtcatgtgctcgtacaaccgcgtcaacggcatcccggcgtgcgccgacgcgcgcctcctgtcgcagaccatccgccgcgactggggcctccacggctacatcgtctccgactgcgacgccgtccgcgtcatgaccgacaacgccacctggctcggctacaccggcgccgaggccagcgccgccgcgctcaaggctggcctcgacctcgactgcggcgagagctggaagaacgacaccgacggccacccgctcatggacttcctcaccacctacggcatggaggccgtcaacaagggcaagatgagggagtccgacattgacaacgccctcaccaaccagtacatgacgctcatgaggctcggctacttcgacgacatcgcccagtactcctccctcggcaggcaggacatctgcaccgaccaacacaagaccctcgcccttgacggcgcacgccagggcatcgtcctcctcaagaacgacaacaagctgctgccgctcgacgccaacaaggttggcttcgtcaatgtccgtggccctcatgtccaggcccctgagaagatcatggatggagactacacaggtacgtaggtcgtcaaatgcaaaaattctcacttatgttactgttcatggtccgacaatggcatcatgttactgaacattattgattgatactttttttttcattgttgaaatgcttgacaaaccttgatgttactactgttcatgatccgacaatggctcaatcaattacagaaaaatgttactgaatactactttgaaatgcaggtcctccgtgccgatacgtgacgccgcgccaaggtgtaagcaagtatgtgaggttttcgcatcgcgccaacactaccatctacttcggaggcctaaacctcaacattgagagggagggcaacgacagggaggacattctcctgcccaagaaccagacagaggagatcatccgtgtcgccaaggcgtcgccgaacccgatcatccttgtcatcttgtcaggaggtggcatcgacgtctccttcgcgcagaacaaccccaagatcggcgccatcctctgggctgggtaccctggtggtgaaggaggcaatgccattgcagatgtcatctttggaaaacacaatccaagtaattcagaatgcaaatcacatcattattttattcttttgacacatcaaatctcaaaatcaaatgttctttgattgaacaggtgggaggctgccattgacatggttcaagaacaagtacatctaccagctgcccatgacatccatggatctccggccggtggcgaagcacggctaccctggaaggacatacaagttctacgacggcccggacgtgctctacccgttcggctacggcctcagctacaccaagttcctctacgagatgggcaccaacggcaccgccctcatcgtccccgtcgccggcggccactgcaagaagctcagctacaagtccggcgtgtcaaccgcaccggcatgcccggcgatcaacgtgaacggccacgtgtgcaccgagaccgtcagcttcaacgtgagcgtcaccaacggcggcgacacgggcggcagccacccggtgatcgtgttcagcaagccgccggcggaggtggacgacgcgccgatgaagcaggtggtggcgttcaagagcgtgttcgtcccggcgtggagcacggtaagcgtgagcttcgagctcaacgtgtgcaaggcgttcggcatcgtcgagaagacggcctacaccgtcgtgccgtccggcgtcagcaccatcctcgtcgagaacgtcgactcgtcggtgtctttcccagtcaagatcgacttcgctatttagacaatcttaattaaatatatattcaggtgtctgtttagattcttttaggcaatgaggtatttgtttttaagttcttttttcctctaaactgccatatactgtcatacgtttagaatcgtactccaaaattggagtgttaagtgtcaatatgtttaggcttccatgttacaattggaacatatatggtcatagaagttgaaaagtttagcagtttcatatcttctgttcttgacacgtatgtgatttaccaactataattaagctctcctgcgtatcatgtcaccgtacgtcgtgccgtccggcgtcagcaccgtccgcatcgagaacggcgacccatcggtgtctttccccgtcagcatgctgaatgtaactgtcttttctaggctccaatattattcagtatgctgaatgtacctatcttttctatgactttgatgttaccaatctctcatcttttcgcttatgtttatacttatcagtcaaaatttgaattttcaaccttaaattttaagccgattttaagattgttttatcgaagtttatttttcagcccttcgttttttcatcaaagcagtgccatacctgcttacatctttcttgaaccatgcatgttcagtcgttcagtcccttcgtgaaaatttcctgaaagttatattttctcatgctcagtccctttatgaaaattttctgaaagtatatttttttatgaaagctttgcatggatctttctggaactagttcttcagttctgaaactaaggctgcgttcgttcattcaggtgagattgggtgagaaagcgcatcgttttccgcgcacacgctgcccaaactactaaacggtacattttttgcaaaaaaattttataggaaagttgctttaaaaaatcatattaatctatttttgaaatctaaaatagttaatactcatattaatttcgttttacgtatcttcccaatcttttcaacccccttcttctcgagctcagttttctgctctgaaactaaaacctcgtggagttttttcagtattgtggcacataaatgtaacttgccaactttgaaaagagatttgtttgaattttttttaacttatatcgagctttcacaaatagttgaaacttgaaaaacttgttctttgcaaaattgaatgaaatttgtcaactgtgaaagagtagcaacaaagttattcattgcaagcctgggaagttttgttttgctcggtcgaactaggtgatcagggcatcctccatcatcatactattcatgtacttatattactatattagtactatattggccggagagagtctggtatgtcatataaggcccctctcccactagacgatatagaccagcagaagggagacattatttacctgcattaccgtaccagtcccagcaaccttgcccctctcctgttagccgatatagacaaacattattgagacgttgtcgattctggaaatcagcaatagtaaaaggggatagtgtacgagatctcaaaatggatggatgcggaacataaagatttagacaggttcagtctctctcaatgagagacaatactctactcctgtttggagattgtatccgccgggtgtatattgatctaacgatctgattgtggttatacccttgaagggctccctgcccaccttatataggatggggggggcaaggttacaaagagagaaacttacccaaatacgacatcagttttcttaatctattttacaatattaccgaaccaagactttaggtcgttccataatatataaagaaacgtaatacctaagtcatgatccgttacatattccataaacataatctactccctataatcagtcggatagacctgccattactatgtggttagttgaacaaactaagcatatggttaaggagtaaataaattaaccaaccgagtggctttttagtcaaccaaatgacttaatattaatttatagcatatagggctgcaggaattc

SEQ ID NO: 63166 - DNA, 13649 bp, Oryza sativa
atttttttaaggtattgggttcacacaccgtgcgcatatcgcaaaaatgagtatgcttaagtccctataagacacatagcttcatcacacctgaaaaatatatggcatacgtggtgtaaaatcccaagtactaatgctcaaatgatttaccactgcctataaatgaccaaaaaaatatattataattagcctaaagccataatattggtcttttagaaaaagtaggaagaaagcatgtgcagatgcacgggaaatttatttgttgtttgtaaaaaaatactaaaaaaaggtcatatgtcaccatattttataagaaaatagattgtaattgtaaaagaaagaaatatttatatcatgaatccctgaatagcatgatccgagtgatataccgactgtttttaaatgatataatgcacatagcctaaagccaactacgtctataaaaatcacatagcaaacgactttaataaaaagcctttatttttagataatggaatataacatcctggcctttgctcaaaagagttacagctaattattacaatctagtactctagaaaagagtgtagtccaaataaaatagaacacatcaaccaaaatagataaaaaaacaaaaccaagacaaggagaacacattaattcaagtctatttatgaatctacatcaatagttggcaaaaagttgcataaccgttatctctagcttataacatgcaactttcagaaattctccatcttcatcacacatttgtaattgtaaccaaaaccggagccaatgtgttgctctgaaaattacctgcatatataaaatagatggtaatttatcaaaaaccatatcattcctgctcaaccacagagcccaacatatggcagaggctactacaagaatcagtttactctttttcttgtctaccccaaaagccaaccataaaaaatatgagatatgctagcagaaagaccaaaagtgaactgaattactctccatatgaactttgcataatgacaatccatgaagaggtgttgaatagtctcatttttcatatagaaacaacattttaaattaccattccaattccgtctcgccaaattgtccttggttaacacaacccctttaagcaagtaccacataaagatcttcatcttaagcggcatcttaagcttccaaatactcttatcctctcaatataaccattattaattagagctagatacattaacctaatcgagaacatgacattctgatgataattccatctaaagcaatcagaagaaagattcaactggatatgtacaatagaagcacataattcatgccaataaacacgattctgaccaactaaggcttcctaaaagaaatattaagcggaacaaatcccatgatattagcaatagaagaaattttgattcggacaatagtatataaagatggatatttatctttgaaggccaagtttcctaaccatttatcttcccaaaacctttttgttccccattatgcagttaataaagaaattttctaaggtattgggttcacaccacgcgcatatcgccaagacaaattaaatatgcttaagttcctacaagacacatggcttttccacactcgaaaatatatggcatatgtggtataaaatcgagtaaataatacccataaacagatttaccaactgcctaaagttgaccaaaatcatacaatcagtctaaagctatagtattggtgttcgaataagaatgcacacatatgtggcctaaagcaatgatattatatataatcaattgctttatataaaccaaacagtgccttaacttgtataaaagttaatagaccagctatatatataaagctttactgttttccatcttttaaattgcattgtaccaactcataaaaagttgtgtaacagctgaataaaatgattttcaagatattaagcacttgaacacgcgtacattgccaagaacaaatatgcctaagtccctaaagacacgtgacatgccacacttgagaaatatgggctgcatactcttaaagggcttcggcccaaaaagaaaattcaccgatacccttaaaaaaaatcaccgtgattactgtgcatcatcttctccgccgcttcatttccaaaaatcccccttcgcgctccttttcacaaccaccaccgccggagctaggactagggttccccactcatccaatcaccaaaaagaaaacccaaattagccctcgagcagatctgcacctccgcaccaacaacctcctcaaatttcttccacaagaaactctaatccgaagcttctcatatccacccatggcggaagagcgagaaatctcgttcgaacaatgggcgacgtttgatgtgaaggaatccacattgaaggagacggtgaagaagggcgtgctgccggcaaaaaaatcatcgggtggcaatcggcctacagtgaggaattctcgacaccgaacattggagaaattgtggtatttactaccttcttctatagtggtttcaatctcccaacttccactttcttctgtggtcttttggatttttatggaattaggatttatcacctaaaccctaacaccattctatacgtcaccgtatttgtccacctgtgtgaagcctttttgggcattcggccccattttaatttgttccgctgcatattttacctcaaagcacaccccaccaaagaaaacccctacgtagttggtggctctagctttcagccatgcggaaatatccacaagcactacttcaattttcctttgagaacctccaacaagggctagcatttgaattggttttacatctcgaacccagttccatgcctccctgcttttgtcggcctccctccagtccatggtccccattggaattctcagccggagggaactgatcttgctgaggctaactccttactaaagaaaatagttggaatcaagggagccggcttacgcgggaagtaggtcactctggcacttcatcaaatgccaactagcccccatcaaggagagagatcaaagccatccttccagcacgaaggccaaactggccccaatcgggaagatccagactcgatcgagttccagaccatgtattctcagatgtacaaagtcttctcgactgggattgtcatcgattatgggcacaatcttccagtcatcccatacagcctaatgaatcctacgcctccagtaagtctctataactcttctttcgtctctggcagtgaatgaatcattggatatataattgccttgtcttgacttttataggaaaatgaatctataatctcaaacccccttgctatggctcggcaatctcctcgaaggagcccaagaaataagcaaccaactgggggcccatcaatcaaaacccctcaaaagggtaaaaggtcagtcaaagagcaagcaccagcaagggctgagaagtgaacgaggaaattccatatcgtcgacactgatgaagacgacaacttagctccaggcgccaacccaactcagacgccgggtgctgacactacccaggtgcccaatgtaactcaagcagtgcccaagcctaagagagcggtttccaagtttaggacatcttcaaggtaaacacaactatgctctgccttttaatattccagaacattagaatccttgttgataaatgattgctaagaatctgtttgctcataatgagatcctgttaacgccaaattttggtaagattctttagtgaattcagttaaggaaaaagcacaaccagtcgacggaaacttatccaaaagagacatagtttaagaaggaaccttgaaaactttggcatgacggtttaaattctatctattaattagacaagatttagtaatttccttttatctttaggaaatgtttatttagtgtccgatcatgacttgtatctttccttttatctttaggaaatatgtgtcatgtccgatatggactagtatctacccatggtataaatatgtacaccgatggtctttgtaatctatctcttgatcaatacaactactctcgacgtatcgccaccctcttttccgaggtttttacttatcaaccggcagaacttggcacgtgacgcgtgttgcatcggctttcgatctctggcgagggggtaagtcctacgttccgccggccctggcaattgtatcggctacattggtgttgttcaaggctgtattgtttcgacctcttagattgctctagtttggttgatatatttgcctaccggtttatcatatatcttagttaatctaatttgattattcaatttacttgtatcgatctgatcttttctagggttttactggtatcggctaaattgtttgtcggtctagattagctaaggtatccactaccctgaaaatcagtcaatggcttgattgtttagattttatgattctttttatattttgcgttgcatcagccctagtcatgcttagaatcataaaaactaatatgcatgcctttcattgctaataagagtttcatcgaggttttagccgatgggttatctggacgtttcatcggcttataaggattatatacaagttagttttagctgattgcagtaaatgtttcattgattatctaattgtttgaatttagtgacatcgaaacaccagcccttaattcattaattcatttgtttatattatgcccttaaatatctgtcaccaaaataaaataatccattagtttttgcaaccttaaacggggccttagttgaaccctttttttttcctactcatctaatctaatctaaatctaaatctaaagtattaaaacctacccccggctgctcgctcctcagcgttttgcgctggcgtggacgcgggaaggaggagggatttcgcgagcgctcctgcctccgcgtcgtcgctggccattttgcaaaaaagcccttgatttacttgataatttgttgtaggtccctatcccttagttttaacgttatgcgttcttacttagaggacctctgtaaacaaaaatattctatacgaagaagagaaaaattggaaaatcgtaccgcgctctgaaaagtataagatgaggggtgtttttgtaaaatagaaaaaaaaaccctaacccccttccccaaaccctagccgccaccattcctcttcctcctctcgctccgctctctctcctgcccaagcaatggccgcccccctcattctcttcttcccgcaggtgacggcctcccccgcgcactctctgctgtcatgcccgccaccgcagagaggattttattgccatgtttaggattctattgccttcttagtccaactcggtaattttcattgggaatcatatggctttctacaacttacaccaaggtaattaaactggattgtcattgcacttgtgaagttcgtttcattgctttcttggttttattttctaccatcacattttatacatttacagttaggaaagaagtgatgactatcacttttttgtttgtttctatatttatgcaaccgtggctatcaactaaccaagttgtgatatttgatattacttttagagctgatgacctacaactgataagtacttaaagaattatgaatttatgactcaattatattgatgtccctaacttttttttaatgttcttgaattgcttctctaggaatttcatgaactcagtaactaagagctaattcacagcagttatttaaaggctctcaaattttatcatttggctgtagaatatgaatttgttccacaggaggaaatgcatggtataatctaggatgttctgcactaactaccgtggcagtgtcacgtaattatctgtcgtctattttatattgtgagcagttaaaagaaatgatcaagctagcatttgatatgattttttttcaattcaaaatttcaatacttgagcaatctaacgtgcaaaggcacactcacaaattccaaatatgagaatggaatatctgtggctttcggttcttctattttttaaggttagaatccacatataacgtaccttcaggttcttttatcgtaacaactgtctctcactctgatgctcatgcatgtatgagcatgtgagattatcaagtttttgcttttgtgaggtgtgacagaaacattcaaaggttgtgttcaagagacatatttgctgttgtgttagtttttaattgttatgggcatgcacttgtaaaggaggagagtgcagtcttgaactattgatggtcaacctctttgttttctatatatatgcccattcttgcatagaggttgaccatatatacaagtgcaaagaaaacaaattcagatacattggtacaaaagtgcaaagaaaacaaagaggttgaccatatatagaagaacatggaggaatgtgtgagaaaggtcagctatctaccaattcttgcattgattgctctaatagcaatattatatcaaatgaacaaattgcattggtttccactaaatctagggagaaaacaaattatgaagaggcatgtttattgttgacaacaagggaccaattgaaagggtcaatgcttagaataccaaaatacaagtaaaacttagcatattttgctattacaaactaatatggaatgactaactacgtttttttgtttgttccttaaatgttgcttgtgataggaaaaaagggggattttcatttttgctctgctatattagctcacttttaccagcatgcttgcttcttaaaatttggtgtacatcttcgtttatctaggtatataaatttgatcatttcatgtctacctgtgtttgctcttaagtcatgatgcaccaatagggctcaacaattcatcagtgctaattaccagagaggataatgaaataaaggtgaatgttccatcttctttgatgtttcagtactatgttcccctggatttgctcatgatttcagatttttactattgaaatttggttacgttgatcaatgatcaatataatgtgttgttgatattctgctagaggttcaatttgatttgtttgtgcatcatagatagggcaaggtacctgccaatgatttaatgtacagatttagttggaagctctataatgcatgtcaggtaacattttaaattacagtaggattgatctctgttgatgaatgttctttatttttctgtgacagatccacaatcacttatttggatgcatcacgctagcagcaaaatactatgctcaaatcagtgtcttaattataggctggctgattgggcccaggaacttggactcttcatagagctcattcaattccattacgtacattagccctcatagcatggaaaatagtcattcaatttcacacattgtaccattatacatgacaacagagcacttctttcctccctatactataaacaaaaacaaccagaaaagcaaattcttctagctgtgcattcacttttccatttctgatgccatgggtcttattccatataaagaagcatcagtacagcttgaagaccatctatccattgttgtcgcattgtatcatcaacgctaatatcatcaccgtctctgtcacaccttccaaactatacatacagaacgacagtaatacattcccttccatccaatattgcaggacaattcacctctagtatactaaaattcttaaaccgaatggattcgccgcgacctccgccagccacgtcaacctgacttttgtgaaaaagcccctcgcttttgattagttacgtgccggtccccactacatccatcgtccgatctcgcggtatggtcgatctggccgtccgattctccggacaaaccctagccggccgtcctcgctccccaccacccactcgacgccgccttgcctcaccactgctgccgggggccgcctcgtcctccgcctctccccgccgcctccacctcctccgccgccactgtgtcgtccccgtccccggctgcctccgcctccgccttcccctcgcgcagggtgcagccgtctccgcctcctccaccgccgtcgccgtcaacgtcgctgagcaccgtctccgccgcccgcgttccgccaccgtccctccgtgccgtactaagagtaggtgtatatgcctcttcctccccctcgcgctgccgcctcggcctccccgttgcgccgtcgctgtcgccgagcaggggcttcaaggcggacgcggagaaagcgaggaggtgagtgctcctctcctcttcccttctcggttctcttatgtctgcgaggaacggtgcctcgtcgccgttgtcgccgtcgtcccgctggctggcaccgccctttcccctctccccgtcgagtcatcctctccgacgcggccccttcctcctcttcatcggatggggtgaggagctcggcagcggcaacgagttcgacctcggcagaccgggcaacgacgtatttgctattattgtgcagaagaaaggggaccgatatgtatgcaaatgcagacttgcagagagagaaagagagagagccatggcgcatcgttccccctttcatttcactttacctcttgcatttttgctgcatgtctggccctcaaggcggctgctgctgcttggccggtgcgcctctttaattcgatatatcgatcgtttctttttcaatgatgccttagttttaatattttacattgtgtgtctgttaattcatcggcgatatgatctcatggccggctgcacattggctctgccagaatcgattcattcgagtattgcataagctatatatgctatggcacttcagtaagctttctgctcttgttgattactagcacacatgaaagagtcatgaactagtgttctttacttctgattaaattgatgtgatatttgtgtaggtgatgacaaaagctacaattattcagtgttgtcgttctctcctgcaggtgacgtattatgcaatttactgtttgctgtagttttacagcgccactgctcacactctgcttttgaaagcaatatgtctaatggattacataaggaaaggtctattgcatccgtcagctaacatttcttacggtgttagggcccttttagttcatatataggagtggcaaagaattttataggactcaaattccaacagatttttcttgctatgtttccctttgacttataagactatgttcctatgctttattttcataggaaaaataccaagaggtataacctctttgtaaatctatccgcggtccattcttcatggtgccaatcctcccttctcagagggtaattcttttctgattcatatggtgcgatgacttaccgtggcacgccgtgaaaagctgagattggcagatggctcattgggtgtgatgccggcatgtcggttctcaatattactggagtaagcacatatctttgtcattggccaattcgcattgcttgaactttccttggattaatttggctgttcttctggaacggtttataggtgcaaaggggtgcgagcaaggctacattggacaaggcggtgcaactatgagccgggagaatgaagatgctttcatggatatgctggtcagtcctactttgtcagctcaattaatgtgtcattcttgttcatacttgattaatgaaattgtaatttcacatggaatttcaattacatggaacatcaacctggagtttaacaaggttaggttttaatcacactccattttaatgaggttggctttttgttaggtaattgccttgcctttctacttgtgtgtactaccatcagaacgaacctgttcggcatagtattttttagcaccgcccaaaaaaactttaagattgtttcaataatttatctacataatatcaagataaatgggcatagtttatgaacctttgaattttgctcctgttccatactaagaagcaaagaaaaatgaaatcatcaaattcaatagatacccagtggagtatgggtatctatttctgaggtttaatgtttttgtttttatttttcccctcaccatcaaaccattttcttatgtttgtgtttatatttaaagcttctagatcccattgaaaatcgttataaaaatgaggaggtcagagctcaagccacgagggatctttctaagtgcattgttgaccacaggatggctgccaaatcattacccacgcctgagcaatatgctgtaagttctgtaaccatcacccttcttttttgtgcactctaattaagtacatctatatgtgctccataaatttcagcacacaaataatgcatcataaacatgtctgatattgttgtatgaccttttgcatcataaacatgtttgataggactttttgcatcataaacatgtttgatattgttatatgtggatatggtgagatgtagaactgtggattttagagcagaaacagttcatggttttaaaatgcactttaatagatgcatattcaaagtattaaatgtgtaccaacttttactttttgtatttgtcttgtgtaaagcatcatacattcatattacaacaatgctgtggctgacttgttattctgacaatcggtttctgttcaggttgaaagggagtgcactaaagccgaacaatggctatgggagaggtcacaactccaggagtccctgcccaagaatgttgatcctgccctttggtcccatgaaatcaacaaaaaaaaaacacgagttggacatgtaattagttctttcctccctgggaccatttttcaactgacttgtgcaaaatcagttacagtttacatcccatattatcttagtacatttgcttgattccacttgcaggttttgtagaaacattgcaaggcacaagggttctccagcaagagcggattctagcggggtttcagatcacatgcataaaacagatagaggctagacatttctaggatttcgtaactgaacagcgttgtcaagcctgacattttgtagcaatatacagatgagcgagtttctgctgacagtcttatacgatccgactctgtaccacagtcagcccgccatcgggtgcctgcatcttgataatcccagaggtgcggttttcacttgaaaaccctactactaatcatgattgttgatgcttgtgtattcttttactgtaatcgactcaagggctcaaggctgttgtctgcattttttcttgtgatgaacaaagaatggaagacgccattgataacttccaatggtcacaagagttgaagctttggggtttcattttgcgctgatcccagaaagctgccctggatagtctgtatgatataccggagatttgtatctactatgtgccattgaccatatattgcacgcacgcagcgtagcgcgtgtatctttctagtgtatcttttcttaaggtgccccacttcaccacatgtacgatgacacattcgtttgaagcaactttagacttgtttttttaataaaagagaaacattatactatgttttagaaaaaacgaaacactatactaattttaacaaatggttgtatttggcaccactaattcaatataagtaattaggtaaaacgaaaatgcttacagaaatgaaaataaccgatagtagttgttaatgtaacagtaataatgtagggcctgttcactttgctgtcattttcaaccttactaaattttggtaaagttaccaaaaaagtggctacatttagtttgctaccaaattttggtaactatataagaaatcatgtcaaaattttgacaagtttgccaaaattttgacaactatactaaaatttggcaatgccaaaatttggtaaagttttttttggcatcaaagtgaacaggcccgtagtgtaaccgtgggccaaaatcatgaccctagaaatatggtacttgcagttttcctcccaaaacctaatttaattaaaaccctaaacatagaaattggggaaaagatcaatgatcaaaaattgattccctaagacgcaatttaatcatgtgatcacgtagattgaaagaaatctagaataatcaaagcaaattagaaggaagcactaacttgccggtctcgatgactggagaggcggtcgcgagcgcggcggcagcctcggccatggcgaggcttcctgcagacttcgaggaagtagagccaaggcaggtcggtcagttttgcatcgttattttgttcatgggccacatttgttctgggcctgaccatgttgggccaaagggggtgcacccattgtaaaaacatgatggcttagcattggaattctttaggacccgggtgcctgtccacctccctgggcctactggccttcgccctttatcacgatgcgaacagcctgttgctgaattactttttttagtcttaaatgaaaaagcacaattgcttttgtttttcttttgatcggaaaggctgttgctctagtgttttttttcattttttttggtaaaaaaggttctagcagtctagcgctagccggaaacagcacataggatgggcggtactctattctagcactaggagttaggtccttttttaagctagtttactcaattattgacgtgcattacttgctccatgcttttaaaaatatatatatttttactatattgcttagactacttattctaaactatttttgaagtttatttcttaaaatatgaatttattatgttaataagataatatgtgtcaataattcagagaattatctgtttcagggtcttgaaatttgttctccttaggaagagaaaatttgaaatacacagcagatatgatgggctcagacagatgacaagctaattaatttgaccaatttatatctcggtacctgtaacatcctgaaaattcgaccgacaaaaatctaaactctgaaaatgtgggccttcaaaaactttttaaataaatcgcatcatgccgattttattcgcttatttcattagattttaatttcggtgttcaccggacgcgaataaggaattattatttaggataaatcctaaaattaaatggcaacacagataaattagaatataatttaaaataaagatttgttgataatagaaataaataaaatattatcgcaaccatatttgtatcaattaaatttaaatacgatggaataagaattaaccctaattaaaaattcaaataaattatataaaaataaaaaaaatgggtaatattaattttgagtgaatccattagttggaataacacaaatgttgagtaaaattcatggatgcaaagattaggaattatagaatcaaatttatacgggaaataaactaaaatcggaataaataagaaaatgcactgttcatcatggcgaaggtgttcgatcgcgtccctagccctaacacctcccttgccgcccgcgcgccgctcgcccgccgcgccgccgtcatcatcgtcgccgtcgcgtcgccgtcggcctcgcgccccgtgccgccgcctcgagccccgtgccgccgcctcgcgccccgtgccgccgcctcgagccccgtgccgccgcctcgcgccccgcgccgccgctgccacgctgtcgccgcgccgcgcgcccgcctgccgccgcgctcccgtcccgtcgccgcgccatcgtcctgtcgccatcgccgcctcgcgccccgcgctcgcgcgtcgcgtcgccgcgtcgagccccgcgccacctgtcgcattgccgctccgagccccacgccgccatcgcgtcgccgcccgcgcgt

SEQ ID NO: 63167 - DNA, 18584 bp, Oryza sativa
accccccctctctccattctcccccaccccatctcacccttcctcccctctcccctctccaatgcgccgccgttcccgtgccgccgcgtcgccgttcccgcgccgccgtgccgccgttcccgtgccgccgcttctgtgccgccgtgcgccaccgtcgccaccgccgtcgtcgccgctaccgctgccggtgtgccgccctccttcccccttgcgtccaccgccgacgccgctcgggtaggagggagagccgagagagagagggagaagaaaagagaagaggaagagagagaaagagagaaaagaaagaaaaagagaaagagagaaaagaaagaaaaagaaaagaaaagaaaagagaaaagggagaaaaaggaaaaagaaaaataaatagaaaatttggaagaaattagggaggttaatagtttagaaaatttaaaataattagaatttaattatagattaattatggtcgtagaattgcaaaatttaattattcttggtaatttctaaaagaaatcaattcgcggtagtaatttagatgtaattaacaactagatgaatctttatggactattatagattatttttggataatctctataagtaatcgattgaaggtagaaatttggatttaatcgctaggaattttagacgtatattatatttaatcatttagtcatagactaaattaaatcgtataatattataagataattttaggattccgtccgatatttagctcgcgatagaaatttctaacctattatatggatataatgttcgggtagattaaattaaaaaaaaacttatgataacaaaatatttatactcgcaaaatagtttaggatatttaaaatcgaaattggtttgccctagtttgtgaatagtaaagttaatataaaagaatcaactttcgcattcgacttccatttggatttatttggatttttatttgaattctaactgaattcaaatcgtttcttcgcacgtaattttagagcccgagggagttgcggatccaagcgaggaccaagacccgcaagactttgagcaaggcaagtcatcactattctttgaacatgttgaacccaattgcgaaattgttttgcttacaaataaaattgcatgcaatgatgaacatcctacttgtgattatgtcatgccttgattattgtttacccttattccttcgtaaccatgtttacgtatgagtccctagtcgattataacaattgcttagaaatgctactctagatttatgcatactcatatttatcaaatgctatatacttgggcaattacctttgggaaggtaattgagatgcggcatgtggagacatgagcgccacattgccatgatattggtgacatgatttgtgaaaggagaaataaactaaacaactgttttcgactggggcggacggaggatttggatggtatctggaaaaggctagtaccgtccccggtcaattaaggaccgagccatgaagctaagtatgaaacgacccccgtacaaccgcgcttctcgtatgggtatagacctagcggagtaaatagccgagcggagacagtatccctgcatagatggttcacccctgagtgaggcaggtgcgctacggtgggacattcgttgaggtagggccgagaggtgtgccctacatcggtgtcgccattggtaggactgccatgagtgtgtgtgagagagaacttaacttgaactataatttaatatgtgtgtgagacttctccttcctaggagcgccagaactcctctcactgctagaaacatggacacctagagtgcatgaggatttaagttcatggagcggatactgccaatgcgaggttatcaaaaagctttgccgtgacgcgtctcatgtgttgggacgaggcacatgtgttgggcagttgcggagtgcgggtaaagtgtacatccactgcagtgtgagtaaaccaaatctattcgaatagccgtgctcgcggttattgagcaccgggacatgtattacacttggctagattctagattcttaacttgtgtgggatgggatattgcatgatgatttttatgctgttggagccacttcctgagaggcgggaaggtggatgccctcagaaaaccatgacaactcaatggcgggaagctatccttgggatcacaatggatggtggacagaaccgtcattgtttaatatgaacactggtactaaattttgatcagtctatgctaggtcttaggcttgcgaaaagaattacaaaacttgctttgcgcaaaagaaccatagccattccttgaaatactcctatcatgtgcattgttgctgtggtggcttgctgagtacggttggtactcacccttgcaactataaacttaatcagaggccggggatgaagcttcggaggacccctatgcctactaccaggagggtgatgaagacgacggcgctcaataggtcttagtacggtcgttgcctgtggaaatggcgtgccgctgccttaactccgctgccttaccttcttctgtttttgggatgtattccagaccactcggtccgatgatttaagactatgcctgcgggcttatgatgtaataattcgtactcgtgtatgtgcacttggtacttcagctatggattcgtgtgtaccagactacttgatccagggaaatggtacggtttacacgattgattcctgttataaaaacgggggtccacagtaccagctagctatataaaaagaaaacgataaaatgtagactttggctgattaaaagttgactcatatactccctccattctagaatataaggcataaccactcttaacccaaagatcaagaaatatttattattaccttctcatttgaatcactctaataaatacaatgtatgcatctaacagaattagaaatattgagagttgaggatttaaataataatttagtggaaaggaggtgctagttaattgtttgcttgcatgcatgtcttatattatgaaacatcgaaaaaatagttgtgcattatattttgtaacgatggagtatatagctagtttaataacagagctaactttaaaattacttcctatgttttaaattataagcacttcttgcgtttaaaatttgttcacaagtaaggatctttagagcactatatttcccccaccaaccattatcgcatttaattttcacccaattttacctccatccattcacaaaagcttgacgctttcgcctttgttctacgtacaaatgcatgtgttaaatactgtaggaatggtcactttgccctaattaatctttatttattctagtcccaaccacccatctcggtagtacatggagaatatttttagcttagctcgtggcaaccagctgggtccttaatcgagcagcttttttccggaggacttttaaagtaaattctacttgaagtatattcttgcagtatatgaaagggtagatttggtatttgttaaaaaatcttaaaatggttatttagtcatttttaattgagatttttttccatggagattttttttctatcggtggtatttttccgatctcgtcgttcgttcatgataccaatccagtctactttgtacgcaagtctactttgtacgcagtacgccgggtcaccggcagccgccttcacgttgtctcgcatgtggctcccacaagcgccgcccagccgctgccgtacgcaacgacgctgtcgccgccgccggagctggaagcgacacagcctccgccgggagcgaagccacagtactgccattgtcgtgcgcagcactatcgccgccgtcgggctcggcagcagctgtctgcttccaggaacttgcttccgtcaatctctagcgataactattaatttgtgatttgtgcattacttatagtctatcgccgcagacgggcttccctgccctgctgctgccgcatgccgccctgctgcttccacctgccgtcgcccggctgcccttgccgctgcgagctgccgcaactgcgcgcctatcaaccggatcttactaagtgcaaaatttgaatttacaaaattaccccccacgcaaatacatgaaaaagacaaatatgccctatttaatttatagggcagaataatttagaggaagatcagattaatttgcaccgttagattaaatatactggtagtatatatttacagtaaaaatgtaccgtaaaaattctctttttctatatctctaatgcataacagagctgcgtccgcttgtagcaattaacactttttgtgactaggtgccatgtgagacagcccgctgcttccacgagtagacagcaagttgggatgcgccggaaccaggctcaattcttttgttttttctttgaccgcaaaggcttttgctctagtgctttttgggggccgggttttgaagagaaatagcgttttattgaaagtacaaacactagccgtcatctttcacaagtatgactcagcaggctgtagagaaatccatatcaatgtttctgcttttcaagggccacgtgactcggtggaacatgtatagcatcctaaaacggtttgggtgtcaatctgctgtcaggttcaccaaactgttttgaatggtgttatcgttcttttatgctaaggcagtggctcttcggtggcttggccgatatccactgttggatgtcggagctgcttttcgctctggcgattttcgttgcttcagtgtcgctgcggttgtgaaatcggcgctgctgggtcgcttggacggctagctcggcaacgataacacctcttctgcgatgttgaagctgttgtgtcgcttttgtgtttagcttggcagcgatgtcctgcgtttgggctccgtcgttgttgttagttgtgtagctagctcccttgctttttactgtgtggtgggtttcagccggtttcccgtaattaaccatgcaattgtatggttttcaggtccgattttccttataaactgagctaattctcttcttctaaatataaaagtgaaacaaagttccaccttaggtttttttaaaaaaaacagacctttccaaaattgagaacaactctctttgttgaattggaaaacacctccctcctgtaggtatttccttctcagaagttccacacataaactctcatctgaagatctaatttcatcagccattttgcaagaagggcagaattcagcatccttgtttctgttaaaccaacaccaccaaacactttaggacatggcaaatctggccatttcaccatgtgatactttatttccatcacacggcgtgtttaaaaacgagaggattcgagctacggttgtctagcctaccaaccataatgtcaggtaagaaattcatcacgtatacttttttcctaacagttattactactatgaacttatatgctttagtcttttagggttttaagggttataaataagaaccaagtgttcattagtattaggggttgctttagaagttgtgtaacttaatcaagtggcgggacatcatggggccaaaggccttctcatttcaaggatgtcttaaagtagcactacgaaaaaaaatcgagttatcttaaaaacacaaaaatactgattgaatatcattgttccatgataaagattgttaaaaaatgtcatccttttcttatcacctggttcagcaaatttagtaaaaaagttgcctatattacatgtgagaccctttgtagtttgcagatacttagtttagtgcctaacactgaagacgcgtcaacattaaattgcaaaaaagaactaaacccatgttatatggttccatcactgaaaatggaatacctaagatagcaagggtgcatgtgttaaaaaagagggacaccatactaatccactgcaagaaaaaaaggtttattatattcatagattgaataacaaaaatatcgaacttatatgatatgacgaaacgattaatgaaaacaattacaagacatatataacagaatagcttcacctttttcagccaaacaaggaaaaagggagatcattttagccaatgcctaagcaatgaaaaaaaagaaccacgctaaaccaataagcaaaataaacaaatttccgcttgcatgttgcattgtgttgcaatcaacacttaggcatggacacttgtgttgcacaatatatgctatcattttccatgaactatggtcattagcacttgggcatgtttggaggacgaggcagcatctgagcctgtggcgtcttgccatccttcacgatgaacacagtattcattccccacaccatgtgtcgatcaaaatggcaatgcatgaaccacacacctgaacaatcaaaataaacatgaaaaaaaattttaatttaaaaaaagaaaactggacatgaactctttgatacaagcataataatagcataattcacagaaaccaaaagaggaatcatcagaaaaaaagttacctggattgtctgcgcggaagcggattgcggcccagccggccttgggcacggagactgtgctctggtacggcgggtcgagcaggttgtaggtggccgggtccctgcggtcgtcgaacttaccggaccctagtcccacgacgtagaaggcgaagccgtggaggtgcattgggtggctctcgaaggacgtgtcctggaacaccacctccaccacggtgccgtactccagcaccttcaccttggcgccgtgcttcgtcaccccgggcctgtcgttgtcgccggtgaggttgacgaagacgggcgccgggttgttagggaagtcgtcctcgtacacgccgcggccgctgccgtagtagtacgcgtgaaggacgtcgatggccgggctgacgaagctgacgttgttgaggctcgccgcgaaacgcgtagtgttgcccttgggtcccttgcacgccgtgtcggttgcgttggtggcgttgcaggggagaaagttgatggcgaggtcgatgagcatgtgctcgtcgacgtgcgtcggtacgtggaccgggtggtccttgctgccaagggacctgagctgcctgaggaatgccatcgccgcgtccacgtcgtcgagagacggcaggacggcggggaagtccggtggcccggcaccgctgtcgccggtgtagtactccacgacggccgtggcggtgctgttgttgaaggggatggggacgggtaacgtgataaacgtcctcgcggccatgtagtacctgctgttggacttggaccccaagctgcggttggcctccaggagaaggtccatggtctggcccggcgcgatcatgatgtattcgacggtgagcggcttggtgtagcgggcgtcgatgccgacaacggtgaggcggtgcccggagacggcgaagaacatgtcgttggtgagccccgcgttgatgacctggagcaggtacgtgttgccgtgctccacggcaaccttgaaggtgtcgtccctggagcaggggaacatgtccccgggctggccgttgattgtgttcgcgtcagacggcttgacgtcttccccaatgcgcttcatctcctcgagcaggtggttcacatcgtttttccaccactcacctgcaaaacccatagaaataattagttcagatcaaacggttatacgatcgatatatacatgcatcaaacaagctaattaagattccgttaattaatggtcgtcgcgaatgcgtacgtaccgaggatgatgggtatctctttgtctggcctcttgaaggggaaggtgtcgccgtgcttggggtggacgacgatggcgccgaggacggtggcgcggtcgaagtcgctgtgcgcgtgccaccacagcgtgccctcctcctcggacatgatcacctggtaggtgaacttgccgtccggccggatcgggcattgcgtgatgaactccggcccgtccgaccatgggttccgcggctggtccacgccgtgcctgcgctacgtacggttaattgttagtcatcgatcgcgaacattgcattgtaagtttcgacatatggatcgatcatggcgtttcgctgtagcaactggcaagtggcaacaacgaagaacatgatttaccagtggatggtgatgtttttgttgccgtggttgtagacgttgacgatgacgagatcgcccttgcgcgcgtagatggtcggcccggggaactgcccgttcacggtgaggacgctcttctcgtggcagagcctcctgtagttggtctccgtaatctgcagagcatcatacatggttaaaggtcatttcgtgcattattcatgccctatccgatccatcagaccatcacactactgtcactgtggatcagtgaagtagtacatcacttacaaagaaatcgtagtggcggcgagtcctgccgccgtgagccgggctaattgcaactgcaaatgttaacaccgcacatgctaataaccagagcactgcaggtattttggcaatacccatcgccggacgcacgatattcgaaccaattttagtgtaagaaaacagggctaactgagaaaattgtacgtgagtatgtatggttttctgtgtaagcacatcgtctgtaattactcaacagtggctagctaagcagctgctttgcctgagaggatgagatggccatctgatcaaacagaatgaatgtatttataggaaatggcagcgcgtgcctgtaatcaacgtcagactatttcattcaaatgattagccagcttggaaaataaaaaaattcttccacgtttcacgcatgtattcttctacagcagtggcacgactactaacgaaaagttttttctcaaactggcgttagttggttgtctgcgcgctcgtgtcgtatatatgcatgcgtatatgctactgtcacgccgcggccactgacgacatcttcagaagtttcctgccactagtgcttttacggtacccactactgttagtggtagcagtgtagtacaactttaatccaaccgttgaatctattaacttaactagcatggtggtccatacaaattacgcgactagcattattatattttctctcatataatagcatatatgttttcttaatgtattattcaaatatattaaaatgacaacataattttaaatttcatactaattttacgaaactactaatgtgtaatatttatattgtattttatatacgtgttagttattaattatttttaatatcaaatttaagttatttgtaaattatattcttatatggactatagactcgtctttgaatatttctttttttaatttcgtattttcgttatctgggtatttctatataaactctaggctcttcttccaatattatttatttttaattctgaatttttattatttctattttctatgtggactctaacactagtacataaagtataaagtgttatataaagtgttataggtgccggttcggaaagcctaataggtgccggtttcggtgctggcaccaattagtcggcactaatgattttacattggtgctggttcccaaaccggcacctgtttggcacctatgtgttttataggtgccggtttcgatgaaaaaccgatacctataatggtccaagggctgcgctcgcacgcctataggtgacgattctatgtttatagccggcacctattataccacataggtgcctgttaatggcaataaccggcacccataatcatgtaacccaaaaaaaaatatagccggttctcagtatgtccattcacatcaatccaccgtacacacaaaaacccacttcaattcacagaatatatgtaatccatctccaaacatcaattcacagattcacatcaccccaaatccaaaaatttccaaacatacacacataaatgcaatccatctccacacattcaagttatcatacatcaattccatctccaaatgtttacatcaattccatactttcaaacaaaggcaatacaaagttaacttgagagaaattaagttgaaataataaagcaaggcatcaccttgttaatcttgtttccatgtccaacactgggtgcacaagttttctcccttccagaatcatgattcttggaatttatatgactgaatgagagagagagagtgagagaaatataaatttgctaaaaacagaattgatgataagtcatgctaaaataactgacataaattgcatctggtattgaagggaaacttcaaatggtataaatttgctgatgaaccttaccatttaaaaatgttccttttgttatctaattggaataatgacccctataaggttttaagggtgattttcagtttaaagcagttttgagcaaaggttcagcacttgagtttgacaagtacaaaatgagtttgacaagtatattgtgcatagggcctatgggcataacgaaatttcagatttcagattgcatcaacagataaaaatcagattgcatcaaaacttataggcctcatttctgcatgtaaatttctgcacaatgaactcacagcactagcggaggcaaactagcggaggcagtgaagtgttcttgttttacccagttcataatagctctagtttcaggttgtctgtagttaattccatcattgatggggaaaaactgccagcattaacaatttaattgaatggctcaagtaggtaaagaacaaaaggaaatattccataagaagaaaataatgcatcactgacttggtcaggaaaatctccgttgaggtcaacattgtttgcattaccacgtcttctaagagcaaatccatcagggttcatcgttggaagtatatgaagatgcatgttttccataataagagttgcctacagatattagttgaactggtaagtttttgagcttatcatatatttctatcgatttcagtaaaaccaatggaaatatatatcataaaaccatagttgagccagacaaacataaaatttaagagcagataacaatggcctaataatttttatacacaaaagcctaataattgtgttgtataacaccgagtggttgtacggtatatacacatcacatattcacacaaaattgagcttaagttcatagcttcatagaattgataacacaaaaaagccttcaaatcaatggcatcccccttttcttcttcattttcagaactgaaaatttaatagccgactgtactactattttcagaaatcaagtcattgcactggtgcacaagctcctaaaatcctggtacatacacactaagcgtctaaaccattgcacaagcactgaagcacaacttcctactttcctaaatggttaaatcctaagtgtgaaactatgaataactcaataatgctagaataaaaaatttaagtaaaattcacttacttttgcttgagatgtttgagaagccagagcaggcaaccagcagcaacggagctcgctcaatcccagtcatcctcgctggccgtccccctaccctgtcgccgccaactaaactgtatactagataaatcagtgagtttcagttcccaaatcccaatcagtgaattttagtactcaaatcttcaatactcaaactcaatactcaggctactcacctgtgtggctgtgacgatgtgttcaggggcgatgtgcggctccggccgtgccgctgtggccctggtcggcggctcggcgctcgctaccctgcgcccctgcccgcgccggtgcgccctcgcccctgggccctagcggctggcgccaagccgtggcacgccacccgccacccgctgcctgcccacctcgctggcgccaagccgtggcacaccgggcggccggatctggcagaggggaggtcgcggccgccgccgcctccgcctccgccgtggccaaccccgtggccgccgctgcgaggcctccgccggccagccatgggagcccgtggtcggcggctgccgccgtggtcgctgctgccgcctccgccgcgggatcccgccgcctcccctcccgccggatctggcggaggggagggcgcggtcgccgctgccgcctccgccgcgggagcccaccgcctcccctcccgccggatctggcggaggggagggcgcggccgctgctgccgcctccgctggccagccgccgaccgcgagacggcgggagaggggagggagagagaggacagcgagagagagagagagagcagagttagagagacgcgagagatcgagaaggggagggatagataaggacgcgatgggtgccgtgcgtgggctcggctcgaatcggctcggccaaacgctataggtgccggtttttaaaaacaaccggcccctataaaaattattaggtgccggttcttttaaaaaaccagcatctatattataggtgccggttcaaatgttcttaaaggtgccggttctacattttttcaccgcaaggaggtaggaaaagctctataggtgccggttttaaatgaaccggcacctatgaaccggtctctatgagagttttttagtagtgtaaactcatctttcaatattttttaatttttaattttgaatttcagttacttctaaattgtattcctatattgactttagactcttcttcccatttttttaattttgaattttagttatttgtaaattgtatttttatacgaactctgaactctagttttaattttattatgtttatttcgaattttacttagttttaaattcctatatggactctatactctacttctaacattccttatttttaattctgaatttctactatttcttaattgtatttctatatggactctatactctacttctaatattccttatttttaatttcgaatttctattatttcttaattgtatttctatttggactctagtctcctctttcaatatttcttatttttaattccgaatttcagctatttttaaattgaatttctatatggatctgtttttctttttcttcaattaatatgagaatttctagtaacataatataaatccttctttgattcaaatatttatgccttatagacaatcctccgaagaaacagtaccaaaagtgatggaagtagataagagtacacaaggaacaagggaggaacaaagaaatgcggcatcgtaacccaggaagtcaggtaatggcaacatcaaactttcctacaactttcctacgtaaattttatcttaatatactctgctattggcaattatatatatatccttaaaaaattttcataaattgcaggaatttgtgtttacatcaatagttacgattgatcgagtacaagaaaatattcaatggtggtacatgtcgtgcaatctttgtaataaaatagttattcagaaaaacgacaaataccattgcaggaactgcaataaatatccagaaaatacaacgcctaggtaagaatacttcatcttttgtaaataacaatacttatgtaataattttttttgcattaaccataatttcatattaggtaccgactacgactccaaataagtgatcatacgacatctacaagctgcactatatttgatgatgtggcacaaagcatgctagagacacctgtctcatcattactcaatttactagatggcaaaaacgacgaaattcctaacattattcaacaactctgtggaaaacaactcatcttcaagttcaagctcagtgaacaaaatctgactgaaggcacaccaaactatgttgtcaaaaagacatttgtgcctgattatatgcttgagaagcaatacctcattaataaggctgaagaggtaaagcaggctactactgattttttacaacacaaaatcttgaaaattttatttctgaaatgtttccgcattatgattttacaggagttaatggacgacgatgtggataacatactaaaacaagatagagagacaaatcaacaggtatttgaacatataatacaaattttcatttatttataatatatagcacatatgacaaatacttcattgcctttgcaggaacaaaccagcagcggccctcttattaaaaacagatccatctcactgctacccgtgaagcaagagctagaggatagtgaccaggaaatcacgagtgaagatgaactcacttcgtctgacaaacctcccagttgcaaacaaataagacggaggtcatacataatagaagacgattcagaagaggagagcaatgaaacaagtatgataaaatgcgtagatgcaaaagttcgaggcaaaaatgcaaaaggcgctcatgcaaaatccacaaaggcggaaatcagaaatgacacctacagccatgaaataaacaaatcagttgttgaagaatccatcaaggcaggaaaaagataggctaaaaccatcaatggcataggcaaggaaagctctgttgaaaaacgtcagaaaacatgtgttcaatcagacaataaagcatgcaacacaaggcctcagagaacaaggaaaatgaattctaagtatacaaatagtgcttagagctcatgataatagttcataattagcagtagctcgatagaatatcctacagttaatgatactagctagaaagaatagttcatagtcaatacagatcattacatgtactgtattataatagtcgaatgttgtatatgcataaactgagatatattactatgcaatctgttattttatttatgattttttatcacatctctgtatatacagacctaattttgcaaccgattgcacatgaagcatccaaacatataattcatgcaaaggaattgaaaagaaaaacagcgtcaaccaacctttgcctgcccgccgattcccccaggctcgccaccctggccgatccgtgacccaaccactgcaccgcctccaccttacattttgctggatgccgaaatgagacccaaaatagcagattttgttatgaccaaaatttttggtgaaaaccagcaaaaggcgaatactaaaaaatccgaggacatgcagtacaagagaagaataatcttaaactttccaacgctgcggttaacagattcacagaagaaagcatatgccttgatcgaaatagagaaactaatgagacaagcaggaaaatcgctaagggactacccagacatagagctaccaaatgctgccgagatagaggaacttggtaacagacttataaacgaagagcttaactatgacaaagaccaactgaaggatgagcacctcgccatattaaacagccttaacacagatcagaaaaaagccttcgatgcgataatggaatctatcaacggagggcaaggaaagcaaatatttgtggaaggctatggcgggacagggaaaacatacctatggaaagcactcacgacaaaactaagatccgaggggaagatagtccttgcagttgcttcatgtggtattgcagcacttctactccaaggtgggagaacggcacactcaagatttcgcattccaataaagatcacggaagagtcaacatgcgaaataaagcaaggaacccatttggccgaactactaaaaaggacatcactgatactatgggatgaggctccgatggcaaacaagcattgctttgaagcattggacaaaagcctaagagatataatgaggttcactaatgaaaacagcagtgaaaggccatttggcggcatgacagttgtattgggcggggactttagacagatccttccggtgattccaaagggaaggagagagaatatagtgaatgcatcaatcaaacgctcatacctctggaatcactttgaaattatcaaactaacagaaaacatgcgactaagctgcatgtccaatgaaccgctagagaagcaaaaggtcgctgaattcgctaagtggattctacatatcggtgacggagcatcagcatcagatgaaggagaggaatgggtaaaaatcccaagtgatatcctactacaaaaaggacaagacccaaaagaaacaatcgtcaaaagcatttatccaaacttgctggacaactaccgtgaaagagaatttctagaggaaagagctatcctatgcccaagaaacgaaacagtccaggaaattaatgagtacataatgaaccaaatacaacgagaagaaatgacatacctaagctgtgacaccgtttgcaaagcgatgacaaacaacagtagcatggagcacatgtatcctaccgagttcctcaacacgttgaaattccctggaataccaaaccacgaacttaagcttaaagtaggcctgcctgtcatgctacttcgtaacatcaaccaaactgcaggcctatgcaacggcacgagaatgacaatcacacagttaggtaagaaatacatcgaagcacagatcataacaggtacacatgtggacgacaaggtatacatacaatcatcatgtcaccgagcgacaccaactggccatttgtcctgaaaagaagacaacatcctctattagtttgcttcgcaatgaccataaataaaagccaaggccagtccctgaacaaggttggtttatatctacctaaacaagtcttctgccatgggggcctgtttggggagctttagattccgagaagcagctgtttggtagccagcttttgagaatctggaaaagctctgaaacccagcttctggcttcttagttcatttttcagaatctataactgcagattctcagaagctgtggactgtttgaggcagcttctagcagaagcagcttttgggaaaagctgcagctgggagaagctcccccaaacagggcggtagcattctctagagtcacaaaccgaaatggcctgaaggttctgattgatgattcagattgtcccgaagaaaatgtcgctagaaacattgtatacaaggagattttctaattgacttaatatttttaaggtttactgcaagcagaaacggtgagctcgaaagacagtctatgtaaaaagtcctctgacatatacccacagtatttaaaatcctctaattgtaccagtgttattcaagtttatagatgcacaaatgttattcaataagacccatttgataagaaagtcctctcaaacgtatatcgagcttaagatagggtgctggtaggttcacattatctaatatcaatttatttaaggaaatgttctatttgtcttgatactgttctgaaatagtatatttttaatatccatatatatctactaatctaataaaaattcatctcagtcaaccaataaaaatatttgaagcataaaaaatcaattagcaaaaatctcaaatagccatatatcttcaaatgtttcccccagcaaagattgagaagataaacttcttgatgtaaaatatttttgatggagtgcgtcaaagagcagtacacttttccttcaataaaagagacaaatgaatcaatcctaatgatatccccaacggaagactgccagcttcacactgctaatcaaatcaaacagccaacaagcaagaagagaactttatattttgcataagagacaaaaacgaatgatatgcatgaatattcctatttacctgaaaccatgagccactgctccaatcatggacagcaaacgagatgcttcgtcaaaggacccttgctgtgccgaaggtcctccgataccgacgacggttcgtcgcacatcaatatccccagtgccgcacacctccgatccatgagcaaacggatctgaccccagggagcccttcaaggtttccccacaataagctggaagggaagtacaccgaggcgactcaggtgaccggcggcgacgcaggaaggagagagggaaaaggaaaatttcaggaagcaagcaagtggggaaaagatgagataagagagtgaggggaaaaattcaggaagaaggaagtggggaaaagaagatgggagctgctttaaaccattcaattctgcgatgctctactaataataaatacgaatataacaaaaaaatctcaaattagaaaaagcacaccacttcggacaccacacaacacaagtgcacacatgtcagggtactgacatgtgaaattagttgagattaataatttaattctatacagcatttatatatagatggagttaagatatctgtaacactgtttttaacgacattgccttatctcacacgtggataattgataatataaaaaaaatacatgtacaaatatattttttaaaaaaactacatgtgcaattggtttttttaatccacatttaatgctgcatgcatgttgacggagcgtggggctcctcaccgggagaccgcgctggcccccctttgccggttcggccggggaccctgggtgaaactctaagctcccaatctgtatgtggaaggttcgcgagacaggaagcacagaagacaccggcgatgtatacaggttcgggccgctgagaagcgtaataccctactcctgtgttttgggagatctgtgtatgaaagagctacaaagtatgagccagcctctcctttgttctcggttcctaatctggaaaggtccagtctaagaaaaagctccccaaaatctatctccctcctcagtgggcaaggtcctccttttatatcttaaggggataccgcatgcaccattctccccctctccctggggacttactctaccttttcataaatggacggagatttgcatggttgccgtccgagtcaccttctgatgggacggcccacaac

SEQ ID NO: 63168 - DNA, 11790 bp, Oryza sativa
gggggggactaagaggagggcgaacacatcaccctcgggcccgacgtcccccgaaggtgccaggccacgtggacgattgtgtctgcctcaaacctctagtcatgatactcccgatcccatgtcaccgacagtagcccccggcgttatgccagggcgattgccctccttaagggaagcggtcgggcgtgacgccactcctaaggcctggtgacaggtgggaccggtctccacaattgggcagaaacccaacggtcaaaaatcacgcacatcggcaatggtaactcggctgtcaataatgagcggtctcttcaagactgccacattactcgagtagcacacgaatctggacatggcgattcgtttcatctggagatatggtaatgtcgcttcggttggcgagcgtaattaacgcgcgcacgatatgatctacctcgactgccacaaccgcatatccacctcatgcgccgcaagcgggtgaatgggattagtgcaagcgtgggcgcgagaaacgagggggcgaaatagtgggcgcgagaagcgaggagccgggcacagcgttggcaagggtataaaggcactgaggaagggatttgtttccttcccttcgccattattccccttgtcttcgccgcttgtgccctaactccttctttcctgcgccctaccttcgccactcgcgctcgctcttaatcttctcttccttccggcgccatggcacggggctccgctctgctcgatggtagcgtgctgccgccctcccgcatcgtgagcgagaggcaggctgggctgccgcgccgcttcatgccggaatctgccaccggccgggagatagttacgctgggcgagggacgcccggcgccagactacccggggcggtccgtcttctttctcccctttgcaatggcagggctggttctgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggcggctgctacttccagccacgggggccggcgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacagggaccatggtgtatggcgactacctccgccgtcggattgcgccgctccagcggcgcgctcggggcgcctgggagtacaccgggtccgaagacttcatgaggacccaccagggagtgagatgggactgggctcctgaggacttcaagatattggtccaacgggtgctgaatctcaactccgtggaggcggccctcattccccaaggaatcctccccctctgcagcgatccagaccgcgcctccatcttgaccattatgatggcggtcggggcctcagaggagcgagctccaaagggccacgacggcgcaggcgggagccgccggggggaacaatctaccccgagagggggtcgtgcttctgggtcccgtggcaggggcccggggagcagccgccctaccgacgcccgggggaagaggaagcagggaggaacacctcccccatctcctccccgagggggcggggcggcgcgtgccagcagcaagcgcccagagggggccgcgccagcatcgcagcccgagggggagcgcaagaagaagcggccccgcaagatggaggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggtcttttcttttgtttcagcgagatcccgtcgcgtccctcccgccattccaagtccggccagtctgaggccgaggatccggcggccgcagaggcccgtaggcgggaagctgaccggcgcgaggccgcggatcgcctacgggaagccgaggaggccgcccaagaggccgcccgggctcgccaggccaaggaaatcgctcgggagggagccgcccgggcccgccaggccgaggaaactgctcgggaggaggccgcccgagcccaccaggccgaggaagctgctcgggaggaagccggatttcgccaggacgagacgatggcgacttccgaggcagcccgcgacgaggccgcgggcgcgtcgctcgggcccactccctcgggcgacgctcaggcgacaactcccggggcagctggcgacgaggctgcgggcgcgtcgcttgggcccactccctcgggcgacgctcaggaccaaacgggtccgggagacatccccgagtccggcacttccatcggcgggccgagccgcgtggcatcttctccgaggcggcttttccccacgccttctgctgccctactgagcgcagagccccttctgcaagccttggccgccgcaaacaccacggtgttggacgggttaagtgcccaggtggaggccctgcaggcagagcgggcggagctcgacgccgcgtgggcgcgtgtcgaagaggggcgacgctcggtggaggccatggtggaggtgggccgtaaggctcaccgccggcatgtctcggagcttgaaacccgcaagaaggtgctggcggagatcgccaaggaagtggaggaggagcggggggctgccctcatcgccaccaccgtgatgaatgaggcgcaggacaccctccgccttcaatacgggagctgggaggcggagctaaggaagaagctcgacgccgcccagggggtgcttgacgctgccgctgcccgagaacagcgggcggcggagaccgaagcgacgtcccggcggcgcgaagaggcccttgaggggcgtgccatggcgctggaagagcgcgcctgcgtcgtggagagggatctggcggaccgcgaggccgccgttaccatccgggaagcaacgctggcggcgcacgaggctgcctgcgccgaagaagagctcgcgctccgcctccgcgaggacgcgctcaccgagcgggagcgagctctcgagggagccgaggccgcggcgcaacagctggcggacagcctgtccctccgcgaggcagcgcaggaggagcaggcgcgccgcaatctggaaggtgcccgcgccgagagggccgcactgaaccaacgggccgctgagctcgaggcgcgggcgaaggagctggacgcgagggcgcgcagcggcggggcggccgcgggcgaaagcgacttagccgcccgcctcgcagatgccgaacacaccatcgccgttctgcagggcgcgctggactcgtccgccggggaggtcgaagccctccgcttggcaggcgaggtcgggcccggcatgctttgggacgccgtctcccgcctagatcgcgccggtcggcaagtgggcctctggagagggcggaccgtaaagtacgccgacaaccagggaggcctcgcccagcacctctcgaagatggccggggctctccaacggctccccgaggagctcgagaagacaattaagtcatcctcgagggacctcgcccaaggagcggtggagctcgtcctggcgagttaccaggctagggaccccaacttctctccatggatggcgctggatgagttccctcctgggactgaggaccgcgtgcgcgcgcaagtccgggacgccgccgactatatcgtcgacagcttcgagggctcggcccctcggcttgcgtttgcccccaactccgacgatgagggcaatgccggtggtgtagacgacagtgacgtcgaggccggcgatccgggcgcatcgggatgagcccccagacccccgccattcttcagttttttcttcttttctttctaaggcctttgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggctcgtgcccaggttctggtcctcgaaaggcgcaggtcggggctagtgcctggggagatccacatgtcgagactggccaggccgggaacgtggtgaccgagggttaggggtgacccgattgtgggtttttgccgattcccccccggagttcaccacgccccggggcacggctcggttctgggcctcgtttggcgattttagccgacccgagcccccgagggcaggattgagcgcgagtgacctatttcaagtcaagattcttcaaaaggaaaaaacagcacagatacaacctttaggaaattgaaattgcttttattgaaattctgaaataagagaaataagaaagtgcatgtgtggcagcccccggccaaccctgcacgcccgagggggtgcggggttgacccgagcccgaaacctgacacccgacccccccctcaggggtagaagcgacgaaggtgttcgatgttccacgggttaggcagctcagtgccgtcgcccgtggccagctgtatggagcccggccgggggacgccgaccactcgatacggaccctcccacattggtgagagcttgctcaatccagctcgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggagacttcagggtgagctcagatgggagaaccgcttccgcgccgtagacgaggaagaaaggtgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgctttcggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttaacgaccggataagcctcgggccacttagtgaacttgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcggcggaccaggtcgaccgcatcattgagagctgtcggccaatagaaaccttggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgacggacgcgttcactcccttcgcggtactcgggtagagtcttatctgtgaggtatgcttggatctcggcgatccaagcaatcaatctaagggagctgggagcactcccctcgggtcccgaggcctggactccgacgggcctcgggggccggtcaggcgcatccgtctcccctaaggggtcgggtcgcgccgacggctgggcaagcctttcttcaaaggcgcccggtggggtctgggctcgcgaggacgcgagccgtgagagctcgtcggccatcatgttatcccgtctgggaacgtgccgaagctcaatcccgtcaaaatggcgctccatacgccgtacttggcgcacgtaggcgtccatctgcgggtcagagcaccggtactccttgcagacttggttaacgaccagctgggagtcgcctaacaccaggaggcggcggatccccagtccagctgccactctgagtccggcaaggagtccctcgtactctgccatattattggtcgctcgaaagtcgaggcggaccaagtatttgaggacgtctccactcggagaggtcaacgtgacccccgcaccggcgccctgaagagacagggagccgtcgaactgcatcacccaatgggcggtgtgaggcagctgcgagggacccgagccggcttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttgaccgagggggtaagacgtaaccacagtgacccgatgcgcctggaaataatggcgcagtttcctcgaggccatcagaacagcgtaaagcattttctgggcctgagggtatcgggtcttggcatcccggagggcctcactaacaaagtagacgggccgctgcacctttcggtggggccgatcctcttcgctaggggccgcatccctggggcgctcttcacccgagcggcctcgcggggcgcactcgtctcctgtgccgacgacctcggggtcggaggacgacaggggtggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgaatcggcacagggttagcctcggggtcagagggcgataggtgcaaccttcccgcagtggcctcggggccttcctgggggtcgggggctcctagcaccgtttgacaagcgggcagagggccaactccggtcgtcgggggccttgggccgccgttcggctcgggggcctctcctccctgctctctcccgggccaagtctgcacaaggtgggggtgcgcggaatgaggattgtcctcatcgcgctccacgaccaacgccgcactaaccacttgcggggtcgccgctaagtagagtagcaagggttcatttggctccggggcgaccagaactgggggagagctaagatacgccttcaactgagtgagggcacgttcagcttcctccgtccaagtaaacggcccggagcgtttgaggagcttaaataggggtagcgccttctcccccagcctcgatatgaaccgacttagggcggccatgcaaccggtgacgcattgcacatccctaagcttgctgggggggcgcatccgctctatagctcgtatcttctcggggttggcctcaatgcctcgggcagagaccaagaacccgagaagcttgcccgcaggtacaccaaacacacacttatcggggttcagttttatgcgggcggagcggaggctctcaaaagtttccgctagatctgaaagtaacgtttcctggttgcgcgtctttacaactaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatctgatggtaaccagagtatgcatctagaaaacacaaaaggtcggaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttgcgcccggccgtacggcaagacggtgctcaatcacctccctggggaccccgggcatatccgccggtctccatgcgaagacgtcagcgtttgcccgcaggaaagagacgagcgcgtcttcctatttgccatccaggagaccaccgatccgtgtggtcttggacgggccgtcgcccagggcaacctccttgaccgggacctcatcgcacgtgactatccgctgcctcggggtggcgggggcggatgtgccaagcctctcgtcgccaccctcgggcttggacacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcgggtccaccgaaggtgaccggaaggtcgatatgacctagcggccaagtgtgccccggcgtcacaccgatgatcggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaggtgagggcaacctccgaccaccgcgcccggcgcgtcgcctcatgagtaggggccgcggccagaagctctcgcttcatagccttgaggctccggcgagaaacgtgagcacacgctcctccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcttcctcccacttcctcgtccgctcagccaaacttttgactgcacggcagtccgcgaggtcgtgaagggaagtgttgtggacggtgcaccacttgccggctggacgctccctgctgggagcgccggcctttttctttttgtcgctcgcaggcctccccttttgggtggcccgcgaagcgccctcgacggcgaggacatgaccctcgtcgtcggaatggaccgacctcttcttcctcctcctgtcacgccgccctgtctgagcggcggatccgggggcggctgaagctgccactccggaaccggaggggttccaggtccatgcctcctccttacgagccactcggtccgcgagctaaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgatcgaagtgactcatcgtcccttcgctgtactgcgtgtaagtccgcttcctcaccggggcgcggatatgtgccttggaagttcatggtgaactgttggcacaaatcctcccaagagtggacagatgcgggtggcaagttcattagccagccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaagctctacagccgacaccaccaactaggggcacggagggctggtccccacgtccgtgtcgaggtgacactctggacgaggaagcgccctccgttgcgtgggcagcacgtcggtcattacgccggtgctcgatgctggcgcgggcgtccggccccccatgcagatcttcccgggtcgaaggagtcgacgaaggagtggcggccgaatggcgaacggcagctgccgctcgccgcgcccttcgtcttgacgacgcggagccggtggtagcagcaccagaggccttggtggcggaggaccgcccaccagcatctaggcgctgccgtgcagtcatgatcaatttggccacatcgtccagccaacgttttgctggagactccgggtcatgggcgacgggcggatgacgtaggagcgcgcccgaagcttggagcgcgccctggggcgtgctgccgtcgccgtagatgaggaggcgacgctccccatctcgccgcccttttccacctcctgtggatgtcgaagtcgcggatccttcagccctctcgagcgccttctcccgcctaggactttggcgtggagggggcggtggagtacgagctcgacggcgtgggtttggctccccgtcgtcaccgctcatactcggggagaggccgtgcgcctttgctggctcagccatgaggctgaacaggaaaagcttggtgcacacgaaagagtgcaagagctcagaagatcactcgcagagtcccctacctggcgcgccagatgacggagcgtggggcatctcaccgggagaccgcgctggcccccctttgccggttcggccggggaccctgggtgaaactctaagctcccaatctgtatgtggaaggttcgcgagacaggaagcacagaagacaccggcgatgtatacaggttcgggccgctgagaagcgtaataccctactcctgtgttttgggagatctgtgtatgaaagagctacaaagtatgagccagcctctcccttgttctcggttcctaatctggaaaggtccagtctaagaaaaagctccccaaaatctatctccctcctcagtgggcaaggtcctccttttatatcttaaggggataccgcatgcaccattctccccctctccctggggacttactctaccttttcataaatggatggagatttgcatggttgccgtccgagtcaccttctgatgggacggcccacaaccacctccacttccgcctggagcagacgcgtcgtggaattgtggccgcctgctgacgacatgaccggagtcagaccagtcacgtcggtcattcttgtccaccacgtgtcagcttagcaatctatatgttcgcccttcttcagacaacattttgcttgtaatggttaggatgaagcctggcatatatctggtcaagactaacgtgccatctctgggaggtaacacgctagctccagctagggtcgagtgcctagaagccctcgtccttacgggatggggcgaggtgtgcgtcagaccgcctgccatcacctaacccgcgatctgaccggtctgtgactggtcacagaccggataaaagagtgcactacactgcgttgcatgcgtcgtgacacgctcagccaaaccacaataaatgtggttaggtgagggcgggcgggctgacgcaccccatgcac

SEQ ID NO: 63169 - DNA, 12390 bp, Oryza sativa
ttcctgcagccccactgtgctcacctaacccatacacgcggagcgaaaacccacgaggggtcggggcgccctggccctcggggccgaggggggtgcagcccgaccccctcggggggactaagaggagggcgaacacatcaccctcgggcccgacgtcccccgaaggtgccaggccacgtggacgattgtgtctgcctcaaacctctagtcatgatactcccgatcccatgtcaccgacacatgtgtccaaacatttgatgtgacggaatttttgaaagtttgaagagaactaaacactgtctgaaatagaagtcattaaatgtaaagaaaaccgtgatacatcgaataatcaaataaaggggtggctaaggaataagaggtagcgactgaaatcgcttttaaaatctataaaattgttcgatcttttgaagtcctaaaataatgagacagctatttaacaaaatataaaaaaactcatatgtaaaagaagataattttatatggacggtagccgcgcaattgcgcgggccaccctgctagttaacttaatgagtaatagaaaaataaccttcacgttcgctctcacaacataaaaattaccacgttaatccgagaaaaatcagaaaaatagaaaaaagtcaaaaggaaaaggattgttaaaacgcgtgataaacttactcatgcatgggcataagtcataacatggaaacggacaagagtcctttttgaaaaatgtggtgtccgtatagatatatagatgtggtgtccatatagaacacctgtgcatggaaggaatctttagggaaaaaaataagcaccgttgctatattcatatacaacacaaattactagcgatttagtacctatatatatgtgttggctcattgcctttttgaacagtatattacatctcataagtaggtaggcgcaagcaaatcgtaaatacaaagcacttcaaaggagaaattctcttaataatcggacaaaaagaaaaaattgagtctatttagaatataaatagctgaaattcaaaattaaaaataaggatatttgaaagaagactatagtctatacagatatacaatttaaaactaattaaaattcggaattaataaataaaaaaattaaaactagaggttagagttcatatagcactagaatttagaaattaaaaaattcaaattaaaaatataagtaatattggaagaagagtctagggtccgtatagaatataatttagaaataactaaaatatagaattaaaaataagaaatattgaaagaagggtttagaattcaatagaaatacaatttataaataatggaagtacaaaataataaaaaaagaaatattggaagaaaagtctggagtccatatagaatataatttagaaatcactaaaatatataaaaaagtaaggaatattgaaagaagagtttatagttcaatagaaatataatttatatataatggatatccaaaattgtcggagacactccggacccatcattatatatgcaagatgaagtgaatcacttcaagtcatctaacacacataatgaaacatccgacgtctcgagagaaggatattggcgacatgggtggtcctttagcctgctagtcaacttcagcctgagatgtacccgtcaaaccacacgaaagcggcgaccagatatgttacacattccgacttgacaaaaatggctaaagatatatcacatctcaaatattcttaactcatactcatgtgaatctagttcccaagatgtgcactagattcacacttttatctcaagcatagatatacatagcaaatacatgtaagatgaaagagatcagtttatagttcaatagaaatataatttatatataatggatatccaaaattgtcggagacactccggacccatcattatatatgcaagatgaagtgaatcacttcaagtcatctaacacacataatgaaacatccgacgtctagagagaaggatattggcgacatgggtggtcctttagcctgctagtcaacttcagcctgagatgtacccgtcaaaccacacgaaagcggcgaccagatatgttacacattccgacttgacaaaaatggctaaagatatatcacatctcaaatattcttaactcatactcatgtgaatctagttcccaggatgtgcactagattcacacttttatctcaagcatagatatacatagcaaatacatgtaagatgaaagagatcgaattacaaataataattagatacacggccgaccggccaaataaaaatattgaacagcgaaagcttgactacccaatcctttcgcttgactacccaatccacaggcacaccatttaggggtttaccccattaagttcacgtcctaaaagaagcagtcgatacccgcatcactcaaaattagactaagtctataacctgcaagcaaatgattatttcagtagcaagagtcagtacattatttctaataatgtactggcaagcacaagacaagcctaacaaactacatgcaaggcatataatcaaggaagaccatatgtagttaaattttagcataaagcaagttttagttacataaaacatttccaaacagatttgcttttgaataaaattcagcaagcaagtacttagcatatgggcatcaaagtaggcattaatcaagtataaatatgcacctcagtgccatccatggcagcaaggaactaattctcaaatctctacataatttgaaggtaatttcagcatttagaagaataaatgcaagtctatactcaatagatatttacatgccgctcatgaccgtgagtagaccgtgagtatggctaatcgattagtttttataactctgcaaagtttggacagctttacccacaagatgtgaatcgctctagtttgtctggtacccgtcggtaccaccacactctacacattgagtgcgatctaactctacacattgagtgcgatctagaggtcacaacgaggcttttacattaagtattgtctaaccttgcatgagcacgataagtgtgaatccatcctaggcttaagtcctagaacctttaggtggcgggcacacgccttaaatctaacgctgtggcggcgaacacatccgttcccccacgaggcacgttatcgttgtattggacagacttagacgcccatgctgtgaggtgaaacagtacactcgtcccttcacagaaatacacacagctaataatattggctagctctaaaattcaacacacacatgggtagttcctataggtagcccacggtacactcgtggcccctacctatactacaacggcctcctgaatacaaggttagacaagtgcttaacttaataggccaaggtctccccataaaaacatatatggatgtacggtaaacataatgaactgacatcgagtgaaatccttagatcggtttgggcacactctccccctatcggtacacaactaatcaccatatgtgtaccacttgaggcccaaaccttaaatccatgttttccataattttatttgttaaaaacatcaatgatcaagttctgttcagattatcataaaaccatttttcatgtttgtaatgagctcataatgacaagtatttccaatctaagcatggtaagcaatatagtgtcatggtgacatcaaaactcatatttaaagtggtatggatataatattcctatggttaggagagagggatatggctatatgtggagttatggtgataatgcaagtaataggtgtttgtctaacaagttttacaaattttaatggattagtgtacaatcgacatgcaagatttgcaaacattttcaataacctccaaaatataagttcaacttgttcaaagagagagggaggtgggacttgccttgttaccgggaaatatcagcacctaattcacttcttcaccgtttatgcaatcatctatataaagtacacgttatgcaattaaacaccaaaatatgtgaaaaatccaaaatgctctaaaatgcatggtttgtgcacagtgagtaggtgctggtctaaggtgaatttaggtgaatttcactttatctcactccatttgagagttatgaattttagaagtttgcttcgatatagtgtagtatttacttaggtactgctatgaaatgcttttgtaaggtgatttttttattaagtttgagtttgctgaggtgacgatatgtgtcttctaagattaacacaattggtttcacaatttttagagttaatatgaatttctaatgtattttggaagttataacgtgttgtatgtttatagtccctatatatgcttgatctatatgtttcatatccagaacatgttaatttatgatttggctaagtaaagtgaatgattttattatttaacctacctttaattcacaagatttagggcttacattatatttgtttcatatatgctaactagatgtgacttatgttagtaacttgatatatatatatatatatcaactatggattaactatatgagttaagtgtgttaagttttgatgaaaggaagtggaactttatcttttctggtccatttagctttatttgttttatttgaagtttgtatgcattatacatatagatttgacttaatcattagtatgtgattactatctactttactaattcaaggtttagagaagttttaagtacagagggtgccacattttattttatattagggaagggcacatttgatggttctatagaagtttggttcactccatttggactaaagatgaaatttctacaaattttacaatttgaactgtacactaggttcatatttccttatataaatatttaggggctattcatgtactgtaagtgtgtatttttattttataactttaaagtgcattatttggtgattctacagaacttgagtttactaaaaaatgagttaaaataaatgttatatgaatttccaaagttcagcttgtctaaaactagttatttagtagataatacttttagaggcttttaatgcaaagtaagtatgtctttttattttacttttgcatagagaatatgttggtgattctgtagaatttgattttaccgcaaaatgagttaaattggattttatatgcattttataatttcttacttgttttatgtttcctttttcttagataatatttagtggtagatcttgtactataagtgccactttttatgttataacatgaaagttcatcattttgtgaatccatagaaattgattttaaggagttaagatgaatttgttatgcatttttgaagtttatagtagttttcaacaattcagcacatgtttaattcagttttcgttaagagtacttcatattcttatataattacgagtaggtcctgctacagtgttgtgtgtattgtatctttgcattacagaccctataatttgttcaattttcaaagtgaagtcctgattccttctctatcgatccagcagtagagccgccatgagcggcacctctgctcgccggcgccggcgacaaacggtgacttggttgggggtgcgaccaaaagacaaaatgaagagaatgttactgcgattccattcctctacttttctcggtcgttggtgaccggagttgcgctagcggcgagtccgagcggaaggtatctttgggtgacggtgcatgtgtgtctacggccatgtactcgctaaatgcgtgcatgcatgtgagtgctagaggttcaagggttctcaccgaggggcctgacaatgctagcaaagcttggacggcagcagcagctcgcgggacggcttggaggcgatggagagcttggcgtcacggcgatggctcgatccacagcatgcatgccaaaatcatttcatgcaacatgtgaaacaccatcccaggttgctactactgcaagcaatcgaccaatggctcaccggtaaaggcggagtcggccatggcaacggcggtgggcgccgaggaagaaggggtttgatctccctctccggtgcaccattatccggggttcttgagggtaaatggagaggaggtcgtggtgatgaagatggcgcggtggctcggcttggcttggtccagagtggttggaacgacggcgatgtcgtgcggcggcgctccgtgcgtgctccagagcttccaggggcgacgccgcgtttccgctgatacaagggatgaaacaagatggaatcaaaagagggaatgttcggcatgggaagtagattagggaacgaaaaaggaattgagacgaccgtggcttgttgacgaacgcgtccatcatcttattcgcggctggtaagggagatgagggagaaagggaaggtggagctcgctccctctcggtgttcacggcattggagtgaagaggaaagctgggcgatgctgctgaggaaggtgtaggtgaggatcggcgttgtcacacaagggagcacgcgtcgagcatgcaggcgcagctctctttctctctctcgttctctctcggctgctgagcggtggaaagggagcgacagaggtgaaactggctccagaggctgccaagtgggccctggttgatggaaccaagacaagggagagagagatgggtatgaaactaagtggagatgagttttggacgaatttcagaatttttctctcctccccaatttgtttattcatagtttaatgtgtggagtagataaattagagtggatttttctggaggtagatgtatgtacctagtttctattttctttggttgcacacaaaaattatgtgtagtttgctcacagaaaaatagagaaaagaggctatgtagaaactagtttgaatttttaggaggtctaaacagaggataaaaattctggaaaaaaatatatttattcattttaaataatctagcattttaataacttattttacctatatacttctatgcagtttggtgcatattttgatgggttaggattttagctgattaaggtttataattagcctattagttgactgcattgactgatttatttgaggtatcaaatttagttattaagttgtaccaaaattatagtgagttggatatattgattagcacttgcaagaatttttccatgattttatcttgcatgatctattcttgataatttgcaaagcttatcttcataggtatgtttacactttataaatgcatctaaattattataaggattaattatgtttggtcttctcctaacctgaggtgatgttatttgtcttcattttcatgcccctataattattacacatgaatgtctttaggtttgcttagttaagttatcttgtattcatgttcatgaacctaacatgaaatgaaaaccaaaatccaaattacataaaaaaaactcaagtcaaactaacgcacttatgtatatgcatgcacacatttatgtttgcactcttgtcttaggttataattgaaaaggttttaatttgttctcaatttttattcatgcaagagttcgatcaacttcatctaggtttaaaataaaaatttttggttcacaaaattaaagaactttcctttcaactagttttgaaaaaaattgcttagccctagaattcgggtatgttacaaaaataaaaaacgaacattagaataagaatgtagagtaaaaacagtaatttagaactaaatgaaattcggaataaaaattaaaatttaaaagtatagaaatataatttaaaataactaaaattaaaaattaaatataaggaattggaagagaggcggtccatgtaaaaatacaatttagaaatgactaaaactaagaattaaaaaaaatattgaacggtcaaacatgcgctaaaaagtcaacggtgtcaaataaaacgacacggagggagtacaatttagtaataactaaaattcaaaattaaaaacaactaataactatcacgtgtatacaatactatattacacattagtttgtttggtcatattagtacaaaatttaaaattatatatttatattttaacaataatatatatatatatatatatatatatatatatatatatacaccagctctagcctagggcagtgactaggggtctagtcaccagatatgaggataggtatgcagtatctatatgcaatcttggatgtgagattagtatgtgacaattggatggcaatccaggttgttaatttttttttatattattatgcaaacataaatgcagtacaggaaataaagacaagctgtaaatacgaattatatacaagatatagaattagatattcagaacatagtaggtttatatagaacggttcaggtgttcattcatataccttgataggttgaaggtagatccttctgaagattacaccaaggacttggtacaacacgttcgtaattatacaggtacaggactctcacaaggactcttacatagactctcacacttagactctcatgagtcttttatttaggttatactatagtactaacacttagatggagtggagtggagtgtgatggctggtggagaggtgagaggaatggttgagtgagatgtgttgtgtgtgaaatgcgatgcctgtggaatgtgatgatgagccccttatatagcgctcggtagagaatctttatgatatctcttcttgacctcaaagagtttatgatacccctttagactttatggagagaatctttggtgatgacgctttagacctttaataaagatgtcataatatcgccttttgactatggactcatcttatctggaatagtgtagattccttatcttgaatagtgatctttgtcggggatgacaagatctttattcattatcttcgttgattattatgggtgctgattgcaccgtgtcgatctctgacggctctgttttctgaaaccactgagccaggcttctgtagtaacttttcttggagcattcattttcaaaatctggtttaattatgcgccctgctcccttgaagtattcataactttggttgtaatatttgctaataaaaatccttgtgatcttgttttggaaaaccggctgatattcataatctgtggtgatagcttcttcaatttctgcagcttcagaaaataatctccaattttcatgattagcaattgttgtatatatttcttcctcttcatccgatagtttgctagtaccgtcttcttgaaaattaaattgtccattcatgatatatatataatgaattgctggacgaacaggtggtgtgaattttggtggtatggaggagaagataatcctgtatcttccatgtccaagtctcctgtagacatctttcacagcgcttcctaaatcagattgaaggatctgatcgagggttgcatagatggaattcacaagaccatgatctataatggtttggagagatatttcttcatggttgtatgtgggtagattccagaatctttggagatttatctcagctttgagaaccaggaatctataggatgggtcagagattgcctggtcatctagccttaagagagggagcatatatatgattactcttatggctgggtttctttctcttccttctaagagatcaaagaaataatcttggagtccaaggaatattttcatttgtctctccttaaacttttgccaaacaagattgaagatgtcttgcccaaagcaggataaagtttgctccgtcttgaagcttaatctaggttggagattttcgtatgtagaactcatgggattttggcttttaagtttcttttggcaagaatctttgtaggcacaagatctacatggtgcttttggctgggtccggagtatatattgtggaaggaatgaattgggatgattatgcagtatgtatagtgtttggggaatggtatcatgtctttttgtggatgatgatggtttattatgtggaaaagattgcaataggttattgatatttatgtggaaaacaaccatgctcgaataccttggtattcttatctgttgccatagattgttcaacttccatgggaagtttatcttggccatcacgggatttctcctcgcgataatctagtaacctctcctcatgatgagggatatcttgtagtttagcccttttttctgttatcttttgatctgaggtcacaaagtttttgaaataatatgctaggccatttaaggcatgagctttttcttttttgttttttgtctgccacaagaggtttaataacccttgttgtagctctgttactctgaaattgtgattaaatcgttcttcatggcctctgggcagttggggcagtctccatgaactcatattcgtgaaccattcagacttctgtgaagccatttccttgcatatatattcaaaatttttagtagcttttaataaatatctatcttcccatgatgtcttacctgtcaagtccatagattttggaagatatgatgggaaagaattgtcatgtaaatatattgtattcacaatttgttctcttttggtctgaacaagctggtcaagaatctcatctatgttagacgaaaatcttaggctcacctgcttgcccattatctcaaattgaatatcttcgtttgtgacaaggaagggacgaatgagtgataaaaacggtgttcctaaaataacatcttgcttaagatttttaacgattagaaaagatgttttaatgcaaacttcagatatgcaaatataggtatcagggatttgatattctactgttaaaagtcctccatctgccccacgaattctgtgggcggctttacggaaatatttatgagggataataccttctcgaatgcaattgacatcagcaccagaatcaattaaagtgatatgctgaaagtaggatccgtctataaaacgatacataacttctgtgtaccatttttgcttcatttatttttgaatggttccaacaacctgatcatcttcttgaattggttcgtccttttcttccatatggaatccctcttttaattctaacatgtatagacgctttcttatttcttctaaatcttgtttcataattttttgttcttcgaataggctgatcaaatctggtttctcattcttctttttctgttcatctaatcttttgaacacttcatcaatagagaggaatttgctcttttgaatatccttttttagtttatccttatcagtcttgactcttgaaaggaatttttcgagaactcttcttttttcttctggatcttgaatggtttcaaaagtatcgagaacaaattcttctaaactggttagaacgagtatattttcatcagactcttcttctgaattatctggctcataacaagagcaaccactgtcttggcagcaattaatctctgcatttttttcttcatctgaacttgagtcattgtctatattatttagtattgcttcaagtttttctttaacatcttctgattctgaatctaacaaggcttggatctcttttttaactttagatttgaaacatctgttagctatgtgtcctttcaagccacatttgtaacaaatggtttctttgctttcagtgtcttttgttcttatattcttattgtaaattctttttggttttcttttggtagcttgaaagctcatcttgcttttatcatttgattttgtcattggtttggaatgggtttttctttttctatggacataaggatcttgaaaaccaaactgatagcaaaaatctcccatttctcttttaccaagaatcctttgttttttgagttgatctttgatttttaggtcattgcaaagctcagcccccaccaattgtatcttttgtgtgatttttccaatatctagatagtgataatttatactccctcccccttcttttcttagggaatttctaaccttttcagcaaataaaggaggtaaaccagaaatatatttttctttatttccattagctatgcagtcattagcatacataatcatttgatgacataaagtaaagatttgatattcagtaaagccatctaagttccattctacaatttctttgccattgtagtaagtcatattttgaatctgaggcatttcctcaaactgtaggtctgcataagttggtcgagggtaataattcctagttgtggaagtaagagtagaaggtttaaaaatcttattgaccatatcatatttttcattatcagaaatctcattgatatttttatttacttttaaattatttagttttaaggctagctcactgactagttcttcagaaattgcggatccaaaagccttttgttttccaagtttgatgttaggatcaattgttgggacaaacataggactaacagactgagaactagaagactgagaattagagggaatatttatctttacctcaggtcttcctgttttgtagccttc

SEQ ID NO: 63170 - DNA, 18513 bp, Oryza sativa
ttcggattttggctcttttttcatcatgtttttttctttgaagaattcttcgaagtgtctgacttggctactttcattccaatcaaagaaaaagatgttcttcctttgttctctcatttctttgtgccaaagttctcttatctttagtctaaatggttcatcgaccctttcaaagtatcttttcatcttgggtcggttcttttgaagcctgagttcttttttaagcaaatctttatcaatttcaaactcatcctcttctatggcaataacaaagccaacatcaagctcgataacattgatatcgaagtctgagattgaaggttcgtcggagttgtcttcataggtagcatagacaacattttgaggttttgtcctaggcctagaatctagactgacagaaggtctagactggagaaaggctttttgttttgaagcaaatgttatctcaacatctccgtctggtgtttcaatcaaggattcgacttccgattgatccatagacttaggttcaacagcttgagataaaacccatttctctggcagggtgatctcatcccattttagggttttgggggtagtacatctattattaggattggtttgaaggagagtggttaggccttttggtgtataatgtttggcacaaggtgctaaagttgtcatggctttgtagtaaactctgtaggtaacggagatgttttcactccctggttctagttcataaccagatgtttgtaagttgagagtgagaactttatggatatttgtgtctgagagggatacagaaaaatcaggaaaggtgttaaaataaacaggaccattactgaggctggcttccaccatgccaagtaaggaatctttgaaccttttatttctgcaatctcttagacaagccagaacagagacgttcaaaccctttctagtcaaggatctgatagcaacttgtataagaccaaagtgaaggtagtgatattgatgtttagctcttatagaattgatttctctttctgaaagaagatgtagggtttcgtgcaaagaactaattggaatagttttttcaattgttttaatatagtagtcactaagtaatgaaaaagtacctacatgatatatttccttaatattaaccttaggaatcttccagttggaaatacttttctcaatatcctcaaaagatatagatgaagcattctttaccgacatagtgccagcagacttctcgctactgcacaaggctacagatcgatcagtggctcttcgtgatctaaccaaccaagacatcttatacgaaagataggaagataggtaggtagttaccagacaacggcggggaaatctcccacaattatgatcaacctatttggatatgatgtgttccagtcaacggcagggaatatttcccacaattaagttcaacctttgcctttgataagtgcccagtcaacgaattacgccgacaaacgccttctgcggctcaacaaggcaacgcgacttcaggcaaccgatcaaaggttcgggaactccgcgacttcagaacaccacaacaccgttcgggatcaccgcgacttcagcacgctacccgacccctctcccccccctttcggagaagatggctggggaggttatatatatatatatgtgtgtgtgtgtgtgtgtgtgtgtgagaaaaaaatataacaatgctagccgcgcaatctgcgcgggccaccatgctagtttgtgtaaagtgatatatctatatgaggggcagatatagcatgtaagcatgattagattaactaaatatattaaaacatcaatatcaggtaagatcggctgaaacctcgattctacccttattggcaatcaaaaggcaggctagagctagagattcaaatcacaacttggtagatcaaacttaactcatgcagcactaagtatgaaaacaagcaatatatctagacaatcaagcccctgactgattttcatggtggtagatatcttagctaatctaatcaacagaatgatttagccgatactggcataaccctagaaaagatctggtcgatatagataaattgaaccattgatatagattaactaagatatatgataaacaatgattatattaacaagattaacatatctaaaacgatataataacctcaataatgcaaaccactgtgacaagcattacctcttgtgaggagatcgaaaccaatgctctaacttgaagaaagaactcgtcgaaaataactaaataaaaaggtggcgatgcgccgagagtgtattgaacggttgttgttttcttatatggttcttgggatatatttatacccatagtacaaacttgtccatgatggacatgactcaaactttcctaagtcacagaaacacacaaacaagtccttacggcggactcttgcaaaatctctaagaaaccgacattaatattcctaattattagatacaattgcctataatggactgtatccttgcacggcaatgctttgcaatccaatccgggcccattgcgaacccaaacacacctgtatcggctactctatccatatcggcttagttaagtccgactctgttctagccgatgcacaaccgaaatttggaaacaactacttctccctcaaaatccacctcgatctgttcttcgactccgagtatctctccaatttcgctgttaataggttggtaaatcatttatgagtttatttactcagattttacaccacatatgatatatatttccaggtgtggtgaaaccatctgtcttttagggacttaagcatatttgttaaagcagtgcgcgcatggtgtgtgctcgatactttggaaatttctttattcacaacatacaagcttctttatagatgttttgttatttgaattttcaaagatgtagtcaactttaggttgctcgcgtcatattttataaagaagtcggttttatcacttgagtcttgtttactcgggggtttataatgcatatgctattattatgctacttaggtggcttaaaaccactcagttggttgatttattcattatctgactatatatttagtttgttcaactaaccacataggcggaggctacacctattaggtgcatctagtcgatgcacctgggtatatatttaattgttttttattcttttcagcctttcacaaccttctgaatagataaaagcactcgggagactatgtcaaagatgatagaaacactcggctttggagtaatctagctcgggagaaaattattttttcgactgtgaaagtctcacgggctaatatggagattatgggtaccatatacctacatggctggcttatccgactggatatagggaatatgttatatctatgaaatatgtaacggaccatgatttgggtattacgttttcttgtgtcttaaggaatggcctaaagttttgattcggtaatattataaagtagattaagtaaactgatgccgtatccggctaggttcctctcttggtaacactgcccctcaacctatataaggtgggcagggagccctccaagggcttagccacaattagatcgtcagatcaatatacacccggtggattcaaatctccaaacaggaatagggtattacctctcattgagagggtctgaacctgtctaaattcttgtcttcgcatccatccacttttaggtctcgtacgctacccccttttattattgtcaatttccagtttcgacaacttttcaaccatgttttctattttatcttagtttcgtccatctttgtcggtttgcgctgtaaaccgtctatcctcgccacgagagtgcgattatccttttgtaggtttgtcccgtaaacctttcgtttgcccacgaaacgagtagttttacttatatcgatctaaatcagcctagaggcttattttgatctctagatctgctttgctagccggtttagctttttttacaaaacctatcttgatttagcttttgcgaggttgagatggttggcgactccatatcaccgcaagtcgtttaagtgtgtcgatcggattttgcgactttgccaaaagggttgccaacaggattattactaagggctatcaagagggcaactaggagaaataaccttcaggaggctacttgtattggtttctcttcatctagctgtgaacattcaaacaagttccagcttaaaaaagtcattcacatagaagggaagataccgtgctgtattgtttgaggatgggaacagtgtggccgtgcgggagaacgactctgagtatctgactgccatttctattgctgaaaattttaatgaatcaggggtacaatggtaacctcaaaattcctaaatcattttttccttttcttttctatttgtttaacttggtattgtgggatccactaaccatctaaaaaaattcccattatcttaaaaaaaaaactgtcatccataagagggacaaacgatggtttcatttgaaaatatcatgggtaaatccttaaacctaaaaaataagagcaaaatcaaaaacaaaattaaaaataaaaattggggtacgaacacaattcgttccacatgacaccaaagatcagactgcacatatattgcttaaccaatcaaacgaatgcaattgtttaatattgtttgttgctgtgctttttaatttattcgagcaagtccttcatttgttcaatctgtttagactctgctgaaaattgtcggcatgcgcatttatcactcaaggtataaaggaagacgtgcggtagagaggcacgcgttttcttttaacacatggagatgtaaattctctggggaggcttacggatcgggcgcccgatctgggagccaaaaaaatcgggcgcccgtccgagccgtccgatccagcgcccctaatctcgtccgtccgcgcgcattaaacaggagcacgacacattagcatgacgtcagcagcttggatgcatgtaaaactactctaaactattttttctcttaaattatttatccaaatcatgatccgattgcaccattaaatgtgttgcaattaaatctttaaaacaagaccacacatggatatattctgatgaaaaaaaaaacttattattgagttatttttaaatgttgcacgctatttcacaaagtatatcggaattgtttcactgagtagatcgaaaatgttcaaaccaccacgtcgacagcagctagataggctactccaaatattatactggtgcgattatgatgaataagagtaacgaccggctttggctaacaggatccgaacctgtataaaaatcctcgtccccatctcttttacctcagtctcgcatatatcctagtaccaacgatccccatactatgcaaataccggaatcgcgacatcaaacgtcgacagtggcgcgctaggtagggggttttggtgctttaggattccgacgagatgtgttcaaaagatggattcttcaacaagaagctactcgttgacttcggaccagaaagatccaacccagccagaatacgtctcccgatgagattggaatcatcttcatcagctatttgattcggcgagatcaatcaagcttaagatgtcgctgccgcggaggacatgcgtctgttcggtatttccgaccatttgacgatcgcgaggatgttgccgaaataatacaacacgccgacacctcgagggaccgaaaccgactactatgctgatcgactttacgcgtggcctggtcggactcggggtgacaggccggatacaccgttgtccaagatcgccacgtattgctgctcccgacatgtgcacatgcatatgcagactcaactaggttgtatccccgcggcactgttataagtataatgagaaataaacacgtaaataaaagaaaaaggtatgttgacaaaagaagaaccgtatggagacaacctaaacattaccatgcaagagtaacaaagttatatgtgcctaaatattagtgttagcatattagcccaattaactgtatagcacacgccaaaaatatttgtagttgacagaaattgcgaaagctggacgctatacagcatcaacccatcataggcataagaacattgacatcaggccaagtgggcgcgtgatgttggagcgtatacaacataatcatatattatgcatagtgcattgcatagaaaagtttgcgtaatagcaaacatataaaaagctatagcaaatgatagtaaatggcaacagttaaagcacaaacctcggtgaagctcagaaataacccaagcaaaggaggcacattcagctgtgtcgaccttggtgtagattctgatctctatgttaatgttggcactgctgatagcagcattcgtaaatcacagtaatcagcaaattcagggagagtaagcaacttgggaaaacacgcaaggaggatccttgtactgattgggagatttgggcgcggacctttctgcggccagggaagatcgtcgaggggaatagataagtacagaaacatcatgccaagtcagtcttagatctgaaacttccactcaagaatttttatctttccctcatttaaaccaaatcttgattcctgaagaaacaaacaaacaaagaatgtcattccatccacagagaaatcaaaagacaaaaatatttctaatcacaccaggtcgccaactgacaaagcgaagcatgataaataccaaatacagtgtagaacgggaatcaacaatgacaaataatttcatataagctactaatgtattgataggaattcaataaataatatggctgattctaaagattagctttccgtttgcaatgtagaccactgactttcttatatgtagacctaacaaatacataagtacatgatttctccgtgcaaacagtataaatttaagaagagattatgtacagtatgctgagctgtattacatcttgcaattatcacataattagttcaagatatcattcgtctcagcacacaaattgcgataatattggactgcactcgggcacgatgttcagactatgcactcacccaaaaccaactggttcttgttactattctcagccattgatgtatggtctgacctatagatggatgtgggaaagcatgaccaattcatcagacagcaaggaaggaatgaagggaagacatggagagcaggagcatacatagcctaagtcatagaagctaaaaagcatgacaacaattgtaagaacctatcggcatgaccgctaaactaaattaagacacattacaatattagcatatgcaatcagcacattgcaatgatcctcgtgagacagcactggatgatttgtattttaaacctttattgatagtctagtttaaatggctcaacaaaggtcattccaattagctagtttgttccatgcattactcagcgtaaaaaggataattatattttgttagtgctttcctttttgttgtcagttctttatgtcagctctaccaatgatagtaacagtaaccgtgcatcacacaaatcagcaatggtagtgaaatgagtaaatagtccggcagagcatagccacacgcaaggcggatcgaggggcattaccttgtagtgactgggcgcttcggtcggagcatgaggttgcaggggctgagcggcttgtcacataatcgtcgagcgagcttcagggggtgacggcggcggcgacagcggcggtgggaggcaatggtagaacttcaggggcacagggaaggattttcgataggctttgatgagcaggggaacagtttggtgaggtggtggggaatagacctcaaatcggcggcggcggcggcggcggtggcgagccaagatttacatcggcggcgacggcggcggtggcagcgacatggatctcctaccgtcctccagcagccagatgatagcacgggcgttaccggcggcgtggttctaaagggacgggaaagaacgatggagcagacaaaagacctaaggctcgtcgtgcatcggacggccagaaacatgcatgggctgatccaatggccagcaagcacatgaacagggcaacagtagcgtggttgcgtggcaacagaagcaacacagcagccgtacctcaccaaaaacgcccaagcatgcactggtttgccgtcttatacatgcacagaagacaattcaacggttaccaaggataattatgataattagtggattaattaatttaattaatctaccaattccgtagatacatccagcatgtatctacaaaggtacgcaataatttatatacaatttaccgtacttatttttcagatcatacgatattatcatatatatgatttattatgtttacctagagcatgttttttatacaatatctattatgtgagcactccctatattaggcctacaacggtttaatactgggggctcgctttattttcttcagtataaatcatgcttatttacggtttacataatgcctgatatttcatctgctcgttatatcctgataatactagaagatccatgcagttttttgagtacatgttcgatattctctgctatatgtcttgccttctagaaaatatttttcaggaacaactgagcactcgagtaggttgtggtcgagcactgttgatgaaaaaaatcgaacacaccagcctgggagatctgcttagctttagtgcaggtccaaaggttgatgggatacgggcgtaccagtcagtttgatcctgcaactgacaagatatgcaaataatagatcaaaacagcagatcggcttacaagccgatgaagtagttccagccgatagctgataatagccgatgccgataccagccgatagcgatagggtttaagcaatcggctatatgtccaatgtagataatgatataaaggtgatcggctgatgatgataaataacaataatatatcaacataatccagtagaaaccaatcggctaacaatatgatgtaatagaacaaatactgatccgaagggtaaataatacatcggctggaggtccgatgtcataaaaaccacaggattagataaatcaatgaaacctttgttgtcattggctaaatccaacttatatatacaatccttataagccgatgcaacgtccagataattcatcggctaaaacctcgatgaaacccttattggcagtcaacaagcaagctagagattatggttctaagcacgacttagtagatcaaacctaactgatgcagcactaagtatgaaaagaaacataatatctagacaatcaagccgttgactgagttttcagggtggtagatgtctaagctaatctaatctagcaacatgatttagccgataccggcagaaaccctaaaacgagaagcagccgatagagctaaattgatatgctaagactagattaacagagacatatgataaataggtaggcaaatatatcatccaaaccagagcaatccaagaggtcgaatgtactgattcagccttgaacgacgccgacgtaaacgatacaattgtctgggccagtggaacattggacttaccccttagccggagatcgaacaccgatgcagccccgcgtcaggtgccaagtcccgccggacgataaaataaagtagaaaaggtaaaaggtggcgatgcgccgaattgtattgatcgtgaagatagattacatagacctcgggtatacatatttatacccatgggttgatacaagtccttgtcggacaagaaagaaaccttcctaaagataaaaggaaaagataaagtccttataggacactaaacacactttcctaaagataaaaggaaactaacaaactattcctaattaatagataacttgccatgccgcattctctttgaactcggtctcttctggataagcttcctttagtagatcaatttccttaaccgaatatagcaagaatccgacaactgacgacttgacaactctcatcggctaatctcagatcttcgaagccgatgctgactctaagccgatgactactccgggcttaccaaatttcactgttaacaagcacactccattatcgagaacatactagacaaatgcagagttgtcgcgcccaacctaccaacgaagaccgacgacctatctcatagcactggccatggctggactactcgagaaaaggttgttaacggataattgctcgcgaacgatgtcggcttgatcacccaacattattgcggacaggacatccagatatgctacgggttgggtatgtgagtcatgctggccacatgagatgcacatgtaataaaccaactctagcacctccattggtgttcgagagataattctactcgctggttcttgaaccagtacatggaagtaatctctcacaccgcaacttccattggtgttcgagagataattctactcgctcgctggttctcgaaccagtacatcgtagtaatctctcacaccgcaacttccattggtgttcgagagataattctactcgctcgctggttcttaaaccagtataccgtagtaatctctcacaccacaacttccattggtgttcgagagataattctactcgctcgctggttctcgaaccagtacatcgtagtaatctctcacaccgcaactttcattggtgttcgagagataattctactcgctggttctcgaaccggtaaattgtagcaatctctcgcgccttaacttcagtcggtcgaggtacgattatggcgatagcgtagcggtcctcgcaccacgacttctgatggtcgagatatgactacggcaatagcgtagcggtcctcgcaccccgacttcagacgacttcagatggttgaggaatagctacgactgaacttcgaccggcagcgtagcggttctcgtaccacaactccaaatggtcgagagacacctactcgctggttctcaaccagtcaatcgtagcaatctctcgtacatttacttctagtggtcgagttacgattaccacctggttctcgaccagcggtgtagccattctcccactatttctacttcaagtggttgagttacgactactacctggtcctcaaccagaggtgtagcgattctcccactacctctacttcaacaaagttgatatcaggtacacaatatcgccaagtgttttacctagagatcccttaccacgacgacacctagagttgaaacctatccttatatccctttacgccgtcctgacaaggcctctgaggaacctaagggaacttcggctgaggacgcccagagcggataaggccttgttggatcatgtagagacaaacgaccatgtaagacctggtcatgtaagagttctcgccgtgcgtattaaccaagccgtgtgatcggaaattgagttttccaacttcacggctgggggctaggatcagtgctttttcaactaaggcaggtcatgggtccaagagccttatcctccgagaacgattctccgacgacaaggctagggtttagggagagtgtatgagtcaacaaactgactgatcgaagtcggtaagagagaagacgctcatgtacaaaacattggtctgtacatttaatttactttcagttttccatacatattataacatgtcaccctttgagcgttcgctcaggggctatttctatataatattcttttatgagtattgatttcaggaaaattctattcgacattgtggaagactccatgtctctatggttctacaccaagatcgactaaggcgagcacgacaaatgttgacaaggctccgtcgcaggctctgcgccttctcgatcactcgagaacggttggtggatctcgacaaggaatacggaatgaagaaatggtgtacctgccgagataaaatttcttgacttcaatccaaattctcgattacagcaagacgggagacttagtcgtatgctctgtactttcttagttgacgtcggagattgactcagacaaaccctataggtgcccgcacgaggctgatatgggaagtctaacgttatctctgaactcaccgagaacggtcatgtgagcacgataacagttactccaaggtctgcggttgagaatatgaatttgttcatttgcattgaagtcgggggctactatcggggttatggataccacatacctactagtagttgactaaatctcgacaggatccaccacataccatgtcttatacagaaactgacttcggatatggagggagttctggataaggaaagacaaccagagttctacatggaaacgacaaagactactcggattgtatccatattggtttccctggttctactcggacaaggggacatctatggttataaatacaaggccccccaggaggagaggggggacaataagagctacaacatacaagccaatatacgccaagacaagacgtcggatatcgacttcagggaaaagcacggctagtcccctacggtgtctccggatactgtcaggagagacgaaagcgctatttctgatctcgccgggcacggattcgaggaggaagaccaccctgttctcgactacgtgacgatacttcaaaccaccacgtcgacagcagctagataggctactccaaatattgtactggtgtgattatgatgaataagagcaacgaccgacttcgcctaacaggatgtagggctattacctgactgttcaggggcccgaacctgtataaaaatcctcgtccccatctcttttacctcagtctcgtatatatcctagtaccaacgatccccatactatgcaaataccggaatcgcaacatcaaacgtcgacagaaacatttttttagtggaacaaaaaaatgaaatggattcccttaatagagggtttccatatatttgttgcaacgacgcattccataatatcaaaattcactgcaacatttgatccgtacatagtgaaacattacgagtatactagctgaaacatcgtaaaactactagttgaaacatcaaaaagaccatatgcaatattcaaaaaatatcaataaaaagagctaaaatatttttcgtcgaaatataatcatgtgtggtcttgttgtaaagatttaattgcaacgaatagaaatgtatgatcggatcgtagattggataattaatttagaagaaaaaacattttgaaatttttttaaaaccacaccttcctgccgagcaggggagggagctccggatttttctccctctcccgggcgaccaagcaggagggttttcgaaattctcttgtcacgaactttgtcgcaaactgagctttacacagttcattagtggactctgtctaccggtttcgagtcttcaactcagcatggtgtttatatttataactatttattctttacgcggtaggataatgaggcatctttggtttgttcaatgagtttttttaaagtaaattctattatggtgccgtcatttcgtgatagagaatatcagaataactttactgagtgctgcagtaggggaaaaaaaggcgaattaacacgtgcatacccctttttcagaagagagaacaaagcgcacaagaatcttaataattacacacataacttgtcaggatgtatggttcttgcaacgatggtgaagtattctcatagattggccagtgtaagaatccatcatgggtgataaatgctaccagaaaatcgtctcatcaggggtaccggtaaccaaaatattcgaatttgtttggatttagcgaaaactagcaaagttttgtttaaatttcatgattggcctagaaatttcgttcgaaatttaattccgtccgctcaaaaattatttgcaaaacaaaatagcaaaccttgtttgtgggcgtgaaagttttgtgcatcttaggccccgttccatactccaactccaaacttcagtttcctcgttttctgttagcatgtttttcaaactaataaacggtgtatttttttaaaaaaaatatttctatatagaaattatttaaaaaacaaataaatttatttttcaagtttataataattaatatttaattaatcaggtgctaatgagcttttctcgtttcacgtgcacggaaaatatctctccagttggagagatcgaacggggccttagtccaaccgttggagagttatttgaaggaaaaccatttgagttattagtggtcaacatgaaataataatatatagtgaacgctgacagttgtttaaaaacggagaatgtaggccctttctgttagacgagaagaggcgatcattatcctcacataaaaaactagagagaaaagagagaaagaaaaagatatgccactatcactcgccacgggcacgcttattataaatagccccccttccaggctttgctgcaagcaaccaaaacgtatagaaagcaaggatgtcgtcgtacttccagaccactcaaccgtttagtaggacttacaagatcggtaaacccaagggcggcggggacgggcagggagctggtaataattactttattcactatcaacactaatatatataattgatagtttcattctgcgatatttgtgcgtttgtgaatcgctagagggaaaacaaggatccgacggtgcaggccggccgcgcgtgcggataatcacacacaacaacgaccacgaaccacgagtcgtgcagcacgaacaagctccagcttcatctccggctccggcccccgtctcctactgaatcaactagcaatcaaccaacgcatccatcgtatagatccgtccatcccgtcatgcacgcgtaagtggcactaaatagtactcctactccgtaaatatttcctcattccctaaatatgtttgacatcgttgacttttttaaacatgtttgttcgttttattcaaaaacttttgtgatatgtgtaaaactatatgtatacataaaagtatatttaacaataaatcaaatgatagaaaaaaaaattaacaattacttaaattttttaaataagacgaacgatcaaacatttttaaaaaaagtcaacggcgtcaaacattttagaatgaaggtagtcctaaaatcaccgcaatggtacgcacagtaagatgagcagataattgggacatacgtacgttcgtacacctgctagttgcgctgctcccccgtagtttcgaccggcttcccgtgagatcgaatagcatgcggcccagcatgcatatgtgtaatatgtctttgtaaatgtaaactataataaagactactttatagccaatgtaatagccaattcatataatagttgtttactatactattaatatctggtcccacctatcatacacatattacgtcttagagtccatcctgcagctagctacagatctatagcccgctgttcttctttttcttcctttacctctttaaaatatgtttacagctagcttaaagcctgctattgtacctgctcttactattcgtgtgtatggcaaatcacggcggcctaggagatctgcttcactccagtgtatgtctaaatcttgcttcgggttcagggcgtgtgttggtatttcttaacgacattactataaatataattcccagcatgacgtagaaatattcatggtatatttatggtcacagaaatgatccacaagcgcacggacataccattgtagcgtttcacccggagtattccaagctatcgtatttatttaatcccaagggaagatatgacaagagagtactatgctaatagtttatatattacttgtatacatcaagttttgtgtaggggttaagtgattcaaagggtaggtgacatacagaagaaagaactaagattccctcactaaacaaatactaagctaagtggagaaagaataagaaaagaattcattcctatacttctaatatacatacatctttagtctacacttgctagtatacagtcatgcaaccaatacccttaacagtgccctcctggtgtttcgagagaccacccttggttgtcgagtttcttatgacaacctgtcatgaccatccaacctccaaccggagctaaataaggaggagtaacctccccaggaaagtgtacttaggattatatactaacgtgtaggaatacccgtactgagctgtcaccatcagcggcccacctctactgtcccgcagcatataaccctaattaatggtatccaataatctaagcaccgtgcttatattactaaatactactctgcatccttgcagctgacatagagcaaccgaatactcgaacattaaacccacatcaatgtacctctctggtaagctagttacacagctatatcgatgcaagtataaagtaaagtcgatactcaaataatatgaatggaataaaataccgaagatgtataaagaagaatattctattaattcgataagtcatacaaaagaagagaggaaagctactagaaccatacccgaattctcctgaagacccgaggactaagaatactattttaattcctactccactagcactaggatactactaaacttgagagagggagagagctcttcttcttgagtgtgtgtagaatggaatgagaggagtggtatttataggccattaggtgccttgggagtgtggtgatgctcaagatatccaataagcatattccctcttgcttcacctccttgtgccaagtgtcatgacggttgcttcgggtagaaacggtcacaactgccatgggatgtcgataactaccagcctgtggattttctaggccatctgggctgttttgggtttggccaaacccaaggttcggccgaaccctggactggcccaattggcccactttttggcaggtgtatctctcggtggatcctcagcccagtggtgtgaattttgggcttgtttgctcgtgttaattctgtgttatgagcccatctatctacaagtctgcttctcgacagcgtttgattgatcgttcgtctattttctgttgattctcctccatttatatgtgcttctcctgcatacatgttagtagcatagtatatagtgggagtagatattttatttggaaattttgcattgcaagcatatctagtcttcattaattgggtagtattgacggtcaaaattggtcgataatgaccgtcaacaaaccccccaagcttaaacctttgctcgtcccgagtaaaggacaaaagaaaacaaagacttggttgttgattaggagttgctactatactgtatatctcaaatgtacaagtgtaagttatgggtactctctctcaaattaaataagttggcacggtgacttacccttacacctaattcccgcaagacactgcctttccttgtcttgagcggttgagagacagaacaacaattagagcactagtcacccactctttattcaacttttattccgggagtttccaaatgattttgcaaaaaaatccaagttcctcatatgattctcttgatcactcaaagtgtatgaatatggattcctcaccaaatttgcctttatgattcctactctaaggtttgatatgtggagcttggtaggtatcaaatgtggcatacttacattcacatttattactaagtcaaaaattggactaaagcaaatgactagacatactcaagatcaagatcatgcaagtgtgtgagtaatatggtggaaatggaatgtggataacaataaagaaaatgcttctcctttatgcatactttcttctccaaaatcctccattcataaatatggagagggcatggctatatttttctatatgttttttttatcatgctcaacatctttgaaagagcagaaatttattcttttcatagccatgcctttccctcctcttttttttcgcaaaggatttttttctaggagaagaaagcataaattggaacggagattatttttggatgatgatgaaatggatatagtggataaaatggatgctagcttccagtgtagaaatttagcatatgtgtgcatatgtgggtgtatgatcttgatcatatggtatgaaaagtatctacacaagtcacaaaatttgacaaagttcaacggaattacaagcaaccaaaatgtatatagtttatcaatacgaatatttttgactctggtaggaattcatatcaaatgaggaactttcaagtttatcatttttgaaaaataaaacatctggaattcaagtcaaacttagaacaggattatagcaactcttatttactatctcatatctcgcaacaacctagacttagattagcaagtgcagctcacttccctcaggttcccagataatgtttggcttttcttactcaacttttgagagagtacttaaccatgaacccatatatgagagatataaaacagagcaactattcatcatttcaacatgaagaactaagcatgtcttacctagcatattaaatctaacctatctttttggtattgcaagtttttgtgttgttttaagttttataaatgcaatgcaaaaattaaacatgcaacttgaaagggaaacatgtaatgtgatacaagttaaatatgtaatgtgatacaagttacctcagtgggggagagacgtctccccct

SEQ ID NO: 63171 - DNA, 2609 bp, Oryza sativa
cagtgaactccgcccaagtgattggttgtccttctgctctgttcatccggaaatgatcccaccattctgaagcagatccttgcaactgatgtgaagcgaaaacaactttatcctgatccgtgcactggagcaattccaacttctcctcaacagcgtgcaaccaatcacctgcttccactgggttggtagtgctagagaaggtagggggtctcacacgaagaaaatcagctaacttgttctgcggcggcggaggattgacattgttgttcccttgctggttctgcatttgttgcactaacatgttgatcaattgggtctgttgagccagcacttgagcaagggttgggttctcttcattgttattgtttccacttccactggcgcgagtgttcaccatctgttgcagattagaaaagatagtaggagaggggttacactaaagataagaccttaaccaggttaacactgatctgatgtgtgtagaccattatattgttcaagttgattaagcaaacaacctagtacagttgcacgctcatcactggactacatcaatgacgggaatgcaaccatacctacacacaaagcaaacaacagcgttctaccctactaactattcttcaaagacactttggcggcataggttctaaggtaggatgccaacttcattccatcttgacatctgggcacttcagttcttcctcgatccactttacttaacctccataagtagacctcattggcgtcttcaagtttcaatgtctcagaactactcaagttgaaagcaggaggggagaggatgataaaatgatttatagagaattctagagaaggaagaaaggaaaaattttcacaaatcatttttgtcgaaaaaattcgtccttaaagtttgaccatttggcttatcctacagtcgagatggctctgataccaacttgtcacgcccggaaattcactagtaatttccgaacttatttgtgcataaaatcctcgtccaggaatcagccgaggtacacaaactgacaattttaatatacaaacccatcataataataacgttacatacttacaaaagaaaagaaaacagcagcggaataacgatttagcgatggcttcagctccactcccacaggcagctcaactggggtataagccaaacgtcttctctttctggatcctttatcttcaactgaggtttgatgattattgcaagaatgagcatatgacatactcaacaagccacacagcaaatatgcaagtgcacaaggattccaaaggatggcataatataggctcatttgcaaaaagcagcatttagcaaaacatttaagataattaaaacagtagagtaattaatcatcaattttaatcaacactgaacagcacacccatgctgcacaggcccaaccatcctgaacaaccatacccggctgtacagatctaactccaaaccaggagctaagcaaattattaccagttataacatccataattattgtgaaaggtgtgagactaatcacgaaaaacattgctcaacccgcccataaccgcgggcacggctattcgaatagttttactctggccagaggtgtaccactgtacccacaagacacgattccacacatgttgccatgccccgaagtaccaccacggcactgcaaagggggaaatcgtgacaatacccttcgcacaacacaactcaccacagtgcaccattcctggatcataatcaccccctcaaaaaccagaggcatggactccccagcgaccgccacggacttctcgccgcttctcagtctggcaccctgtaatgaaccatgctatacaaaagataaagccgttgcccatgctggcttgtggttggcacggtaaatgtttcacaacagtagctcgcgaaccggtccttaattgtcatgagcacaaccatcaaaaccacatgctcacaacccaccttaaccagattttaattatcaattaattaacatcacacgattaatcatcgtgagctaccattaaatataaccataattaataagaataatataatataatttatatttaatcccctttaattagctaatgtttctaagcatagctaagcaaacttacatatagcatttagctgaaccaatccaatatataaggttcatgctaatcaaattataacccataggaaaataagatcatcttcggccattaattaacggggaaaggttcaccacccgatgacattaaaaaataatgcatagttgaaataaaataatagctttaaacgggttcaacatgctcaaagggttgtttgggatctgtgcgacttgccttgggcttccgcaaacacttccgaaccttgctcaacgaaaacgctctccttcagaacgtcggaaactaaagcaaaagaataaaaatcaacaaaacagtacaaaaacaagcataaacagtacatgtgaatatttttaacatgtagatcttgattttagaaaaatttagcaacttgaaccacctgaaacggatctacggttatttagttatgattttccgaagatttcatctataagaaaaaggggaaaaaggaaaagacgatgatgtcatgatgacatcatcaatggtgg

SEQ ID NO: 63172 - DNA, 3141 bp, Oryza sativa
ggtcctcccaggaaggtgatatggtacccgggacccgggtcctctgacgagtctgtgataccgggctccctctcaacctcctctggctctgtctcagctccaagatcagtatcctcctctaactctgagtcgatctggatcggagtctcctcgctagaacccagctgagacgggggtgctgcgaccgcctggataggctcggccacggtgactgtagactgctccccactggggtccaccaagcagggtgcaggctcagtgcccagtatctccgcgctctctaagatagtacggaaggcagtcaggtacggtggagtgaggaacagtagtagtcaaagtggtggtcgcacactggcgcaggtggcggtgggggaggtgcggtggaagtagaagctgctgtcgtagtggcggtggctgcaccgagctgctcctccaactccctgacctgctgctgactactctgcagctgcgcctcaagtgtggcgatcctatcaccacgggtgtcgtactgtcctgagagctgtgcgtactgcacatcacgagcctgaagctgggccagcagcaagtcaatctcgttgccccacgcgtggtgctgctcctcaagctactgtcggtgctgggtgagactggtgatctcggtctcaagctctaacaaacatctctgctgctcgtctatctcaagcagtgcctcctcgtagctgtcgtctactgcctcagcccaatgggacaagtgggtcaccatcgggttgtagcagcacggtgaggcctggacggagcagaaagtgtagtcctctcccctgtacgggtggtgggcaaactcagtcctcatcagctccactcggtgtagtgagtgaaggcgaaggaatgcctccctagcagcgtcctggactgctgactctgcaaagtcacggcggtagcgtgcccggaagcgatactctggctcaacgtcagtgcgtggctcaatcgtcacccgagcctcccacttggcacggtctccgacaacgaacctcctcctccaaaagacgggctgtcttaataagaatttgcttgctgttttaagtgttttaattcagatcagaacaattgcagtttaaattcctttataataaagcttagttcctgagcatctgtttttcttctttcccccccctccgtctgccctcccttcagatggtcaacaccaggaatggcatccgtgcagcaggtgagggcagcagcggtgaagaacgcaccgacggtggacatcccaatagtgcctctggcaacggtccgccaccgctccccgagaatccgacccttgcccaagtaatggctcatcagactcagatgacggcagccatgatgcagcagatgcagcggcagtagcaccagcagatgcaccagaggatgcagcagcaagctgcgtagcagcagcagcagtttggtccccctccccctcagtccaagctgccggagttcttacgcgtcaggccacccaccttctccagcaccaccaaccctatggaggcaaatgactggctccacgctatagagaagaagctaaatctcctacagtgcaatgatcaggagaaggttgccttcgccacacaccagctccagggtcccgcgtcaacttggtgggacaatcacatggctacccgtccgccaggtacggaggtcacttgggcggagttctgtcgcagctttaggaaggcgcaggtgcccgacggggtcgtgccacaaaagaagagagaattctgggcactccaccagggcaaccggacggtgactgagtacctccatgagtttaatcgtctagcgcgatatgcaccagaggatgtccgcatcgacgccgagaaacaggagaagttcctagcaggcctggatgacgagctgaccaaccagttaatctctggagactacgccgactttgagaagctggttgacaaggccatccgtcaggaagatcagcacaacaaaatggacaggaagagaaaggcagcgcagttccggtccaaccaaggaagtcaccagcgaccgcgcttcgctcctggacagcagggtggacctaccaccatgatcgtccgccagcaccgccctttcaacacgagcagcttccaccagggtgccagtggcagccagaaccaccagggaggccagcccaaccgcagtacagctccgcgcccaccgatggcaccagcacagtcagctccatcagcccaagccaagaaggagactggagcaaagccagggtcctgtttcaattgtggtgagcatggccactttgctgacaagtgcccgaagccaagccgtgccggggcaaggtttgcccaagctcgtgtcaaccacgcatccgcagaggaggcgcaagcagcaccagaggtcgtactaggtacgtttcctgtcaactcagtcccttctacagtactttttgattctggtgcaacgcattcttttatttcaaagaaatttgtggggatgcatgggttaagaaaagaagagcttagtacaccaatgagggttcataccccgggaaatagttcaacctcggtcagttatagcccttcaatgctaatagaaattcaaagatcaccatttctagccaacctcatccttcacgaatccaaagaccaagatgttattcttgggatggattggctgaccaagttcaagggagtcattgattgtgcgaatcgcacagtcaccttgaccaatgagaaggtagaaaccgtggtgtacaagtcaccagtctcaccgaagcagagaatctccttacatcagattaaggtggaaaaccctgtgaccaccgaggagaaaagttcacagaaattgaggatatccccgtagtctggaattatcaaaaatggttcccggaaaactcactccattccacccaaaaaaaaaaatggatttccaaatggatttgccaccggggactgttccattttacaagaaaccgtacaggatggcaggcaacgagctagcagaggttgtcacgaccggaaataacccaacgggcgttccttacgtgcgtgtattattccttgccccagaggcaaggttcaccaaaagttgatacaattcaaaatttaacaagcggaagcgtaaatagttaattattacatgggcagcgagggcccagcccacactaagacaacgaat

SEQ ID NO: 63173 - DNA, 6532 bp, Oryza sativa
cccgtaccaattttcatagaaaaaacggtacctcatggtaccttctcaaggaccgtaaaattattctaaacttatatatggacgtattactcagagatattacagatttcctattgtttttgtttggccatgattttaacatataggaaagcagaggtatctggtcgatccttttttgaccatatataaccttggaacagctgatatttcttgccaggaagcatccctcagtaaacatttgtgcttttcaatggaaaacttgctgttcatttgtactagtaccatgttctcaaggacaatgattttgaatacctcagtaaacaactcgttctttaattttctccaagactatattataaataccatgttctatttgaatgcaagataggactacatgctcgtgaatgattattgcctgtgatttgtgggagttacatgctagcccggtctcgttctgaaaattcattcgacaaagatgcttctgaaagagtgtgttcggtttccaatcttatgtagaataattttctagagactgttttaaaattgcatttaaaatcaggaggtccacactatagaggtaaaattttcaaatatcgcctagaatactttcaccttatctagggacagtttctacagcttcttttaggcactttttaattagctttttagttttattctatctagaggtacattttaggaggttaatatgcgttagtaaacgggcaataggtttattgtttgtacaaactgtgtctcctcttttataaacataaaagatgcttctaaaaatgactaaagagtcacaagacataaagatattgtgtaatgtgttttcatttgtagagacaattcaccacaaggcatttgttaggcattttcagaacgcctctatgttgttagaaaaatgtctctgtagtgttagaaaaacatatctacaatgtgtttttgttgtactgtaaatctgaaagtcaatcattttcatgtatttggtgacaaaatcactaccattcacttttgtacatgccatgtcacgaattatttatcgtgtgctcgttgttcttatctatattcgtgccgcacaacttcattcgacaaagatatttttaaaagagatgttcggtgatgcaccattcaatcattttccgtgttattggtgacaaaattattatagattcctttatggccataacacgccaagaattattcttcatgtgcccgctgtttttgtccgcttagtaatgcgcatgatcttgatccactacattccacattagttgtggaatggttgtcttctttgaatgatagcaatgattcttttcaggtactttgcatggattaaatacttatgctttacttgtgatgttgcccttattttcataatattatttatgtctttgatgttgtccaaatgactggctggaataaattcacaaatggttatatttgtgcgtgataacacataactataagtcaaattaatcacatatagaaacattttttttgtgttatagtatattatcccacgtttctacgaagtttgtcgtttggtccaaaaaaagagtcaagggaaccaagatgtttttatatagggcatcacacgtacgtatttaattttgctcctgtagttatccggttctgtagtttcataaataattatacattttatttatttcacgaagagatttgatataattaatgtaaaaggaaatgtttgcagagatatattgtagtacaccaacttgatcgtaactatgttgccagctccctaatcgaattgttaccatgaaattgttttgcagaacatgtgcccatgttgtgtcctttctccgatggtatccaatggttccattcttcatgtcgtagagtatggattagggtgtgaaatatcgaaatttctaggttaactcaagtaatcaaatgcatttatagatgcaggaagatccaagcgtagggcaaaagaaattgaacaacacaaaggcaaccaatccactgttgttacaacattttttgagattttagaacttcccttaatttgaaagagaaatttgattatccaaatggggtgcatagttagcttaatttctagacaaggcatctcttgaagtttgtattgcaggcatctagttccatatcatctagctacattgctaatgaacatttattggtggatttactggtagtctacattggattgctattatgttatagaacttttctatcttgatatgttaatatgaataaaactaacatgatggtcgtcatgattaaacatatgtcatgtataagtacaaggggggaaggcacaaaaaagtaagtgtgggttgtctagctagtttgatcagcaaaccagtactatgcaccatcggttaaaataaatgttttagcataccttaatctatattttgaaaagtaatcacatattgatgcaatatgtctaatatatattagtaatatttgatgcaagaatgtaacttgacaataatgccagcgcaatcataatttaacagttttgtgtatgaaaattttcagtcacttctcaagcataatagagaaaaatgtatcttctagccactttttagttagaacctggcgacaactacatatacaaggattcaaagattacagtgggaagtttccatgaggaacttagaagatcattatcatattttattcaacctggacaatcagacatgggaaatggtggagtgactagttaaaattatggaagatgaacaacctaattagtgtttatgaattttgtatctatggtgctcaatttctgtcgcagtaagtaatataatatgattttcagtataccctcttctctttgagtttacatatgttacaccattacctcataattcccacaacgtgcccattacttgagattaattctcattatttacccattgtgaattatcaattgtcagttgattatgtaacattaaaatgtttctttcttaccgactagcaagttacttttttgaacaatgatatcgtggacctaagtaaatatcaacacagaattgtatcatcttgtagaatatccagtaaaagagaagatcatgaaccaaaacgccgagttttcttgggcacttttccgctgttcaaattgctagatccctatatcattggctttgtatgggaagacatgagggttgagaacctttgaacacaaaagaaatactagctaataagtgcagtgcatccaaaacagatgttttattcattagacaaactggcagatctgtcagcgcacatgtcattcatgttcaatactaaagttaaacaatcataagatcagtcacaacatttatattatgaaatttctgaggtcaattcagatagctaaattttatttagcatatatgcatgtttttcccatttccctcaacaacatggaattttttgtagcactgtttcttcagaaaatcacactactggataaaccatctttggtcggttgacccaaatccacaatagtctcggttccattaaaaaccgggacttcacctcgtgtcagaggctgtcaggtcccaaaaatctttagtcccggttggtaacatcagccgggattaaaatcagtgattttttcctactgggactaaaaatcaatataccgtatataatcccttactcttatcctcaaaattttctatcttctattcctcctctctctctctcactcttatcctctccttctattcctcctatatctctcacactccttctattcctccttctctcgactctcggtagcgccggtgactagcaagcggcggccaacgaggccggcggcggggaacgtcggtgggggcctgggcacggtcgacggcccgcggcgagaggcaagaggtgcctgccgcccacggcaggagacggcggccgcagcccgcgacagtagctagcggtggctttatttctttctctttttttaagaatttgtgattcattggatctgtgttatttgatctgtaatgtatttgtgatgaatttttttatagaatttgtgatgtttttttctgacaatttgtgatgtgaatattacgatttgtgatgttgttactttgatctggggatgtaggagaatctcgatttggattttgtgatggtgagattggtgtgaaatcaatatgcaaacaccaataaaaaaaagagaagaatgggacatggcactaccctctttactaatcgggactaaaaattcccctctttactccctattagtgttactaaccgggactaaagataacgatctttaatcctggattcgtagtcttggttggaaaaccgaaactatagagggcttcaaaccgggagtaaagagcatttctccaccagtgtcactttgaaaagatggatcgatctgaccctaagtcactaaattaattcaaaatctacatgtaaatctgttctgctacaaaatgaattgagataaattacactattggaccacaagtcaagcaaattggtacaacatgaagcaagtaagagataattgtccaccagagatatcaaccgcgttcacatcactctcatatgtcctccacgctagttcacaagtacgtaaaccacatcatttgcttatccgccactctctcaaatttcaaagaggatagatggtttacaattgattttcattagattcatcacaaggacaagagaaataactgaaactgtgtcatgctatatgttttttttaaaagaacatatggtaacctgtataaagcttgtggtgcaaaagtaaaaaataatgcttggtccttgcactcaatttagattattcgacccaagtttacttaattgtatttacttagttgtagatgtacatagtcctacggtcctaccacaatcgcacatcaccccatgcccagacactaacatgctaatatgtaatgactccagatttgagtcctcaaaccatgatgtgatatctaaacaagagaataggagcaatagttcctccctatttttaaattatccaattctccaaagtagttatttagcaggacactgagggctgtgagtgcaagatatggtctgttgtctatatcttttgcgtatgttttcagttttgttgctaagataagataataggatttggtgatgggacaaacggttgctccacataaaattatagattaccagctgattcaatgaaaaaaattcacataggttttaccaagttatagtatatatagatatactatgccattaatcctcatagatgaaaagaccccttagctgccaatgcaagagtgcagggccttcaccattgacaaaaaactgaagttgccctaaaatttttgaagttgacagattactattctattatcatgcatgactttaacgacatagcacacactttgagatggatcaggatcctctgcagtcgaagtcacgtgactttgtcactaacatttgggcttgatgatccctggacccacacatgtcagtgacaaaggcatcatacatttgactgcagaggatctcaatcccattatattgaggtcatccaattagagacgtgacctaggacaacccatctcagtcacaattgagtggaccatatttagggaatttaaaacagaattatttattcatgcttgacactataaatatagccattgcgatgcgagcattaacactatacttcttttcgagcatatgatactaaggtaagtttatctgtattggacaatgtactacattcaattccttgtttgctttgttcctcttaataaaataagctacaaactttggcctaatatcatgtccctttgatatgtatagcaaaatcatgagcactgcacgagcaaatcttgccgcgctgtcgatcatggcactgctcttcttaggaattgtgattggtgatgcggctagagagactccgggaacatatttttctcttggtagaatggatggtcataatcctacagtggcttatggtgcaaatactcactcagacagtggggatatgaacaaaggagagaactcaattgcaggtcattctagtgaaagaaaactagggaccactacagatggagcacgttttgaaacccttagttggtattgcagttatatcgggaaaaaatgtctgtagaatatatgtatatctagccagtccagtcctagagtaataagtgtggcagctttctttcagtacatcgctatactataatgttgaaataaataaatctcttggactgttggactgtaaggcatgtatgctgtatttacatgtactgtaaggcatgtatgctctattttcaaatcaaggaggcatccttgtagaagttgaaatggaaaaagtaataatataaattaacttacatgtggtaatcccaatctctctagtttctggctggtatggtgttggtgtgtatatattgaatgatttgagcgacataccatcatcttttgtgtagcatcctacttttcctatggtgcttatgattgtgtgcagctgttgatttgattgtgcatgcatgtaggaacagtagaagcctgctagcagtgaaattcgtaataa

SEQ ID NO: 63174 - DNA, 3050 bp, Oryza sativa
ttcggctgagggagccggaggttagggatggccccgacaggtggggcccacctggcggtggctcggggggaaggagagaggaggacacggttgggggagaagatgacaggtggggcctcgggtcccacctgtcggagagagagggagggagaggccggctggggaggcaaagcagacttgagggagagagagagccgagcgggccgagggagaaggccggcccgagagggagagagggggggggaaattgggccgaaaggggcccaaagagaggagggaggattttatttgttttctttttattttaattggttaaatgatcttcgtgactttaaaactatttctcgagctccgaaaattcacggaaaattccggagagtacattagggcacaaagaatattacaaaatattcccggccaaagatttttaagggaaaattttaattctcccattattttacttgattaaattgctttaacttttatttaatttccagaaaatgcattattaaatgatttttaatcccgaacgaaaatcggggcgttacaaatctaccccccttacaggaatctcgtcccgagattctgggatggctagaaagagggctggcactggcggtctgtcttatctgctgacacatgctgtctctttgtcacgaccggaaataacccaacgggcattccttacgtgcgtgcattaatccttgtcccaggaggcaaggtacaccaaaagttgatacaaatcagagtttaacaagcggaagcgtaaatagttaacttaatacatgggcagcgaaggcccagcacacacagagacaaacgagaaacagcggaagactaaggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacgagggaattataccatagaggggttagggttgcagtaaacagcatttaaagacatttagttgctcaaagctattttgtaaacccgatcctagaactatacaatgttattaatcaaggccgtgaacccacacgaacctgccttaacccaaggcctacgatgattcagaccgaaccggcaacccgaccctgggtcccagctcgtcctaagccaacccaggccaaccattccacattttagttgttaagcaggttttaagaattaaaacactaacttgggtacattgctcggcttgcccataaccgagggcgcggctattcgaataggttttactctgatcagaggtgtacatctttacccacaagacacgtcttcctcatgtgcagccacgtgccacataccaccacggcatatggacggaagacatgacatagtttccaacccatcctagccatagacaagagtaccgacccaaccccacctatagccggaacctccgggacaggtaggcaggactgagcccctagcagcaggacaccagccctgtgccatgacatctcttctaccgggccgcagcacgtgtagccttcatttgtcctagagatgtccatcgacccccgacttcgtccatctccatccgtgtacttttgtttataaccagactgagccacaaactaagccttacccactagccatgtggaagtacgatagtgctttgcaacagaggcccgaagaccggtccttatgtggccgaggtgctactatcaaaaccatgcaccccaagcctagcctaaaaccattttgagagttttgaatagaggggaaggtgtgcatccagttccacaataatccaaccattccataatgttcaagtgatatgaataccccaaagtctagaattataaaatcacctaatgttgcctaaataataagcgaagcatctacctaaattcagactagtggaaccatgagtagagtgcccagtagttggggttttgtttattctagggtgaacaaggtaataataacaatgacgacagtaaggtcataacaaaggtaaataggcatggctaattaaaacagtgataacgcgggaatttaaatgaagcgataatgcattaatttaaatcaaaataacttcgcaaagtgggatccaatatgttcaaagatgatgtgacttgccttgctcgctttcccaaacgtcggcttcaacctccacgaagagcggatcttccgaagctgcagcgtctacacgaccaatggaaaagaaaagggcttttactctaataaactccacataacaagcaggaacaaagcacaaaaatgggttcttgacttcttaaggaaaaattagagacttgaacggtccaattccgagttcaaatggccaagttatggccatttgaagtttatatgctctttaaatgaatatttacgaatttcttcatttaaattttaatttaaagggtttattgcgtcagccgggggagagggacgcgcggaccgggtccacgggagtggggcccacgcggcagcctcacagtccacggtggaccgggtgcacctgggctcacaccggcgggcgcggtgggccccacgcgtcagccgcacccgagggccttggcggctgacggccgggccccacgcgtcagccgctcggcgggaggcggcgcccgcgcccctatggtcgccggcgacagccataggcacggtggagcggcggccgagagaggggaagggaagggggaaaaaggcgacggtccacggctcaccccgaggcgacggcggcgacggaggaggcggccggagcagagggaggcggtggcgcggctcgggtcgacggggtcggcggcgttccggcggtcggcgaccgaaacggagaggtggacgaggtcggcgaggatgcggcgccgaggtgggaggcggtccggggcgacggcggcggtggaccggagctcggcggcgacggcgcatagagagagcgacggcgcgagctcgattccggcgtggagaaggtgcggcaagtggcggaaacgggggctgcagga

SEQ ID NO: 63175 - DNA, 722 bp, Oryza sativa
tcatttttttttaatccacgattccaacggttgctgcaactcaaacagaaaggtaaatgtcattgacatagcccaaaaatttttagagtaaaacatacgtgataaaaaaaaagatgagcatcacaacaacctacatgcagccatgcagactgtttctcaactaaaaacagatcgagtttgaggctggaggtgcatgtgtctattcacacttgctgcattagcactgcaaacatttgaatgtaaattaaaatcttaaccacaatttattactaaagtaaccaaggacttatccactgcaatatggattgtgggtgcttatagcactctgcttacccgttattgattttgttgatcgagcgggcacgactcggtgtcagagtgcttctagccttcgaacatggcgtgttcgggtatctgatccgtgccaacgatgccagtgctgcttccatccaaaccgtcagctctgcaaccaaaaggaaaataacatcaaagagcatgtataagagtctcattcagcagaatccaaacgggagtcgggcggcgcaagggggcggctcaatttattcatccaaaaccacgatctgaaaccatacatacatccaccatgcatgaccatgttgaataaaaaaggactctaataagctggatctgaaaaagaaagtaatgaaagtatttatctgctccggaggtgcaagagcaagatagatgcaaaagtatacacc

SEQ ID NO: 63176 - DNA, 2667 bp, Oryza sativa
cgggcagggcggcggaagcggcggaaggaaggggatgacgggggggccccacccgtcagcgagggtggggggggggcccgcccgtcagcggcgcgcgcccggggaggggcccactgggctgcaggggaagaggagtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacaaaacagttaagtaattaaacaatattaagccaacgctatacaacataccctgttgtataggcccaaccattctgaacaaccaccccggctgcacagttctatctccaaaccaggaatgtaccattccaaaccaggagctaatcaaattattaccagttatagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccattgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagctatcatgaaataatagtgagtcattagttatcccataagtgtactaatgtttctaagcagggctaagcaattatatctaatatctagttgaaccaatataaataaagctcaactagtcaaattataataacccaaggtatcaaggaataaggtaatcaagaacaaaagggctataacaatcaataggttaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgtgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcgggctagggtttggtggaccggcgcatgggcggcggttcacacgaacggacggccgagattgatccgatccaaatcggacggccgagatcgattggtccacgaccggctcacgggagaggatcccgatgacgtcaacgatgacatcaccgacgacggcggcggctcggcgaagaagacggctcgggcggcggacactcgtcggcgaacggcggcaccacggcaccaacggagggcaccagcacgtagaggacaacgcggcgaacacaccggtgaccaaaacaacggtggagaagcaacggacggcgacggcgacgagaaggaagcggcggctaccttcgggttgtcgacggcgacgaagctccggcgggttccgacggctgcgaaggggcggacgaggacggcgacgacttggcgacgacgacggcggtcttcccgagtgacggcgacagctggagcgacggcggagcacggctgaagcggcggcggcgacggcgaagctagggcacacggcgctagggcttttccgacgacgagaggcgaaggcgaaggtggcgacgggtagaggagacaccgggggtccttttaaagggctcggaggcggcggcgaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccggagatcatttcccctctattgattcggccggagaaggaaag

SEQ ID NO: 63177 - DNA, 10403 bp, Oryza sativa
gattcctttttttctgttattggagtataagtagcagtagctaagtttccatttgtaagttttacaattcagtttgaatgaaagaaaccagaaaattgccccacaaattctctctctctcgcgaagttctgaaactcagtaaaactttgctttctctgttctgaattccttttctgcgttcttcagttttctcgtctgttgccgtgcccgacgtatgcagtgtgcgcacacggtgttcgatcgggtgactcgtagctaacaaatcttgtaccagttcgtgctatttcttcgtttagtgatgcagccatgtttatttgatttgtgtactaatatttgcaacaagagaaaattaacttgatggcgctacttaacttggtggcaagtacgtacgtattgaacaatgaatagctaaaattagattctgtatttttgttattaattacttatttcattttatgttgcaagaaaaaaatgtaatgttagtacttactccctccatctcaaaataactcaacctagcaggagatgtgacccctctagataaaggtagtccagattcattatactaggagagatcaaatcctctcgtaggttgagttttttttgacggagggagtaattagtatgaacctataagtagtctggccaaatgattgagaattcgttgtcaagacaggaaaataaagaaagctgtcgtgatttccatgcatatcgccgtcctcatgttcttcacccaaaaaggcttagaaatttggaataacaaagcatgtttttcttttaatacgctccatgcgtgacagaactttagaatacgtgtatattttcaataaggtcattgcgtaattctagtaggagtgtgttgcagaatatttacaaatactgtcttatgcttgtcgtttactctgacatgtattttatccgacgacctgttgtatgtgtgtaggcggtctgtttcactttcttgcataagacaatcatgttcttaagtttcaacacactagaactcaaagatccacagttttgatgtgttagtcttaaattaatatttgtgttgttactgtggtcgttaccgagtattagctagtgctctaccttctctctaagtagaacatagtctaatttaaagaacttttttttttgatttttttgtttttctttttttttacccaaaatactactaggcaccgtccagtagttttaatttaaagaacttttacggggtagtaacactataaaaacgatttcgtgtacagagactttatattgcagacggaccataactagtcgcgtctgggaagataggctcattttcgcttgcggtccatttatgaggaccacacggttcgatttttccgtgtggtcctcttaaatggaccacacgcgaaaatgaacatattttcgcgtgcggacctattaagagagccacacataaaaatacccattccctctttccctctttcccactttaaatcttctcctatttctttcctctcctctctatctctttttctcctcactccccttcccccgcacggtgtctctcatctcctcactcctccctcctctcctctcctcccgacagcggcggcgggcataggcgatggttgcgcacgacgacagtggcaacgcggcggcggtgggtgtaggcgatggcgcgcggcggcctcctccacgcggcggcggccgaggcgcgggatccagcgggcggcggccaacccccgcacggatccggcgggcagccgccctccccccacgcgggatctagctcccctcccctccccttccttccctcctagatccggcggaggggaggggcgttggcggcggtgcggccggaggggagcgcggatcgggcggtggccggcatggaggccggcgggagcacggatcgggtggtgggtgtcgcggaggcagccgctgatgacgacgagggtgggagcagcatcctcggctgacgatgacaacgagggcgggagcgacgtcgtcggccgacgaggaggaggcagcggctgggagcggcgttggcgctgccgattctaggactttcaacttttttgaattttttcagatttttgtttttccgtgtgggcgatataagcacccgcacgcgaaaatccgactttcgtgtgcaggtgccaaaaatcgtgatttttcatacccctgggtgcgtgcgggccacccactcgcacgcgaaaactgattttgaccgcacgcaaaaatctttctcgtagtagtgtaatcggtattaggattaattaatttgtctcctgatgtaaatgtacaggtaaaattatctttccatgctagtatttggtgatggcaattctgtatattttctcctctcaatcccattccttattcttgttatccttcaccacggcaaggcgctgctagccatcatgagttcacgtacgccgccaccaaccattacaatggaaggactaagcgcacgaaagtactaaagtaccatttttaaaattttgtgataaatttctaaattgacattatactaccagcatatatattgtaccgtaaaagaagtcggaggtttgtacgtactgcagtaaagtatttgcctttagtgcaaaaatgcaatgtataacaataattggtgttagttgtaactgggaagagacaaattattaaaaaaaacataagtacatagcaggaagaactagtaggaccgaataccgatcaactggatctattccggtacgaaaatattgcaagagagatataaggaaacaatagcataattatattgaatcatctttcaatataatataaattggcttgggaggcatagggcatagggcgtgtttggttagttggaagattgctcgcatgtgcggatacctaaggaggttgtttggttgcctgcacaaccattggggcctagaacctcatgtgagaaatggcctctatagctaggccctaaaaaaggctcaagttgagcttctctccctatctaggctgggctcgtgcaggtggcgtgacatgcggtgcaaaccgtagatgcaagaggatgaggggtagttttaaaggtatgaatatattcaatattaaactcatttttatatatttaaaatggactatggtaattcaaatggttcttaaaactaacatatggtttaaagcataggtttgataaaagaacataagaatcatgattggtattggcctctataacatgtggggcctcttgatgcttttaaaatattcttgcatgtagttatgttgtgatgttagtattcttaacacggtcttgacaatcaagcgtattgctcacttagtcgtaccgatgaaaatacatcacgcgataagatgataaagtgcacacatttactatattaatatacgaaaacgtttcatgttttaaacttgggaccttgtacatatgttatgtaacataattatttttgacattaggcaaacattatattacccggcttttagaagaaagccaaaaaagaaacacacagagccttgttacaggaaaaagaaaaacaaaaatatcgaaacatgaattcaccaataataaaaggggaaccacacgagatctaaaagtggatggatgcggagacaaggatttagacaggttcagcccctctcaatgagaggtaataccctactcctgtttagggatttgaatccgccgggtgtagtatagatctgacgatcaggttgtgtcaggccccctagagggcctcctgcccaccttatatacgatgggggcaggattacaagatagaaaccttaaccaatatggcatcggtttcctaaatctaatttacaatattatcaaaccaggactttaggctgtttcataatatacaaggaaacataatacccaagtcatgatccgttacatatttgataggtataagctatcccctataaccagtcggataaccatgccgtgtgggtatggggtacccataatctctacagtagcccctaagaccttcacagtcgaaagataatcttctctcaaaccagattactccaaagccgagtgcttcaatcatctttgccatggtctcctgagtacttttaccaaatctgaagactgtggagggctgaaaaataattaaatgtaaacttaggtgcatcgactagatgcacctaataggtgtagcccccgactatgtggttagttgaacaaactaagcatatagtcaaggagtaaataatccaaccaactgagtggttttgataattatagtcaaccgagtgacttgatatcaatatacagcatatgcggtgtgagtctccgaataacatgatccgagtgatataccaactgctttgtaaaatacgatgcgagcaacctaaagttgtgtacatcatgaaaaattcacatagcaaaacagctatagaagaagcttatatgcggtgaataaagaaatttctaaagtattgggcatacaccatgcgcacactggtttaacaaatgtgcttaagtctctaaaagacacaccgtttcaccacacccggaaatatatggcatacgtggtgtaaaatccaagtaaataaactcataaaggatttaccaaccgcctggaaaatgaccaaatatataatcagcctaagccataatattggtcaataaaaatgcacacttacgtggcaaaaagcaatgatattgtatccaatcaattgctgtataaacccaaacagcgccttgactatatataaaaaagtcagcagggcagctataaaaaacttcactattgggcaccttttaaaatacattgtaccaactcctaaaaagttgagtaactgtggtataaaaggattttaaggtattgggcacttgatcacgcgcactttggcctaagcaaaaagtgcctaagtccctaaaagaacgtgacaggccacacctgaaaatatgggctgtagacatattaggcctaggccaaaaaatatgccttcgacaccctttaaaggatgacgcatgtaatatgctcccgagtaataaatcttccgagtgatatagaccaagtatagctcatatgaatagcttctgatctgagtgattatcccttatgggatacttcaaaatagatataaaagttgaatcccgactggtgcaagtattcggttgatagcccttacggggaataacgaatagtccagacgttgagcataagaaatcgactcacgaccataaattcatgttgaatgtattcggaacaagtccaaattgaagatataatcctcgcgcttgtattgatgagcccctaagcatgtagcttatccttctgttgtagtcacaattgtccattgatagtggctgacgtggtcggcatggagacgaaatgaccaacatgaagatgatatcacccatcaaagctgacgaagatgttggtagtggtaaagacaatgacacaattcaaaggtgatgaagtcgcatagccatgaaggcgaagaaaccagtcggcagcaaacaattcaaccagcagtgaagacgaagcacccagcaatggcgacagagttgcgcagccatgacagcaaaataatcagtcgataacagacgaggcacctggtgaagaagacgaagacgcctatcagtagaggcataataagccagccgtgaaagtgaagactccatgggcggcggtggaggcaagccgagataatgacgattagcagcaacagagatgataagctgtgaagatgaagttgccaatcaatagcagaagagtaggctatgttgaagaggcttggcaagatgttgatgaagatgacaatgtcattgatccagtcaatagcagtgtagcagccaatgataataaaaatgatgctcatcagcgtttgtgtagtaggtcagccgtgaaggcgaaataataagtcagggccgatgaagcagaggtgctggtgattatgtcagtgacaataatccatcaaattgttgagaagatattgaaactcgagtagtttccttgatgcgagcgtgtgcataatgaagactgatgcaacaccctttgatttataaagatggcagtagaacttagagttgtagatgttgcagatgcttcacttgaaggaaagtagaaactgttgtccaactcgttgaatctgagttaattggttgataactccaacctcccgaatatgtagattaaatctcaaacttgatacttgagaaatttgaagtaaattgtggcggcatgaagaagccaaaattttggtgaaataattgaagttgctgaagtagaacgtctgctccgaagcaaagacgaagaaaatgactcattggctggttaattgattgtttcatgttgagataacatctgtcaaattttgagagtcttgtatttgtgtagcccctgactctttggttagttggtaaacaactgaacatagagtcgagaactgtagcttcttgtcgtcgagtagtcattgcttgagtgaagatatgtgttgaggatgtccgagtagaaatattgaagattggaacaccacttgttgtagtaaaataataaggcatcatatttggtgacgcatgccaagatgtcgaaactcttgtagtcgtcgtggttggtgaagtagcaaagcttgcgaagtagaggcaatagagtttgtcggtgccgaagacaatgaagatgaagtagctccaccatggtgacaaagttgcatagccatgatcacgtagacacaagtcggcggcacaaaagcaaaccagtacgaagacgcacgtgaagagagaaacaccagtcggcggcggcttaaccagcgatgacgatggcgccagtcaatgatgatgaagacgcacagccgtggagccaaataaaccagtcggcgtcagacaaggcggccggtcagtgaagacggcggcataataggccagccgtgcaggcggagacaccagtcggcggcggcgaaggcaagccggcggtgaagacgtagacgcccaataacgacggcataataagccagccgtgcaggcgaagactctagtcggcggcagcgaaggcaagccggcggtgaagacgtagacacccaacaacggcggcacaagaggccagccgtgtaggcggagacaccagtcggcggcggcaaaggcaagccggtggtgatgttctgactgatcacttttatgcatatctggatctggatcctacagaacaaacatatatgatgagtagtatctgatgtaaatataatactcgagaaaaattcaagtattttaaaatatttataaatatgtatttcttctcttgtcaattttgatttccccgagcagatgactccttacgtttacacactctgcccgactagtcatagcccccgagcactgggagtcggcctaggcacttcccaaacatgcatatgagtgacatgagttcgtcattaatggaacaaagtttcacggatcggagtttactactcaggtacttttgcaattgtttagagcagaaaataaattatcttatctctatgcttttgatttattccgagtaatacttagcaccttgtgttactcggtccatccaacgagcccccaggtgctaggaattggcccaaaggcaactatccatcggcaaaccaaacggaaagcataggaagatagaactccataactcaataggcacttttgtactcagattatgtcgcaagcaatcaagatagatattatgaaaattgttgaaaaaatatgatataacatctgtagcccccgactcactagtcaacggcgaaccagttgacgtagtgaggcagaggaaaaggaaaatatcatataaaggaaattaatgatgacttagctttataatattccccttggtgatggcagaggtggccaatgtgggaacaaagtcatccatcaaaaacaatgaagacaccagtcggcggcaacgaaggcggtcgacggtgaaagcgaaggtgcccatcaacggcggcataataggccagccatgtaggtagagacactagtcagcggtggcaaaggcaggccggtcggtgaagacgtgaacacccatgaacggtggtgtgaccaaccaacagtataggcgaggacaccagtcggcgacgacggaggcgagtcggcagtgaagtcgtaaacgcccaacaacggcggcataattggccagccgtgtaggaggagacaccagtcggcggcgacgaaggcaagccggtcgatggagaagtggacgcccatgaacggtggtgtgaccaaccaaccgtataggcgaggacaccagtcggcggcgacgaaggcaggccggcggtgacgtcgtagatgcccaacaacgacggcataataggccaagcgtgtaggcggaaacaacaattgacaacaatggtgccgtagcattacatgtaaacaacagaaaataccaagagattaatatgacatttagagatcaatctaaaacaacaataagttgaaaggaaagaaaccgatgaattgacggttctagttgtggccgtgacgatatttgccatgcggtcagctcaaaagaagtccatgcaaatatatgcgtgattatatagtaaattgtgcacgttgatcgatggatcaactcatgcatgtattcactccaggaaaatcgcagggaggacgccttggcagcagcaccagttgcagcgtggaggctgccgtggggcgcatcaggcgggtggattgatctgatctgctcgggagatgacgtcatgaagtcgaacaagctgcccacgatggtccttgtttgatacggagtacatgaatacatgccaacaaaatagccaaaaaagcattaattaatttgtaattagaaatcaatccaattagcaatagaaaattaatgatctggatataattaaggtgcatgcgcgcagcatccatgtaattagttgatcaatctggttagcagcaatccaaaatcgatctcccgtagagacgtatgctaggtccaccaatgcatgcttgccgtcagcgaaagggccaatttgcaccgatccgacaagcccggctccggcctccatggacgaagattccggggtgggttgctcccgcaggaaaatcgcagggagacgccggggcagcaacctcttcgtcggcgatgatcggcatggaaatcgcaggcggcgcagcgtggtcgatggctgctgcgtttctttttctcctgataggttgttaccagcgatggccaccacaaatcagttggcttcgacgatattgaagattggttccatcgcacttcttgatagggaactcgacgcactgcgcgccaactgtcgagacatgaattcggcaataataaaagaggtagcgtacgagacctaaaagtggatggatgcggagacaaggatttagacaggttcagaccctctcaatgagaagtaataccctactcctgtttggggatttgaatccgccaggtgtagtatagatttgacgatcaggttgtgtcgggcaggattacaagatagaaaccttaaccaatatggcatcggtttcctaaatctaatttacaatattatcaaaccaggactttaggctgttccataatatacaaggaaacgtaatacccaaaacatgatccgttacatatttgataggtataagctatcccctataaccagtcggataaccataccgtgtgggtgtgaggtacccataatctaaaaaaaaaaacacagaaagctaggatcaccagcaaccatccggggcaccgagacttatggatcctaaagaacgaaacaccacctcataaactcccaggaacgctaaaacatctacctcagcaaccataaggaccttatagagacccttcttagactagtgcatcgacaggcaacacatccttaggtcgcagatcctccaatttgcgcttcatcttgtcaagcaaggaagacagagcctttcgatctttttcttttaacagcaacatccatctctgcatcagcgaaatgatcctgaacattgcctgcaagggggacttgatcaatttgttttcaaacacaaaatcattccttacaagccagagcccccaacagcaacttgcacaaacgaaaagacccacattcctccctagtttttctttaagaaactttaccccatcccaaatggtagaaggagcaagccccccttcaattacttcagttatgagaacccaaacaaacttagctagaggacagttaaaaagtacatgattggttgattcaatgtccaggcaaagcttgcagaatttatcccccccccctttccaattccttttgacaagaagatcagcacaaggaattctatccctcccagccaaaaaaaggaaatgtttaactttcaaaggaactttgcaaccccaaatctccttcatatccctgtctacaacacccccaaatttcatcaatctatacatagacttagcagaaaacgttttgtttttttcatgaggccaaaccacagagtctggagaatc

SEQ ID NO: 63178 - DNA, 1220 bp, Oryza sativa
ttctcctctaggctttaaaatcaattctaataattccaattaaacaacaatttatatatttgggatttttagggtgtgacaccatcgtcctccgtcgctcgccatcgtcgcttgtcgtcagtgaggcacctcctcctctttctctctccctatctcccgcgccgtctagtcgtcgcgtcgctgcctagccgcttagccacagccagtgtcgccgcgccgtcgcaccgccgccgcttgtcgtcggacgccgccgtctgccgcgtcgccgtcccgcggtagcgccgccgtgcgccatggtcgccgggccggctcgagccgcccgtgcgcgccggccgcgtgctccccgccgccgtccgatctaccctcgggtagattggggccgtcggtttggccacccgcgtggttgccgaatgtgcgccgcgtcggcgccacgtgtgcaccacgtggcgcgccgccccttccccggtccgtggactcggtccaccgtgaaccgccctccccgagtcgttgccatgtggggcccgcatgtcggcgccgcccctctctctcccgggatttatttattgcgcaataattcaattaaggatttttctgtttatagtaaaaacacagtgaatcttctaaaattcatatctaattcatccgagctccatttaagcctattcaagtctcagtaaatcaagaaaaatgtgtagaatccattaaaaatagttttgttctctgtttcagtagtcttatagcctgtttgtattgtttgctttgtatgtcgcttagattccggctctcctgacgctccgttgtactttgaaatagtcaccgaggttcctccagcagcagtgcaaggcaagtcatgcttgtcacttgaacatgttgatcctatattgcaaatgctcttttgtttccgttcaaatactgcattgttttataatattaccatggaatgtttacctactgttatagccatgctattttggtacgatgttcctttcttagcttgggatataacatgactagaggttggactagggattgcttagccttgcttagttcaactagcacacaatgggggacaacattaatgcatagatatcagattgtagaaatgatgttggttaatgcccaccgctccggtgttggttaattaaaatatattaaatggtgggctgtgggtgcatggttttgatggtcgcgcccatggcaattaaggaccggttcgcggg

SEQ ID NO: 63179 - DNA, 5467 bp, Oryza sativa
cggattttcgaaaaatttgttcgttagggtcactgccatatcgcttaaataagcgaatgcaaaatactcgcagatgagattggccccgatggttggactgtagagaatactgttggtatttcttaacatcattactagaaatataattcccagcaatggcgcagaaatactcctggtatattatggttacagagtttatccgcaagtgcacggatataccattgtagcatttcacccgagagtattccaagggtatcgtatttattttatcccgtgggaagatcatgtagagagaacttgactaataatttatatattacttgtgataatcatattctaagcaagggttaagataatccaagggtagagtgacacacaagcattaactactcattctcataatatatcatctaagctaagtggaaagaaaagagaaagaaaatctattcatatatttctgatatacatagtatacatacattctagttaactgatatactagctaataccctctatctcgatgccctcctggtacttcgagaagccacccctgactaccgagttccttacgacagcccgttatgaccgtataaccagggcaaaatacggaagaataccctccccagggaatcaacttacgattatataccggcacggaggaacacacgtactgagctgtcaccatcagcggcccacctctcatccgcaatatataaccccaaatatcatatcccgtaatctagacaccatgtctaaactaccagatactactctaatatcatcgttatggcatagagtaattgcataagcaaacactatacccgcagcaaagcatctcccagataagatagccgtatattcagtataacatgaacataatgtaaagtaggtactcatatactcggaaagtctttcaataccataaggccctctttgtttaggcttaggcttattggcccagacttttaagtcagcttattggcttatatgatttataagccagtggatttaatgtcctaagtttagtggtggagtcatacatctatctcatataagccaaaaaagcttctccaacctagcttttggcttgatagtgttagagtggcttatagcttcaaaaaagccaaatgaaaaagctgcttgtttgttttcgcttagactttttgacttataagttggcttataagtctaaacaaagagggcctaaatgtatttagaagagtattcaagtaaaagtacaaagcttaccaaaagagaagagaaaagctactagagccatacccgaacacttccgaaggcttccgggcttctgatttctactatattcctattccaccagctagatactactaaactaaacttgagagaaatgagagagctattgcttgatgtgtgtgagtgatgtgagaagaggagctccttttataggcaggtaatgacggttgtgacggttggaatggtcggtaataccctccaatcgtcattggggatcaaatccagccgtccatccaaaccctgcatccatcggcgccacgggaggtttggccggccaaaccatgaactggcccaacccagcccatcttcggctggcggcctcctttgttgtcctcctcccatctgcatatcaagtgtgtccattctcctagtgatttcacccaagtcccaacgagaggaacttgagcgccattcacttgaagatggaagcacaccacttgatctggaaggttgattgtccccccattggatgtcatgaggcgcacgccaccggtcctcactggcacttgcccaggttgagaatccaatactgtgacgtggagcatgggtccatccgggtgcatccccaattggctcccaacctgcctcatacatctgcacgggtgtgaactttctcgttcatttcttgtcatgttgtgcgtctccctgtatgctccacctgcgcgagattcttctatggtctacaggggaatggttagttcatggcagttgtacaaatgataccccgcatttggcaacgggatttcatttgtacaactggggaaaaagtaaatcaaagatccgtctactccatttttcagaatgtgcccttgcactagataagcctcatcaatacacggatgagcggctgagataaaagcaatttggtcgctaacgacccctagcccttttgctatccgagtaatcagagaagtgcactcaacaggaacagagaactttatactttctaaccattgccttatcatacatttcacaggagtaatttggatctttctaaccatggcaaacatgataatcaattcatctgccctaatgggcctcagatcacctctaggaaacaaagccatatcaatcgatttgtgcatgagcctaagtgtaggattatggatatcattcgttctaggtttcttgcaaattggagcaccataaatatcttcccaaaacctaattttctcgaacccagaaattcctttctggagatcgattttacaggaatcgtgaaaatcaagaagtgtacttaagcctttccatgtaagtgtaaactcttcacggaaataacgaaaggaaattacatcttctatttctttcaaagtgcacagaaattgtaaagtaagcagacgagcaccaggctcatctaccacagcaaatctctgccaaccaacagctttccaaatagtacgaaattcagcatccatacctatgttttttagcagctccggtgagtattctcgcgtgtgagcatactcccggtcattcagcatgtagtagtcttgtctctcccgatcactgacaaggtcgaggtcggtgtcgtttaggagtcatcgcggagcttcggcgtcctccatcgagacatctgctgatgaacaagtactagactcatcatgatgacttgatgaagagccggaccccttgaacagacgagacagttgtcttctcattctgcacaatggagcaggaacggactaactcggcagaggttagtaatgacaagaatctcacccgccagttagtttcacgaaagcaacttgtatatatgcaactagtgtttgaatttgagggaaactatcaaagcttgaatgaacttgagagcaaactttggagagggaatgaaaatgtgttgaaatggggtggaattccctctctcggccggttggcttaagtagtgcacccacacggtcaaaaccgacctgtggggcccactagccgttgcctcaaagaaggaggcagccgaccgttggcctcgctggttcggccgaacccacagtgggcccaaccaaccccactttcggccgttgggttccaacggtcagtgtggttgtggcacaataaattttcactgaaaattttattttggtttgctctgaaaagttcatttgaagaatttcctaaaaattcaaaaatcctaaatgcaactttgaaattcaaacatgtgatgatgcaaaaatttaaattgttgaaagtaaatatgcggatacataccaatcaacctgttggcgaaggtcgcgtcatttaaagtccgacgtgcaagactatacctccatccagttcagtttgcggattttctacccgtctctggaggtgacggagcgggcgtctttggcttctccctccacaccttctttggttttggtgcggacagcggcttcttttgagccaactgcttctagcttcctggccggtatgggtggttctaccggcgtcttccaataacggttcgtaggcattgttgttttcttttctaggaaattctgaatgaatttcaccaggctgtctgttttaggtggctccacttcgacctcttgaatattctatgggttcggcccgtactttattctaaccatggagcattattccgtgctcagttgaaactcaaacttctcttccttgccgttgatgtggaaatggatactccccgttcccacgtcaatgttgtctcctgcagtgctaagaaactggctccccgggatgaagaaatctcgtatcttgactggcacatcctccgctatccctgccaggtaacggactgacgaatcagccagttgaaggcgcattggtgttggtgccaacaccgtgaagtagagcttgtcgaagacgtcttttggcatgacgctgacactggcaccaaggtcgcacaaggcctggtcgaactgttgtgccccgatcgagcaggtgatcgtaggacaccccggatctttcttcttctccgggagcttatggagtatcacgttgctgcattgttccgtcagcttgaccacctccgttgttgggagtggtctcttgttgttgagtatgtccttgagataacaggcgtatgttggcacttgcatagtgtccaacaacggcacgttgatgtggatcttctagattacttcaacaaaacgagcgaattgctcgtccactgacggtttcctactccgttgagggaacgatagcaaccgtgtgtcgcagtactcttgcggcactgtcttttctggcggaacttccttgccagccgagtcattagatggcacttattttgatatcccattagttcctacagggttaggatatggcggatcacgagtggacttacctcccctcgtcgtgatggcccttattttcaatggaggagtcaggttgccccgggatcctcccagtttgatttgcagggactaaggatgccaactgagctagctaggtttctatcattttattaaagcgcaactgattttgaaaagcagaagcaaagccatctaacttgacatatgttttctaggaccttgtcattagccgcaagctttttgcttagcgcataggtggtcttagcttgcgcaaaaacgagatccttcaaggaggactggttattaccgttgttgttacctccttgataatatgggcatggtttgttccacccctgacctccttgtggacgatacctgttgttgttgttgcccatgtacatcgcctcctcacggctttctgggcagtcattcccaaaatgacccgtgttgccgcagacctcacatgtggcgtgagagtccaaggccttgacggtgccttgcggccgtttctcgtggtcgtccaattgcttcatgaggaggtccagtttggcagcaagtaactctgtctccttgacggtgtgcatggcttgctaatgggtctgtagtcgttcctcgctccaacccatattggagaccatcttctctattagatcaatggctccttgaaccgttttagagaagaacgctcctccagctgccgcgtccatgtgatcacgggacatcggggtgagtccattataaaagttctgcgggatcagccagtcgtccatcccatgatgaggacaggcggctacgtactcatgtagtcgttcccatgcttccggaatagactcatcccttgtctgctggaaacttgaaatccttccacgaagggctttggttttgcccatcgggaagaatttcgagaggaatgtcgtagagcatttgtccca

SEQ ID NO: 63180 - DNA, 1745 bp, Oryza sativa
ctatataaacgctccccgagctccccacctccgtttccgccactcaccgccctctctcctcgccggaatcgagctcgcgccgtcgctctctctctccgccgtcgccgccgagctccggtccgctgccgtcgtcgccccggaccacctcccacctcggcgccgcctccttcggcttcgccgcatcctcgccgacctcgtccacccctccgtttcgctcgccgaccaccggagcgccgtcgaccccgtccacccgagccgcgccgccgccttcctccgctcaggtcgccgtttccgtcgtcgccgtcgccctcggggtgagccgcggaccgccgcctcctttcccccttccctctcctctctcggccgctgctccgtcgtgccggtggtcgccggcggcgaccatcggggcgcgggcgctgcctcctgccggccgcgccgacgtggccgcctccgggcgcgcctagcggctgccgcgtggggcccggccgtcagccgcccgcgccctcgggtgcggctgacgcgtggggcgcacggcgccggccggtgtgagccgggtgcacccggtccaccgtggaccgtgagactgccgcgtgggtcccactcccgtggacccggtccgcgcgccctctcccggctgacgcaataaatatatttttaaattaaaatttaaatgaagaaattcgtaaatattcatttaaagagcatataaacttcgaattcggaattggaccgttcaagtctctaatttttccttaagaagtcaagaacccatttttgtgctttgttcctgcttgttatatggagtttattagagtaaaagcccttttcttttccgttggtcgtgtagacgctgcagcttcggaagatccgctcttcgtggaggttgaagccgacgtttgggaaagcgagcaaggcaagtcacatcattctttgaacatattggatcccagtttgtgaaattatgttgatttaaattattgcattatcgctttatttaaattcccgcgttatcactgttttatttagccatgcctatttacctttgttatgaccatattattattgttattgttattattattaccttgttcaccctagcttaaacaaaacctcaactagtggacactctactcgtggtatccctagtttaaatttaggtagatgcttcgcaattaaattagacaacattaggtggttttacaactctagactttgggatattctcatcacctggacactgtgaaattgttggagtattgtggaattggattcaccccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtctaaggctaggatgggttggaaactatgtcacgtctttcgtctgtataccggggtggtatgtggcacgtggttgcacgtgagaaagatgtgtcttgt

SEQ ID NO: 63181 - DNA, 10917 bp, Oryza sativa
  unsure (1)..(10917): unsure at all n locations
aaactggtaaatggtgcgttttttacaaaaagtttctataagaaagttgcttaaaaaatcaaattaatccattttttaagaaaaatttagctaatacttaagtaatcacgtgctaatagactactccgttttccgtgtggagaggatgggttcccaacctatcgtatcgaatgcagccttaataacacctcctgttgcaattgcaaccaccggtctcatcaccaagaaggtggcacacagtacatgtattcttaaccgctcccatgttacacatgccttaatcagctgacaaaagattaaaagctgtcatgttagttagccatttagctaaaaatatgcatattcctgaaaaaaaaaagctacaaatatacatagcatatatagctgtaacaaatcccaaccctactgttctaccttctattcttgttggagaaaaagatgatttttttttgaccaatccattggtggtcgacacattgagctctgcctccggcaggcatctatgacggtcaattccattttgaccattgcctggtgtgagtcctttaaccatggaaggcatattggtttgatcgaggttctgtaatgaaataatgaaataaagtgttttttacttggcatttctgagttctgatctcaaataaaagtttacagtagccctgtatccatttgaatgcttggaattgaatttgccacaatccttataaactttaattagcattgcacatccaacgattaaatttgattcttggtcatattgtcatcatccaaaatgtatgaggagtttgtgttattttgcaagttagcatccagttttgctatttttgagatagcaactgctccttctgtccacaaatataatcgttattataccatttgtaatttatccacacatataatagattttagagtactactcatatcactcaaccatccttatttaatttttgatacaaggacacattgttgatggatgttttttatttgaactatagagatagacatagcaaaactcattgaattaaagtagcaattctgaaatgcaacatcaatgcagcaaaaaatcagggcatttcaggaaaaaaataacctagtcaagcattaagtacttgcatttatatgactgtagaaaatctcccatcgtgcttattgccatggacaagaaagctttcatatcactgcaagaagaaagaaaaaatatcgccataagtagctgctcttctctctatgtgttcagatcagatgactagaaatacacccaacacataccgtgcatgtgttacctagctgaaaccatatcaaataatgcaagttgccatctctaggcatgaaaggagtcaggcatgtcgccataggactctattggagcaaaggtcaggtgttatcaattatctggacaacatgccgccatagcaggataggatatgggttgttcgatgctgctttggatgagtacaagttagcacgatctcccagtcagtgtaggattcgcaatttcagactcaattttgaaccaaatgataggtttttgtaggattagccagacagtttgccgagtctctcaatttggattttttttttggttgatgttcagcaaacaacagttccaaatctgaaaacgtgttctacatattgtaagagtggcattcatgcattggtcatggtcatgggaggcaccggggatctctacagtttgcaatcaacgttgcatctgcaagcacagcaatttaatttggctattgaagctacattagtgagtcccttcgatcaaccagcagaaagccagaaaagtacacagcaatttatatttccctgaacatgaagtaaacgtgcaacacacaaccagcaaattctttttcctttggcaacgcacaggcgactactggcagtactctggagtctggacaattacaactctgcgatcttaatttgttaatttcaatgaatgatgcagcaaggtataaaattctgttcaattatatgattagattattattattatcaatctaactgcgtctggggtcatccgtctaaactggatatggcgaacatcctcccaaaacagtttatgataagcatggtaatttcatcggattcaaaattttcttgatttggcactgtgaacaaacagtttatgctctgtttaggagcaaaataatctttaggagcaaaataatgtcttgtttatgagagagaattgctacatgatgtttcccaaaatcaagtgatggaaatatgccttttgatatcttagttcagccatcctaacaaaattaagctttgcaatcgttcgcagcactacttttttcacacacaactaacacatacagctttctcatgacaccttaggatcaacacacttgcgttaaacaaatacacctgatgaaatatttatcggaatattgctaaccttcgtgcagattttgggtcacttgatgtacttctccattagtgctccaagacttctcctctaactccggctacctcctctttccctctgacgccgacacccttatgtaggaccgaatagtaaaaactaagccaaccaaaaaggggtgaatggttgtagtagccaaaaaccgaaacatttagcggaattaaggccccgtttggtatagctccagctcccaactccaacttatctagagctggagctgaaatggtacagattctcatttttggagcggggttggcaaagctgctccacaaatttgtactacgagggtggagctggtttttctgctccacagctctactccatcccaaaaaacctactaccctttaatttttttaatgtatttacacaaaaatgccactgaactacccctaaacaactccttccattctctttcctcatattctcccatcatcgccggtgagactggcccgattcggcggtgaccggcagcgtgcgggctggcggcagggcgcgggctgctggcggcgcatggactggccgatggcggcgagcggcggcggtggcgacacgctggctgaccggcggggcgacgccaaccaagtgttcgacgaaatgactacaagggacgtagtggtgtggagctaacaagtttagccaagcactttcacacccacctcaactcctataggagctagctcctactagagttggagttcacagttagaagtcggagtttggaactctaccaaacgggacctaaaagttaccctcaactcgatgtagactggcctacccggagtagatgcgccgcggtctgaccgttcgatgtactccggcctgaccggtgtagtacctccggtctaagcagccaacacgctgcatatatttacttgccggtaggggacgaaattgacaaccctgctgggaagggacacaataacaagacctatcgccactgaatctgtagagaacacacaaacatgccacccatctatggcagagttacaaacatctccagggaaaacatggtacccaaaccgaagtcacccaaaggtctcatggatttcacacaaaggtcccatcagtggagaaaaaagtaggcccggtaaaaacgccctcaagtgggatcgtctctcatttccatggacacaaatgtattcacactggcggagaaaccgtctttactctcagtttgtaacaccctgtagtcccggttttccaatcaggactacgaatccgggattatagatcgctataatttacttgtatagtatcacacactaataattatataatataaatagaatataacataaaattaaacataagtataatataaatagaatataacataaaattaaacataagttttaagtaaaaataaattgaacataagttcacatatctatctattatatactaaaagtccattaacctttctacaaacgctcccaagctgtcacgtggcatcctacaaactcttataagccgccacatggcgttctaataaattaggaaaaaaaaaggtggacccactaattaattttgccaattaaatctccattaaaataaaaaaaatctggtatcccaccaccgtacgcacacacgtacacgtactccctccacaccctccgaactcccccctattctcctattctcccccctattccccttaccaactcacctatccggtacacggtggttactcattaagtgttacttcctccgtttcaggttataagactttctagcattgcccacattcgtatagatgttaatgaatctaggcacacatatatgtctagattcagtaacatatatatgaatgtggacaatactagaaagtcttataatctgaaacgaaggtagtattattttgtctatgcctacacgaatcatttaacatatatttaatactctagatgacttcaaatatggcactatctcttatcaacatatattttgggccgtcagagtttttcctaactatttcctcgtgctggaagaaagcatcaggtaatttaaatatggatttatctctgaacaacatgacttccatttgactgcttggatgatatcacaatcatattaaccacttaatcttgatcccttttctacttgaacccacgcagcacttagttcactgcgcagaggttcttggaacaccaatttgttggggattacaagtatggacggcaagcgcatcggaactggatgcctcttcccctgccacgaacaatcgatgaggaaaccgctcaggaaagggaagcttccctttgtgcttgttgtgggtggtagaagcatcggtgaggagcaacctcagctttatctacactgcaatcaaatggttcttcctgatatcccagtggctgttcccaggctgtagtctgcaggtgctaatcccgattcctcagatcttgagaatctcaactctgttgctcccctgcaattgcatatgcggttgagttgggaaattccgaagtatgtgaagatgtggagataataagaaaattgtcacaaaaaacacggcgggggggggggttaatttgatctgtatcgttgcaaatatgtctatttagataaatgccattacaattcgtctattcgtagccgtggtactgaaattttacaaagttagaactatgtcatcgccgtcacgtttttcattttcttccccatatgcacgtgggacccagtgttagattcatcttcttctttttgctctctcttatcatcttccttcactctcccttatcgccttcatatgcaagttgttcttcaaatatttgtttgcgatttcttttgtcttggcagattcgaatcggagaatggaggttgcaggttactacgaaccagttcgacgaggaggcgcgtgcagcctattcggcggaatgctcaagaggaacgccatgctcaggccaccgcgccatggcgagggggagatgtcccagcatggaagggggaggtggaggcgacggcaatggcgatggctaaagtaacgcagttttgctattttccacaatatccgcctcttcttttcaaggttataggcggcacttttctttgtgattgttgctagcacctctcctagctaggaaggaaagagttgaagaggtcatactttactactgttcatgttatttgttttagcgttatcaaagttctttggtacaatgatcagattcatagttccacgttccaactatatataagtacctagctcagtatgatgtttcatggtggagtagtagtttgtagtaaactatgaaatagtacctctgtctcagaatataagaagttttagagtcgacacaattattaataagaaagtcggtacaactaaatgggaagaggttacgattggtgaagtgaatgatggaggattatatatggttggttgagaagggaatgttagtggataagttgttatattttgggtcaaatcctgagagctaaagttgttaatagagagtattaactaaatatttgtatttgctacttgtagtggcctgacaaaaacatgttgtgccaatatttgtcgtcaaaattcaaaattcattgtattgagcaagcaggcattatgctcagtatccctagctaagtcaacttaaatatatattagaatgcaaattatagaatcactaactggcggctattgagtctgaatacaactcaagtctcaatttcatcttaaattaaataagagtttctcaagtcaaaatggatacacaccagtatcctgtggctcagttaaatctatagtatccatatgcgacatccttgagaattttctaggtaatgaaggtgtagtaagtgttggactaccggaagaaacttggagaaagacatactagctcccaggtttcaaattatgtgtcgttttagtttttttctaagttaaacagtcctaactttgactaccaatttctacacatttgtatatagtttaacaacatgttatgaatgtatttcttgtagtcaatctaaaaacataaaaattttattgatatattacacaaatttatagaaaatgattgtcaaagttaaaagaatgtttgacttgaaataaaactagaacgacaaaactaaaacaagtaatttgaaagggaagaaatatagtattatctctcaaaagatctaataaataaaaaaaggtagaatcatgatttattcgtttgtaaaggtttaatttcaaatcaatgactagcttgtacatagaagaaaagtagtgtacttctacaaagacttgacaaaaacaaaaaagcagtctcacatggcacaataattagtttagtacacttgacgacccatattgccagtcattgcaaccattgaccaattcccacaatgtaggacaataaatttggttggagttaggaaaacatctggcatcagcattgacattttgtttcaagttcaaagtcatcactttgaattaagaaccggtcagcaaaaaacagtccagaccagtcgctatcctctgttagctagcagccttttggcaccaataattcaacttttactcagacctgctatctcactatatataagatagtctcatgggtttcatggtgtgccaaattgtacatgcttatttcaaaaactcagctcaaaatggcttctaggtctcctgtgctgctgtttgcgttgatggtttgtcttgtcatcgtctcgcagggtgtcctcgctgcaagggagcttgtcgagacaaccaaaggtaacatatatctctgtttatacttttgaaaaagactgaaatcttggtatgtcggtggtcaccacaatttcataaatatttaaaatttaacaacttttgcctgaatttaaataaatttgaacaaaatcataaaaaaatagaaaaatccggaaatttcatacgagatagttgcttccgcggggattcaggaatttcaatctgaaatttcaacccctgcatgtatccgttcgtatcaaatgctaggattttctcgattcctatggccagtcttctcattctgaaagtctgtacatatattggaatttcctcatacttggtgtgtgtcactcgaaccttttgttgacataatgtttgtcattttgatttctggtcatcagagggttaatgtactgttcttaaaaacatcacaaggttcatatatatagtgtgttctgcatgtgccaccaatttgaatggcatggcaggatcgaatatcaacacatgtcattatctaactagagtttgcctgctgattttgcagttgtggtagatggaatgaaagttgagcttcctgaaggccgcaaaggtgcagctgctgtctcggggtatggaggcggctggccagggacatacggacactatccatgatacaattgtatattctggatatataaaaggattaatttagcttaaccgtgtatatgtgcatctattttattgtgtatttagaatgtgttgtatcgttataaatctttaattttacacatgtatttaaagacgtcctgcgaagcaatcggagaagacaaaacggaacaccagggactgaggaaactagaagccgttaaagctcattctttttaagctagccattttatttgttactataaaaatcatttttccgggcatgcagtcaaaaagatttgcacaaacaatgaacaaaccacccctaataaaagacatgcgaaaattatcaaaattttcacaagcgatattactcgcatgtgaaaattaatttttgttggttggtcatctcaagacacctgcctgtgataacattgttttggaaataaatgaactggtgctcacaaccatcgcagcggaatgcggagagccgttgccgtcattgctgctgtcagggaggcgatggactagatacatcatacaagagccttgtggtcgtcctcacagacttggttcccccaactccagtacgccactgctagatccatgagactcgtagtcattgttgcagccttagctcccccacatccactatgataccgccacatgcatccaggagagcctcacgcgcggtaattattgccatagcctcgactccctctcccctaatgcgttactgccagctctaggagactcactcttttcgctgtagcatcgactccccatcccccatggtgccagctggtcatcgtcgtagccatgactccccctcctccactatgctaccgccacaagaatccagcagagcctcgtgtgcggaaattgccatagcctcggctccctctcctctaatgctatgctgccagctccaggagactctatgttatcgccatagcatcgactccctatcctccatggtgtcggccgatcatcgtcgtagccatgaccccctctcctccactatactatcgccacatgcatcaaggagagcctcgtgcgtggtaattgccatagcctcggctccctctcctttgatgcgttgctgctagctccaggaccatctctgttattgccgcagcatcgactccccatgctccataatgccggccggtcatcgtcgtagccatgactccccctctcctccactgcgccctcgccgtagcatggtgtaaaatcacttattgtcatatagtctcaactttgtactctgtatccattttttccccaacacgtgggagacctgatagtttaagagtaaaacttttactcctacaaattctatacttgaataaaactagcactgtggccaaacatgaagtctatcttgattgtatgtttagtttatatagataaagccttcccaggggctagcttaagaggcttgcttaagaataagaaagatatatatataatatatttcaaaatagtagtgtggaatgtatttatggtgattccataaatattctatcctaaaaatcgaaataatagggacttttcaaagatttggtactgttactaattcataatctggcatatacatgatgaaaacatcattcttaattctacaataacttttataatagcgtttctttttcttccaatgaagtttcattttttctaaaatgtaccctaattttgggcttagtcctgataattgattcaacttgttaaaagatagaacttggttttattttgtcttcaacaagttcagtaataagcataacaactctattgttccaatggtgagaagaacatatattagctttttgataaattttcaaacgaataatttcacagaattatttggctccaatatttgggtcataaccatccttttgttaatcagatttgcaaacttttccacgcacaggtatatatataccaacgaattccagaacataaaatggccattacaagtatggaagataaatggtgcttcctgtcgcggagaatcaaatgcatgcatctcgagtactaaaactaaagatttataagtgtaccaaagtaacgaaagatatatgtttaaccnnnccaggaaaatatatgtcgtttaacaaaatagaaagacgaacatgttggtcaatcccaacaatttattaatccattacatgtagaatatatatgtggcgtgttcgcaagtataaatcatggacgaggtgggctgggggcgtacgacgccggcaagccgctgccatacgacgatccatctacgttgattgcaaaaccagcaaataaataaataaattgcgattgtagcctctcagtacttggatacaattgatacaacttgtaagagaaaattttgacagtacttgagcaggtaccactggtggagaaaccatctttcgtcggtcggccgatttccacaatagtcctggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggtcatgtcaggcccccccgggatccaaccgggactaaagtcgtaactttagtcccggttggtaataccaaccgggactaaagatcccggtgatctttagccccggttggtgctaccaaccgggactaaagtcccacccctatatatatgtcttcttcctcctccagctgcccgagcaaacttcaaaattttttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagtttatttgtaaacaaggttttataaaatagttgagaaggaaaactccagtgaaagttaatcttaaataatagaaaacaaactaaaataaaaattaaaagaagtaaaacacattaaaattagtttaaaactttacaaatagtttttaagaattatttggtgtaatattttatgattttgggctgcaggaa

SEQ ID NO: 63182 - DNA, 1509 bp, Oryza sativa
ttcagtaagagaagctttggagaagatgtcttaggtggagtcctggcttataccccagttgagcgcctgtgaagatggagccgtaggcccgctagtccgctgctgtttatttttgattgtcaggcctgaagtgcctttgtaataatgtaaatattatcgatataataaagatgtgccttttgtatcatgtttgtttggtgtaccccggcttttcctgggacagggattaatacactagcgttcgggaaaaggcaattttctcggtcgcgacaacttcttcttcctcctcttcctcttccacgtcggaggtggtgatgtagccatcttctgtagcaacataggcccgttgactagggcaatctttctgcacatgcccaaatccttggcaacggtggcactgaatgcgtcccgtcgaggcgacagatgaggcactcttggcgggtacttgcgaggaacatttacctgactctgctggtcgtgcttgccttgctcttgccctgatgcatgcccctgcaattccttctctgcaagcatagcaaaccgaaacaactggttgacagagttaaatttcttataatcaacaatgttctgaatttcctccctcaaaccatagtaatcctgtacagatttatcccgttgttccaaacgcatcagtttcttgcgtaaatctctatgataagatggaggaacaaacctatcgcgcatagctaccttaagttcttcccaagtagtaggtagtaccccctcatcagataacccagcccaccacataatagcaaaatccttgaactcactactggcttgtctaactctatgttgctcgggtacaaggtgggcattaaacttttgttctactgttatctcccaatcaaggtatttctcagcatcataatatccccaaaaagatggtattttaaacttaaccttagcataaggatcatcgggcactcgattattattattaccttgttggtggcgagtgccacccgtacctgtgcggtttgtgcataggcgacgtcgtagccgtgcttgccttgtagccggtgcgtcaatatagccactggaatcatacaccgtgtcttcaggatgagcatcgtcgtcaccactcaccacttcctcattttaatgaaggcatcttggaaagactttgcaacggcctctgtgatgtccttttgagtattttgttggagagttcgtagttgctcttggctgacacagacagcaaaatcctggggactcttctcaccttcgttacttgacattgaaacaccaaaacagaaacaaaacggtgaaggttatccctaataatctactacgcaggtgtagtggtgcctctcgacgattctcagcaatatggagttcctaactaagctcttataaggttcttaccagcaaagcaaaggatacctagaaggcgtagtcagcgattgcaaggatcaagaacttgtgctatccagaagtaatatgtggagctaggaaggccaaatatatatatatgagtggtacaca

SEQ ID NO: 63183 - DNA, 23310 bp, Oryza sativa
  unsure (1)..(23310): unsure at all n locations
cctttttctgtatttttgggcatatgtttcctgaccacttctttacacactcctcttgtttggtatgtatcctattcatgatttggctcctaatcttttcaagcatggataaaattggaagctctctggcttcaagaatgtacttgttgaatacctcggaattgttgttgagtagaatatcacacttggggaaatcactaaagaatgctctgcaccactggttgggtggtatttcctccaggtaggcataagcatctttgctaagagacttcatcttttccatgttaaattcccactctggtatagtacttgaccttgcaattgcccacaactgattctttagagtctcccctttgtatagaacatgaaaattttggtacaaatgcctaacgcaaaatctttgttctgaatctgagaatttatccctcacagctggtaccaatccctacaaaatttaaaaaggaagggtgagtactaatccattgaacagtaaataattcaaatattttaaaaaatgacaagttgaacaaaatcaaatatgatggaataaagtcataccttctgtctgtctgtcatgatagtataaggtccagtgttgtcgataaggagatcttctttcaaagtattcaaaaaccaaccccaactagctctactctccacctccacaacagccatggctataggatagatgcagtcattaggatcaatgcctactgcagtcaacaaatgtcccccaaacttggttttgatgtggcatccatcaaggaatatgataggtctacaaccacttaggaatcctcttttgcaagcatcaaatgacacatagcatgtatggaagcacatattttgtaggttcaagaaaaatttactacctggatttgaagtcctaagctcttgtccataatctcacaacatatcgtattgtgctatttcatcaccatatatcgctttcatagctagtttccttgctcgacctaatttatgtcttgatggtgttacatttagttccttttgaactactttagagaaacttttgagtgtcatcctatcattgtccctaaagctttcaacatatctatttgcaagatacctggcagttacataattcaactcccactccttctgacatttgtggccatctatatatctttttacataagacaattcgtcctgctgtcctcagctacatccaacatccatgagcactcttctttactttagcctcaatttttttcttggtatttcttgtaaatttaattgcgactctattcttcacactgtattgttttattgcttgcctaacttcaatagcatcagagaacaacatcccaaccttaaagattggtgactccatgtccacagcagccacaaagttcttaaatttcaacttaatgccttcattatcttcatcagatgactctggaagcaacaagccttcatcatcagagtcatgttcaggaagcttaacaaccatcttgctgctagccacttcttctatctcgacacagttgtcaaaagcatcatcatcccccttgtcagcctcataatcactgtcaacaaagtcaggatctacatcgatgtcatcgtcatcgtcaatgtcatgaccttctataggtttaacatctgaatcttttcgattcattgtagacctctcacggctagccacgataggtatagaagcaggggtagaaagagcaacatcatcccaattgatggattccagaatgtcttggggatccacatacaaaagcaatgtcctaaaccttggtgctaatgcaaccatgctgttggtgcttgcatcagagttaattctccttagcccatcactgaatgtcttcccaggcaataaccaataaaccttggccttctcagacatatcatatcctagttgctcaataaaatcatcaagccataatgaagaccatgtgtcactgtcacaataatcaaaccaatccaccttttcatccaaataaattctgctactaccaactccagagaaaaaaccaccatgatgtagttcagttgtgaactgttcatccttgcagcctacatcacaagacaaatcattctgatttgtcaaattgtaaataattatctgatctgttataaaaaaaagattataaagagtacatattcatgattagagcaaaaattatttctaatcacaaactattcgtgaaggattacttatatgacacctagccttataaacacccaagcagtggcggaggcagcgccgggccaccacaggcaattgcccaggctccatgcgtacaacaacactgctccaatgcatatacaacatattactcattaaacatatacttaatcactttgtctcataggttataatggagattaattaaatgaataaacagaaacgaggaagcaaggaccaaaccatcaaactgtagatacagacaccaaacaacacaatcacaagattcaagaaaaaacagagaaacatgcaattaccggtacaaatcaatgaaaccctaactttatcaacaacaatcaattgaaccaaaaacgaaaatatgtaatcactagggagttatttaccataagaaggaggggacgccccaagaattcgccgagtcggcgccatcccagcgcacgaggcgatcacgtcagatcagttcgtaggtctgaattactaagcgcaccagtttgggatgatctcagatcagcgtggctcatatatgatgccctcgcaaccggcgcagaggcgatgcagttttgctgtgcactcgctgctagccaccgtcgcctctcgatctgttgaggtgagtaaatcacggacagaaaaacagaaccaaggcacatatattttttgctgtgttaaaacaaaagaaccatttagaatataaaaactagtaggaggttttttgtaaaatgagatgggatatcactctatgatgctgatgctaacgtgggactttgtccaagatggaaagctgacgtggcaaaaaatcttatgtggcagccttttgaaccataaacgcacccacctagccaagttgttgcatcggtatgtccaattttcaagttctcgcacttaatcgcacccacccgccaagttcttgtaccgtcaacgcaatttactctttaaaatatatggaagtaaaaacattactaaacactaataagtattatagggaaaaatatgaagtgcaaaccctatatgtaatgcaaacgtagaaaataccgttggatcgaaaaatggacgcccgatattcgtccacgtcaacatgagttaaaattttactcgtaaactgtacagcaaaagaatccctgtgagttaataaattgctctagatattacgtttatagaagaaatattgatcagttaaaaatttactatcacataccgaacaaaaatacccattagtaaaaatttcaccaacggcatgaagattttttcactggaaggatcgcctgtcacgtgtatatttcattgaaacgtacaccctccgtcccaaaataagtgcagttttgcactattcacgttcaacgtttgaccgttcgtcttatttgaaatttttttatgatttgtatttttattgctattagatgataaaacatgaatagtactttatgtgtgactaaatatttttaattttttcacaaaattttcaaataagacggacggtcaaacgttaggcatgaatatccacggctgcacttattttgggacggagctagtacgtaccacggcagccaacccctatgagtaattttttaacttcaattacgcccgctccaagtcaaattttataatgagtaatttttttactcagttgtctgttgctgtgggaggggagcagggtggtcgataatcacgtgtttctctcataaaccaactactgtaactgatttagcccacggtaatttttttactctgtttgcacctgcaggatggggatgggtggcgggtctgtacgctggggatgcgggctcccgctctgagtggcgccacggtttagctggcgcgcatcgcctgtgtctcgcgtcacgtagcgtgaccttatatatatatatatatatatatatatatatgtatatatgtatatatgtatatatgtatatgtatatgtgtatatatgtatatgtatatatatatacatatatgtatatatgtatatatgtgtatatgtgtatatatgtatatatgtgtatatgtgtatatatgtatatgtgtatatatgtatatatgtataaatatatgtatatacatatatgtatatatgtataaatatatgtatatacatatatatacgtatatatgtatatgtatatatgtatacgtatatatgtatatgtatatgtatataggacactcatatggggcaccatggtgcccgggcaccatggtttcaaatgcacaaaattactcaaatttttcaaaatttttaaattgtgagtatatacctagttataagaattcgattcatacatatatctatcaacaaaacaactcaaatttaactttatttcacaattcatgattacatacctaactaattatatgtatggatgctatatacctagaatcaaaatctaacaaaaacaagttcagttcaaacttgctttgaactagttagtaaagtagttaatgttaatacctaaataattgaaaaagtttcatactcatttgaattggttatatactcaatttcaacaatggtgcccgggcaccatggagcaccaaacaaatttactatgtatatatgtatatgtatgtatatgtatatatgtatatatgtatatatatgtatatgtatatatatatatatatgtaaattaactggtgctacatggagtatgggctccaagattcaaattgagtatatacccaatttgaatgagtacgaattttttttaaatgtttaggtatgaacattaacttctttactaacaagttcaaacaagtttgaactgagtttgaactttttttttttgttagattttggttctaggtatataacatctaaacatataattcgctaggtatgtaataatgaattgtaaaataaagttgagtttgagttattttgtttttaggtattggtatgaatcaaattcatatacctaggtatatactcacaatttaaatttttaaaaaaaattgagagattttgtatgttttataccttggagcccgggcagcatggagtcccatatgggtatcctctatatatatatatatatatatatatatatatatatatatatatatatatatatatatatatatatatatatagagagagagagagagagagacacactatactatactacacatggggtgtagtgtattaaaacacaacccacctcctctcgccgcacctcccacccctacccccctcccctgctgcatcccacccccatccatagtatgtgtaatagtaattttcttactaccccaccaaacctaaactaccggtaatctatttactcacctattttgcaatatgtatattaggatgcaacggaccatcccatcctattttcctggatctagagtccatccactcccatgccggttttcccgcatcgaccaagagggagagggcacgggagaaggctggcggtggaagtgtcctccagcgacgggcggcggacgatgggcgaaatcggttaatgacgagtgaaatcggtcggaggtggcgatggtcgcgggtcgccgacgtcctttgcgccgagccatggagaggtgaggtggttctggctattttcctcgctcgatctggtgctcccttccccaccccgcccatgaatcggcgtcgacatcgacaggatctcttgaggaggagggggcggttgacggcgggatgcggggaggagcatccggctgcgttgaccacaccctgattcctccctcgaaggatctggcacggatcaggcctcccatcgctgcctccctcccacagcggtggcgtcatgatctgtgatgcacgatgataatgagggtaagcagctgagtccatgcaattttgaactttttactttgcatctttgttgttttaccgatttgctgctgcagttctgctaatttgctcctgtattctgattccttcacattctgcagtctgcactcgtgccggtcggcagcaggcgctggagaccctggccacgcaaagcaggcatggggatggcggtcaggaccgatggatggatggatgtcaattcgtatgtgttccaatgaaagtcaggatgttttatttgttttattttctctccatgttctatctactcaatcaatctctataggcaatagctacttgtttttctttgaggaagcatagctgccatgtttgatcaattaattgcagcttatttgcgggcgccagatatgtgtggtgattgcttgtgttcgttgatgcgctgtataacatacatgcatgttccatcgatccattgtagatcaatttgtagtgaatgctagatcattctgaatttatgattattcttttcattaagaacattcggtccatttttattcttgaaatcgtttttcatctgaaaagatggcaggttttgtgtagcttataacttgtatgttattaatcagagatatatggatattttagcctgaagtatcccaattacctattctacatttttcagccaactgcattcttaattttcttttttgtagaatgtcatcgatcacagatcgggactaggcaagcccaggaactaccgttaaggaaacataatgtgacatccatgcttgtctgaataaaaaatgatctgttggctaaaagtaggcatgaaggaacctaaactggtagttcaattttttataaagcattttatttcttcttcggcgaatcatatctcatttagagtcatttatgagtgtaaattaaagacttctcttagatgatgtaatcgtttttgtttatatccaggtggctgtgggatgcctctctagatgttcgtgggtgatggatatctgtcgatgggagacctaaggatctatagtgctttgtcggctcaacatcgatatgtggcactagcgccgtcttgtttgttggattcgtgcatgtaatagtaatttagttactaagagacattaagaatcatcggtgtaatagtaacttggttactaagagatttttttggcaatatcaatatgttatgttgagattggtgtaatagtaatttatttactaagagaaatcttgtgatgatatatatggaaaatcatatatgaaccaaagttcatatgaaccatgaatctcaaccgtcggtgagttccaagaagcgtgcccaagtgcacaatggttagcaggattagggctggacgaaaaactcgtagctcgttagctcactcggctcgtcactagctcggctcgactcggctcggctcgttgtgaattcctaacgagccgagccaatgttttagctcgttagtcataacgagccagctcgagctggctcgcgagcagctcacgagctaaacgagctgaggtcaaaagacagcccaacaaaaatatttggaggcccagcccaactagacatcaggtatatatgcatagaaaccctaaatccccatcccattatcgatctagatcctagcctacggtcccagcgccgcaccctcgctccccccgtctcacttcgagcctccaacgctcccagcgcctactcgccctcccccatctcaccaatctcgcgctgccgacagcagggtcgtggccggccgcgggctgccctccatatctcaccgtcggtcatcgcttggtgaatggccggttgaagacccgagcctatatcctcgccgccgtcggcatcagtactgatctgaggccgtcaacatcgagcaagcttgtattccagccgttctgttacttctttcattgccgccaacactgaagaccggatctgttgttttctctttttttttgttttattggcttgtttcatttgcaattttcatagttactatttgatattttggtacttctttgggtgaatcgctgattggctatagattggaacatcatattatggatatatgcatttgctttatttgtttctgccatcttgctcactggattgatatgtgctagctgtgtactgactgaaccttgcagttttattgctctggctcacgagcttaacgagctggctcgagctttccaacgagccgagccgagccagcatcctagctcgttaggatcggctcgttatcctaacgagctagaccgagccgagtcgagcctagccgagctggctcgctatccagccctaagcaggattgagagacggtaacagtactactatttgttaatttacacttactgccccgttagagcaaggtcaatggtatagccaactaggctccaattcatctatagccaatctaatagccaatttatacaatagttgcttactatactattagcatatggtcccaccgtcatatacacattgcgtcttgaagtccgtgctgcagctgactacagatttgtagcccgctgctcttctctcttatcttttatcttattaaaatatatttacagctggcttatagcatgctattgtacctgctcttacagtggacacgtcagggatcgtggagacatgtcagcttggcccactgacacaaaatagaaaaaactattcacgtacagtagctgctcccttgtcacgctttaacactctgacgagcatggctatgacttgtcttctctcgaacatggctgttgatatttgttgaccaactatggatgtgttttagttatttagtgtaaagtctttaagtatacgggcacatatttaaagtatgaaacatagactaataataaaataaattataaattccgcatgtaaactacgagacaaatttattaagcctaattaatctgtcattagcaaatatttactatagcatcatattgtcaaatcatggtgtaattaggcttaaaagatttgtctcgtaatttacatgttaactgtgcaattgttttttaaaaaaattattagtaataaaaaataatttatgtgtagcatcatattgtcaaaatgcttatccgataaaatttattagtaataaaaatattttatgtgtaaaatatttgtacgtatatccttaacaattaaaaatcaaatgctataaataagccaatcataaaatcaacttctaaattaagtttaaaactttaattttattttttaaaagttaaatgagaacgtggttaaaggatgaggacatggctgtgtaaccccctcctcccggcacgtataaacgaaattcgttttattgcatgactatttaagtattaactattttttttaaaaaatagattaatatgtttttttaaacaactttcatatagaaagttttttataaattacaccgtttagcagtttgaaaaatgtgcgcgcggaagacgagagaggtgggttaggaaaatgggcaccggtagagaaaccatatttggtcggttgcccaaaatccacaataatcccggttcgaaagaaggcaggctgtgttagaccccccactatgataataccaaccgggactaaagatccaattttaatcccggttgcttataacaaccgagacaaaagaaaaacgaaaaanaatcgcactgcgcctccttgagaggaccaacagccttatcctctcatccactcatctctcctcctctcccttatcttctccaatcttctcctcccttctcatcttctcatctccttcttctcttcttcccccttccttcccttcccctctcctccccctcccctgcggccgtggcagatccctccccgacacaagcgtggccgcgcgcggcgagcggcggatgcagccgcggcggcggctgggcggcgggccggcgaagggtggcggcggcgcaggcggagcgtgcggcagaagcggcggcggcagcggccgtgcagcctggcggagggtggcggccaggtgacagtggtgaagcgatgaatttgcttttgagaatttgtgatgtatttgatctgtgcgatgtaaatatgtgatgtatttgtgatgtttctttttagaatttgtgatgtatttgttttgattatctgtgatgtatttggatattgtggatttgtagatgatcgatctgggattcggagatgatcttttgttctgtgattttggggatgatttggggatatggtgaaatcaatattcaaagtaaaaaacaataaaagaaaaaagaaaatactaaccagatctggtttcatttttagtcccggttggtaacaccaaccggggtttaaaatggctccatctttagtcccggttggtaccaaccaggactaaagatcgatttttagtctggggtatttgaaccgggactaaagataacgatctttagtcccggattcgtagttccggttgaaaaaccgggactacagggggttgcaaaccgggagtaaaaaacgtttctccaccagtggggggaagaacacagcctattaagtcaggagctttgggacggtagcaacgcccatttatttgacactcttaatataattaacaacaagattccctataaaatattttatagatctcgtcaagatttattgaagagtttgaaacgtagttcaaagagattttctaaaaattgatccaagatttataacaaatatttggacctctgaacaatattaagaaatcagtagtcaaccaccaaaattacggatttcgttgaaatgcataattttgataaaatatttgacctcgtatgacctattttaaaggaacaattgcttatttgaccccgttttgagccctaactaccaatttgaccctacttttaaaagtttgcttatttgaccctccttttcaaaaacgaagctcccgtatgaccctgttctgttaagggcatctaacggtgttaactgaagcacaaaatgtctcttttgcccttactcatttgaccctattacatgtggaacccacccgcagttccctcttctcctctcctctcttctctctactcttgtattctcttctcctctcctccacggggcggcgactgatgggccgcggcggcggcgctctgagggggctgagggagaggggacggagggagggagcggcggcagcggtggctgacggagggggtgagttgcggcgggggcgcacggagggggcgagctgtcgtcctggctcgtggagggagggaggaacgacggcggtgcatgtgagcggaaggagggaggatgcggcggcgacggcgcaagcgcccggaaggagggaggaggcgggagagggggccggcgccggcgcaagcgtgcggaaggagggaggacgcggcagcggcggcgccagatctgagggggtggcggcgccggctccggctcttcgtcgtcgtcgtcagcagggcgccggcgctggttctggctcttcgtcgtcgtcctcgtcctcgtcagcagggcgccggcttcgctcttcgtcgtcgatgagccgccgccgccactcctcctcgtcgtcgttgtcactagagccggtgccggctcgtcgtcgtcgtcaccagggccggtgccggctcattgtcgtcgtcaccagggcggcgctgatctgagggggtggcggcaccagctcgccgtctcgccgcaagtcgcagccgtcgccgcaaggagagaaatgtggatagggttgggtggatgcatagggttttctaagggtattctgggtattataaatattagttgtatttctttttttattttaaatcaaaacttaacggactaatggaaacagggtcagacgggagcttcgtttttgaaaaggagggtcaaataagcaaactctaaaaagtagggtcaaattggtagttaggattcaaaacggggtcaaataagcaatagcccctattttaaaatttataaattcaaaaatcgcatcgttgcatggctcgtgtgaccacagaccatccccatgcgcacgatagaattgatatattttttataagaataaattatatatagttcattttaccttcgacctagtttgatactatatacgggatggattaatattgcatgctcttggaaaataaaattgttgcacatgctcctgttgtacggcaaagatgtaagtacccatgttaaatactttatccgtcctaaaatataattaataatttaagattgaatgggacgcatcctagtaccacaaatctgaatagctcactaatttggtaatataaatgttgctatatttttttataaacttatcaaaatatcaaaatgtttgacttacaaatgatttaataatatgaaatggaggatgcatgtgaccattgcagagcacatacatgtgacgacggcttgcctgggaaaaaaaatgttcttatagggtacgtataaaatattcagatagacatgcatgttatatgtaggcatgtagcttgaccagtaccgagacattaatttggtgtcatgtcgcaggtgtactcgctggtggaccaaggaaacaaccaacgtgcagtctctaaataggagaggaacgggataggtacatgttgcatcccattagaacataatggacgtgatccatcctgataaaatgcatacacgtggcacactgatgagcaaggagcatatgaaccgtggttcatattatctatctatctatctatctatctatctatatatatatatatatatatatatatatatatatatatatatatatatatatatatatagacacacacgtgggataaggagaataaatgataatttggtcaacaactaatgaattgtattaatttgaccggtgtattaaaaaactaaaataatagatctgccctggagaaaaggatcggagaggttaggaaaacgtacagatgggttgatgcatgccttttcttccgccgtttaaagatccaaacgcacctcctgtgctctactcacaatataattaagattgattatcccgccgattcatcataatataattgagtagtacttctcaacttccatccttttttctgtttgctggtcggtgaacatgcatgcgtgacatgcaaactcaacagtaggccgtgcagatgcaattcgaattgccgtctgagcgagcgactcccggctgcgctgaagtttccgatcgtgttaatggaaatggcaaggcgaaagtcgctcgcgttcgatctactcgcggccttccgttccaatatgctatctgcctctctctcgattagatatatttacatgcctcttccgaatacatttgactgaggaataagttcactttgggtccctctatttgtggaaaacgcttcgattaggacgtccgagacgagcgcaaatatcggacgtccttatgaccttatccaaacctctcgaccgcctctccccaccattcccttcgttcctttcattttttctcctcttactctctctcttctcaaaaagtcacgagagatgccgagggcgaggcgtcgtcgccgtcgccggcagccacacggcgacatcggcggtggggcaaggtggtgcatgcataggtaggaggtgctgaacctcgccggcggccacaagatggcgatgaggcaaggcggcgcgagttagggaggaagcactggacctcgtcgatggggggcgtggtagggaggaggcgatggacctcgtcggcgtccacgggacaggcaacgcaggattagggaggagtcgcggtggcttgcagccggtcgccggaattgctatactccggccgccgccgtctctagcccgggatccgcgccggccttcctccgccgcctcgtcactcgccttcgccaggcgtgctgcggcgcggccgctctgggtgcagctcctgctgtcggtggctcagtgcaccgccaccgccgtcgtctcctgttcgggatccgcgccggccgtcctccgccgcctcgtcgctcgccttcgccaggcgcgcggcggcgcggccgctccgggcgcagctcctgccgtcggcggttcggcaagtccctggcttcgtcgtgggcacactgctgcggcggcggcggcgggtaggagccaccgaggccgacgaggccgtgtagactgcgactgaggtgagaggggcttgcttccccatcccctcggagggtgatttgtgcattttgttgcacaccacatgtttttttttgttgcatatagtgtgtccgtgatgttgcaatccgtaattttctggatgtttcttaaatcaatactggatgatgttgcatttggtctcttcgggatgttgcatatattggttttttgttgttgtagacaatgttttttagtgttgcattcgattgaaacatgttcgataatgcggtgaaacatcttcgataaagcggtgaaacattcctcaaagataaaacatcaagaaacaattcgtgttgaaacattttttttgagcgatgaaacattgcaacattcattcaacatactgtgaacattttttgagcgatgaaacattgcaacattatttaatatacagtgaaacatcatccggagattacgtccgatccgtagctttccccctatttgtcggccagtctgattttcgtctctcgatcgcaaaaccggataagacaggtcccccaacttacgaaaccgtttaactaagatccctcagtagtatttgactcggttttggctgaggtggcgcgcttatgtggcaatttgattccaaaaataataaaacctatagagcccacatgtcagtttcacccacacaataataaaaaatggtggggcccacgtggaccccatctgtcatactcactactcttctctctatcccctctcattctctatcctctctctatccccctctctctctcccctgagaatggcgagcggcgagcggcggcgggcggcgcagaggggcggcggcgagcggcgagtggagcagaggggtggcaggtggctcaccgtgtcgaggtcacgccccagcacgtacgtcctcttggccgccgtgtcaaattgctcccgcagccgcatcaacgacctcgtcatggaccgtcgccgcctcgccggccttgcgactaccgccgccgccgtcgtcaccttcgcgaacccgcacagctccgccgatgcctccgcgctcgccggcaacgacggcgcctcgccgtcgcatatcgccttcttgagcctctcccaggacagcctctcgccggcgggtaggatggggcagcgacccaagaagcccggcgaggcaccgcgtgaccacctcggagccgatgcctagctgccgccgccggcgtcgtcgctgctcccgccgacgcagccggagccgcccatccgcgccgactgcctcccaaagccacatctggataagagaggcaattcaacagtgcttatcccaaaaagatcaaggaactccaagaaagcaaacagtgcttgtcccagaagatcaagaaactcgaagaaattgagttttggaatcagggcaattcatgtgcccatcacaccaaggtgagatcagtagagaagaaaaaaagagatagatcattgagcttttcgtcatctgtttatatgttattgtgtgtcagttcattttgccatcaataatgctgagaaattctggtttgtattggaacacagccatggaatcaatgagcattgaggagtacatcagcacgctgcactgaaggcgtcgttcccgcggaattgcagcgaatgatgcaccggaggacgtcgtcggagatcgagctggcgatggcgggctacttcgacgccagcgacgaggcgtcggagatctgtaagcagctgctgacgaacatcaagaacacgtagagcaactacctgtccatggacagcttcctcgccaccatctccgacagcgtcgccgctaccgatggcgccgcggcgatgacagcggcagcgccgctcgctgccatgcggagcaacccgttcagcgacgtggcgacgcggagtagcttccggcagatccacgacaggtactcgtccattctccatgccatcaagtcgagccacgggaaggcggcgaggaagctgaaggtggtgagggccatcaggaaggtctcccgggcgtgcggcgccgcggcggccgcctccgtcgccgtggccgcgcacctcctgttcttcggcctcctcgtcggggtgcccggcccgctccttcccgccccactccggccgcggccactcctccccgtcgctccgccgccgacatcgctcggcctgccgctccggtgggagagagaagagggagaaagatgatagagagagggggatagagagaagggtagtgaggatgagaggtggggtccacgtgggcctcacaactttttattattgtgtgtgtgaaactgacatgtgggtcccataggttttattatttttcggatcaaattgccacgtaagcgccacgtcaaattaagaccgagtcaaattagccacgtaggcgccaccttagctaaaatcgggtcaaatactaccgggggaccttatttaaacggtttcgtaagttgggggacctgtcgtatccggttttgcgatcaagggacaaaaatcagactaggcgacaaatagagggaccaaaagtgaacttattcctttgactgaagataagagcagagatgggctatggaaagagcccacaacgttaatggtagatgggcccatgatgttaaagcattgttgcatctacggttcgattgaattacttacataatcaatggttagatttttctcctaaaaagtgctcaattagtataggtataggtatagatagatagatagatattggcccaaataatgtcaatcgaagcatgttgaattcttctctgtatatccagataatttgtgtcctctgattcaaccagtgcagccacgccgacgcgacgagcgtcaggaaccctacgcagaccagcgcgatggtggttgttgctgccgccgtcgatcgccgccgctccaaccggctgcaggtggcggtgatggtgtacggcgagaagctcccgatcccagagattgtggccatcgacgaccagtcggacggaaagagctctctcctggagggcggaggcagtgtttaattttttcggtttggccgattctatcggaggttgatcatcgatataccgcaatttcagaaaataaatttcggtccgaaattttgaacaaatgttggttaaatttgaacaaaatattaccaaattcacaaaaaaaatataaatttccggccaaaataatatgtgtgtgttgttgtggggggggggggggggtccgaaataaccgaaatttcattctcaaaccctgcctggaggccctccttgccttccgcttcaatatccacaaggtcgggataggtacccaccgccggccgtcttctcatcctccagatggttcatgacgacccaactgtcctcgatccatagtgccactcttccaggtgcgtgtttcgcttccttccctaggcggcgccctccaccagtggtagctcctgtggtgcctttctagctccccagctgccaccacatccgcgcgcacttcggccccgtttggacttcaaggtctacttctcttttcacactgacaagtgaggctagacatctgccatataagcgaaacaggggaatacgtaatctgcatatgtggcagataaaataatggatgttacatattctggtattgaggataatggatgttaatcaaacccggttttgtatagtttaggagttaaaatttctagtattaagaataacggatgttaatcaaacccaacataaagttgaaggacggtaagtggacttattccgcataccgaagataagtgaactggcccaattaaaacattcaatgcccacactgtacgatgttgtggagatatcctcctagtttagtggctgtgggtataagatcaatatttgagttgaaagctaaaaacttgaaaaagtatgcattgttatcacgtgtttggatgggaaaatatgtggtgaaatctatacaagtagtagaaacttagaaactattggatagatgcctgagatttttgtccacatcaccggtagtaaaaatatgatgtagacaaatcttaagcatccatttttagatccaatcgtaatttctaagtttccacaaatatatgtggtttacagtatatattttccttctttggttattctaaaaaaatcccacatctagtaaaattatgatggattcaatacactttgaacatgtttactattctcatttatttagctagaaatgttatcatggatattaaggtcctctgggtttagatttattggattatactttttagccgactttttggtttacatggtttataaagggtaatagcaatgcgtcacaaatatttgccagagctcagatgccacgtgtgctaaggaacagtgatagacacaaggctcacaatgcagcaacctcacgtggcgtccacaaaaataaaattttcttttttttttctccacttttccccatctatctccctttcctcgagatccacgcttcctttcttatccccctctctcacgccttcccctatctctcctatcatgctcaggcaccggcagcgacctgacgccgctctctctcctctcacgctcgggggcggccaggcaaagcggtggtctctgcggcgacggagctagctaggcggagcagcggcccagacagagacagcgccgtggcagccgggcggagcagtggtgggtcttggtgctcgccggcgcaatagtggtgaggtcagcagcgcaatagcgggggacgatgggagctcggcgacgcggtagcaggggacggtgggagctcgagcgcttcccttcctcctcttctagccgccgcggatcgaggggcggcacggccggcagcgagcggagatcgtcgtggattggggggtagcatggctggcaagctccggtgggtgcagatcgaggggcgcagcgagcggaggctgttgcgaaggtgggggctgcgacgagccccgtggtggtgcctcctctctccccgttggcgcgggagctcggactcggcgcatatgcggcttctctagcgagcttctcccccttctctctctgtcctgctttctcgccatggttgtcaatgcgattctttctcagtgaaaaagctgttttcttctgatgaggttctcggagccaaacaaggccggcgcgaacctggtgaagacatgggccccaccccctcatctcctccacacatgcaatctgcctagctggagagttgaggctataaatgccacgtagatgcactatgaatagcctataagccagtggttttgaagcgttatgtttaattgttgagtcccgtctcccctttatgagaaaagaaaactaggagagtcttatggctttcaaaagaaaaaaaattgcgagttggtttaggcatagatcttttgacttttataagctatagagtacaaagatggtctatgtgttttatggaaatttactttttatgagctatgctactgggaatgaatctggggtgggagccgatcacgcagaaagcatgagctccaactgtttatggagtgggagacgctgcagttgttagaaactcgctaaacaggtccttagttttgtttttcgtgggagacggtggtggttgtagattgtgtgcaacatgaggaaggagcgaggttgatggacaacttaagtggtaagattagtatctgcaggagtgtgacacaaggagtaaatacaatccctggtctaaacatcattaagaaaaatatatgactaaaacatacattacatatatataggttcataagaatagcacactataggggctaccggccggtgtgtccagtttttagagccttcccttcagggagacaacaatgacagggtacatagcccttcctttctcaagatgcttggcaacaagggggacatacacctggaagagctcgtcaacgatggactccccgaagtggtccgtgatgagcggcttgatgacggccctgatgctgcagttcgcgatgctgtcggcgctgcgggcgcagtcggccaccgcatcgccgttggacttggagtcgtcgtgggggtcccaactcgactcgaagacgcccgtgtgctcgacgtcgaagaggccactctcctctatcagctcagtcacctcgtccaccgatggcgcgtagaacggcaggttgaaggtggtcagatcctcttccttcacgcgcccctgttggcacaagattacacctccttatatactccctccttttctaaatgtttgacgccctgacttttttaaacatgtttgaccgttcgtcttattcaaaaacgtttgtgaaatgtgtaaaactacatgtatacataaaaatatatttaacaataaatcaaatgataggaaaaaaattaataattacttaaaaaattgaataagacgaactgtcaaacattttttaaaaagtcaacggcatcaaatattttgggatggagggagtaatttcaagtgaaggaattctgaacgggtttgaacgaaagtagcatggctagaaaaaacgatttttcacagcgaggtttataaattttacaggaggatcttatttttagctgtgaatatctgactacgaagttatatagagagggatctaattttccaccgcctgcaaaaaattattaattttcgcaagcctgtaggtacatgcagaggttatggctgcctgaaaaatgtgttttggctgtctgcaaaatatttttttctagtagtgaatttgaactaaatatttatgaaataaactgcacatgatttgtgcatgcgctccaaagaagtccctaatacttgattctgtctttatttgacattgagacaattaagtttagatcttccggcgtcaaataaaaagtaggaggggaaactatgctaaataccttttggaccaaaatttggagagcttcggcaagtaattcccacatggtgtcgacgtcgccatgcgccagcatttctgagctctttcggcctaggaatgttagcaccatgcagccgccacttacgagttcctctgagcgaagtgcgaggaacagtgagaagtcctctttgaacttcttctggaacaatttgacgacatgtgatggcgtagccttcccgatgcagatgttgcctttattcagatggacgccacttgagagctctttagggacctttcaccatggatttttttcagggaggattataatgtaatgctgatcattgatttatataatatcaatataaaaagacaaatattacatatcactaccaggaaaaccatttgtggaggtagttgataactgatttatataggcggatctataataaatatattattaaccacctgtacaagtggatccacaactgcttgtgaaaatttctgatttttcattttcatgggaaaaacctaaaaaatatttataacttagtgagcatttatacagcaataattactcacaaatcgcacgatttttcatgcgaaatatagaattcaaaccgatatcctctcattcacgtgtaggctacttaccagttatacagcatttcaaaactatgggagactttatgtccctaaaacaactatcttaactatggttcaagtcctcaatcagatttaaaatgggttttctatgaattttcaaagtttggacatcatacagaaccgcctgtaaaaataccttattttcaaaaaaaaaattgatatgagagtttataataaatatatttggctaggtaaacgatctcaaacgatttcaaatttgtgaagactgcacgtttagctacatttaatttgtcatatacatgctatgtttgtgtagttgtgtgtaggggtccccttccggtgagaaaaaaatgttgtgcagtcttataggcgatcggatttcctcttgcatttttttttgtcaattttgggataatttgatcatatgcagtgtgtaccttggagcgccacatgagggcgtaggaacagtggaagaggtggacactctggcaagggaagagcctagtgtagaacgatcctggtagaccagcgatgtagtatggtggctccaacaatctctccttccggtcagcaagctgcttgagctgctgcagcgaccggaagacgtagttaaagtcattgccaggtaggtcattaaggaagaactgtagttccgtcttttccgggtagccactagtggagatcatgctgatcactcccgacacgactagcagcgtgttgggacccgacgagcagccgaggtcagcgatgacgatcttcgccggagctggagaggatagggacgcaaaaaccccctctattgccttgcagagcactggcttggtctccatgatggccttcatctgcagatcatcgaacagtaaaatgaataagagctagatcaacaaactagcaagcgtatatatgtatggaattgagcagagaactacaggtagcctggaattagtggcatagctgtcatttccatcgcctccaaccatgtgtagggctcgctctatctccatatggcactggctgtgtatggctgtttgaccctattagatttcctgctctcaaactcctccatatggcccgttttatagagagatggggcgagcatcttctattattatattgtactacttggcaaatttgcatcaacccgtgcatccccatgcgcatacgggtaatttaatttgtatcaagcatacttttttgatatgtagagtatttcacacaggattaagagaaaagtaaaattaaatagggaattagtggcatgagaaagcaggaagaaaaattaaatgaaagatggttgtgattggttaagaaaagattaaactaggtagaaaagtagttttattttgaaataaaatttgaatgttagaattagctacattgattatggaataaagggagtagattctaaccaggtaatgtaacgtatatatatgtttttaggtttcttcaagattttgtgagaccaactcagagtgcactgcatgtacgttggtttgattatttgctttgttaaccatattgtgcactttggatagaaatatgtacttcctttgtttcacagtgtaagtcattataaaatttcccacatttatattgatgttaatgaatctatatagatatatatgtctagatttattaacatcaatatgaatatgggaaatggtagaataacttacattgtgaaacggagggagtatatagaacttgaacggaactcaacatactaattggggactaaaatcaactcgatggatgtgatattttttcttattaatgtggaaacttttaacagtttctgtttaatgtatgaattatataatgaatatattttccccttgcacttaaataagcggaag

SEQ ID NO: 63184 - DNA, 1443 bp, Oryza sativa
gtgcctcggctgattcctggacgagggttcacacacatgtaagcgtttggaattttggatagaaattccgggcatgacaagttggtatcagagcctctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactccctcctttcacttgtctttagatgctgcgttacaagcctgagtacctgtttggtgttgagggttttgtccaggagttgcgtacgatgtcctttgtcattggatttgggactgccccattttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgacagtggcagttaccttgagactgaaggaattgagaatgatgctaccacgaagcatttggttgagatgttgtgggctatggatgaaagtcgtgtggagactgtgttagccgctcaagatcgtgaagaccggaatcgtggtaagatttgcaagttagaagacaaggtggatcgtttggagaaggaattagccgcattgaagggagaagcaccgccgtagaaggccaggattcgtcttaccgcaaggaagagagctctatttgtccctctctatcaactggcgccaaaggttcgtgtggtggagaaagaagttgccccagctcaagcggatcctccggtcatcatcataagtagtgatgaagaagaagaatccaagcgcatcaattccaagattgagtgggtagcaactcaagatgataaagacgagccttcaatcgacctccgatgcttggaagaactagagtgacttgttaagtcgttgtcttagagcgttgtgttagtttgcttgcttaaagtttgcttgtgtgtggcgcat

SEQ ID NO: 63185 - DNA, 3365 bp, Oryza sativa
agttcatcgttttcacccaagggaaaattggcaccgcgttttgtgggaccttataagattgtcagtagaagaggagaggttgcttatcagttagaattacctcaatctttggcaggagtccataatgtgttccatgtgtcacaattgaaaaaaatgtttaagggtacctaccgaagaagttaatattgagcagatagaagtccaagaggatttgacttatgttgagaaaccaatccgtatcctggaaacaaatgagagaagaaccaggaatcgagttatccgtttctgcaaagttcaatggagtaatcactcggaagaagaatcaacttgggaacgagaagatgaattgaagtcagctcatccgcacctgttcgccagttcttccgaatctcgaggacgagattctgtttaagggggggggtaggtttgtcacaccctgaaaatttaaaatttataaattgttgtttaaatggaatttttagaaataattttaaaagtcttgaagagaagatctagttttaattaataaattccaatataaaatgggcccagataaaatttcattcaatactttgcttaattctataattcctagatttttctgggacttatttgagctaaggaagtatttttaataaatggaattgcatttaagaaataatttaaattgaaaaaggttttaaaaagtctcttttggctttgggccgaaagtcggcccaaaacccctctctctctctcctcggcccagttcggcccagtccgccgcgcgcgcgccctctcgctgtcgctgacaggtgggtcccgcctgtcaggaccttcgtcctccttcggccgccgccgccgaaaccctagtttcgcgccgccgccgtttccttccaaatccggccgttcctttccttctccggtcgaatcaaaagaggggaaacaatctccgggatctcctctaccttttctcctttggaatcttcggctaaatcggtttggaagttcgtggaattgagttcgattcggatcgacctctttctttcaagccgcgagtttccttcgccgttgccgccgtcgtgggcctttgccgccgcctccgagcccctttaaaaggacccccggtgtctcctctacccgtcgccaccttcgccttcgcctctcgtcgtcggaaaagccctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgccccttcgccgtcgccggagatcgccggagcttcgtcgccgtcgacaacccgaaggtttccgccgtttcctcctcgtcgtcgtcgtcgtccgttgtttttccgccgccgttttggtcaccggtgtgttcgccgcgtcgtcctctacgtgctggtgccctccgtttgcgtcctggtgccgccgttcgccggcaagcgtgcgccgcccgagccgtccgctccgccgagccgccgccgctgtcggtgacgtcaccgttgacgtcatcggggtcgtccgccgtgagccggtcgtggaccgttcgatctcggccgtccgttttggattggttcgatctcggccgtccgtgtgtgtgaatcgccgcccgtgcgcccggtccaccaaaccctagcccgctgacgcaataatccttcttttccttttcaaaaataattcattattgcgtcataattcaattttaaccaatataagtgttttaatccgatttaatctttaaaaattcataactaattcatcttagctccgatttagttggttcaagtctctaaatttttctaaaattgagatttacactttaaaaatatccacatgtactgttcatgcttgtttatgtgctgttttggtgattttgctcttttctgcttagattccgtcgtttccggagagtccgttttcgcagaagaaaagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatataattgcttagccctgcttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtatattcctggtttggagatagaactgtgcagccggggtggttgttcagaatggttgggcctatacaacagggtatgttgtatagcgttggattaatattgtttaattacttaagtgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttttttccgctgcttagatctttattgattgagaggaactatctacctctgtaatgacattttattcacttattaattagagtaatatttgtactctattatcaatttgttattgtgtgcctcggctgattcctgga

SEQ ID NO: 63186 - DNA, 1505 bp, Oryza sativa
ttaaatgatcttcgtgactttaaaactatttctcgagctccgaaaattcacggaaaattccggagagtacattagggcacaaagaatattacaaaatattcccggccaaagatttttaagggaaaattttaattctcccattatttcacttgattaaattgctttaacttttatttaatttccagaaaatgcattattaaatgatttttaatcccgaacgaaaatcggggcgttacaacgggcgacggcattccggcgaaacagaggagcagctggaggagaggacaacgctgcgacgtcgatcggcgtaccggcgacgtacaggagccggccggaggcggggaggtactggacgccgacgaggaggccactccggcgagcttcgggcgaggaggaggtgatgccggggatgagggcagcgtcacggagccgagagaggtggtggcgacgtcggccggcgcatgggaaacgcgacaatggcggccggaggcggaacagtggcggcaacgccacagttgccggcgggggcgcacctccaagggtctccgtgcaaaacggagggcaggccgggggagaggaggctgctgcgacgccggggaaggcggcggcacggccggacggcgcgtgggtgaggcggtaggggcggctggagggtggccggcaccgaggaaagagaaggaggaggcggggagaggtggtgtggtcgcgggggagctcgggaaggggctaaaacgatagaatgcaaagagggggttccattttatagcggaagggaatgagccggccacgggaggagcggggaacggcggcagaaaaggcgcccggcggccatggaaggcagccatgaatggcgcagccgttccggtcaaaatagtgcacgattaaaggggagattagggggaaaagggagaggaacgaaaggggattaattccccccaattaattttggaatcccatgcttgaatcgcgcggatttgagggaggaatggcgctagggtttacgggagaaagaggaaggaggccggcggctggaggtcggggacacgcctgacaggcgggacccacgcgggaggcgcgctcaacgcgcgtgcggcgcacgtgcgcgggaagggagcggctcagcttgggccgggcggccggcccaggaggagatgagggagaggcggcccgggggagagagggaggaggagggagtgggccaggagggggaggcccaagaggagggagagaaggagagggagagaaagagagggaggaagggaggactttggccgcgggccgagggagagagagggaggctttgggccagacttggcccaaaggaaaaggaggattatttttaggttttctttttaataaactttgataattgtttttgttgcttaataattattttcggtgctctgaaaattcaagtaaaatttgagggctccttttagaccaaggagaatttaacaaaaattctccgggccacgttcgaatttttcttgcacgtattttagtgt

SEQ ID NO: 63187 - DNA, 3876 bp, Oryza sativa
  unsure (1)..(3876): unsure at all n locations
tcctttgtttcacagtgtaagtcattataaaatttcccacatttatattgatgttaatgaatctatatagatatatatgtctagatttattaacatcaatatgaatatgggaaatggtagaataacttacattgtgaaacggagggagtatatagaacttgaacggaactcaacatactaattggggactaaaatcaactcgatggatgtgatattttttcttattaatgtggaaacttttaacagtttctgtttaatgtatgaattatataatgaatatattttccccttgcacttaaataagcggaagcttaaaagaacatcattctcaacatcagatcaatttcaattctaaaaatatagtaggttatatgtatatagaatcatttgactgcaaattttaaattttcatgtttttgaatcaaattcaatgtaatattgaatgccagtttcagtgcatgctgtgtgtgtgtgtttttgtagaattttcttcaaatttggttcgagttgatttaattcttttaatataagaagcatatataataaaaaaatggttatttgtgtaatttctcttatgaaatttctataaattttgattgcagtcatttgaaaattttattttttcttttcaaatttagggtcaaaaacatttgttcccttcatttttttcggaactaaagttttttaacttgacaaatatgtcttataagttcagacttgagtgttaacccaaaacatgcgttcagactcctgcaaacctagtaataaattaaattatagcagagtgagtttatttttaagtatctgttatcatatcgcctccttaaaattatattcactataaaagcaactaatctaataatctaaagctgctcttttgatagcttttgattggttcacttggtgcctcttactttggagaaaaatcataaatctatactagagaaaaaaatacctaataatcatatgtgagaaaaaatctagagaaaaatatcacatatggattccagaggcttccaaaactatcttccctttccaaccacatgaacttttactcctttaccttctataaatataccacccctacttggtactactcatataactctttaaacccaaaattattaagaaaaaaaaaatctaaaatagcgaatttacattcattttccttctttaagtatcatacgcctacttggtactactcatgtaactctagaatatatagtaaacccaaaattataataccaaaaaaatatgcaaaacaaacaaagaaagaagacaaccttattttcttatatcatcatacctactcagccttgttttcttatatcatcaaacctacttagctaaaaaatgattgtgttttttttttacacaggatatgttaaaaactctaaatgtactaaatgcttgatctttcaaaaattcaaattcataagaaaatatatttgaatcaattaattctgataaatctcaaaatttcttttacttgtttggatttatcaaaatttatgtataaaatgatgtggcacttgtagcaagtacttttatattcaggctgaagaagcgatataaactgttaggttgttccttatttggtcttttctaatgcctaatgcagtagcacacatggcaaattggcaatgcatgacgttagtattaggaaataggaggtgatcttctaccactaatgtgagatttaatgcaagtaagactgtttgtttaagaatatactatataatataaaatgcagtgtgctagctaccagtagtacagctgctgttgtctttttatattttagagtttatgtatgcatgaccagtatgcatggagtcataaaaattcatacacgagatggttgggaaacttggcgatgatttttacctttaagggttgnnaaagaggtatgattgtttgatattgatacatacttgttggtggagttcccattgctggtaactattacattctgggtgtgctgaatgattatgcttggtggtagggtgctagaggaggtggcttggtggtagggtggtagactaggtggatgtggaggtccaccgtacaacggtgccgacatccatggcctgcatctagatagtatgtttctcattctcttataatatttcaagaaaacatcttaaccatacaatttgatctagatagtatgtttctcattctcttataatctttcaagaaaacatcttaaccatacaatttgtgttttttcctgttagatttcaatcgctacattgtgagatttaagggagttaccaaagacatgattgttcggcagatgttttgtattatgtctaatcctaatgattttgatctgcttcccgataatgatagcctcagtgtggtatgcttctctctattagtttctcttttttttctcctctatttttctaactataagtggcagtttgtcaggaattatccaagaaaaagggtacattgtgagatttaagggagttaccaaagacatgaatgttcggtagatgttttgtattatgtctaatcctaatgattttgaccagatagcctccgtgtggtatgctgctctctattaggtttttttgtctcctctatttttctatctgtatgtcttaatgatctgcttttgggatgttggtagagggtgtgtgtctgttcccaatatggatccagatgctgaagaagaagacgaacaataagtctacgtgtttgttggtctccacgataaccataagtggcagtttgtcacgaattatccaagaaaaagggtaagacacaccaatggcaggtaataaaaagaaactggtcagtaggctttttgccgcgcggtgcgccggttagacgcagcgaccgcgacgccacatttgaaaacactcttggacgactagttatattactcttactcatataagtacatgcagatgcaaccatcgatcgacacgtgttgtatttgaatatatatgaacctgactcatatgtattcctaggcatgcaacacatgtgttgctgtaactcagtaggatttataatatgatgagggcgtgtttctgttcccagtggatatggatccagatgctcaagaagacgacgaacaatgagcctgtgtgtttgttggtctccacgataaccatgagtggtaccaagaagaagaagggtaagacatattttttcatatctatgttcacatgcagtaggctaggcagtagatagtaatcatggctggtcggtaggctaatcatgactggcagtttgacagaatttagcagttcaaagtacactgattagtaggctaggcagtagaaaattagcaagttggcattggtgagtaataaaaagaaactcgtcagtaggctttttgtcgcacggtgcaccgggtagacgcagcgaccgcgacgccacatttgaaaacactcttggacgactagttatattattactcttacttatataagtatatgtagatgcagccatcgatcgacacatgttgtatttgaatatagatgactgatatgtattcctaggcatgcaacacatgttgctgtaactcagtagaatttataatatgactaactaaattcatagtggatttaatgtaggacaacaactcttaatggatccaagggtcatttcggattgctgcttaataattataaaatgtgccaagccaattaatccattggtaactcgattctttggccgaatttggattacaaccaacttataaccacaaatcaatgtcataacctaccaaattgctgttggtacggacagaacggtaaattaagaaccaaaatgcattatcattaatgcattaattggtcagattaatcagaaaaatgaaatcagaccatagtccacacgaactttcaggaacatgga

SEQ ID NO: 63188 - DNA, 10513 bp, Oryza sativa
gggggaaaggagagagagggagggatagttgggccaagccggcccaagaagggaagggggggaaagaagacttttagggatttttctttttataaaacctttttaactttgtttatttcttctcaattattatttgtgctctgaaaattccactaaaatttatttacgcattttaggcttttaggaaatatacaaaaatcctccaagccttatttgacttttaaatttgcacattttaattgttgaaggctttcacatgaattttaattattctcggcacaatttcgaggatgtattttagggtcgttttgggacgcgacaaacctaccccccttaaacggaatctcgaccccgagattcggaagaactggcgaagagatcgggatgggctgccttcagctcgtcttcacgctcccaggtagcttcttcttcggcgtgattgctccactggaccttgcaaaaacggattacccggttcctggtcctgcgctccatggtgtccaggattttcactggcctctccacgtaggtcaaatcttcgcggacttcaatttgctccgagtcggcctgctcggatggtactcggagacacttcttgagttgcgacacatgaaacacatcatgcacgttgcccaaggaggcgggcagctccaactggtaagcgacttctccgcgccgagcaatgatacggaaaggacccacataccgaggtgcgagcttcccttttgtctgaaacctgtgtacacctcgcaatggcgtgacccgaagatacacaaagtcgtccactgcgaattccaggtcacggcggcggttatctacataacttttctgccgggactgtgccacctttagattatcccgaatgattctgactttagcttcagcttctctcaggatatcagtcccgaacacttggctttctcctacttggtcccacaagagtggtgtccggcatttgcgcccgtacaacgcttcataaggtgccatttgtatgctggcttgataactgttattgtaggagaactcggcataggggagactcttatcccaggtcttcccgaaatctagtacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagcttgtttcctccataggtggtcttcacaggaataaatcgggccaccttggttaatcgatccacaactacccatatagaatcatatccaccttgggtttttggaagtccggtgatgaaatccatcccaatttcatcccatttccattcaggtacttggagaggttggagaagtccggccggtcgttggtgctctgccttgacacgctggcacacgtcacaaagggccacgaactctgcaatttcccgcttcatgctaacccaccagtatttctccttcaagtctaggtacatctttgtactgcccgggtgaatggaataagggctctcgtgagcttcctgaagtatcagctgtttaagttctcggttatctggaacgcatacccgctttccgttccatagggttccgtgttcatcctctgtgaaaccagcggctttaccctgtttcatattcttgaggagtccatgcatgtccgggtcatttttctgagcctcgcggatttgatcgagcaaggcgggcttggcttctaacgcggccaaaaatccacgaccaactatgcttaggttcagggcttccatctgttggttaagctcgggtggaatgccacggacgttaagagtgttgcaatggctctttcgacttagagcgtcggcaaccacgttggccttaccaggatgatagtgaattcccacatcatagtccttgatgagttctaaccatcttctttgccgaagattcagatccgactgggtgaagatgtatttcaaactcttatggtcggtatatatttcacagcgattcccaatgagatagtgccgccagatttttagagcatgaaccaccgcggctaactccaaatcatgggtagggtagttgccttcatgaggtcgtagctgacgtgaggcataggctaccacatgaccgtcctgcatgagcacgcaccccaatccttggcgcgaagcgtcgcaatacaccatgaagtccttgcgagtatccggcaagattaacaccggcgaggaaaccagcttttccttgagagtttgaaacgccttctcgcattgcgggctccacacaaatttctcttctttcttcaacaactgtgtcatgggtcgggcgattttggagaagttctcgatgaatctccggtagtatcctgccaaacctaagaaactgcggacttgagtaactgtcttgggttgcttccaatcggtgacggcggtcactgtttcggggtccacagcaactcctttagctgatatcacgtgccctaagaatttgacttcggacaaccagaactcacacttactaagtttggcatacaattgatgttcccgcaactttcccaacaccagacggagatggtgctgatggtcttcttctgattgtgagtatatcagaatgtcatcaatgaaaaccacaacaaacttatccaagtattccatgaacactttgttcattaagttcatgaagaaggcaggtgcattggttagaccgaatgacatcaccgcgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcgacgcacatcctcttcgtcttgtctttcttctccacaaaaatcacaggagcaccccatggggaagtactcggacgtatgtactccttttctttcaactcttccaactgtttctttacttcggccagttcatttgctgccatacggtagggtcgcttgtacagaggagtggttcctggagcaagatctatccggaactcaatctctcgcttgggcggcataccgggtagttcttccggaaacacgtctccgaactccctgacgatggggatttctgacagtcctatctgatgcagttctgaacttctgacagaggttgggggtgcaaagaaaacaaccggttgttccggccctcggtacagagtgaccgtgcgtctcgcgcaatccactactccttggaattgagccaaccaattcatcccaaggatcacatccaagttctttgtgtctagcagaatcagatccgagggaaaaggaatcccctgaatttctatagggacggcagggctataatactttgctgtcataacccctccaggggtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacgtccttaccaccgttgttggggcggggaggcgcttggccttgctgacgccttggcttcgggcatttatccgcaaagtgcccgggctcgaagcagttgaagcacagacgctgctgaccttgagcgtccctgtggccttgaccaggctgcacagttggcgtaggaggacggggcgcacgagtcccctgctgaccctgctgctgctgcggctgtgggacgcgcaccacgaattgaggtcgaggcgcggagcgaggctgctgctgctgctgctgctgcgaggaggatccccctggatagggattggtgtagcggaccctttggttagcaccctgttgattgcggaaattcgccaagcggcgcttgtgcgactctagttccttgtgcttggcttccaagcggatgctcttgtccaccagtcgttgaaaatccggatagtccccagagactagacggacggacagctctgggtccattcctaccaggaacttctcttgcttctcctcgtcttcccgcacatcctccggggcgtaaccggccagattgttgaactcatgcaaatactccatcacggagcggttgccttgcttcaactctcggaattcccttttcttaagggccacgactccggcgggcacatgggttctccggaaagcggcggtgaagcgggcccaagtaataggctgcccctctggctgcgtagcctggaagtggtcccaccatagagatgcgggcccctgcagttggtgggcggcgaagatgactttctcctcatcgctgcactgcaccgtgtctaactttttccccacggcatgcaaccaatccaacgcatccacggggttgttggagctagagaaggtaggtggacggatgcggaggaactcggcgagtttagagtgttggggaggtggtagtggggcattaagttgtggcggattttggaggtggtggaggaaagcagtcatcatgttggcttgctgggcgaggatttgggtgagaatggcgttggtgtctggtggtggtggtggaggtggaggaggaggttgaggtgggttgccctggtggttgtggttgctgccttcgggttggttgccatcaccggtagcagcatttctcctggtcatcaccatctgaaaaccccacacagaaccagcaaacagagagagctgacaattaaagctaaccacccacgactaccataattcttgaatttattactgctattaaattggttcattaaggttcaagttgcttaggcaaataaaataagacaggctccgacacagttatgccacacaccggcataaaccatgccccacacaacccaacaagaagacaaacgagaaggaacacacgcgcaagcctactaactgctcgtctaccgctgcgacgggccagggcggaaggtgagcaacagcgcatcctccgtgctaccaacgcaggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcggcgcttggggcggcagatctctccctgggcgatcttgagctgatgcagctgcgcctccaccgcgtctaggtccttcttgagctgcaggttctcctgacgcagctccaggatcttcatgttgttctcgaccatcccgcggcgcaccatctgatggaagtcgatacgagccgcgtcgtacgcctccaccatgtgtgccaggtgcacgatggtagcgtcatcctccgagctagcatcccggaaggtggcgtagtcgcgggctcctccgcggcgagggtggtagcggtagggcgagtgctgcaactcgtccgggtagcgctggtggagagtgccgatggcgaggagagcggcgctctggcaagcggcggggaaggaatcgccacccgcggtgactgtcagcgaagtccgctcagaagagccagcgaggatcactgcagtgacctcccaaccagcgcggggctccgcatcgtcaccctcctgttccggaagcggcctggcctggtagttgtcgcgaccgggaaaattgccttttcccgaacgctagtgtattaatccccgtcccaggaaaagccgggttacaccacacaaacatgatataaaagacacatctttattatatcgataatatttacattattacaaaggcgcttaaggcctgacaatcaaaaataaacagcagcggactagcgggcctacggctccatcttcacaggcgctcaactggggtataagccaggactccacctaagacttcttctccaaagcttctcttactgaaggggggaagaaaaatagagcaagaatgagtacaaccacagtactcagcaagccacaccggggatgcacaattaatgcaaaggagtacaaggggataataatataggggttaagttttgcagtaaacagcatttaaaagtcacttagttgcccaaagctattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatccccctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggaggtgtgaaacctattccacaatgatccaacaattccagtgtgtccaggtgatatgaatatcccaaagtctagagttgtaaaaccgcctaatgttacctaattaaacagcgaagcatctacctaaaatcatactagtgataccatgagtagagtgtccactagtaggggttttgtttaatctagggtgaacaaggaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccacataacagcagaaacaaagcacaaaaatgggttcttgacttcttaaggaaaaattagagacttgaacggtccaattctgagttcaaatggccaagatatggccatttgaagtttatatgctctttaaatggatatttgcgaatttcttcatttaaaatttaattaaaaacccatttattgcgtcagccgggagagagggcgcgcggaccgggtccacgggagtggggcccacgcgtcagcccctcggtccacggtggaccgggagcacgcggctggcggcggccggcgccgtgggtcccacgcgtcagccgcacccgcgggcgcgggcggctgacggtcgggcccacttggcagccgcgagggcgcgcccgaaggcggcctcgccggcacggccgacgggaggcggcacgaccgcgccccgatggtcaccgccggcgaccaccggcgcggcggagcggcgcccgagagagcggagaggagagggaagcgaaagggcggtcttcggctcaccccgggtcgacggcgacgacgggaacggcggccgaagcggaggaaggcggcggcgcggttcgggacggcgagggcgacggtgctccggcggtcggcgagcgaatcggaggagcggacggggtcgacgacgacgcggcgaagccgaaggaggcgacgccgagacgggaggaagtccggagcgacggcggcggcgaaccggagctcgtcggcgacggcggagagagaggaatacggcgcgagcgcgattccgacggtgagagcgagcggcgaacggcggaaacggaggagagaggcacggggagcgattatatagcaccgggagggggagatagcggccggagagggaggaaacgggcgcggagatctcggccgccattgattgcgtcggcgaggatcgcgggtgtaaatcggacgaatccgagggagagagagagggaaaaacgggggaatcgggagagggaatcgcggggaatgattcccccctcattatggcgcgcggggacggcgggatgcggcggattcggcggcggcggcggcgctagggcacaggcgagcggcgggagcggcgggaggaaggcgatgacaggtgggccccacccgtcagggagggcggcgggcgggcccgcctgtcagcggcgcgcgcgcgggggaggccgatgggccgcgggggagaggagagagagggagagaagtgggccgagccggcccaagaagggaagggggggggaaaaggacttcttttagggtttttctttttataaacctttttaactttgtttatttcttctcaattattatttgtgctctgaaaattccactaaaatttgagggctccttttagaccaaggagaatttaacaaaaattctccgggtcacatttgaatttttcttgtacgtattttagtgtttgccaatttcttttcgaattttaattaattctattattccttttagagaatgatttttaattcgggatgaatttatcaggacgtgacatttagcatctttcttagtgaacaggtatatcagagtagcatgatcagtatagactatcaccttagctcccaccaagtaagatctaaatttatcgatagcaaaaacaatcgtgagcagttctttttcagtagtcgaataattgaattgagctcctgttagagttttgctagcgtaacatattgcatgatgctttttattcttggtttggcccaagaccgcaccaacagcgaaatctcttgcatcacacatgatctcgaagggcagagtccaatcaggaggttgaatgattggagcagagacgagtgcctttttgaggatttcaaaagattttaggcacacgtcgtcgaactcaaagggcgcatccttggccagcagattggtcagaggccgcgcgatcgtagaaaagtccttgatgaaccttctataaaagccggcgtgtcccaagaaactgcgaatccccttgatgttcacaggaggaggaagttgatctataatcattgattttagcatgatcaacttcgattcctcgttcggacactcgatgaccaagagctatcccttcaccgaccatgaaatgacacttcccaattaagtaccaggtccttctcttggcatcgttgtaagactttgtctaaattttgtagacagtgaccaaaggtctttccatagacagagaagtcatccatgaagagttccataatatcctcgatcatgtccgagaaaatagacatcatatacctttagaaagatgcaggagcgttgcatagtctgaaggacatcctatgatatgcataggtgccatatggacatgtgaaggtagtcttacgctggtcctccggatggataggaatttgatgatatccggaatacccattgttgtcgaatggacaactgcatcacgtcgaaaggcgtggttctctcaacagtggttggaattttcggatccccctattacatggccatagggggctatttatagccctattacgggctctccctattggggtttaggttttacaggggaatttaaatggttacccttataacagggacattattggggcacatagtgtcctttacatatatagacccctattgggcttaaaatcgctaggcccatctacttagtgaaagaatttggcccaacggcccgttgagcaactcttcggtgaggttcggcatctggcgaacctgagccctcttgccagggctttcgccttgtcatcctcgcccacatcgccttctgacgaagtccctacctggctaagcttgggtgtccgggccatggctttcgccataagacattcgcccacacacggtttccttctcgatcttcgccactttcctccggtctaagcttgtcgcttaagcctttggttttggcaggcccggccgaaggcccttcgtggtatacctccaactcccatcaaggaaacagaagaagtatagatttgccagctgttccaacatttcgtcaccgaagggtagcgggaaatgatcctttttcgtagccttggtaagcttcctgtagtcaatgcaca

SEQ ID NO: 63189 - DNA, 3500 bp, Oryza sativa
  unsure (1)..(3500): unsure at all n locations
tgttagatatgaaccgtgctagaactacatttattttgggacggagggagtatatgacagttgagtcggatgtataacacagctcgtgatgaaaagtaactgatgggctggggctagatccctacccacgcaagggccccatgaaagcaaccgatttttagtgtttaaaagatactcctaattaattaagttcaggaatagtcctgccagattggtgccctgtgaccgtcttagaagtatctgtcgtttgtggtgccaaggaagtgctaagtactcctagatcagtccaacaagcttctgcaaacgatgttatattattaccatctttaaactatccaacggtttctgtgatgattagatgcaactgatcacaaacatatatggtacacgtgttggcttggaaacgaagaagggaaaagaagacatttaacattgctttcgtctcaacttagtggagctatattttcataatacatatgattgagtataaaattacaatgaaattcaagtatcctttagatcagagccacattgtatctctgtttcccaacaaaaagtacataatttcttttgtgtgctgaatcaaaatttttaacaatagcaccagcaacatattatcactatattggtacaaactaatacgtacatataagtcatacgaatatttatgtaccttcagttttcattcgtatgactaaaaatttatagttacacttatacatgtaattaagcataatcctttttctttctatataagtgcatccttaatgttgagcaacataatcaggacagttttggccatctcaagtgaatcagattattggatacatcgtctcaaaaaaaaaagattattggatacatgccacaataaatttactactttggaaaatatagcttactagttacaattctctatttataaccattccattgcaacactcgtgaaattagatctatgccatgttatacancttgatacatgttttgaatcttttttggtatatttttttttgtactcctgccaatcctctcttaaccatagacccaaatcccaccaaccgaagctccaaattccccaaatcccggcagtagcgatgcgcggcctggcgacgacgatgaccttagcgccaacttgcgtgctatccgagctgatccagcaccggtggcggtgagctcagctcaagcagatctagtggagacgacggtatcgggtctggtgttgagctacgacgtgcggtctgacagaggtgacatggccaacggtgacaagaagcgtagctgcactgcatggtccgacaacaacaatgagcttagcagagagaaatatttaaccatttgccacatttagatgtgacaattaactttttgccactgaagccacatgtaataaatacatgtggacccacatgtcattgagatagagatggcaaatagttgtttgccaaatctaaaagtggtaaatagttaaaagccgtcgatgccaacgacggtggggatgggatggccggctcgggtagtcatcatggatagcgaccgctccaccgccctttcttttttattatttttccattttctaaatttcttttaccaatttccccctttttcccttgtatgtataactatgtttaccgaaatttaaccacagtttttgagctgtagaagatacggatatttgggtccatatataaatacagtggataagaaatgattcaaaatgtgtatcaagtgtacggcatgttatggatccaattttaaaaatgttacagttgtacaaataataataatggtattttttcgaactagcaaatttataatggcatgaatccaattaattaaccagttctatttccttgactcactcgagtctatcgaaccatggatggggagctccttcctcttctcgattcccttcctctcgtttgataataataaccaacaattttgttccttgataaatatgtaataataaacccggcttttcgatcaattatcctgcagccttgtacttttgacactgtaaatcttggccaataattttatctgttctttacattgtccatcagatttatctctccactgaaacttgattacttgatctctccactactgatttattggcaaacctgttgcgtgatcttatatagttgtcaataattaatatccctttttctcttgctccattgttcacagagagtttcgtattacaccctccgtcccacaaagactttacctttgagttttatgtccaatttttgactgcacgtcttatttaaaaaaataaaaaataaatacacacaaacaaagtactattaatgttttatcatctaataataataaaagtgctaaccatataaaattttaaataagatgaagagtcaaaccttatattaaaaaactaaaaaatagagtctttgtgagatggaaaaagtaaaagttagtagtacattacatagcaatcctaccgtaaggtgcagggtatcaccgtattatctatcacccgtctgtctcatcacatcgctctagtaagagacaaacacaagaaggcaaatgggtgttggccggacagcctagcttccagagcccctgaactgatcaagtgccgctccactgctctgacgaagtcgtccatgatttcatctgacgctgcaaaatgctgcactattattggctcaaatacagctcttacgcgcaaggctaccatcttcagatcgagcaaggctttgcccgtgccgtcatacggatcgtgcatcatcatcttgttgacctcaaatgaaccctcctcctctatgatgttgttaacttcactgtccatagggcagcacaagggaatgtagaaggagtcaagcttttctttgctgataacaccctggcattgaattgaagaaaattcagtataacagagtagatttgtatcagtgtagctgctttgtataaaatacatataagttgtagagtaattcaggtaataaattaacctagtttggtgcctacatatgcacttgtgcaagtacccctatgagctgatttatttcgaaactcttttaatccctaaagggaggacgcctgaaaagttttgcagcacatgttctgtcactcaacatccaactgtcactggactggaaattttgtgggacagtagatgaacgcacgttgtacatatgaaaattattttcagaatttaattaagaggttattacccgtatgccattaagaaagatgatgctggcctctgtgccactgaaaagttcgagcctccctctatgccatcgtcgaactttatagcgccctacacaccattccgtcctttttgtcctaacggtagaaaacagcgcatctaaatgacttagttgccattaggcgttcttgccaacgtgttcgttcgttcgtccccaaggcgccgaggaagggggaggaggggaacagctcctggccgagcaccgacgtgacgagcgcggccaccacgtccacaagcagcgcctgcgcgccgatgttgtgggagg

SEQ ID NO: 63190 - DNA, 7456 bp, Oryza sativa
cggtccacgatggcgagcacggagaaggagaggaggaggtagctgccgtgcggccgccgccgccaccgctgctcctcctcatctcttacccgccagcccactctgacacccggatcggcgggaggagggatccctccccggacgccgccgctcctcgtccatcttcttggtccgcgacgaggaggagcccgtgggctgggatgatccggaggcgccgtcgccggcaaaggaggaggaggaggagccggccttcatggcgttgagcttgcggaagtggagctcgatggtggcgcggagggagttgtaggtggcggatgccgccgatgccacgggcggacggggagggagtcgtcggcttggaggacggggtgagatttcgatttggctgtggagtggattgagtgtggtgggcggcgtggatggaggtggcggtggccatcattccctacggcggcggccttgccgccgcgccaccccacccctcctggtcgccgcgccgcgccgcctcggctggctgccgacgccgcctggccgctggcgccgcctggccgcctcgcgcggtcgcctgcctcagcattgtggctggccgcttttccgccgcgccggtcgcctgactcagcgccgcgcctggccgcttgtccgccgtgccgcctgtcctcttttgaaagggcaagagcgacatttttcctacccgggcccatatgtcagatttgccaaacggttaaacccacacagaatagcgacagaatggtgtggagggcgcaataaagctcgccgatggcatataggaaggctcgaacttttaagtggtacagagacatgcatcatctttcttaatggcatacaggtaaaaacctctttaattaatcatgtaggtcgtaattaaagagttgacgtgtgcaaagacatcttgtgtgtgcttgtgtccttttgtttttgtttttgtttttgtttttttgcgaataagagcttgaagaaaaaggtagatgaatcagaagcaacaagggaacagcagtccaaagagattatgtgtgtgcttgtgtcatatgtgattggaaaacacgaacataagactgaattggtatgtgccgaaattggtcaactcacccttaatgccatgtcacttaaagccgtcaccgccggcgtccatggttgaattaactcagtgtcaggtttgtccgagcgcttgaccaacagtgagacaaccattcggcctccagggacaatctcctgtgccctcaagctcaagaatcgcatgaaatccttcctaaactgccgagcataagaatccgcgacaatttgatgccttgatgatctcaactgttcatcactatcatgcatcgggattctactcttcttgagatcttcaggtgcctgcagttacaatgcacactacttacagaaatcaaaacataccccctccatacatggatgggtaatcaacacaattagttactctctccattttttaatatacgacgccatttgacttttgagattcatttgacaattcatcttattaaaaaaaattatgtaattatcatttattatattgtgacttgatttatcattaaatgtttttttaagtattacttaattttttttatatttacataaaaattttaaataagacgaatgatcgaacgtttgttaaaaagtcaacagtatcatatatttaaaaaacggaggcagtacttacctcggataaccaatgcaagctgttagccgagcaaaccaaatgcaaggagccacgagcgaatagcctctcgtagaacgacccaggtaccataccggtgatcacagcagtagggcgagcgagcgcttcatcaccactgtgcttcagtgtgtccaagctcttcgccacggcgttgaaatcgttgtcaggcagatcgttcaggagcacgcacatctccggcggcagctgctcgtgctgcgcgcagtagcggtggatggcgtcgacggcggcagagacgagcgtgagcgcgtttggtccggaggagcagcccaagtccgcgatcaccatgttctttgggtgaggacatgagcttgtgcataagcctgtgactgcctcctctatcagagtcttcatcctatcctgggctgttttctgcgtgcaaattattttcagatatgtctcaatcagatcttgcaagcaagcaaagtaaacattgaaatagttggcttttttggccacacaatgcagggtgggtgtagtatgatgattttcagattacggcggggtttagttttcaattttttcttcaaacttccaatttttccatcagattaaaactttttttacacacataattaaactttcaacttttttctctgaaattctaattttagtcaaacttctaattttggtgtggaactaaacacaatcgtcaatggatagagttaccagctgggaatatgatgaaggccgagtttacttcaaactttcaacttttccatcacatcaaaacttttctacactcataaacttccaactttttccttcaaacttctaatttttgtcaaacttctaattttaatgtgaaactaaacacagccgtcaatggatagagttaccagctgggaatatgatgaaggcagagtttagttccaaaacttttcttcaaacttgcaacttttccatcacatcaaaactttcctacacacataaacttccaactttttcctttaaacttctaattttagtcaaacttccaattttagcgtggaacaaaacacagccgtcaatggatagagttaccaactgggaatatgatgaaggccgagtttagttccaaaagttttcttcaaacttccaacttttctatcacatcaaaacttttctacacacacaaacttccaacttttccgtcacatcgcttcaatttcaaccaaactttcaattttagcgtgaactaaacacacccaaaatatgaatgcaccaagttaaactgtcaaacatcaaaattataaaatttatatgcgctcaagtcagacaactaggtagattggttccatgtgaaacccattttttttacacaaccttcaagctgactctatttagcgagtgattttataatacttgagaaggtacctgcaagtatcatattttttatataaaatttggtcctctcaatacttccagtagcaagaggtatcaaatttcaactaaaaattttaatatctcttggtatctcttaagtattgtaaaaattctcctatctcgaacatacctcgatgcatctagtatcatagttcgaaaaaatggtgcaatattccgttacattaaaattggagtatttaatttgaacaagtgagcatatcctagcttactataaacttatcccccactaactccttaagcttaatatgcaaagatgccacataatcatccactaacaagatgccatataatcatccactaattaacaagatgccacatcatcatccactaacaatcatcacatttaaacatcatgcaagcatgctatatctttatagtttttataatttaagagcttttcaaacacaaatatgttaaattatcatctaacataattcacataatgtttcaatgtatatcttcatactaaattcccgcagcaatgcgcggggtttcacctagttcttaaaaaaattgtcccaagtaaacatagttatatgatcattttgggtaaatagccaatacggtcccttaagtttcacttcggactcaatttagtcctcaatgtttcaaatcgttcaaacgagtcctccaaattaattatttgggttaatataatccttggaccaaaaaaatatcacgtgagcatgccaagttatcctcgcatgtagcggtatgaataaaatgaccattctaaccttatataatatatagaaaagaaagaaaaaacacaaatagaaaaaaataacaggctagccgaggcccaacgatcggtgcttgactacagcaatcgtaagtgacaattctaaaacgatcatacacctgtgaaacatttgtcttcttttcttttctttcttttttatatggtatataaggatagaatggtcatttcattcataccgctgcatggcaggatgacttggcatggcatgctcaagggacacttttttgagttcaaggactatattaacccaaatgattaatttggagaacttttttgaatgatttgaaactccgaggactaaactgagcccaagcaaaacttcagagaccatattagctattcagccgatcatttttatataaacatttaggccattaaaattagcttccaccatattaatggcaattcctttccttattttgtcaaaaacaggtgaataagattgcattatgaccaaaataaatccatttctctgttttttggcaaatatcaaactgtcatcaatttttgtacaatagaccttttataaaaacaaaaatatctgatcagtacaaattctgccttgactggttcttatttcaatgattcaattcatttataatctgctactgtcagttccttcagatgacgaattagtacaaggcatgtaatactcagaaatgaggcaacgccctcaactttcgacaatcataagaagccggtatagcactttgaagaaagagcaagcatctctggccaccgagtcagagatttgcgccaatgggcttggtccaccccactcccactcgcgcctaacgatgagaaccgattccctcggtctcgagtgcacattgctctctctcttgtgcgatgatcggacgcgctatctacgtaacggactcgcccacgatcccctcaatgcacaaacatataaagggaacgttacccgttcattggcgacgatcgatttacggcttagccaaaaccaaaactctcagactttcgatcttaaggtgtgttgaaggggaacgaatggcgaattcccatcgccgtcgccgcacggtgatcttcataaccggtgccttacaacaccgtaccgacgcatctaaggcgaccatatggtttcttcatctagtcagtacaccaataaattccacataagagaaattaggtgatcatgcatagcctaagtttgtgcatttaagagttaaacacaagcatacctgaagtgctgagttctgagcatagctcgtttcaccttgccctggattcatatgcacactctgtttggagttggtggccatgattcagtttctttctcttctcttttgtgaagctaagctatctgattacctacttataaccttgcagttttcatcagtggcatcatttgactggttttttgttttttgccccagtatttgacttggccactttggaaatttgtgcactgtcagacaaatgagacggtccaccactctacctatacctacttcagaaattccacctttacagttttaactacttaagaaatccatatgtgcaaatattaaactatattcgttttgaaatacagcgagaaacagtaaaatttgtttaacaaaaggaaaatagccttgtcttatctgttgtgaagataacaagtgttggattgacaaccacaaagtgttgatgtgatactctgatgcatctccattatctgaagtgataactccaaaactgttggcttctgtgaatatataaagtagatgaatcacataggtaaccaaaataatgactggaaaataatttatgacaagaggtaaaagattaactgatttcgcagcaccaaccatagactccttcaagcctgacctttaaacacacaactcaatgcatcggtcaaagcaatcaacgttcacaacacgcgcaccctcacccaacccatatgatgaaagtatttagatctattggtagaaatgtgaagcgtgttattgttaaaaaaaatatggatgggtataatcgttatttagccatgactaaacttgttttctctttctttggtttatttggatgcaacatgagcaatgcctgtagaatggatgaccacaaatcgacctagatagggtgaaaaacataaaataacaaaagttacttttaatcactatattaacaaattactaatcaatatattagtaaattactaatttattcttaataatagtgaacagttcagatctatcaccggtagatagcatcggatcatcgctcactccgtaagtatgtgaacttggatcaaataaggatgcaagtaagaaacggaattggatccttaccgcacagagctacagcgttcagattagattcaatatcctaagtttgatctaattagtaagtgtgcttcagattaactgtagcgcacccgaatactatctccgattaacttttgtctatattctgaatatattttatccaaatacatagttagtagttgcaaaattataaaatggatgtagtacctatatatcagtgaaataatgcattttagtatggcaaaagagacattttggtgttaaattcgtcgctctctgcaataaatgcagatgattatttttttgcgaggaaactccctactcaaagtaactagaagaaaaaaaaatggaaattcaacagcgtgcttagaaaatttacaccatatgtgcctagtcgtttcattgtcaacagcgtgcttagaaaattgaacagcgtgctttggttcaggttttgtcaaaacttcacctttttagttttgttcagaacaataacaataagttgctgatttgtaaaataagaattaatatcaaacctacatcacgattataagtgctcacttttgattgatccaaaatcatattaagtttctttttaccatagagaaacttttccaaagaacttttcatataagaaacttttttttggtcaaatttgtataattttgacaatcaatcaaaacacatttattcctgtgacacttagaacaagaaagtaactaatgagatttcacaagattctctatacgctcaacacaacctatttaattgcttccccctcagcctataggcttcctcctgggccttggtgtttgtcattgagaccaatagtgtttgtcattcggcccattttctgatgtctcgatgagtttatgagcccaaatcttctaggatagaattctcctccatttttgatggtctttcctctcaactttggtggtttattacatacatttattcactaacactcgtgggaattgttagaattaagtccaacactatgttgattaatttcaaaatgcactttgagtaattttaagaaaccaatatatctttgtgttgattaatcctttttcacacaaaacattgaataaagaactcgcacaaaatgcaactttatattttttcaaaattaaagaaccttgatgtcgcctataggagggatgaatatgcgttcctaaaatttatcacaacttcatagcatattacaatgataagaactttcagttcaaatcagagcttccgatatggaattggaaattttggtctccacaaaaagttcagcggataacaaaataaaacact

SEQ ID NO: 63191 - DNA, 3975 bp, Oryza sativa
ccaggtgcacgacggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcagcgaagtccgctcagaagagccagcgaggatcactgcagtgacctcccaaccagcgcggggctccgcgtccccaccctcctgctccgggagaggcctggcctggtagtccactccgtgtggataccccagggccacgcacatgcctcggagctccaagacgaagccagtcatgtccaaaccacgacgggtgacgctgccggccatctacaaacaaaaacaaaaagaaaagcaacattttcaaaggtcagattttggcgataaatgaagcagcaagacagagagagactagaggattttcacaaataaccaaggatttttatttttgaaaatattgctaaggcttgggatctacggctcgtcctagggtcaagggtggctctgataccaacttgtcacgaccggaattaacccaacgggcgttccttacgtgcgtgcattaatccttgtcccaggaggcaaggtacaccataagttgatacaattcagagtttaacaagcggaagcgtaaatagttaacttaatacatgggcagcgaaggcccagcacacacaaagacaaacgagaaacagcggaagactagggcgacgaccacaggcgcttgacggcaggcacgagctagacaccaaagccttcatcttcaaggagctcctcttctgggcttgggaaaaatttgagcaagactgagtacaaccaccgtactcaacaagacacacccacaagtgcagaataaatgcaagggagtacaagggaattataatatgaagggttagggttgcagtaaacagcatttaaagacatttagttgctcaaagccattttgtaagcacgattctaaaactatacaatattattaatcaaggccgtgaacccacacgaacctgccttaacccaaggcctacgatgattcagaccgaactggcaacccaaccctgggtcccagctcgtcctaagccaacccaggccatccattccaccttttagttgttaagcaggttttaagaattaaagcactaacttgggtacattgctcggcttgcccataaccgagggcgcggctattcgaatagattctactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccgcctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccaagaccggtccttatatggccgaggtgctactatcaaaaccatgcaccccgagcccagcctaaaaccatttttggggattttgaatagagggggcggggtgaatccaattccacaatactccaacaatttcacagtgtccaggtgatatgagaatttcccaagtctaaagttataaaaccacctaatgttgtctaattaaattgcgaagcatctacctaaatttaaactagggataccacgagtagagtgtccactagttgaggttttgtttaagctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgctcaaagatgatgtgacttgccttgctcgctttcccaaccgacggcttcgacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatagatatttgcgaatttcttcatttaaatttttaattaaaaatcgaattattgcgtcagccgagggagagggcgcgcggaccgggtccacgggagtggggcccacgcgtcagcctctcggtccacggtggaccgggagcacgcggctggcggcggccggcgccgtgggtcccacgcgtcagccgcacccgcgggcgcaggcggctgacggccgggccccacctggcagccgcggggcgcgcccgaaggcggcctcgccggcacggccgacgggaggcggcacgcccgcgccccgatggtcaccgccggcgaccaccggcgcggcggagcggcacccgagagagaggagggaagggggaagcgaacggagcggtccacggctcaccccggtcgacggcgacgacgggaacggcggccgaaacggaggaaggcggcggcgcggttcgggacgacgaggacgacggtgctccggcggtcgacgggcgaaacggaggcgcggacgaggtcgacggggacgcggcgaagccgatggaggtgacgccgagacgggaggaagtccggagcgacggcggcggcgaaccggagctcgtcggcgacggcggagagagaggaagacggcgcgagcacgattccgacggggagagcgagcggcgagcggcggaaacggatgaggagagcacgggggacgtttaaatagcgtcgggagagagggaaagcggccggaggagatggaaaccggcgcggagatctcggccgccattgattgcgccggcgaactttgcgggcataaaatcgaacgaatccgagggagagagagaggggaaagagggggaaacgggagagggaatcgcggggaataattcccccctcattatggcgcgcggggacggcgggatgcggcggattcggcggcggcgctagggcacgggcgagcggcgggagcggcgggaggaaggcgatgacaggtgggccccacccgtcagcgagggtggcgggcgggcccgcctgtcagcggcgcgcgcgcgggggaggagccgatgggccgcgggggagaggagaaagagagggagggagagaactgggccgagccggcccaagaaaggaaggggggaaagaagacttcttttagggtttttctttttataaaccttttcaactttgtttatttcttttcaattattatttgtgctctgaaaattccactaaaatttatttacgcattttaggcttttaggaaatatacaaaaatcctccaagccttatttgacttttacatttgcacattttaattgttggaggctttcacatgaattttaattattctttgcacaattttcgaggatgaattttagggtcgatttgggacgtgacaacgaccaacggaaaagaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaactcatttattgcgtca

SEQ ID NO: 63192 - DNA, 1887 bp, Oryza sativa
ccgcacaacccaatcgctgtgacgtacataattcttggcggcttcggccggggcactaggacgtccatcttcttccacttccgttataatgtgccgaccctcaagtttcttcgctgcacctcgttgcccgcgtgccctcttctgttcaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtccaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcgtttatattattacgtcacttgcctgctccaattccttctagggctagctcttccactccggcttgacagacgactccgacaacacgtcttttctgcaagatacaaaaagatgtattaggataaatgcgaagtaacatatatatatatatatatatatatatatatatatatatatatatatatatatatatatatatattgcatttcacgttaacgttcgtcctcgttctcgctctcgttcgttcgatcgttctcgttctcgtacacgttctcgcggcaacgtacgttgacgtgttcgttctcgctctcgttcgttcgatcgttctcgttctcgttcgttaacggcggtgtgccggcatcgggccgccggttggcgcggcggcgaaggtagcggcggcgtgtcgacggcggcggcggcgtggcgacggcggcggcggcgtggcgttggcatgcggcggcggcgttgcgcggcggcgaaggcggcggcgtggcgtgccggcggcggcattgcgcgcgcgccggcgaaggcggcggcgtggcgtgccggcggcggcttggcgcggcgtcggcgtggcgcgtcgtcgtcgtggcgcggcgtctcgtggcgggcggcgcgacggagagagatcgagatgaagggagatctggcggcgcggctctcaccccagagatgcggcggcagcggaggaggcggaggcggcggcgaggacgacgagttcgagacgacggcgagatatggcggcgtcggcgcggggatttgccctaggcagtggcggcgaaggagagaggccgagtgagatcgatcggccgaaaacgtctaagtgttggtgaagaagacgagggcgcacgggaa

SEQ ID NO: 63193 - DNA, 1575 bp, Oryza sativa
atggttgtaccggtgtgtggtatgactgtgtcggagcctgtctttattttattggcttaagcaacctgaaccttaatgaacccattttatatcagtaataagttcaataattttggtagtcgtgggtggttagttttaatagtttgttctctctgttggctggtttgttttggggtatttcagatggtgataaccaggagaactgctgctaccggtgatggcaaccaacccgaaggtagcaacaccaacatccaaggcggcccacctccacctcctcccccgccaccaccaccaccaccagacaccaaccccatcctcactcaaatcctcgcccagcaggccaacatgatggctgctttcctccaccacatccaaaatccaccacagcataatgctccacctccaccaccacccccgcagcattctaagctcgccgagttccttcacatccgcccgcctaccttctccagctccaataaccccgtggatgccttggattgcttgcatgccgtggggaagaagttagacaccgtgcagtgcaacgatgaggagaaagtcatctttgccacccaccagctgcaggggcccgcatctctttggtgggaccacttccaggctacacagcccgaggggcagcctattacctgggcccgcttcaccgccgctttccggaggacccatgtgcccgccggagtcatggcccttaagaaaagggaattccgggagttgaagcaaggcaaccgctctgtgatggagtatttgcatgagtttaacaacctggcccggtacgccccagaggatgttcgggaagatgaggaaaagcaggagaagttcttggcaggaatggaccctgagctatctgtgcgtctggtctccgtggattatccggatttccagcgtctggtggacaagagcatccgcttggaagccaagcacaaggaactggagtcgcacaagcgtcgcttggtgaatttccgcaatcaacagggggctaaccaaagggtctgctacaccaatccctatccaggtggatcctcctcgctgcagcagcagcaacctcgctccgcgccccgaccccaattcgtggtgcgcgtcccacagccgcagcaacagcagagttagcaagggacccgtgcaccccgtcctcctgcgccagctgtgcagcctggtcaaggccacagagacgctcaaggacagcagcgtctgtgcttcaactgcttcgagcccggacactttgcggacaaatgcccgaagccgcggcgccagcaaggccaagcgcctccccgctccaacaacggtggtaaggacgtcgctcggggtcgtgtgaaccatgtgactgccgaggatgtgctgacgactccggacgtcatcgttggtacgttcctctttcattccattcctgctaccattttgttcgactctggagcttcccactcgtttatatctgtgcctttcgtgggaagaaatcaactgggggtagaacggcttaggaaccctctgctcatcaccacccctggaggggatatgacagcaaagtattacagcccggccgttcctatagaaatccagggaatc

SEQ ID NO: 63194 - DNA, 2814 bp, Oryza sativa
aaatatctttagtcccggttgttcacaacaaccgagagtaaagaaaagatctttactcccggttgttgagaacaaccgggactaaagatatttcgaaacaaccgggagtaaatatcttttcccgctatttcgaaattctttttaaacccggttagggttaagaaccgggactaaagattatagcactgcatatgattttcgcttacatatgtgtttataaaatagaagttaatacattaacattatttaaagtacaaagattaatgacaattacttcgaaaaattatttttgtctgtaataaattaagtggataaatcgtaataagcaaatatatgacttataattaataaaaattccaataatcatatatacttagcatatatatgaatgatattattatattgataaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgttgagtgagtaaggggtgtcttcatataataggaggatgatagggtcaatcgtcaccgtaaaagggggttgcccatccaactgatcgtaatcctcgtcagtcttgtcctcaactccgacgatttttcttttgctctgggagaaccacttgacgtttaggctcatcaggccttgtgcccttctttcctttgctagacatgtccttcacgaaaaagacttgcgttacatcattggcaaggacaaaaggttcgtccgagtatctaaccttgttaaggtcaacagttgtcatcccactgtcatcaatcattacgcctccaccagtcaacttaacccattggcaccggaacagaggaaccttgagaggaccatagtcaagttcccatatatcctcgatggcaccgtaatacgtggcagttgttccatcgtgtcccatggcatcgacacgaacagcgctgttttggttcgtgctcttcatgtcttgggctctcgtgtagaatgtgtactcattgatgtcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacgtaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacaaacatacttcttcagaacgcccatgtaccactcgaaaggaaacatgttgtgtaggtacatgggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggatggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtatctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgtgtgaccatcttcgctctctataggctggcttccaggcctctttccgaaca

SEQ ID NO: 63195 - DNA, 8496 bp, Oryza sativa
  unsure (1)..(8496): unsure at all n locations
cctgttagggacaaggcatcttgggtaaagatgaatggaccaaaggtgaacccaccgattaatgagaagaaagttggaaggcctaggagatgtagaagaaagcagccacatgaacttgaaggaggaacaaaaatatccaagcatggtgtgcaaatgcattgtagctactgtcaaggagttaatcacaacaagaagggctgcaagaaaaggaaggaagatataaaagcaggaaagcagcaagccagtgctgctccttcacaacaacatggtaatgaagattttatgcctctgcaggtcatgcctgaagttctgaacagtcagactagcattttaaccagccaacctagctatgatcagttacaaaataccatattgtcttccttgacgagagaggttagacaatgctntgccaattttccattttatagctntataaaacagttttcacaatttcaatgtactttctgcagaacattataaacaactcttctagagttgaccttggtccactgccagaatcaaattttattgccacaaaccanaaagctgcagtgcagccgccaatgacgacagcccaaacccaaaagaagggggcaaggggggccccccaaaaaaaaccccccaaaaatttttttccccggggggggggaaaaaaaagaaaagctgagccaaggaagagaaatacgcaacccaataagaaatcagagttgaagaaaagggaggagacaaagaaaaagtgaacaatatattcaacttgataaaaaggattagcttataatttatccagaagttatgtttattttttgccaaccaattagacatgtttcattttggagtgtgctctgttacattgctctaatttccaatttaggaacatctcttgtttttcctgtttatacaacagctatttatggtaaaacatttcagaatattaggagcacatttctgccaggatttgtctatggacaagaaaacataccacatatgtctgtacagaaattgctactggtcaaagcaatgttagcaaaattcaggttatcacttggacatgcagttccaaaagagagaatacaaccagtatttgctacatcgtgttcaccattcatttaagtagctgaaaaattcttgtatcccttatataacaaaagcacttccagagtatttacaaaagcacctacactgccattattcactcacatactgctttgacagcaacaaagagtcaaagagtcctctcacagtggtacaccagatgcagttatcatgatgctgattccactatggacgaagaatcccatagaattacagcacaaaaaaatggaaggttcagattctcatcagaagggaacctactacggccatgggcggcgacggtggtttcgagatctaacaaccccctgcactggctttgagtcctgatggctgccgtggccgggcttcgtgtcccatcgaccactgacccacgccggtttcgagtccccgaggaccgccgccaccagctttgagtcccgacgactgctgccgcacgccggctttgagtcccaccgaccgccgcagccggaagctacatatttaaggtcctatccctcatggtgattaattgatccgtactggaaaatgtcctcaaatgagaaaaacagcaggggatttgtgcaaaattattatgatgtgtaaagggccctcacgtagactttgtccaaggtggaaagctgacgtggcaaaaaaatcatatgtggcagccttttaaccacaaacgcacccacctagtcaagttgttgtatcgatatgtccaatttttaagttcttgtacttaatcgcacccacccgccaagttcttgtaccgtcaacgcaatttactctattttaaacatcactctcagtgtgttcatagtaatatacttactcaatctgtccgtaaaaaaagtgagtgaaaatttttaagccatcaaaatactagtatcgttatccttttatggggcatattttgacacatacagtcaatattagattatggagtattacattcaatcatatgcatatcaatcgtacaaaaaatcgcccgtgcataacaaactacaggaccaacaaagagaaaaaaatgaaacgaaaccccgtccacgggaggatagaaacagcagagatgcggatgacccgagaagcatgccgcacgtggtggtgctgcatgcgctaggcttcctccagatccggcgcagcaaccagcgtctacatcggcctcctgccctatactcatcgacgcaggcctggaagctagtcgccgggccttaagaccgttgccgccgcgcaaggtggaaagtaaccttcccctcctttctggcttgaacgttgtttcagggccaccactgccgctggccgactactcgtgtgctccctgaaccgaccatgaggcacgccatggacgacgtagccggccgccgccaccctcacgggctccgaagaagaacgaccaccggcgccggccttcagatcgggcaccttcaagaggacggcaatcgccctctcctacctggatgcatgacgacgccacccctcaccgatggatctcctcgccaccactcggagctcggcctccacaccatcgccccgacgagcagaccggtcactcgtcgccgctgaatccccaatttctcagatccgaaaaaaatggaagaggacgggagtatgaatgggggtttggatacagtgagatggttatggatggtataaatagaactattggtgtgagtaaaaaaattactattgtttgggcaggagcgttgacagggtggggtgggggtggctcttagtggtgcgcgagttaaaaatttactcggactattggagtggggtaggggtgcaggggtgggatcgagattggtcgtcgatgagttaaattttaactatatataaaactaataagaagttggatagcatcaagtaaaaaatttactcggactatgggagtgaggggagggcgcgcaaaggtgggatcaagattggtcgtcggtgagttaaattttaactgcgtactatggacctggtgggagcgtgggtgggtggggttggaggctgtatgaggtgttttttaatacgtagcaccttagggtgttgtatagtagttatatatatatatatatatatatatatatatatatatatatatatatataattacattagatttctatatcatgattgtgggcgtttgcatgcaaatcgatgcccatgctaaattgctaattgctcgctgtatcctcacattaaggcatgttatccctccctaaaattttataccctgtcacatcgaacgtttaacacctacataaagtattaaatataggctaaaaaataactaattgcattaaattgcgactaatttgtgagataaattttttgagactaattactctatgatttgacaatgtggtgctacagtaaacatttgcaaataacggattaattagggttaataaatttgtctcacggtttactaacggattttgtaattagttaaaccgaaatcatctatctaggtgttatcatcaaattaggagcgacatatataaaagaacagtcaagacacagcggagcttcctaattgttaaatttacatcaataaataaatgaaatactaaatttcagacccccaatgaggagggacaatctcatattttcaattataattttcagaattattaaataaaaaaatttggattccaaggcgagttcatttttttatattaactgtgaggccacattatctatgatttttctattttgagaactattaaattagaaaataaaaaactagaacaaggttatagaaaagcataaagaacgcatttgatactctagcactttgcattgatcatcaattctacagtttaaaattatttaataaaaatataaaatcaagatattttaatgtgtagaattattaataaacaaaatagataacaaaaagtaaatttggacgtgatttctatagcaattgcataattattgacattttgagtttccggggaagatgcctaggccaccatgcatgagcagagtatctttcagtggaagcattggatgctaaaagcgaacgtcggtgtggagtaagattttgtacatattattattattatcaaaattcacaattattttcaataggaaaattaaattactttgtttttattaatctatctgtcaattaaaaaaatataattctatgtttaaaaaaataaaatttatacatattatatatatatggaaataaaaagtaagagttctatgtaaaaataaagattcttttgaattctatctccacgcaaatccgctaatatggaatccactaatttcctgtatgagatatttttgaaaataaataaccaatattctagaatatgattaagatttttaaaattttaatatagtccgtgcaaaacacgggttgacggctagtgcaaccaatggatttggaatgtacaaatcaattttccgtaatgttcgtaacacattaaagtttaaacaaggataaactgaacgcagtgcaatatcatgcaacaattcatcaattcgattccctgatagaatacactttcgtgcaatcgtgctcgtacaaagccaatgctgaagaaaccacaccttaaaattttgcatctcgatctcaccaactgccacaaagaggtaccaggagaaggacgagcacttcagcagcgagagctcgagaaggcttctcttcacgacggccggcacggcggagtcatcgaggaggctgcaattgacggcgaggctgcggagcgcgccattgcctactagaatccggcattcgtcgacgggaacatctgcaacaacagcgaccagaacaccagcatttaattagggggaaattgatttggacgggagaggagcagagcggaggggatgaacactcaccgacggcatcctcgtctacgagactacgaatacatgagcaacggctccctcgctgacctcctcttcaaggccggtagcggaggtggcagctacccggccctcaatctcatccaccggcggttgaagccgttgtcgcggcggcggcagcgaggcacggttgcctactgcgctgagggcgaaggtggacggcgttgctgagagggattgccgcggagatgatggagttacacgacaggagaggggccactgttggtgtcgacggcggttgggagggggagagatcgggaggtggggcaagggagtgacggcaagcgccattgttttcctcccggtgatatggatgaagcgccgagaaagctatttggcaatcagtcacgcgtgcccctccccgcacgactggacacatgtcgcgcagagagaaggagggaggagctagttttctgttttttttcttgttttttttcctttttttcgtttatgtttggttgattttttcttttttttatccgttttgttcgtttcggttcggtttggttttttttccaggttctcttccgttatgttctttttccggttgctataaagatgtatgaatacaaagtttgtactcatatgtaaaccaagtttatattcgtacgtatgtaaagtttgtatacgcgtatacgtaatgcattttcttgttttttatttttttatacatatgcatataaagtttgtatacatcatatacaaagtttgtatatgtcctatataaactttgttacatcgtatatagactttgtatacgtcatatataaactttgtatatatgtatatatttttaatgcgttaaaaatatattcataaaaaaatatatacatatgtatatagtgtatatacatacatgtgtgtatatatagtatgtacatacatatatacatatgatgtataggagatacagatagactagagatgaccgcacgcgcgcgtggggcgcgcggctgatcgcgtatcagcgccccccatgaagtgtggttgccatagcctggtcggctgacaagtgggcctgaacatctaccacgtaagtaaaaatagtgtaaatagggtttaaactgccatagaacatgtcgacgagtgatactcgtggactggatgaatagagtattgaggtacgttggaacaggggtctacgtagtacgacatcaaaacagacaaaaaaaaaaaggattatactagttcaggccccttatcaggtaatagccctagtccagtttatataggattaatgatgatgagaatagattacaaagagagtaatcaaaataagcaataccgatgagttcgtagtcgaagaattcgacgagatctcccggcgagttggctccgtggactccggcttcgtaatctttggtgggtgtgttggcgatgagatgtgataccctttgcctctcccgaagggtcccttttataccgtggaataccatgaccctcaagtaagacttggggatatgtaaaccaacacggcatactagaaattttgacctttccgaataggacttctacaattccttaactcatggagatattttccataatctgagacgaatttctaaaggtgtatacgggaactgaccgtatacgtgaagatatatcttatcgatatattccataagtagtaggatagagggtatgccttatccgtaaccgacagaacataattcggttttatacagtttaggggcgaagattaatagtgtgaagggacggcaataggacttattccttgttgtgcatgtcggagcccattatcttctcagacggcgcaacgtgcgtcagcgtggactagcccaggcccctgctctcctgctcgttctcaagcgcatatgcatttaaatggatgggtgtgtataaatttatataagcatttgtgtttgtgcttttttacgcaaaagaaaagtttaaaatcaagtaaaaagtttcccatttgtagaaaaaccgtactcacttaagcgagaaatttcgtagtgccggttttttagcgcttagtcaaatcgaggtgtattttttttaatgcgtgctctaattttgtcgccgaagatttttttttttggtgatttttttctcaggtaaaacaccttattctctagtacacagttgctaattaatcatttttgtatggctcatgcatgcagccattgattgctaaatgggtggctgagacagaagcaacagcaaaaatccctatgaagcatgaaactttttcatgcttatgctcagcagttttggaaggattgctgaaaattcttatctctatgaaaatttctctaactaaaaaaaatatgtatgctcatgtacgaacagaatatattttcagtattaattgtgcacttgtaactggaggcactgatgatcttaaggagactaagagcttgaggctatcaaggcgtcaaatcgtcacacagatgcttatgctcagcagtttaagaaggatttcaagcagtttttgagcctgaaggcccagagggtcaaatggttatctcagtgtacatcaggtgctcagacaaacctaattctgagttcctttctgttgagatcataggcatataatgatttaatatattctataaataantcatggcataccagtagcattaacacatcattagatctacacatgtaaactaagcagtaanacatgaacagatgaaatatgcgtaacatgtcgaacacgtaccgagctggcggaaagaccggttgctcggcaggaactactcgcggttgcgggcgtcgacgaaggcgcgcagcacgcgagcggagaggaaggcgagccgtcgtggacgaacagggagcagtcgcgcgaagcgcttcccaaaaaccttattgcccccttctcccggtgcaggacgtcgaaggcagaggttccggagacctgctctcccgatcgccggtgcacgccggcgagcgggatggagtagtctacgagtgacggcgcagtatagagtaggaggcaaaccatagattgatttcgcatgtgttgcgtgaaggcggcggctcggtttatatagagataggtcgcttgatcagggcgcccgcacgatctcccctccgcgtaaccgaaccggataagtcgcgcgtaacttatccggactccacgccgttttcacgcatcggatttttcggaatgtttccaaaaacaaaacaaatccgaattttcctgcagcaaaacaaaactgcaaaaggaggctgcatctgcacaagggtgaggagccaattttgcggaccaatcgacgcgtacgtcgtgcacgtgcgccgcttgccctgctaggccaggcgagcgagcgcgtgcatgtgttccccttcttctctccaccatacatgcttcaagtggctaggagggcatcctcccttttaaggaggtccccctctcctagaataagcaaggtagtactaaactccacatgcatgccatcccatgtggtgggattttgtgattttccaaagattaaaccaaagaattaatcttccagtgggctaaggcccatccattaattccaacaatccccaaccaaatctcaaaatcccactgagattttcctt

SEQ ID NO: 63196 - DNA, 613 bp, Oryza sativa
gggaaaaagtgtaccggaggtccctgaacttgtcaccgagatacgaaaacgtcctccaccgcaatacgagatatggggtcccctaactatacaataccggtcacccgaggtcccacggcatgatttctccccgatttgtccgatgtggcgacggttttgtccgccgtggcgctttgacctcagtcgtcgtcgctgactcaggagcccggtagttaggatataatgaaggaaatgtttggcgcggcttgcttctcccccaaacaccgaaaccctagcaggtagcgagcgggcggcggcggcgacgacttggcgagtggcggtgtggagatgtcgagctcgatgagcgacggctcgtcgtcttcccgtcagtggaagtcttctcccgtgccttaccgggttggtcctctggattaccaacccgcggtgatgtgccaatgccggtgcccggcgaaggcggcgaggtggctctcgtggagcacggacaaccctaggtgctgatactacaagtgtcaacatgctagggtaagtgagggcttttggttgatatgttgttgaggttggatttggatagtttggggtttgaatgtagggttgtggtttcaggttggggggt

SEQ ID NO: 63197 - DNA, 1404 bp, Oryza sativa
cccccctctgctttcatttcacgaatcggatcgcaagaatctcatttcatttccgcaatctcgtagtcattagctcggtggggtaccagccatcaacgatcgctctagcagcaatcttcatcgctcggaacaagaagacggcgcctaatctagacgagctcaagtcggtcgtgggctcgttatgccagcaaatagacaccgtaagcactaacactttctcttttgcgagatctcatcccattaggtttaagttcttggtagaaatgacaatgtcgagagtaaattctgcaacgctgttgttctcttgcaggggcatgtgtattcctgctacaccaagatgatgattcaagaggacaggtcgatgcaatcgacgacgggaggtagcttcctcgggtgtctctgttgcccacattgggggatcggaggacagcgccatgggaggggccaataatgccaccaccttggaggcaaccccggacaagaagaggaaaaggttgcactcgcctcagcgccagtagagggaggagctggaggctggagctggacagcatgttggttggagtccagctctgcaatttttagttgatcattttcaccctttttcttttgtttcagctgagccctagtcagtgctcttgcaagttcagggggggttggccaaatggaggggccaacatttgattcttcttctgattatgcaattgttacagttgattgattagttagcaatggaaagattctggttttgtggagatctttccctggcccagaaaggtactagtgtaaagagcagaggaaaaggcctgaaaactgataaagagctcttgctcaaagtagggaggaagtcctcactgagatgtggagacagagagagggaatcccaattcccaagtattgagtagaagtcattttttgtggatactgtatggttatctgttactctctgttgagtcatgccattttggttcattagcaatttcctgatgctaaagccaaacagtggtagtacatttttgttgcaagaactgattgatagtagttggatagccagggggcaggggccatctctctcactgtacttcactctactctctcgtgtctcgtgtgcaattgctgaccatgagtggttgggaattgtttattgatatcttttggacgaaaggaagaaatgcgtttgctcggtgcctttctgatgttgcctttgtgccgcgtcatcaaatcaccctgccttgctatttctcacaatggctttgctgttctttgccttcttggaggtgactgacactgttggtttgtctctctcgcatgaaagcagctgtaacgctgccttctttagctctctctgaattgtgcatcatgcaatgcaaatcactactccagtagtagtacactccactaggacac

SEQ ID NO: 63198 - DNA, 2225 bp, Oryza sativa
agtcgaagatggcgacccgaaccagagcagaagggctatgttggggcaattcgatcatgaagagccgaagtatctcgggcagcaagacgttgcacggaaatcgaagccccgcatcgaaaaatgcagcaaagaccacggtttggttgtccccaggcttcggcactaccgccttgccaagagcaaaggcctatccttcggccatgaccccggccgagaacagcttcgccaactccgtcttatcgataagcgaagcgccgagatacctgatgtgaccttcaccaatcttccccggatcaggaccagtggccgaagcaggagcaggtttacaagggtccatggatgaaaagtctggaaagcccggtataagagccgaggtcacactggtcgaagtaggcaatgaaatctcgtgaacgcaaggagaaacaaagcgataccagccacagaggagatggtaaaagtgactagaggtaaaagtgaaagtgacgctagggggtaagtgtatatataacccacccgcgtgacggttcgcctgccacccagtaagggactgccacgtgtcgccagggtgtacggaacggtaatttcccgttaaggctggccgaacaatgaaacgacgaaagtaacagcacaccggcccatcatgcccattactgttcacgggaatcctaatttattcaaccatttcgccaataataggcgaggaaaggaaagaacagtgatcgctagatctgctaatgcaaaatgctagactttttcgcaggtaaaaaaatataggtttcagcaagaacatcggccgaaacggagcgcgtcatggtataccacacgatttgcaaggtcttggtcgaagctccatactcacccttgcccttgaggggcttgttggaggtataccacaaggacctttggccgggcttaccgaaaccaaggacataggcaaaggcgtaggctggaggcaagtggcgaaggtcgaagggacaacataggtgaaagccaaacagcaaaagccgtagcatcaagttgacaagcttcgccaaagatggaccatgccggagggcatgtgtttcgccaagtatcgaaccttgccaggagaaggcccagcaggccaacacgccttccagaggcttcaccatggactgggccgagtcacttggcccattaggagcccatacgagcaaaagacattgtatgcccataaagatgtccctatcataagggcaaccacgtaaattcctctgtagagcctaaaccctaatggagagtctagggccatgtaacagggggatctgaaaaaatttttactaagcaatacaattgtctttacttccaaccactgttaaaagaactaggtccttcgacgtgacacagttatcaattcgacaacacttgctttgcaatttctgtgcactttgaaagaaatacaagatgggatttcttttcgctttttccataagaaatatacactttcatgggaaggattatgtacacttcttggttttcacgattcctgtaaaatcgatctccagaaaggaatttctaggttcgagaaaaataggttttgggaagacatttctaatgctccaatttgcaagaaaactaggacgaatgataaccataatcctacacttaggcttatgcataaatggattgctataactttgtttcctagaggtgatctacgacccattagaggggatgaattaattgtcatgtttgtcatggttaggaagatcaaagttgctgctgtgaaatgtatgataaggcaaaggctagaaagtataagattttctactcctgtggagtgcacttccttgattactcggataacaaagggactaggggttattaacaatgattagattgcttatgtcttagccgcttgtccctgtatagatgagaattatctagtgcaagggaacattcttaaacatggagtagatggatctttgatttacttcttccccggttgtacatatgaaatcttgttgcctaatgcgggatattatttgaacaactaccatgaactaaccattcccttgcataccatagaagaatctcgtgcaggtggaacatacagggagacacgcaacatggcaagtaatgaacgagaaggttcatcatcctcaacacccgtgaaatgtatgaggcaagttgggagccaactggggatgcacctggatggacccaagctccacgccacagcatcggagtctcaagctgcgcaagcg

SEQ ID NO: 63199 - DNA, 4884 bp, Oryza sativa
ctagttttcacaggttagcaggtgagcatgtcttgtatctgtatatctccaccatggtatagtactagagctggaaattgagacccaattggttcaagcataagtaagagataaatttccgactaatgaaattcttcatgtgattgatcttgtatattcattattctcagctgaactttgcttgtgaacaaccatccatgttttgggaaccttatacatctaagtaattgctttatgtgagatgattaagatgaaaggaatccttgcaacatggttatgactcttgggaatttattttcaaaaataaaattattttaagaaggctcaatcctccaattgactttaccttatacctaccaaggccatatgcaagtacattaatgatcaaccttatcatgcatatgactgcttgacattatattgagctttgtcaaaattgtgtgacttgtgttaaatatctttcatactctcatgatcaaggggtcactatcatttccactttccagttccacatataaaaaaaattggctaagcttctacactggaagttggctttccacaaaaatatccattcaaataaactcctacattggactatgctttcttctcctggaaaagttcttggcaaaaaaagaatgacaaaagggggaaaggcatggctatgaaaaaaaagagaaaagaaaaaaaagaaggaaataaaatttgctctcaaaacattgagcaaagaaaatatagccatgccccctccacaatcatgccaagaaaaccaatttggagagaaagtataggaaaaaggagaatcatttctttattccatcattccacaacatatttcacttttccattttcaaccacaaataaagatccttgatctaggagtatgattgatgatcttcttgagtccatatttttggctttgcaatatatatgatgcaagtatgtcaccagtttatccctaccaagctccacatatcagccttagaataggggtaaattctggcacactttgccttggtgaggatccaaaagaaaatatacatctttgagagacaagagagaaaagtcaatataaggaaaagagctagtttgcgaaaattcataaaaatcccatgagtatggcagagaagcagaaggactggaatcaagattgttccatttatcaattactcaagatggtaagatagccattgatatagttcacaagtgcaggtatgggtgtgaatgatttatatgcttaattcatatcatgaagaaattcattctacactaacctttactcagggacgagcaaagggctaagtgtgggggttttgttggtggctattaaatgccgattctataccgccaacatttgcataaagtacagataataaagcatccaacatagagataggtgcttaatctcacatattccataagtgttggtgtatatttttatgcagaagataaaccctgaagttggaaggaaaatcagactaaagtgaggagaattatgtatccatacaaggaggggttatgaacatcatcgaaacatcagtaaatcaaccaaaaactccaagaaatagatagaggaaggtccagggagtccaccgaccgaaggtcaggccaggagggcccagcccaggttcggctgaaccccctggttcggccgaaccctggtgatcgccgttgatcccaggttttggcatggacatcccagatcactccctgatggcggttgcggggcagttcggacatttccccttctcacaaccatcataactgccctacgataggacctcacttcattcactctcacacacacttccaagcttgagctgaattataagaggctttattgtactatattgtatactagaataggaagagagtagagtagaaggagtcggaagaattccggagttgtcggtaatcttctcctatttcttttattctgtttattactctgaattcattataatattcttcttgagtaatttagatttatcttgtgagaattatctcttggttagttcctaaatagcatacgggattattgttcactataatcaactaaaatatagtgattgctttggtgagttataaacactaaagtagatagtaattgcttagacgttttgtttaggtaattgttatccagtaattgatgcgtatcccacagtacgttgaggtgggtgtagaggtggtgacagccctcgagatcactaaagtcttccttgtccgggtacgtagtagagcgacatctgggaacagcgggttgccagtgcctgaagtactgcattaggattaaaaataagctttccctagaaacagtttctcactagtaaatcctctctatcctggcctatcaattgcttggtgtccttggatgaaccggaggaagtctgatcacacacgttcccttggattcgatacccttggaatactccgtaagggaagtgctacatcggtatatccgtgcgcttgcggattttatctgtaaccgtatcaattaccaacaagcatttctggcaccgttgccagggaacggttgctgatcatttccaaacccagttcatcctcatatcctttttcattttttttattctaccttcacccctgctatcctagagaagtattcctatcaaactcttctcgaccatcgtgcaacctctgtttgagctgtctgctcctcggggcgaattctatgagccaccttcttcatcggagcccatttatacaactggctatgaaattcgtcccgagctaattagtattggttagggaaaatcctttctctggttttgatctaaaaaatccctaccatcatctgcgagactttgaacaagtctgctcatgccataagattcgtggcatgagacaagaaactgtgcggtggaaattgtttccgttctctcttcaagagagagcaaagaaatagtacacctctaccgttggatgtgtaaacggtagctaggaaaagctgcgagatagattctgtcttgccttcttcccagttactcgtattactgcccttcgagtagaaattctcaatttcaagcagatcgaaaacgagtcaattggtgcagcttggtccagattcactaatttagtacagtccggaccaaccctgtccttacctgagtatgtgcttctccaacatttccatacgggtttggataaggagtctgcattctatctggacataaccgctagaggatcattcatgcataaaacgccgtcagaaggaaaaacgatcttggatcgcattctagaaaatacttccttcatgacgcagtccaatgaaccccagctggaggcatccgtgtccaagatagaggaacctctaacgatcgagccatttgctgaaccgtccacttctgctagctcgattgatgagaaggttcctgagcagccatccgtcaagaatgaagaaattcagactccggattgtgccacaattatgttcagggacggttttgacgtagactacggcaataccctgaactattttagcaagaggaaaccacccgttcctttgtcacctcccgatcctatggaactcgggttcctacgagaaactgtccgggagttgacatccataatgagcgacgaatggcaaagggaggcagagctttcatccgaagtaatccggataaataccgctccccgaatcattccttgtcacctagaagggaacgatgtcggtattctctacagtccaactatcggggccaacctcatctctgtgtcctttgcattcgcttatttaagcgataaggcagtgaccccgacaaacaaattcttcaagcatccgaatagaaatattatcgaaggatttgggattgtgcaagatgtgcctgtcttctttgaagacagggaggcgatcttggatttccatgtctttgaaatccaagactttgatatcctaatcgggctgcccattgagcaacttctcatcaacacatcccgattaggtagcctcaaaataacactgggagagaatgaattctcaattccattctcgcgggcaaggatcaccttgaccgaccctctcccagaaactgagtcagcggaagaggttaccgcagttcctcctcatgagtctaccaaggcccttctagaagatgaggtccccgacttcatcaaggaagaagcagatcccagtgagactctcgacctgccaatcatggaaccaccacctcgacctccgctagagcttaaacctctacctccaggcctacgatatgccttcctacacaatgacagagaggctcctgtcataatcagtgacaagctctcggaagacgagactcaacgtcttctcaccgtgttagaaaagcatcgttctattcttggctactcgcttcaggaccttagggggattaatcccgcgctttgcacccatcgtattcctattgacctcgagagtactccctctagggaacctcaacgacggctcaataatgcaatgcgagaggttgtaaagaaagaggtcttgaaactcctgcatgccgggattatctatcccgtaccatacagtgagtgggttagcaaagttcaggttatgccaaagaagggaggaatgacggtcgttgcaaattctcaaaatgaactaattccgcaacgaaccgtaaccggatggaggatgtgtatcgattacaggaaactcaacaaggctacaaaaaaggatcatttcctgctacccttcaatgatgaaatgttggaatggctggcaaatcattccttcttctgtttcctcgatgggtattccggatatcatcaaattcccatccatccggaggactagagtgagactatattcacatgtccgtatggcacctatgcgtatcgtaggatgtcctttggactatgcaacgctcctgcacctttcccaaaggtgta

SEQ ID NO: 63200 - DNA, 1089 bp, Oryza sativa
atttaagtatttttgttgttatgggatgataaaatatgaataatatttacttgtgacttatgtttttaaatttttttaaaaaattttcaaataaaacacacggtcaaagttggatgcggaaaaccgtggctgcacttaaaatgtaacggagggagtaataaaggatcgagttatccgcatccgtattcctaagctttaacagatttacgtatccctgagaaaaattacttataaccatcctggtttttgaacaaaatcgactatccttaaaggtcacactaacacttgcactatcacagagatgggtgtagtgcgcaagcaccattgcagagcagctactccaagtctccgaacactactacttgcccctccagaattgtaacagctggagtacgtagataagggagaagtgaattgtaaatggtccactcaagtattcaaatcccattagtatgtagataattgagaactgaaaaataaatgatcggaggttccagcagttccacaaaacatccgtgattaaaatgtgattagatattgatgctccacaaaactacctgtcggcaaaaaatattctttaaaatattatgggtgtttgtttgtttgttgcccgagtaaataaccccaatactgtccttacgtatatttatatttgaagtatatactttcagtaatactcgcactaggggtggaaacgacggctcggcttgcagtggttcgcaacaaaactaggcttggcttggcttggctcggctcggttagggaaacaagctaaaacttgagctcggcttggcttgttttctggctcgagccagctcgagctggcatgcaagtcttcctgttgaaacacctcttcatatatattttgtaactattaaaaaaacaagaacaaatcatcaacttgtaaaatttaaataagtttatatattcaattcttcaaaatcttaaagaaaaatttcaagttggcaaataataactccataaaaaaataaataatcgatataaacacatgatggcctaagctcgcgagccaaatcaaacggctcgcgagccagctcgggctcggctcgtttcaccaacgagctgaaa

SEQ ID NO: 63201 - DNA, 749 bp, Oryza sativa
gggggaaaggagagaagagggagagaagtgggccgagcgggcccaagaagggaagggggaaaaagaagacttcttttagagtttttctttttataaaaccttttcaactttgtttacttcttaataattattatttgtgctctgaaaattccactaaaatttgagggctccttttagaccaaggagaatttaacaaaaattctccgggccacatttgaatttttcttgtacgtattttagtgtttgccaatttcttttcggattttaattaattctattattccttttagaaaatgatttttatttcgggatgaatttatcaggacgtgacagtagtccactccgtgtggataccctagggccacgcacatgccccgcaactccaagacgaagccagtcatgtccaaaccacgacgggtgacgctgccggccatctacaaacaaaaacaaaaagaaaagcaacattttcaaaggtcagattttggcgataaatgaagcagcaagacagagagagactagacagttttcacaaataacaaaggatttttatttttgaaaatattgctaaggcttgggatctacggctcgtcctagggtcaagggtggctctgataccaacttgtcacgaccggaaataacccaacgggctttcctgacgtgcgtgcattaatccttgtcccaggaggcaaggtacaccaaaagttgatacaattcagagtttaacaagcggaagcgtaaatagttaactt

SEQ ID NO: 63202 - DNA, 8152 bp, Oryza sativa
ggtaacttgtatcatattgcgtatttccctttccaattgcattctatacacctgaaaacaacataataatttgcaaaatagaatataccaaaaagataggttaggttttatcatgctaggtaagacaaactagttctctttgttgaaatgatgaatagttgctctgttttatatctcttatgtatggattcataggtaagtgctctctcacaaattaaatgtaagtagcccacaattatttgagaacctgaggtaaatgagctgcatttgctaatctaagtctaagttgttgcaacataagagatagtaaataagggttgctatgatcctagtccaagtttgacttaaattccggatgtttgtttttcaaaatgataaatttgaaagtttctcatttgatataaattcttacgagagccaaaaatgtgccattatgattaaaaccatataaattttggttacttgccattcaattgaactttgtcaaattcttgtgacttgtgtagatacttttcatgctctatgatcaagatcatatacccacatatatgcacatgctaaactcctacactgagctagcaattatccattccatttccattctaccactaaataaattcttcatgcttttgtgtgctttcttctcctaaaaagaaaattctttctggaaaaaaaaagaagaaggagggaaaggcatggttatgagaaaaaaagaaaaaataataaagttatgctctttcaagcatgagcatgatattatataaaaaaaggaataaaatggccatgccctctccttattaataaaagaatgacactactagaaaaataatttattgccatgaaaaaaatcgtagcatcaatgctaaaattgtggcaatagatacatgttgccacaatcttaaaatcgttgttagccgtggtaataaatagcgtggtaacaggttattgcaacgatttttatttagttgtaataaaatttgatattgccataaaatagatgtggcaaaaaatatatattgcaacacttcacatggttgtaataaataactattgccaccactctatgtgtggcattagttatacgtaccaaattaaatgtctcaatattaatttatcatcctaactatcttcttttgatatcttgtcatgttcaggattcgaacccaagatctctcccttacgcgcgctctccatgaccaactcacctacgcatcagttttgtttaaaaatgcatacaattccatttgagactgcctaacttagatttgaatcatgaatttgagtatttaaaagatttcaaataaaaaatttaagttgtagatctcatcgagagctataaatttcatataaaatttatcctaatccgtgtccatatgaaaagaataagtcaaattatgagatgataaattttttattgcaacgaactaaatgtgtggcgatagaacatgtttttttgcaatagtaatgttttttttggcgatagctcatttcctattgcaacaaaaatactgaataaaacaacgattgtaaatcgttgcaacaaaatatagttatttgccatagaaaaaatatcattgtgatagtataatatattgccatgaattatttttcgttgtaataaattggtggcgatagctcaaccctcttgtagtgtgatttttgggaggacgtaagcacaaagaagaagcattttctttatttttcttcatattccatttccaccatatatcacacacacacacactttgcatgatcctaagtatgtttagtcatctattttagtctgagtttttgacttagtaataaatgtgaatgcaaatatgccatgtttgatccctaccaagcaccacatatcaaaccttagagtaagaatcaaaatggcaaaatggtgaggaattcttattgatacacttagagagactgagtgaatcatttgaggaactcggctttcttttgcaaaatcatttgaaaacttccggaataaaagttgaacaaagattgggtgattactgctttaattgttgttctgtctttcaaccgcccaaggcaaggagaagcagtgtctggtgggaatcaggggttagggtaagccaccgtgccaaagattatttaatttaagagagattacatatacctttgagatattcagcatagtagcaactcctgattaacaaccaagtctttgtttcctttcgtcctttacttgggacgagcaaaggttcaatcttggggtgttttgttgatggtcgttagcaatcagtttcgaacgtcaatatttactaaatagaggagaactagttatgcttgcaatgcatattcatgttagaataataatattccactagtatttggttcactaaacttttgcagagaataatcataaagtggaggagaatcgacatcaaatcaaacgataaatcaatcggacgatgtcgagaatcagacttatgcatgaatgggccaagaactcggaaatgacacgacgaattgggccaaaattcacaagtctacggagaagagcacgagaggatgccaccagccgtaatctgggctggttgggccggccccaggttcagccgaaccctcctcagcaccgtttgatccaggtcttttctagatggtgtagatcagcccccaatggcggttggagggtatttccgaccattccaaccgtcacaaccgtcattaggaggttataaaaggagctctcatcctcacttcactcacacacctcaagcaaagctctcccatattctctcaagtttagtttagtgttcttaagctagtggagtaggaatagaatagaaatcagagtccggaagccttcggaagagttcggttatggctctagtagctctgcttcactcttttgtaagctttgtactttatttagaatactcttctttatacatttatggtattgaaatgctttccgagtatatgaatgccaactttactttatgttcatgttatgctgattatactcctagtttatctgggagatgcataggtacaggtataatgtttgcttatgcaattactctatgtcatgatgatgatattagagtagtatctggtagtttaggcgtggtgtctagattacgggatatcattatttggggttagatgctgcggatgagaggtgggccgctgaaggtgatagctcagtacgggtattcctccgcgcatgtatataatcctaagttaatttcctagggagggtactgctccatatttaaccccggttgtatggtcataacgggctgtcgtaaggaactcagcagtcaggggtggcttctcgaagtaccacgagtgcatcggaaagagggtattagctagttaatcgtataactagaatgtatatacactatgtatactagaagtataggaatagattcttttctattttctttccacttagcttaggtaatttagtacgagaatgagtagctccatgcatgtgtgtcactctacccattgatttatcctaatccctccttagactatgattattacaagtaacatataaattattagtacatttctctctactatcatcttcccacgggattaaataaatacgatacccttggaatactctcgggtgaaatgctacaatggtatatccgtgcgcttgcggatgaactctgtaaccataatataccaagagtatttctgcgccattgctggagattatatttctagtaatgtcgttaagaaataccaagactccttcatcagtcttgtcgaactctatgctactcaggcacaagatgggcactaaatttttgctccactgtcatctcccaatcatggtatttctcagcatcataataacccgaaaaagatggtattttaaacttaaccttagcataagggtcatcgggcacacgattattattaccttgttggtggtggtcatttgaagtgccacccatacctgtgcggtatgtgcatagacgacgtcgtagtcgtgcttgccttgtagcttctgcatcaatattgccactaaatcatacatcgtgtcctcaggatggccaccagcgttgctgccactcacttcctcactggaaggttcttgtgtctccaacgcagcaacccgattagctagcgtggatatccgcttgtccagcctctccatgtggtttaagaagccacttttattgatggcatcttggacagcctttgtaacggcctccgtcatgtcattttgagcaattttctacactagttcgtagttgctcttgacagactgtcgatatttcttaacgacattactagaaatataattcccagcattggcgcagaaatactcctggtatattatggttaaaaagtttatccgcaagcgcacggatatacaattgtagcatatcacccgagagtattccaagggtatcatatttattttatcccgtgggaagatcatgtagagagaacttgactaataatttatatattacttgtaataatcatgttctaagcaggggttaagataatccaagggtagagtgacacacaagcatcagctactcattctcataatatattatctaagctaagtggaaagaaaaaagagatcatctattcctatacttctagtatacatagtatacatacattctagttaactgatatactagctaataccctctatccgatccccttctggtacttcgagaagccacccctgactaccgagtttcttacgacagcccgtcatgaccatataacctgggctaaaaatggaggagtaccctccctagggaattaacttaggacaatataaacgcgcggaggtatacccgtactaagctgtcaccattagcggcccacctctcatccgcagcatataaccccaaataatgatatcccgtaatctagacactacgtctaaactaccagataatactctaatatcatcgtcatgacatagagtaatggcataagcaaacattatacccgcaccaaagcatctcccagataagctagcagcatattcagtataacatgaacataatgtaaagttggcattcatatactcggaaagtatttcaataccgtaaatgtataaagaagagtattctaataatagtacaaagcttataaaagaggaaaggaaagctactagagccatacctgaactgttccgaacgcttccagactcctgattttctactctattcctattccaccagcttgatactactaaactaaacttaagagaatatgagagagctttgcgtgaggtatgtgagtgaagggagaaggtgaagtccttatatagaggtagttatgacggttttggaaggggaattgtccgaagtgccctccaaccgtcattgggatgcaatcctggacgtccatgccgaaacctgcatccaacgacaccaggatgggttcggccgaaccatgggcaaggccatccccagcccatcttcggctggcggcctcctctattgctcctttatgcagacttgtgaattttggcccaattcatcgtgtcaattctgagttcttggcccattcatgcataagtctgattctcgatattatccgaatgatttatcgtttgactcaatgtcgattctcctccactttatggttattctctgcaaaaggttagtgaaccaagtactagtggaatattattactctaacatgtatatgcattacaatcatcactagttcacctctattttggtaatattgacggtcaaaattgatcgataacgaccgtcaacactgacacagtcagcaaagtcctgggcagtcctctcatcatcgtcacctgccattgaaacaccaaaacaacaacaaatgtgaaggttatccataataatctaccaggcaggtgcagtggtgcctctcaactactctcagcaatatgaagaaccttaccaagcccttaccaagcaatggatacctggaaggcgtagtcagcgattgtagggatcaagaacatgtgctgtccagaagtaatatgtggagctaggaaggctaaatatatgtgagtggtacacaatccaatgacagatagtaatgctaaataaaaatcccaagtcacttgccactagttgctggtctactcgtgtcctagacagtagtggtaacaatgatggcgcaaatgaaggactggcaggcaagcttcagcgagtctcagcaaaaacagcaaaaccgcaaggctgataagcacaccacgaagttacagctcaagcagagttgatatgtggcctatggaattttctgaagccactataaagaatgtgcagaaacttgtgagctcgaacagacaattttgcaagccaatttttttctgagtctgagtccgtatgcaaaagttatggctgtttgaagttggggcttccgtgtaggttttccagagggtatataaactagtctgtttagcggtggtatgggatatggtggcaacggagtatgtaggatgttctagtgaggtgtggtgatctggataggtgtttatgatggcagaaacggatctcaaaagatgaaccctaacacacggatgaaaggtggcggctatggttacaaaggaaaacacacgactagactaaaacatgcactagaccatcaacaagaacttaagctaggactcaaactcaacactacaaactctgaaaaggattgtgcaaaggccaaacacggtttgggttaaggacactaacgactacaacttttttttttggcttttctttagactctaggataaatgcgaaaacaaaaactaaactaggataaagaatccgagcgaacctgacggtgaacctagagctctaataccacttgatgttgactaggtttcccgatctttcgaaaggttctgataatcaacgatttgggcggagtcgcgacacaaatcgatccggcttcttgaacgaacacactattgagccccgcaatcgcagcaccacgtctcctctggttatcacccatgtcgaaacgcggatgacctcgccgagaaggctaatccctatttgcgaatcgaagaacacacacaggaacaaagaaggacgcaaccaaaaatgcagatgaatgaataagctcacaagttgggtcttacaaaccgatctagcggtgaaactgttctcgacagaataatctaagcaaaacccaaaccctaaagatgacgacaggtactgatatcaagagtttagggtcatgcaaccaacccttaacgcaaccctaataggttccaacacgatacacggcccgaaagcccaaataggatgatgcagcaccgggatatattttggatgtcaacttattcagtcgattcccgttgactcggaaagaatttggacgtgtgtccaaaaccattggaaaggatatcttcttagctttccatccatatagagaacgccccaatctggtcacgtatgcgacctgcgtgcccattttagtgcagactgatcctagactctgaattgcactcgaagccgacttggtttgggcctccaccttgacttggatgtcctcgatgatcctccatgactctaagtcctttcccaagtgtctcctttccccttctattgttcctaatcacaatataatcattaggtagcaatctattctcaaattcgtacaaaaaaagcacataggaacgagctcacctctaaattcaattgtcgcgcgcgagcgcttgttatcggtccttgaatgaccggtggaggattgttgtgtgtatccgaaggagtgatatccgcatcacgtgttttctcatcagtttataatcttttaggttgaactatttggtgcatgaaatttaataacatttacaatctttcttacattgaagacgctagaaataggaattattcctaaatcctgataacatttgcatatgaaagtttcttatcaaaaccgttactcacatagcgaaacttacaatgacctaaatgtattaaaaaattcagtgtatgaagcaactcagtgtagtggtggaatggggaataaaatgattacgacttgtttgaaaactcgagggaagatgattggtagtttcaacgagtaaattgatggtgagattaacatggaaatttgatttttagtcccaatcttttgtttggtagaggtggtgggaattgatagatgattggtagtttagttgaagattagaagttagaaaaaaaac

SEQ ID NO: 63203 - DNA, 2437 bp, Oryza sativa
ggtgacagccctcgagatcactgaagtcctccctgtccgggtacgtagtagagcgacatctgggaacagcgggttgccagtgcctgaagtattgcgttaggattaaaattaagctttccctagacaccatttctcactagtaaatcctctctatcctagcctatcaattgcttggtgtccttggatgaaccggaggaagtctgatcacacacgttcccttggattcgatacccttggaatactccataggggaagtgctacatcggtatatccgtgcgcttgcggattttatctgtaaccttattaattaccaacaatcccccctcctgaccgatgatatgatgggattaaaaaagggttacaaaatcatacgtgttattactcatacgtatgcacgggtctaaagctaaaaaaacaactcaataagcacaacccacccaataaatcacgcagtaatataacgcggctaccgtacataagtaaatatttaactctaattgccatcatagcatcatctataatatatctttattcaaatctacacctcgaaggtctcatgtcacatggtttaactacaatgtagttaatttataacttgttacattgtagcaacgtccaatatcgccacattgtttgttacagaacatttcattcggtaccaaaaaaaaaataaacgggctgagcattaatcggacaagccgttatcacacaattaaccccacgatccgtttttttttaaaaaaaaaacccaaaaaactgggcgtgcaacacatgtagatccatcattatcgccagtgcttacgtccaaggcgtaactccacacagaaagcaaaaaaaaaaaagaatcagcaaccaagctagcttcaagttagtgggggctctcggagcacatccttccagtcactccttcatcttccttggctgctcatggcatcgccggagatcactagctccacgtcgttttgtccgccactcactcctcgctcatcaatgggttgccctccggcgagctctccacaccaacaatgtaccccaacgcgccaagcaggagatgctccctctcaatggatgccgccatgcttggatgataacgacattgcaacccccacgccgaatagggtctacaaccatgtaagttccactccttcaatcccactgtgttctatggtgaatattatcgacgtctagtttgcgatagtgatgcaccaaaagcacattatttcgagccacgattattttttttcgttgctatcgccgtgtgacgatactaactactcccactaaaaatataccattttttatattttatatatggtttgccaatatttcatgaatcacattcaccgattgattcttttaacgacaagcaattctcattgcattcaatagttaaaaactaactcaactcccattcctagaacaactaggttcaacaaacatctatgcacgataacttcgatctataagtaattttatatctctaaacctgacactcttgctacgtaattttggatgttttatatcactaccttcatgaatacgaaagttatttttaaactatcacatgatcccgaacgcacgtctctgttttattaaccgaattaatcccatacctaaggaatacactagcaactggatgacaagccattttttaactggcaatccacgtgctatactcagcagccataataattttagaaatggtatctaactttcataatgtttccagtatttcatcgataatttattaacaaaacttatctttgctatataacagggtcctagcgtgccaccgcatatggtgcccaccgaaggcatggctttccctacatacgacaacgcatacaacttctaccagaggtatgcatgtcacgctggatttgacatcaagaagagccgtacgcacaaagcgtttcgcgaggtgtgttgtacgagggagggcaagcacgtgtcgaaggtcaccgatggtgatagacaacggaggagaccgtccaagaaaatggggtgcaaggcttttatgaagctgaggcacaactacgacggtggtgcgctctcatcggtggtgtatgatgtggtcgagctacagcacaaccaccctctaacgccatccccttcggcggtaaagcacatgcgtgcacataagaaccgcgacgacacagttatgcaatttgtggacactatgcaagaaagtcacgtgccgcaaagttgtatcatgggcgttctatctgatctccatggaggccaagacaatatccctttcacttcacgcgacgttgagaacaggtgatttttttaaattattccgtttcttggctttgtgatgttgctttcatgaaagtttcttttcgtgctttcttgcacgaagacacaaatgtggattgtaattaggacgttcccatctgaccgatgcaggaaagttgccaatgtccgaaaggaa

SEQ ID NO: 63204 - DNA, 965 bp, Oryza sativa
  unsure (1)..(965): unsure at all n locations
ataggggagcccctgatacgcgccatgagtcacagtatagctgctctagtttagtagcaagagaaactctacggtcttgacatagcacgagttgagttcaacgaagcgagtttctgaattcggcatatccagctcaaatggtgatgaatcccggagttcacaataatagagaggtagatgctgcacctgatcacagctgattattagttgatcaagatcttgttcagaaanccctgccgtacacaggaggagtttcgtgaggcaacatgacagactacgagatatattaaaaaattccattaaggctctttgcatgcagcagcatatcactagacgtgcaatctacactccgcttctcagttgtgatcgcaagctccacgctctttcttttaccactgtcaatagcattgcaaactagctcaccgatgttaaacaaataatctaatgatgtctccaaatcagtgagcaagcagaacctgaggtttagctttttaatgatagattcgctccgaggagaaccaaataaactgctcatcaatttaactagaacagccatcgcttcatcggccgacattgaggaattttggtggatgaattcatctgcatctaagtcgacatcagagagcaaaagaggcaggtgcttccaccgtgtcgacaggacactggtccttagaactgtgcgcatatcaactctttctaggatagagagtaagatatgatccggcaattggttgaatctaccttggtcctacaccaataaagtgctcaatcatttaaactgaagtttaaaatgttctcttaattttacaagaaatactaaacatataaaggatggtattaggtttatttacactggaaaaactactaacaaaaattactaacagagagagggaaagagacttacatagctttggatgctattggactgcatgactactgacaatggggcttttccactcggatgg

SEQ ID NO: 63205 - DNA, 714 bp, Oryza sativa
accgccactctgacccattgaacaccatttttgcacgggacgctcaaattgaaccagacatgatgttgtgcatcaatcaaacctacacgccttatgagtttgaaacatcatgggatcaattcataaagagttatgatttggagggctgtcccatcatgaaagctttatatgatatcagggaaaagtgggtgcctgcgttcttcaagaaggaatactgcaggaggatgacgtcgacgcagcggagcgagagcatgaacaagttggtgaagcacaagtttgctgaccaccaaaccgcgctgcaccgttttgctcggagaatgttggaggttataactgacaggaaggagaaggaggctgccgagacaagagcatgctcggttagtgatatttttactgggggaaacggtctgacatcactcctataattctactaaattttaactcacaccaactaattatatttctttttgtacatggaaagccaatgttggctgtacggtggccatctgttatacagatgtcgagactttacaccagggcggctttcagattgttcgaggaggtgcttcaggacagcactgacttcaggatcacacaagacgacaatttccgcaacgggtgggtagttgtcgacgttcgatgtcgcaatttcggtatttgcatagtatgggcatcgttggtacaaggataaatgcggggggatccactagtcta

SEQ ID NO: 63206 - DNA, 648 bp, Oryza sativa
atagaatcaatgcatcccattgtatgtctgaacagctctgaaacgcacctaactttttcccaattcttcccattgcatgtctgaatagctctggacaatatggcagcctccattgatcagctaaaagctaaaacaaatggtatggtttccactctccatttgtttctacgacacgacctacattttagctgaaatggagaccagctgcagaccacgttcaatgacttcaatcagctaatcaatgaagacaatcaattatataattgtgagcattgttcaatctatccatgtcatcctgattttgccaaataacaagcacaatcagatatccagacaaaagatcaaaacttttgccaaatcagaagcacaatcagagtccaaagatcaaacttttgccagatcacaagcataatcagagaccaaagatcaaacttttcccaaatcacaagcacaatcatatatccagtagataggaaatgcatcacgaaggttcatcgcaaatacttcgcaacattcatccattggtagcctgagacagttagtagtacgatctaagcctcggtaccttctaattaagcaacactagacgatagatagcataatagcatccctaagcaaacattgactataggcatcagtgatcagtgg

SEQ ID NO: 63207 - DNA, 2181 bp, Oryza sativa
ggagaggagagagagggagggaaagttgggcgagccggcccaagaagggaagggggggaaagaagacttttagggatttttctttttataaaacctttttaactttgtttatttcttctcaattattatgtgtgctctgaaaattccactaaaatttatttacgcattttaggcttttaggaaatatacaaaaatcctccaagccttatttgacttttaaatttgcacattttaattgttgaaggctttcacatgaattttaattattctcggcacaatttcgaggatgtattttagggtcgttttgggacgcgacaactaccagggcaagcagctcccggagcaggagggtgacgatgcagagccccacgctgcttgggaggtcactgcagtgatcctcactggctctcccgagaggacttcgttggcagtcaccgcgggtggagattccttctccgccgcttgccagaacgccgcactcctcgccatcggcacttttcaccagcgctacccggacgagttgcagcactcgccctaccgctaccaccctcgtcgcggaggagcccgcgactacgccaccttccgggatgctagctcggaggatgacgctaccatcatgcacctggcacgcatggtggaggcgtacgacgtggcccgtatcgacttccatcatatggtgcgccgtgggatggtcgagaacaacatgaagatcctagagctgcgtcaggagaatctgcagctcaagaaggacctagacgcagtggaggcgcagctgcatcagctcaagatcgcccagggagagatctgccgccccaagcgtcgccgcgtctgccgcagccagaagatcaccgcccgcaagagcacctccaggcctgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgtcctggcccgtcgcagcgttagatgagcagttagtaggcttgcgcgtgtgttctttctcgtttgtcttttttggtttgtgtggggcatggttatgccggtgtgtggcataactgtgtcggagcctgtcttattttatttgcctaagcaacttgaactttaatgaaccaatttaacagcggtaataaatttaagaattatggtagtcgtgggtggttagttttaattgttagctctttctcggtttgctggttctgtgtggggttttcagatggtgacgaccaggagaaatgctaacaccagtgatggcaaccaacctgaaggcagcaaccacaaccaccaaggcaacccacctccacctcctcctccgcctccaccaccaccaccagacaccaacgccattctcacccaaatcctcgcccagcaagccaacatgatgaccgctttcctccaccacctccaaaacccgccacaacagaatgctccaccaccacccccacaacactctaaactcgccgagttcctccgcatccgcccacctaccttctccagctccaacaaccccgtgaatgctttggattggttgcatgccgtggggaaaaagctagacacggtgcagtgcagtgatgaggagaaagtcgtcttcgccgcccatcagctgcagggacccgcatctctctggtgggaccacttccaggctacgcagccagtgggacagccgatcacttgggcccgcttcaccgccgctttccggagaacccatgtgcccgctggagtcgtggctcttaagaaaagggaattccgagagttgaagcaaggcaaccgctccgtgatggagtacttgcatgagttcaacaacttggcccgttacgccccagaggatgtgcgggaagatgaggagaagcaagagaaattcctggcaggaatggaccctgagctgtccgtccgtctagtctctggggactatccggatttccaacgactggtggacaagagcatccgcttggaagccaagcacaaggaactagagtcgcacaagcgccgcttggcgaatttccgcaatcaacagggtgctaaccaaagggtccgctacaccaatccctatccagggggatcctcctcgcagcagcagcagcagcagcagcctcgctccgcgcctcgacctcaattcgtgg

SEQ ID NO: 63208 - DNA, 1963 bp, Oryza sativa
gtgacgctgcagtactgggtgccccggccggagtgatctgtcgtccagtgcaggtacacgacgagttccaactaagacgcaggtggctcgagatgtacacagtaacacactggtacgtcgtaccacctatccatcggtagcgagcacgtctccgcgccgcgcggtgctgcatgcatgtgtctccatctgcagccttgcaggtttttcgttcagatcaatcagggggggctgctctcccgttttccttcagggtgattgatcacactggccgtcgatttccaaaggttttcacaaagcgcgtattactattaccacgtgccgattggatcgagtgaacactagaagtaaaaactgctgtccaagtagggagttaagtaacacatcgcgagatccaatgacccaacaaaaccttgcagaggtttttgcagttgcatgcatgagtggcaattggctcttcggtttggtttgcatttactactatattcgcatcatcaaggattgacttcagactttctgatgagttgcaggtgcgtgcgtgttcatatacgtttattactgtcagttgattttctttgagatgtactggtctggttggttggaggaatatcgagtgcacttgatcgatagataagatagattggaggaatatcaagtgcactagacggatagataagatagatactggttacatcttcacagcttgtgcaagcctctgaacagagaagacgatatatggagttagaaatatggaaacacagtctacgggaaccatatgcgctttatgcagtgcacttaagttttaggatggaaaaatgggggagggaactggccgtagtaatgcatggtccctagttactgacaggatggtcataggatgcatatactactgtaaccgtttggtgcttggattgatccatgatacatcagtgagggcaggtagcagatcgatcagtgcatgccggactgaacaatgactgcaagtctctgcaactagcaagcagtacagtcgtacttcagtttcttttgtaattgaattaaccatcacataatatagcaagccccatttgcaattaaacactgaaatagtaaaacacgtgattttaatagaaatgtatatgcaaaacagaaaattataaaacacaacaagataacataggaataagaaatacccgtttaaatagaatatagaaaaaaaatataggaaccggaagagaataacagactagaatgaaagtttctaataggttgaacctctactgagatatttctgaggaatttcataggatttaggaagcttcaaccctatgtttcaaatgactaggtagaaaatttttctataggattaaaactctacaaagttagtacacattgtttccaaaatagaccgatagtgtattctgtagggtaggatctgattgacagattagataatgcatgcggtacagcacttacattgcaaatttgcaattagggccctatttagattccaatttttttcttcaaacttctaacttttccgtcgcattgaactttcctacacacataaactttcaacttttctattacatcgttccaatttcttcaaacctctaattttggtgtggaactaaacacagcctagctctaactctctgtgcgctcttcttaatcttaattaagtagccatagcagcgtggttgctagaatcgccaacaacatttatagaaaacatagaaacatgaaaaatacggaattttaatatgaatatataagtggaaaacataggaaaatctatgagcgactttttgaatagtccgcataaaaaacaaaaagaaaaaaaatcagataacatagatagactaaatttttttttcaaaaaatgaagctcttgctaactttcttcaaaatttataggcattaagtcatttcttaggaattttgtaggatatacatgaaaaatacggaattttaatatgaatatata

SEQ ID NO: 63209 - DNA, 26384 bp, Oryza sativa
  unsure (1)..(26384): unsure at all n locations
actacagacaacggactactggtgtatatatagtgtgcaaagaaattctcaatcgggccaaaaaatgtcatttctaacgggcgcacactaatctctaactggtacaaaatgaagcccgacaccgataagagtcatcggtgacgggctccaaagaaggccctattgagatggccttaatgcctgtcaccgatgactcttatcggtgtcgggcttctatttgtaccagttagagattagtgtgcgcccgttagaaatgacatttttttggcccgattgagatatactttgcacactatatatactccagtagtccgttgtctgtagtttatcccactgttcactattttggtgggaggttgaagggggcgaatttttgtaatttttttgcaaacaaaaacaggaaaaatcataaaagtaagtaaaagggtactaatcatttcctattaatttagtagtacttatgttatgagatgttaactaatattttgttcattgttcagcgatggatcgaagttggatgtacacgactggcttgaggcgtcattacaaggagtatagagatggcgtattaagttttatgaaaaccgcagaggaggataggataagaagaaacaacaagtacatgtgttgtccatgtagcgattgcaggaatgagattttgtgggaagatgaaaaggaagtacacgctcacttgatacgccggggattcatggagagatacacatgttgggtgatgcatggagagcaagatctgggtactaatggtgcagcagcagacagaagtggtgcagacaatcatgaagaagtagatgagaagagcatgacatgtttgtcccatctccattgggcggtgaattggttgatgtggaccctgatatgcggcaagacatgttacgtgacgttgatgacctagctatgaacgagagagattccatgaagttcagcaggttggtcagtgactcggagactcctctatacgcaggatgcaagccaaagcacaccaaattatcagcaacattagacctaatgaagttgaaggctagtagtggatggtcagacaagagttttacaaaacttttgggaatactgaaggacatgcttcctcaggggaacacattgcccgagacgacatatgaagcaaaacaggttctctgtcccctagggttagaggtctggagaattcacgcgtatccaaacgattgcatattgtaccacaagcaatacgcggacttagatgcttgtcctgtctgcaaggcttctcgatacaagcgaaagaagagcgcgggcgagggaaagaagtcaaagcggggtggtccggcgaaggttgtgtggtatctaccaatcattgatcgtttcaagagaatatttgccaaccccactgaagcaaagttagtacattggcatgccacagagagaaggaatgacggtttgctaagacaccctacagattggattcaatgttggaatatcgatcgaaagcacaaagagtttgctgccgaccccagaaacgtgaggatatgtttgtgtacggatggcatgaatcctttcggagacatgagcagttctcacagcacttggccagttctcattgcgaactttaacctcccgccatggttgtgcttcaaaagaaaatatattatgttgtgcttattaatccaaggtccgagacaactcggcaatgacatcgatgtgttcttggagcctgttatcgatgaccttgagattctgtggaaagagggtgtggaaacttgggatgcatatggtcaggagaacttcacactacaagttctattgttctgcaccattaatgattatcccgcgctgggtaatctttctggacaaaccgtgaaaggaaagaaggcatgctctgactgtatggaacatacacacagtaggtggctaaagaaatcaagaaagatggtttaaatgggtcataggagatggctccccctacggcacgcctttagaagaaagaagaaaattttcaatggtaagaaagaacttgggtctgcccctgcggatttgtccggagatcaggtacacaatatggtgaaggacattactaatgagtttgggaagaaaagaaaacgtagcaaggaggacaagaataggttgtggaagaaaaaatccatattttggcggctaccttattgggaagatcttgaggtccgtcattgcattgatctgatgcacgtagagaagaatgtgtgcgatagcttgctagggctattgttgaatatgcctagcaagacaaaggacgggttgaatgcgcgtctcgatctataggacatgaacattcgtagtgaacttcagcctgttacagatgagaagacaggaagagtgtacctcccaccagcttgccacacattgtcgaaggatgagaagatcgcaatgctatcatgtctggcagatattaaagttccttcgggctattgtgcgagaataagtaagcacgttaaattagaggatccaaagctggttggaatgaagtctcacgattgccacgtgctaatcacacagatattgccagttgctataagaggcattctaccaccacaagtccatcacacgatccaacggctttgtgccttcttcaatgcaatcggtcagaagattatagatccaaaagacctagatggcttgcaggccgatattgttagtaccctgagtcacttggagatgtattttacactagctttcttcgatatcatggttcatctcactgttcacctactgaagcaaacaaaaatatgtgggccagcttttatgagagaaatgtggccatttgtcatgaccggaaataacccagcgggcgttccttacgtgcgtgtattattccttgtcccaggaggcaaggtacaccaaaaattgatacaatacagagtttaacaagcggaagcgtaaacaattaatttattacatgggcggtgaaggcccagcacacaggaagacaaacaaaaaacagcggaagactacggcgacgaccacaggcgcttgacggcaggcacgagctagacaccaaagccttcatcttccaggaactcctcttctgggtttgggaaaaattgagcaagactgagtacaaccaccgtactcaacaagacacacccacgagtgcagaataaatgcaagggagtacaagggagttataatataagggattagggtttgtagtaaacagcattaaaagacacttagttgctcaaagctattttgtaaatacgatcctcgagctatgcaatattattaatcaaggccgtgaacccacacgaacctgccttaacccaaggcctacgatgattcagaccgaactggcaactcgaccctgggtcccagctcgtcccaagccaacccaggccaaccattccacattttagtcgttaagaaggttttaagaattgaaacactaacttgggtacattgctcggcttgcccataaccgagggcgcggctattcgaataggttatactctaatcaaaggtgtacatctttacccacaagacacatcttcctcacgtgtaaccacgtgccacataccaccacggtatacggacggaagacatgacatagtttccaactcatcctatccatagacaagagtaccgacccaaccccacctacggccggaacctccgggacaggtaggcaggactgagcccctagcagcaggacatcggccctctgccctgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccggagaccggtccttatatggccgaggtgctactatcaaaaccatgcaccccgagctcagcctgaagccattttcaggattttgaatagagggggaggtgtgaatccaattccacaataactcaaccattccataatgtccaagtgatatgaatattcccaaagtctagagttgtaaaaccacctaatgttgcctaattaaccagcgaagcatctacctaaattcatactaggggaaccttgagtagagtgcacagtagttggggttttgtttattctagggtgaacaaggtaataataacaatagaaataataataaggtcataacaaaggtaaataggcatggctaaataaaacagtgataacgcgggaatttaaataaagcgataatgcattaatttaaatcaaaataattttataaactggaattcaatatgttcaaggatgatgtgacttgccttgctcgctttcccaaacgtcggcttcaacctccacgaagagcggatcttccgaagctgcagtgtctacacgaccaacggaaaagcaaaaggcttttactctaataaactccatataaaaagcaggaacaaagcacaaaaatggattcttgacttcttaaggaaaaattagagacttgaacggtccaattccgagttcaaatggccaagttatggccatttgaagtttatatgctctttaaatggatatttgcgaatttctttatttaaattttaatttaaaaagggtttattgcgtcagccgaggggagagggcgcgcggaccgggtccacgggagtggggcccacgcggcagcctcacggtccacggtggaccgggtgcacccgggctcacaccggccagcgccgtgggtcccacgcgtcagccgcacccgagggcacgggcggctgacggccgggccccacgcggcagccgctcggcgcgcccgaagacggccacgtcggcgcggccggcgggaggcggcgcgcccgcacccctatggtcaccggcggcggccataggcacggcggagcagcggccgagagaggggaagggaagggggaaacgaggcggtggtccacagctcaccccggggcgatggcggcgacagaggaggcggccggagcggagggaggcggtggcgcggctcgggtcaacggggtcggcggcgctccggcggttggcgaccgaaacggaggggtggacgaggtcggcgaggatgcggcgaagccgaaggaggcggtgccgaggtaggaggcggtccggggcgacgacggcggcggaccggagctcggcggcgacggcggagagagagagcgacgtcgcgagctcgaatccggcgaggaggaagggcggcgagaggcggaaacggacggaggaggtgcggggagggtttaaatagggttggaagggggagtggccggccggagaaggaaggaaactggcgcggcattctcgggctccatcaatggcgtcggcgggattaggggagaggttttcaaacgaatccaagggagagaggaggaaaaattggggggaaagggagaggggatcacggggaatatttccccctactttattgcacgcggggacggcgggaagctgcgggattcgcggcggcggcggcggcgctaggcgcgggcgagacggcgggaacggcgggaggaaggggatgacgggtgggccccacccgtcatcgagggtggcgggcgggcccgcccgtcagtggcgcgcgcgcgggcagaggccgagtgggccgcggggaagaggagagagggggagggaaatgggccgagccggcccaagagggggagggggggattttaaggtttttctttttataaaatcattttaactttgtatatttcttaataattattatttgtgctctgaaaattccactaaaatttatttacacattttaggcttttaggaaatatacaaaaatcctctaagccttatttgacttttaactttgcagattttaatttttggaggctttcacacggattttaattattctaagcataatttaaaggatgtattttagggtcgttttgggacgtgacaccattcgagagatacatgggaattctgaagtcctacgttcggaacagagcaaaaccagaggggagcatcattgaaggttacacgaccgaggaagccattgagttttgtatcgattacatggccgagactgatcctatcggagttcctatgtctcgccacgaaggaaggttggcaggtgtcggcacaactggtagaaaaagaattgttcccgatcaagcttcctacgcgcaggttcatttcgcagtgctgcaacatatggctgaagtaaccccatactttgagaagcatttagcgaaggtccgacaggacaatattggtcgatcagatatttggatcaacagagaacatggtgctcgcttcaacgaatggttcaaggatcgtgtagcacagtcgaccgatggcccaagtgagatattacaaaggttggcaaggggtccatcttgggatgttgacacatggcaagggtacgatatcaatggatacacattttacaccgtcacacaagatgagaaaagcacagtgcaaaacagtggagtccgtatagatgcatatcaggatcaagctggatcgagcacatactttggccgcatagagcagatatgggagctgaactatctgaacttcaaagtccctttgtttcgttgcagttgggtgaatatccgcacaggtgtcaaggtcgacaaggaaggcttcacattagtggacctggccaaggttggatatgcaaacgaaccatttgtactagcgaagcaggtcgaacagattttccacataaaagaccccgcaaacaagaagatacacgtcattagggatggcaagcaaagaattgtgggggtgaacaacgtcgtcgatgaagaagaatacaacaagaatcttcatgtcagacctcagatagaccttgacgatgatcccgaagacgaagtggcttacgttcgttcagaccattcggaaggcatatcactgtgaatgatcatctatgaaaataagtgcgttgttggatcggaaaatcagttggcataattgccaaggaatactcgcaacaaggattgttgtagacatgtcacaagggccttcagccgaacctgccgaaaccatcaaatcagcgagacgccaactgagtccacgaggttcctctcaagcgaagccaaaagacgaagtcaggagggttcgtcaccaagttcgaagggctcaccatcaagtttcccatccaggtgaagaagcaagaagggttcgccaccaagccgggagggctcatcgccaagtctccgctctgggtgaaggcctcagggtgaagcacaatgggttcgccccatggaagatgggtttcgctagggagaccagctagcagcatggcccatgaaggctgttcacctcttacgggccaggccaggggccaatcaaaggtcccatagttagaatggatactgtatgccccttttaatgtccctatccatataaattcccctgaacatattgaaccgtagagggtatgggcctgtagtaaggctataaatagcccaatagggccatgtaatgggggatcccctaaaaatttcataaattagcacgttgtttactattcaaatcattccaccaagagagccacgtcctttgacgtgaagttcttgtcattttgacaacaaggattagaatttactgttacaattaatagtttctttagttagggatctttgtagtgatttatgcaatagggagcaatgatattggtagaatcagatatttaccttacagtttgaaatcatcattaagtattgtttttgattgatcgtggaaactggcttgagtactgctcctgggactattatagtgctaagctaaataaagcccgtacaacgaagattggtacatgacttgtctctatcagtctgttgcatgaaatttaacgagcatgcttaggagttggagacgagggagaaatttaaatgatgagtgattggaggaaaaaataatactctagaattagacttacttttacaagttttgaatcctatgaaattacaattaatttattattatgagaaggatggagtaaataatggtccacggtacttgaacattgatagttcaaatattataggagcaaaatcaagagatagtaagtactataatgtgtgtttataggggtaaatttatgggcgctatcagcacatgcgtttgtaccgtgtattaaaaaaaatgatcagcataggtactcactggtgagtaagttgtaagccctcaaaaaagtgtgcaggggatgttccaccgccaaagcgtgttttcccgattcaatcattccatgtggttgttacgtgcatgcatagtgcgcaatagtgtttctgttgcttgtgtatttttttaagctctccaaacaactaaaaagagttttcatagagagcccaaataatgtgattaatgattgtcccattatgcagtctgaacatattagatgtacaccgaaatgcttgaaagaaaattatatttggtcgattaaaatctaaaaatcagttggcataattgccaatggatactctcaacaaggattactcaaacctctatgttgtaaggaggctacactaaatattttattattaattggtccaattagttgccaagccctttatgtatatgtaaggatattttgtgcattttttttaaaaaaatgtttcacgatcactataacatgcatggagtagaaacaattgacatactcatttgtaatttgtgtgtgtgcccgtatataagcatgcatacattcatggtacatcaatttggcacgtaggtgtagtttaatgcaagaattaatctgagtgtacgggtaaaacaatttgcatggcgggtacgaggttggtacaataacttaagaaataatgcaacaacattctttctatacacattcagtttttaagtaattattttgtcaatatacatggactaatttgtactaatatacttaaattttgcaattctagtaactaaagtcacttaaattttgggtttatagttgagagtgaaaaacaaattggtggtgcaaaaaggatgaggaacataattcttatatattaaattccagactgtaagctaatatccttcgaattgtgtaatgtcatatctaaagaagtggaagctgaaacatttcttgaaaaaagacgcgtccacgtcatcaataaaccttaaaacgtccggtatttttgtagatcgatgtgagccatcagattacctaaatggcgaaagatcataaatgtccgtcttgaaaattctattcatttgatattttactattttcccctccactcccccatccaccagtgttaaacggctcctcttctcctgccttagctgctctctccacaccgccacttttgcatcccctcgccgccaccgccgcctgcagccgccgcctctgactcctatccatcgcgccttggcagcaggctcctcgtctccctagccatactgcctccccatccaaaccgcaccgcgtcccccgtcggacccagacgcgcggagctcaagggcgctagactcggctaggctcacaacggttcaccgcctcagcctactcgcccacaagctccgacgctgcctcctccccatctaaaccgcagctatctcatctcatcttacaccaacagcctctctcctcatcgccatcaatggcactgctgatccggacgatttctcatccaaatggttactatgcaagagggtttcttgaagagaccgaggaattagtgcatactaatcaccaacccgtgcgttgcatgggctattattattaatattataatattttagattctaattatagaaaattcattagatattttttaattatatcggtttaaacttaaagatatataaatcagatgtcaattacaacatggatagtataaactgaagaatcaaaagtattttcagtagtctgttattaactacaatagcctattgttaaatagggcattgttatttaatttttaatcgtacctatggtcatgataatacgatccaagtaagtactgaccagatttataattaatgttttagctcataacgagtgctctattagtttggtacactactacgaaaaccatctttcgtggcggtcattttgggtttccgctggcagaaatcgcagccgtcacaaagcaaaggccagtgaaaatgtcgatcttcgctagcagttatttaccgccagccaaaatgcatcttcgctggcggccgagaaaggaacgcccgccagcaaagagatctcttcgctggcggtagccttaggacggccgctagcgaagccaccgaagacatgtccttgctggtggcggacataacgcagccgccagcaaagaagtatctccgcttgcggtagccttaggtcggccaccagcgaagataattctttctttgataggaaacatattttcaaacaccaagtcaaagaagatagtagttcccatcccgggcaggcatgaattgaaataatagtttccatcccggataatagtgaatacatcctagcatttgccggcaagccaagtaagcgtgatcagcgcttacccacaggaacatgaataaagatccaaattgcactcccatgactacacatgttccttgaataattgaaaactagaatcaaagaaccaaattgaaatcatattgcgcatccatggcaagcatggaacttgaattatttacccagaaccagaatccggaatattgaaacaagaataatgtcgtaaacataggataaacatgaaaacctaaatggcgtgaacaacaatatgaatataagcggtcacatgtcacatagaaatatatcggaaataaatagatagagcaaacaatccatgaatcacacaattagttcatcatacacttgcctccaaagaaaggttggtatcatgcacaatctgaaggaccactacctaatcacaaacaaaacctcagcaaacacattcaaacatgcatataaaacaatgaaaaaggtgaacctactgtcccatcccatcaaaacgcaataacaaagaacgccgtttggactataaacaagactgctgcttcaaaccttcatatcttaaaatatgaaaaggctatggccgcaaataaatacattttggaaatacgaaaatgctatgccattaaaatggtctaatttgcgctcgaaagaaggcttcacaatctgtccaaaatttcagactatccgcaccaaaacaatcaaaactggagttctactcgcccaatcagggtattcctgaccaatatggaaagctaagaaacacctctacaactttgtttataggcggcttgggtgattccactgtttaacccatccaaaaactattcaatctactactatccaaattatgacataaaaacaacagttatactaaaaaattcatatcgtctaaaccagttgagataaaaccgctctctttggtcagaagatagacataaatattatctacaacttcctaattatatacactttcacaaaaaatatcatttagtcctccgaaacttcgaaaaaccgaaacactgtaaatctgccaacgtgcagaacagccaattcgaaccacaacaacaaaactccttctctaaccttctttatccaggaattaaaccactaaaactaccatagaacaactgatacaacaaggggataagcctcacctagggttttccttctatatcccatgggaaacgacgaggaaactccgatctaacccctcctccttctcatctctcctcctcttcgttccgtttttccacattgcttcttgatccaagctatgaagatggagatctagggagggcaatttgttgtagaggggagatatgcgaacacatgaggaacaggaggaaggaggcgctggccagggagaggggtgggattcggtttcctaggttttaagggagaactaatgggcagggtttatgagccttctcatgttggcccacttataaagatatttttcttttatttatttctattaacatatttattttaacaagtcaacccaaactaaaaacctaaatatatttttttaatatacggggtattacaccttttcatgatgcctttgtgctatgtaagttttcctctcttcgggactcatcgcctttgtcggtgatatgggcatggggtctcaagaccagagggaggaggccaccccccaacaccacatggccctccctcgaggggagtctggcccgaggtggggtggcggccactccttcctagagactagatggaggaagctgccccccaatgccacgtggccctccctcgaggagagtcangcccgaggtggggtggcggccactccttcccagagactagacggaggaagctgccccccccaatgccacgtggccctcccccgaggggggtcgggcccgaggtagggcgacagccactccctcatgtgactaggggtcgggttcccccgacgccctccgcgagtcgccacgtgcggtgggttaggtggccaccttcgagcgctcacctacccgcattaatggtgacctaagtaggcgcgccacgccacatttaatgtggcgtatagcacgcctaaattggtctgtgaccggtcgaatgaccgacgggacccagggtgtcaggcgcactatcgcatgtgtcagggggcgtacatcccgtcctgtccagtcagtcatgatgatgagaggtcttagcctcccatcccggccagagtcggttcattcgctctggtcaattagggttcccgtttcccagtgcaaccaggagcccagaagactacacaccttaaatggtggttgacaggggcaccccccgtgttaggcggcaagatttggcaggcctcatcatcaagatggtatgcgcttgcttcccaagtcaagagacaagacaggcatttaatgcaaagattgtaatccttctccactaagttgtgtttttgggcccatgtggtaaccccttgaggtataaaaggaggtccaggcctagtaagagagagagagcttatgcccctgatgatcaacaccttctaccccaacaaggagatcttgtaatttctcacaagatcagctaagcacagaagtagggtattatgcttctcagcagcccgaacctgtataaaccccttgggtcagatctttttggggggttcaaccccatcttcacacatctacacaggaatctcgaatctcacccgctgccaaaccaaaaaagagggacctcacggttccctggtggaggagttcacctttcgacagccttgatgtgttccggtagcttcttctcgtctagcgtgtatgtgtggttcggcttacttatcatgcacgggtttaggtaggcaacaggcttttttatcacttcggcctccacgtaattcatcctgccaacaatggatgatcaaatgagctacgcatataggtgtagtgatctattaaaacgttcaagtctagcacttacagacaccagatggcaatcaaattggcgtccagcctcttcctacagtagagggaatgcatatcggagaaatggacttagagtagacaaagacctctctagaagatgttctcccccacagcaactgtgaatgatgaaatgcctttcatggtgcttgccctaatgtaccaatcgtgccgccttcttagttgccacggtccttctcttagtttccagtcgtaaatgaatggtttgtcattctcaaactcgtgtggctcatctagagaattgatatagttgagatagtgataaaaggtatgtttgaacccttttaattttcttttatcaaactcggcatttacgatatctttctcctttcctcggaatgccgttaccatatactgtttcttggacgcactttttgctttgtgcttgtgcgtccttaccatcactagcacatcggcatccttaggttcctctggttgcgatggctctggttgatcaggcattgtctgttcaggcaccgcttcaatttcacccgccgctagctttgtaggctccgcttgtacaggctctgatggttgtgcggaagacatttgtcgtattgctagctgtgattgttgctttgcaagcaccgattgttcttatgcatcctttttagtcggaggtgatgcaacaggaggctctgatcctggaggtgatgcaactggtggctctggtctagggggtgaagcaataggactatccctcggactagctacgactagtggacgtgatgataataccgatatccttggtggacaatcagttccttcagttgaccctagttcaatatcattcttgtgccatagtatgaattggtcgacggcatctccaaggtacacaatctactcagtagttggaaagtcgagcgcgtgcatccagtaagcctcaatgaccgtccggacctctaccttggcgtagtcatccggaatgtcttggcaatgaaacctgcgacctggtatgaacctcccagttgcaacgagtattttctttcccgccctgccgaccggaatcaagagcttgcacggagtatcctccgttacatcatcgaaaggatagctcagctcaggctctaaaacagcagcaccgtgcatcattttctgactccagtatatattgcattcgtcacgagctactgccctagcctgagagtcaatctcttccctgtagcgatcacgcttcttgtatgtatgagcatcctgtttgaatccatccttccagctagtctttgaggatactccccgtacacggccagagtgctccggtttgcccaaggcataggtcagctcgtcccagtctctatctggcacaaacgtccaggcctgttgctgcgtgatgatgttcttcatcttgacagctacctcctggagcttctgatccttgaatactacatccccctcagaggtgaaggccggtgttcttgcacgcacccagttcctgcttcgtgggttgtgatttttcataggaatcggtttcccagccttctccatctcttcatcttgttttgccatttcttcaccgcttgccggtaaccggtcgatcccaaatgatgtggatattcattccttcttgctagctcagccatcttctagctcttctccttttcttccgccgatgtcttaagggcaatgaactcatcccactgggcctgtgttatccttccgtagtccttaaacggcgtgagtcccttctacatatatttcttatttaggtctattttccagtttcgccacagcttctccatagtcttcaacgcatattccttggctttatcgtcgtctgtcccctctggatattcaaacttgctttgcagtgacgtccaacagctgttctttctactctctagaactttcttccaatccttccatgtgatctccacaacattccttaccaccgccccacattggttgctatacttcgaatatgagtcttccggtgacaagggttcccctgtctcactcatccgtgtcagcacacttacttccttcaatagcattttcttccctcgctcgcccctccatttcttgggtttgcttgaagctgttgtgcgcacgacagctgtagcttcagcttcaggttcggttgcggcttgggatttccttttggagcgacgtggagcattcttctatgtttgcaattcacgtggtttcaattaaaatccatagttcgtggttaatatgattggaactaaacatatattatatgctacgtaccaccggttcagggggaacatagtcagagtcaacttcattgtcactaccgccctttctcttctttgcaggagaaggatgggggtcactcggtgagtgatacgatctactacctggttcacttgagctcgacgaagattcctccgcgactacttgcgtgcaaatttcttcctcgatgacggcctgagtttccttgcccttgtcacccgtgggttgctcttgggtgggtttgtccattgatatcctttgaaggtgaatatatgagattggtaacgacaactatattacgatggttgaactaaattatcatcgtacatctcatggttgaaccaaacatctcacaatgtttaattatcaaaaaacatctcaccatttcaaactacctaattaagttccttaattatcaaagaatgacagatttcgaagtgcatggaaaattttggtgtctaggttggttccgtgcatggactaccctgaccaatccaaaaaaattccccatgcacttcgtattctgtgatggcttgataacctaggaactacattaaatctacggccaatctatcaattcatccatttgaactaaattttaaaccctaaacctaattaagttccttaattatcaaagaatatcttcactggtgtcagcttaagagggccgccagagaagatatcctatcttccctggcggccatcttaagttgatcgctagcgaagatgtgtttccgctggcggcccttgaccccccgactccaagattttctatgctggcggtttttccacatagccgccatgaaaaatattttccaaacgccatgaaaaatcgattttctagtagtggtataagcccgattaatagattttatatgtcgcttaaatattagagaactactatatgcaataaaagaactctaaatctctaccatttgactcaattagttgaaggttaaagaaaattaatattaaatgacactgtgccccatatttgtgtttgagaatgtttgtaagaaaaaatttgtagatatatcttttcctatataatattggcttgaaaatctatctagcatgaatacaaatgggtgcctgagggccacaaatattcatgactaactgaatcgaagcaaaccttcaaatagtagtatttcgcattttatttgaattattccgtagaatccgagactatctgtctattatatactaaaagtccatgaaacttcctagaaacgctctcaagccgccatgtggcgttttacaaacgctcctaagggcagtcccaacccataacactaacatagacactacccttccaatgcaaacaccactattccatacttcaatttaatgctacttatctcacatgatgtcttggatgttgtgtagaaccatgtctgatgcaagacatgatttccttctcttttctcatttattcacttgccacatcattttttatcctaggtggcagcttatttaatactatggacaccatcctagtcattgggttgggaatgccctaagtcgcctattagatcgatctcttcccttcccctgccgtacatgcatgccactgtacgtatgtacgtatatgtgatgcgtattccatatgccctccccttttctcctattttctaacaactcaatacaaaatagtttaaattttaaatagctaaataagcatgattctcaatttatatacaacattaaattcatttgtgctatttttatttgtaattaaataaatacatcaagatcggtattgcatatattttgcgaaggtaaaggaaaaactgaaatacgtttggacatagaccctagcgtcgcagtcattaaacaatataaaaaaatgacaacaactatatcatcttaactcattctatatataaatatgcacattaaattaaatatcatgtaggacccaaaccatcaccctgcacatcttaaaaattaagaaatcactactacgaaaatatctttcatggtggccattttaggttttcgctggcggtttttgcaaccgccacaaagcaaacgccaatgaagatcaaaatctaccctagcggttatcggccgtgagcgaaaattgattttcgctggcggttgtgttataccggccgccaattcaaattattcccaaatccactcctcgattcacaaattcacataaatttacatcaacaatttacaataaaaacagtcaaaatttttcattcacaatcaacacaaatccacacaaatcataagatattttccattcacaagccacataaatccacagaaatccgagcaccaccgcccgcggcccggtggcgtccgtcgtgacgaggtcgaggccgatagtcacgctccaccgcccgaggccccagggccgtgctccccgcgccgcagccagggcggatccgtcgttcccctgtccgtcctccccggtggcagcttcctccccttagacagatctgggagaggggagaggatgggatgggagggcgcggcgccccagtagagctagctgcggctgctctccttcatgtcgacactcatgacatggaatctgaggtaggccagcgagtcggtgaagcacagcacgcacaggatggtcgtggtcgccatcgtcgtcacttccttcgtgttcgtcgtcgctgcagcttctttcgtgatcgccgtcatcaccgtcgccagttgacgtcgtcaccatgcacatccatgccacgcccctcccgccgtcgtggtcgccatcgtcagcgcgcgcccctccggccacgcccctcccaggtggaggaggctgggggcgcagccgcgcagggaaggaggagggtctcggtgggggaggaggaggagagggaggtgggtggagagggaggtgggtgggtggagaggagatagagaagagaggggacagtgggtggttgaagggaatatctcagcgcgcgtgattttaaatgacgtcgatttttttttagcgggctatgttttttcgctggcggaactgtttagtaaccgccagtaaaaatgttggttttcgctggcggacatttaagaagtacgcctaaaaaaatagagtattttttatagcggacgtcttaacgtggttgccaggaaaaataggttttcgctgacggtcctatacccccacccctcttgatgtttttgctggcggttttagcatatatccgccagtgaaaattatagtgcgacgccatgaaaaattgttttcctagtagtgaatatcgttgaaattctataagaaaaaaaaagcaaaacatcctaatatcattttacacttaaatcggcaggcgtattattttcacccattagatatatcattctactcccataagccgctacttgtcacatgttaaaaattaatagaaattacatgtattctaaactaagagtccataaaactttctagaaatgctctcaagccgccatgtggtgctctacaaacgctcctaagtcatcatgtggcgctttaataaattggaaaaaaatcctaaaaattttaagaaaaaagaaaaacatctcaccattggttttagtggacccattatttttaaccattagatcaattttaaaggaatatatactcaatccaacctatgggcctattagatcgatctcacagaatatgtagccttcccttcccctgccgtacatgcatgccaccgtacgtatgtacgtatatatgtgatacatattccatatgccctccccttttctcctattttctgacaactcattacaaaatagtttaaattttaaatagctaaataaccatgattgtcaatttatatacaacattaaattcatttgtgctatttttatttgtaattaaataaatacatcaagatcggtattgcatatattttgcgaaggtaaagaaaaaactgaaatacatttggacatagaccctagcgtcgcagtcattaaacaatataaaaaaattgacaacaactatatcatcttaactcattctatatataaatatgcacattaaattaaatatcatgtaggacgcaaaccatcacccttcacatcttaaaaaattaagaaatatcgttgaaattctataagaaaagaaaaagcaaaacatcctactatcattttacacttaaatcggcaggcgtattatttttagccattagatatatcattctactactcccataagccgctacgtatcacatcttaaaaattaataaaaatcacataaattctaaaagaatgaagcatccgacctcgataaaatcattatttcagccattagatctatatttaaagaaaaactttaaaaaacaaagtgccatcccattccccctccccctcgattaacaaagcgccatctttatattctgaaattataaatatatagtaaatgaataaatatatcgttggagtatataaccatactaacaaaaacagggagtagggaaattgtcattaattaactcaagttgcacgcattagatttttaacttatgtggtatgaaaactattctacatggaccaatgggagtgctagaaaggtccattaggacacttccaaggttacatgtggccgttgatggagacaaccattaataaaaattcatactgaaaagcataattttatagcagagagtacatgtctaatatcatatcacgaaaagacaaccttgcatgagaaataacatacaaaatataacttaaatgattatctcaactctccattgtactatgttaggagtaactttgtctaatgtggtcaatattgtggatggcagtaacatccttaactctcctaagatttatttcgaggcctaacaaattagaaaacaagccatagcacaatggggccatagtaagaatgcacggggtttgtgcgagtcaggaatcccgacaatggaattgcctaagcatcaactctattttatactaacaaagaattacattggactctagcaaatgagataaaagtccgggcatggccggcgttgtattaataaaattgccaaagtatcaactcgatctattttgtattaataaagaattgcatagcaactaactccactgttgaaaaataagtttgtcgtaaattcaagattccacaattttggcgaattttaatttagattttatgtgttttaaggatcgttacaaacaaaatcataaccatatttcagagcaatcccaaatagatttttgagagaagtatcataggtttaaaatatgataaaaaatccaagtaaaaatcagccaaatttatacattcataaatctatctatctattatatactaaaagtccattaaacttcctacaaacgctctcaaaccgtcacatagaactacaaacgcttctaagctgccacatgacactctaataaattagatttatttttcttaaaatatgatggtcccattattttataccataaaaaaataaaaaattgaaaggcccacattcctctccttccgacctgtacgtgtagtacgcacgacatgctaccatacgtacgtacgtagatgtattggcccctccttcctttctgtttctatctctcttatttttcttattttgatgacccttctattcctatctctcctattttgatgatgtggtagattgaaaacatattgatgtgttcgctggaggaagttgggaacctatcactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatccttagttccggttcgaatgctgtcaggacctgttaggcccccccgggatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacactttttttctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccagagaacttcgttgtacccaggttgcgagcaggggcacaaaaagttggataccactctggagttgttgcaatggaaggccaaaaatggggttagtgacaaggcatttggcgatttattgaaactcgtcaagaacattcttccggggggaaacaaattgcccgagacaacgtacgaggctaagaagatagtctgcccgttaggactggaggttcataacattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggtgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccattacgatgtgtatctacaacctccccccctggctatgcatgaagaggaagtacataatgatgccgattattattcaaggccccaagcaacctggtaacgacatcgacgtgtacctaagaccactggtagaagatcttaaacagttgtgaaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatgatcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggtagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaataacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttcgatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcaatgctataatcttcagtcccggttcttaaccctaaccgggtttaaaaagaatttcgaaatagcgggaaaagatatttactcccggttggtgagaacaaccgggactaaagatcttttctttactcccggttgttctcaacaaccgggagtaaagattttttctttactc

SEQ ID NO: 63210 - DNA, 2401 bp, Oryza sativa
ttcccccttccctcccctctctcggccgccgctccgtcgcgccggaggtcgccgccggtgaccatcggggcgcgggcgtgccgcttcccgtcggccgtgccggcgaggccgccttcgggcgcgccccgcggctgccaagtggggcccggccgtcagccgcccgcgcccgcgggtgcggctgacgcgtgggacccacggcgccggccgccgccagccgcgtgctcccggtccaccgtggaccgaggggctgacgcgtgggccccactcccgtggacccggtccgcgcgccctctctcccggctgacgcaataaatgggtttttaattaaattttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcggttgggaaagcgagcaaggctagtcacatcatccttgagcatattgaatccccgtttacaaaattatctttaatttaaattaatgcattatcgctttatttaaattcccgcgttatcactgttttatttagccatgcctatttacctttgttatgaccatactattattgttattgttattattaccttgttcaccctagaataaacaaaaccccaactagtggacactctatttatggttccactagtatgaatttaggtagatgcttcgctgattaaattagacaacattaggtggttttataactttagactttgggagttctcatatcattcggacactatggaattgttggttgatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggaaatggatgaagccgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggttatgggcaagccgagcaatgtacccaagtcagtgtttcaattcttaaaatttgctcaacaacgaaaatgtggaatggttggcctgggttggcttgggacgagctgggacccagggtcgggttgccagttcggtctgaatcatcgtaggccttgggttaaggcaggtccgtgagggttcacggccttgtttaataatattgtatagctctaggatcgtctttacaaaatagctttggccaactaagtgacttttaaatgctgtttactgcaaaacttaacccctatattattaccccttgtacccccttgcattaatcatgcatctgccggtgtggcttgctgagtactgtggttgtactcattcttgctctatctttctcccccccccttcagtaagagaagctttggagaagatgtcttaggaggagtcttggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctatttgcaaaaggtttactccttttcttccttcttcaaatttcaactagtactagatggtcaggtcagtgaagaagaagacatcgtcagttgtttgccgaagctccggaagactgcaggatccgctagcgaag

SEQ ID NO: 63211 - DNA, 5361 bp, Oryza sativa
ctagcactagtggatccccctggtattactagagcacttagtataaatactaaacaatgaacccacaaagatgcaaatatatcttacttagacaaagtaattaaataacataagaaagaaacacgaatgcttactttatagaagaagttctccgaacctggagcagagtgtaccgacagctccggtactcctccagaattcctcctacgaagctacactcgttgaggtagaagtcggatgagcgccaaacttccgggcactcctccagagcttcccctcactctctaccttattctaatgtataaaagatacaatagagcctcttgtaattcagctcaaagttgtgtgttggaaatgagagtgagctcctccttttataggcaggtatgacgattacagcctatgcgaaatgaccaaactaccccagaaccgccattaggatgtgatcagggccgtccacgcaaaatttgatgatcaatggccaccaaaacggttcggccgaactcccgggatggctccgttcggcccgtttttcatcgtggacactaattttgaggccctcagcccattggcatgatagttgggcccatttggatttgtttaattgacttatggggcctccaatccgtgtaaatgtgtcctgaatgcgcggaggtgcagtttgtcgcttgacggatgtgttttcttctcaaaatacctgcatacgcatatttcaccaacactagtgcaaatgattagtaataatacctaccactatgttggatatcatgttttattttattataagaaatgcttattggtatttcttaacgacattactagaaatataattcccagtaatggcgcagaaatacttctggtatattatggttacagagttcatccgcaagcgcacggatataccattgtagcatttcacccgagagtattccaagggtatcgtatttattttatcccgtgggaaaatcatgtagagagaactcaactaataaattatatattacttgtgataatcatagtctaagcaggggttaagataatccatgggtagagtgacacacaagcatttctactcatcctcataataaataatctaaactaggtggaaagaaaagagaaagagaatctattccaatacttctaatatacatagtatacatacattctagttaactgatatactagctaataccctctattcgatgccctcctggtacttcgagaagccacccctgactgccgagttccttacgacagcccgtcatgaccatccaaccagggctaaatactgaggaataccctccccagaaaattaacttaggatatatataggcgcggaggaatacccgtactgagttgtcaccatcagcggcccacctctcatccgcaatatataaccccaaataatgatatcccgtaatctagacaccacgtctaaactaccagatactactctaatatcatcatcatgacatagagtaattgcataagcaaacattatacccgcaccaaagcatctcccagataagctagcagtatattcagtataacaagaacataatgtaaagtaggtactcgtatactcagaaagtatttcaataccataaatgtatatagaagagtattctaataaaattacaaatctgacaaaagaggaaaggaaagctgctagagccatacccgaactcttccgaagacttccggactcctgattcctattctaattctattccaccagctagatactactaaactaaacttgagaggaatgagagagctcttgcttgaggtgtgtgttgaagtgaagagagtgagctccttatatagaggtaggtatgacggttgtggaaggggaattgtccgaagtgccctccaaccgtcattgggatgcaatcctggacgtccaagccaaaacctggacccaacggcgccgggattggttcagccgaaccaccaggttcggccgaacctggggctggcccaatccagcccaatttcggctggtggcctcctctattgctccactcctcagacttgtgaattttggcccaattcatcgtgtcaattctgagttctttgcccattcatacataagtctggtcctcgacatcgtctgattgatttatcgttggtgttgatgttgattctccttcactttattgtcattctctgcaaaaaggttagtagacctaataatagtggaatattattgttctaacatatttatgcattgcaagcatcactagttctctcctgttttagtaatattgacggtcgaaactgatcgataacgaccgtcaacaatatgcaggtattgacggtcagatattatgatttaaggaccgtcaacaacacccccacacttaacctctgctcgtctcgagtgaaggctatggactctacaacaaagttatgacttccttactaataatcatgcaaacaaattattcaaagtcatacctgtacttgtggatctttgcagtgtctaccatgcaatcttggacaattgagaaatggaacaatcttaactcaagtcaccctaacttttcatgaagaacaacttggggtttttttttcaagtaacacaaaattataactttgctttgctccttaattgattctcttgatctctcaaagtgtatgattcctcacaaaggcatatgattgtgccttttcttttcctaccatctaataaggcttatgtggagctcagggtatggaaaagagtagagcattacttgcatcacatatattgcaaagtcaaataaaggatctatggaaatacaagtcatactttctggtcaagaatgcgcatgtgtatgtctatggtaaatttgtgggtggaagaaaatactataactccttttatcatcctccatttattttctcttttcatatttgggagagtgcatggctattttttttcttttttttctttttcttccattttttttcatcatcatgctccacacttgtatgaacacttttttcctttctttttgcatagccatgcctctctctcacttttttttaaagaactttggaggaagaggcataaacgacatggagtatttattttgtggactatggatgaaatgaatggtaaatgagaaatgctaacttccaatgtagaagtcaagcataagtgcgtgtatgtggagtgtatatgatcttgaccatgagagtacgaaaaacatttcactagggtcacaaaacttgacaacgctcaatgtaatgacaagcaacgtatgtagcaagctaatcatgactgatcaacctatggctctagtgggaataaaaatatcaatgaggagtttagcatcgttatatatttttttctttttataaaattcccaagtgtgcaacatgaagagcaggatttctatcatcagactatatctcattcatcaattgtctggataacatagggtccctattggatatatcaccacaagcaacaagtaatgagctaagaataataggcatgcatgttattttcagggagatcatgaactctaattgtaccatccctagcttgagtttaattatctttgatattttagaactgataatcaaattaaactcaagatagaatggatgtccaaaggaaaatttgtgcaaacctgcactctgtataaaacagaggacgattcatggtagaggtggttcagccgaacaggaggtttggcagacccctcattaggtctgactgcatcaattttccatgtgtggttcatcatggctcatcacttctggggtgatcttgcttttgttatgccgttaatgtgcaagatcacccccccacacttgtctttgtatctgctaggctttattggacacaaaaaaaaacaaaaacaagagtgaaggaaaaaggactcacttggttggaagaccaaggagccacatttattttgttttgttttatttttttccttttcttttcctttttttatctttttttatggcaacaatggatatgctggataccctggcaggatggagacatgagatgaggatgcacatggtgtatgagattcttaccagatatgtcttaccaaggtttgaaccgaatgcaagaatacaacaagttttgcatttgttctacttggttccctatgcatatcttttctcatagataaggagcgtgatataagtgttcgaagttattgtacactcctccttgattgtctttttatttcctgcaaaaggttagcggacaacaaatactcgaagcaatacaaagattttattgtagcctcaagattaattgttcacatccacgctaaaaaggaattggattcaaaacttaagaagcgtggatcccacaaagaaaatgaggttattcaggaagcgatttatactagagcagaagatatgaaggaggcggtaaagcattttgcagtgtcactacatagagagttttgggttgccaagttcaactggtcgcaatatgaagttaggtgtgttaaggaaaaagatgggtgtccctggagagtgcacgtttataagggaaaattggaaggattactggacagtgtcagtggttaccaagcatacatgttttctaactggtgttcagaaataccacatgaacattacattgtgcatttgttgcatctgagatgtatgtatgcgcatgtcatcttaggtgtgttacaagcggcttacgaacgacaatgtcgtgaacaacagtgcaactggcgggtgctaactacggcactcgctccatgggaagcccgtacaagatgcagatgcagtgatcgttgtcaggttcttcgttccataaagcctacgactttgggttgaaggttctttgtttgtccaaatattcttgacgacaatttcatggtaagaatattttgattatcatgaatccttattttctcacaatattttctaactttgttcgctttacatctattcgtttctcacaggaaccaccaaggagatgtcaatacagagaatgggtagacaccagaagagaatgggtagacaccagaagggttctactccacctagccgtgtggtgcagcttgaactaccagaggaatacagggttactaaagggtggtttgagagaggagagggatcctcacgtaggggttaactattatcggacaacttgccatattgaaatttgtaatctcatgcttccttgtcacattactacatcgtcgttgtgatcaactcttgcactacctccctcctagttcgaatctaatattatctatgtaaccgcaatggaacctgatgtatcatgttcaaattctactgctatttcttcatgttacataattctccttgtttatgtgtatataatgtttctatgaccgagactgtgataggcctatatcaatttcg

SEQ ID NO: 63212 - DNA, 1495 bp, Oryza sativa
tctccagaatcaaaatgagcagccacgcttgtggttttcagttcactacttatcattgtgtaatcgaaagtttgcagcaatcatgtagtaaataaatatattcatgtctataaacagtgagcttgctatgtttatggatgattcctgttgaggatacaatgtaccgatgttaagcaccttccctttttgtttaaggcagggctttgtattcatgtaataagggagacatgtgtaataaaagcaagttctaggagggttattttggaagatgctgatatggaattatgtgtataattgtttactgtcaaaggagacctagggtctcatttcagaggaactatgttctaacctcgagttaataaccaacctgatgatagaaaagaaaatgccgagtccgggaagatatctgttgattcaattgtcaaggaatgggtcatttcgccgacaagtgccccagaccaagaaacatagctgccagcacgtcagtccacgcaactccttgcaatcagaagcttgctcctcagcgaattgtcatccatgcatcccgaagcagtcctatagaccacgttgcaacaactccaactccagcgagtgcattaccacaaggtgtcaatgctcaatttcagcccccgccatcagttgacaagacagaggccagtatcggcattgtacctttgaatgttccagcacagcagccaaagaaatcaagtacaagatgaagaacccgagcgtaagaaagctattgtctgttacaaactgtagtacctgttaaggaagcagacatgccaatcgccaagtggtcactggagcaaatgcagtacctgataagcctagcgctagtcaggagcaaccataatactcttatatcagtgttcaaatacttttgttttatagttgttccccgtcaatcatgtaataacagagaaacatgagataatgaatgagtttgataagcttatgaaggatccatgttaagagtgcaagtgctgtgagttgtgcacattttgtagttgattagggagacctagggtctcatttccgtaaacccataatctgttaggaatcaaatagcctagcgattgatggcgaagaaaatcaagtgatcaaccaaagaggcatttgtttggactaagagtttcagatgtgtctcttcggatcaaaggcaacaatcgtcagtctagcttttgacgaactacttcagggtttctctgaaagacagcacgcccaaggacctcattgccccagaagcatcctcaacacccggagcgaagagtacctggttgagaaaggtcgaaaggtgattaatggaagagatcggaaaagatgtttggttactgggaaaagaagtaggtcgaaaggtgattgataaaggataacgagaaccatgatttgtgtcactcgaggaagactcccgatagcaaacaaccctacaacagttgccctgtcattaaagtaggtgaattcacgagtaagagagatgaccacaggtagaagt

SEQ ID NO: 63213 - DNA, 3348 bp, Oryza sativa
aaaattggctgtgaattttgcatttcgctccttgcgccctctgtaagagcggcaaggacctaactgaaaaattcgcagacggcgccgtcgagccactgtctgccacatcagcttgccgccctagtggagggcggtagggtctatttttgtaaatttttccaacgataaattatttatgtaaatattaaaaaaattaaaaatgaacaaaattctggtgcatgctgatgcagtcttgggtcaccctctgcgtgatgattctaggttttgtgttaaacaactcttcagcagcattgctcacgaatggtcgactccaactcctctctaaaagatttagttaagcaagggtgagtactaaccgtactcagcaagccaccactacataatgcatttagtgcacacaggggttcaagggtggttggtttattcgcataaagctagatttcacaaatcatttcgcaaacctatgacctagcagctttaactgaaaacaacgttaagttgaatttgtcattaatccgcgagggttcatccaccttggttcggtttaccctcgcatccagttttccacattcccaacatcatcatgaccttcccgcccatcgggcaaggtcacaccactttcctgaactaagcaagatttaaaatctatgaggctagtcaagtgtagtacaagtcccggcgctcaataaccgcgagcacggctattcgaatatatttgatttactcacactgcagtggatgtatgcttttaatcccgcactccgcggcttgcccaacacatgagcctagtcccaacccacgagacttgccgcggcccggtttttcaatcaccggggcatttcggcacccgctccaaggactatggatccccattgcactcccggcacaacacaccacctcgagccggcagtgaggagagtcctggcactcccaggatcacaatgggttatattacatataggttaggtgcattttagatttttggcatcattaaccaatccatatcccttcacaacatcacaacatctcacatcagaaccaccatgacaggggtgccgccccacgaggatttcttagtccaccgggtctatacccactcgagaagtgcgttcgtactctgattgtttcttgcatagcttcttgactcggtctttaactgactagggtcggcgactagccgtttctagaaccacccatattctatccatgccgccccagtcgaaaacattttgtttcattaggtttttggttttcgcaaagctttttgtgctgcgggtggcgctcatgtctccacccgccttctggcaatcactcttgacgagtgaccgccaccacacatccatatccaactactatggagtgtatatcataagcaatattaagcaatgtcaataattgaccatgcataaataatagactcaggcaacatggatataataaaggtaacaatataaaggatggttcatgaaagtgcatctaggcccctaatgattttggtgattaattacaatgcgattagagaggactaacatttttatttaagcaaatgtcaaggttgttatgtcctcaatgagttagcgtaatgcatatcccgccaaatacgttgacatgatgtgatgcagcaaatgagcaaatggtatattgtaccttttcttttcctttgagtcaataggaatgccacactattaagagggatggtgcattgacatatgaggagtgatcaaagtgctcaaaatctatttttgaaagtgtctctcctcagtttgaagtgttctggattttttcggagttgtccgaaactcattttcggaccttccaaaaaatacacagaacctgttgggcgcttctagaaatttttggatatgtccgaaaaggattttcggactttccgaaaatgactatgaaggcaaatatggttatgtatattttcggacttttccgaaattgatttttagagtttccgaaaatcatcagttgtcccaaaatcgcttctgtgtattttcggacttgtccgaaagggattttcggactttccgaaacatccagaaggtggtttttggttctggaaattttcggatttgtccgaaaagttttcggaatgtccgaaaaatctttcgttgactttattgttagtgctgagctggaattttcggacatgtccgaaaatctttcgaaatatccgaaaatctcaattattgtgcataacgagcagattttgggctgtggctataaatagcaccctcccctcacttgtgagggctgctggtcacattggatattcttgtgcccttggcttgctcttgttgagattcacttttgagccttgctttcttgtttcccctctcacccgtgttcgattcggatttggtgtgtgtgtgagttgtggattcgagtttgtgtgagtgcttgttgttgacttcgtgaagatttgtgagcacttgcatcatctccgggagttcattgcaccatttgttactcttggaggttgaggacttctaggcggctaggtgtcgctcccgagccaccgatctacttgtggttggccgggagaagtttgtgaaggtcggatctcacctccgaaagggaagagatacccttagtggaaagagggtgcttagtgcaacctcttgaggaaagggttagctaagacctagctcttagtgagctcctcaactgagagtagaatcccctcaaggattcgaacttcgggaacaacttcgtgagcttcatctttggtgactttacttcctccctctccactagctttgcttgtttgagtcgctataggtctagttgctgtttgtgctaacatattcttgttgtaggcaactagatctaggatttactttgtgtttgtgctgactccgaaaattttcggatatatccgaaaatttcggaaatatccaaaaattactgcttccgcttttaattgaatttttgaattagcctattcaccccccctctaagcctaattgacactttcaattggtatcagagcctaatctcctaattaggcttaaccgcttggagagatcatgtcgggccaaacaggggatgggaatgatggtgataagggagctaagatcccttatgactacccccctacatctacatcttatgtgagtacctatagcggcaaagctccgtacttcaatggtacggactatgccgcttggaagcataagatgaagatgcatttgaagtctattaacccatctatttggagaatagtcgaaaaaggctatattttacagaatcccgaagatcccactaaggaggacgacgagaacgagtacaagaatgcttaagccgctaatgcaatacttagcgccttgagtggaagtgagt

SEQ ID NO: 63214 - DNA, 721 bp, Oryza sativa
ttttttttttttaccgcgtcggattttactgcatttttaccctcctcttctcaggcctagaaaatatttcggcgcgacctgccaagaccgaagagtgtactgtagcattagtgctcgatttttacctaccttactctattggaaaaaaaattacattactggagtgcttcgtgcatacaattatttttctttgtattttttcactcgccgattggtgatggtctgattgatggacgacgccgtgggccttctcacggcgagtgttcgcgacggcgcacacgggttcgtttgtttgtttcttcttcctccttgtcccggcttgacgtcttgtcgtttcatttgtcaatatctagccgcagtaattttttcttcgtagtactaatatgttcaattaatttaaatcgtatcattatttgttattaacaaatatataacgatattacctttgttatatagagaatttagcaacatcatatttaatttatcctatcaaaacttaataatgttgtcaatttatcaaatttttgataatataaatttttgaaaatgtttatttaggcagtaatttctactgctgctgtagaaattacccttcattttttgtacggttaaaacgtctcaaggaatcgtcggttgtgggatcggtaacagctaagcgatggcaaatcattgtcaacgacatgcatggcccatcttatcgccatttatatcgccgataagg

SEQ ID NO: 63215 - DNA, 1714 bp, Oryza sativa
  unsure (1)..(1714): unsure at all n locations
ccaaaagtatcattcctaatgaatatgcttcacactgttcttttaatgcatcttatgttcttaggaagaatgctagtgatcgtgttgttgctaagtatgtaggcccaaggagcaagaatatttctaatcaaaagagtgctttgggtgcctaaggcacttgttactaacatgagaggacccaagcaagtatgggtacctaaaactagaaattgatctcttgtaggaatatgtctccggtggaagaagttgagtaattgatagcagatgcaccaatcacatgaccggagaagaatcaatattttcaactcttgatccaaatggcacttcacaagataacatagtcttcagggacgatggaaagggaaaggttatgggattgggtaagattgcaatctctaatgatctttctattgccaacgttctcttggtaaaatctttaaactacaatattttgtctgtttctcaattatgtttcatgggttagaattgtctttttaccgatgttgatgtgaccgtctatagaagaaatgattcatcggtagtctttaagggtgttctcaagggaaagctttaccttgtggatttttcctgaagtaaagccaaacatgagacatgcttagtggcgaaatccaacacggggtggctttggcatcgaaggctagcccatattggtatgaagaatcttcacaagcttctaaagcacgatcacatccttggactaacaaatgttcaatttgagaaagatagggtgtgtagcgcgtgtcaagtcgggaaacaaattggagcgcatcacccggtcaagaatgtgatgaccactacgagaccattggagcttcttcacatggacctctttgggccaattgcttatctaagcattagaggtaacaaatatggtcttgttattgttgatgacttttcacgcttcacgtgggtgttcttcttgcatgacaagagtgagacacaagccatcttcaagaagtttgcaagaagagcacaaaacgagttcaacctcaagatcaagaacattcgaagcgacaacagcaaggagttcaagaacacgtgcatatagagtttccttgatgaagaaggcatcaagcatgagttctcggccccatactcacctcaacaaaatggagtagccgagaggaagaataggactctcatcgagatggcgaggacaatgttggatgaatacaagacatcggaccgcttttgggccgaagccgtcaacaccgcatgccacgccatcaaccgactatatcttcaccatcttcttaagaagactccctatgagcttcttaccagtaacaaaccaaatgtctcttactttcgtgttttcggtagtaagtgttacattcttaataagaaggctagatcctctaagtttgcccctaaagtggatgaggggttcttgcttgggtatgggtcaaatgaatgcgcataccccgttttcaacaaaacctccggcattgttgagatcgcgcgtgatgtgacatttgacgaaactaatggctctcaangtagagcaagttgactcacatgtgttaggtgaanngaggaggacccgagtgaagcaatcaagaggttggctcttggggacgtacgtcctagggagccacaacaaggggcctcttcctccacacaagtggagccaactacatcaacccaagccgacgatccctctacttcaaacgtggatcaaggtgaagatggc

SEQ ID NO: 63216 - DNA, 4028 bp, Oryza sativa
aattcctgcagcccgtctacagaggtcagagtaaaatcacatctaacaacgaagcttcaaatttggccggataacgatcagacaataagaagtccagcagtaaaactatttgggaagacgtcaaagtatgtcaagtgggataagttggttctcttgggaagcataattcaaaggcaaagttatcgaccctggcatcaaatagcagaagtagctattacccggagaccgggaaagctaatatgagacagttggtggcaagttagaagtgaatgacaagcatgatattcttatgatgacaaacctggtatcctagtaatgacaagctagtgttgacgcatgacatgaagtggtgacttgtatgaggttgactccgaagatatgaatcatgagaagttctggaatggaagcatcattaaactaccgcaacctagtctgagtcagccaaaaggtgcaccctggttcaagtcaggtgaagagaagattccatccgcaacaggaggtcaagccaagcagttccgagtggtgaagttttgctggaagtttgtcaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaatccgaaaagaaattggcaaacactaaaatacgtacaagaaaaattcaaatgtgacccggagaatttttgttaaattctccttggtctaaaaggagccctcaaattttagtggaattttcagagcacaaataataattgagaagaaataaacaaagttaaaaaggtttataaaaagaaaaaccctaaaagaagtccttttcccccccccttcccttcttgggccggctcggcccacttctctccctttctctcctctctccccgcggcccatcggcacctcccccgcgcgcgcgccgctgacaggcgggcccgcccgccaccctcgctgacgggtggggcccacctgtcatcgccttcctcccgccgctcccgccgctcgcccgtgccctagcgccgccgccgccgccgaatccgccgcatcccgccgtccccgcgcgccttaaagaggggggaaatattccccacgattccctctctctttccccccgtttttccctctctctctccctcggattcgtccggattccatcccgcaaacctcgccggaacaatcaatggcggccgagatctccgcgccggtttccatctcctccggccgctttccctctctcccgacgctatttaatccacccccgtgcctctctcctccgtttccgccgctcgccgctcgctctctccgtcggattcgtgctcgcgccgtcctcctctctctccgccgtcgccgccgagctccggtttgccgccgtcgtcgctccggacttcctcccgactcggcgtcgcctccatcggcttcgccgcgtcctcgtcgacctcgtccgcgcctccgtttcacccgccgaccgccggagcaccgccgccctcgtcgacccgagccgcgccgccgtcttcctccgctccggccgtcgtttccgccgccctcgtcgtcccggggtgagccgtggaccgctccgctcgcttcccccttccctcctctctctcgggtgccgctccgccgcgccgttggtcgccggcggcgaccatcggggcgcgggcgcgtcccctcccgtcggccgtgccggcgaggccgccttcgggcgcgccccgcggctgccatgtggggcccggccgtcagccgcccgcgcctgcgggtgcggctgacgcgtgggacccacggcgccggccgccgccagccgcgtgctcccggtccaccgtggaccgagaggctgacgcgtgggccccactcccgtggacccggtccgcgcgccctctctcccggctgacgcaataaatgggtttttaattaaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttagtagagtaaaagccttttcttttccgttggtcgtgtagacgctgcagcttcggaagatccgctcttcgtggaagtcgaagccgtcgtttgggaaagcgagcaaggcaagtcacatcatccttgagcatattgaatcccagtttacaaaattatttttaatttaaattaatgcattatcgctctatttaaattcccgcgttatcactgttttatttagccaggcctatttacctttgttatgaccatactattattgttattgttattattaccttgttcaccctagaataaacaaaaccccaactagtggacactctactcatggcaccactagtttaattttaggtagatgcttcgcttttaattaggtaaccttaggcggttttacaactatagactttgggaaatattcatatcacctggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctatgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgctttaattcttaaaacctgcttaacaactaaaaggtggaatggatggcctgggttggcttaggacgagctgggacccagggtcgggttgccagttcggtctgaatcatcgtaggccttgggttaaggcaggttcgtgtgggttcacggccttgattaataatattgtatagttttagaatcgtgcttacaaaatggctttgagcaactaaatgtctttaaatgctgtttactgcaaccctaacccttcatattataattcccttgtactcccttgcatttattctgcacttgtgggtgtgtcttgttgagtacggtggttgtactcagtcttgctcaaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaaagcccgttgggttatttccggtcgtgacaactaaccatcaaaggacgtctaagatcttctacttccatcccatggtttccagcaaaactcatagatagaaaggaatgcgtagcaccagaatcgaaaagcactgttgcaggaactgagttaacagggaacgtacccaaaatcacatctggagcacgttgagcttctgcagcagcaacatggttgacacgtgcctttgtcgctggtgc

SEQ ID NO: 63217 - DNA, 3681 bp, Oryza sativa
cgtgtaacctctctccgccgcttgccgctgactccagccgcgtcgcgccgccgcttcggtcgacgccgacccgcgccgttgcctccctcagctccgctaggacgaggaggacctcggccgccgcccctcttcgccggaaatccgccggagctcctccttcctcggtcgccgatcgaggccgagcccgtccgccccatcccgagcgacgcccgtcgccagagctccgtcgcgacgtcttcctgaggagccccgccgccaccgttccttgccgtcggccgccccttcgccgtcgtgcatctcggtgagcactccacttcctctcccttttcctccccttcgtcggccgcctcccgggtgtcctcacgacgtgctgccgccgccggtggtcgtccgaccgggtcgctgccgccgcgctccgcgctccgtgcccgcgccgttgctggtggtgccgggcagacggttgccgcctaccccttgccgcgccgccgcgcgccgtcgtttggctaggccggctttgtgccgtgccttgccccagccgcgccgcccggctgtccccagccgtccgatcggccttggccgatctgggccgtccacgtggtggacgcgcacccgaggccacgtgtggacttggtccaccgtgcgccgcccctttgtgccgctaacgtgcggggcccgcctgtcggcgctggttccccttgctgacgtcagcaaatgccttttcctttgagaaattaatcatttaatacgcaataaattcgttaataactctagaaattctcttaatggctcaaaacctctaaaattcatatctaattcattcgaactccgaattgagccattcaacttgcaaaattcatctaaaattgagctcaacatgtttgtttactttttatgtactatttccttggtttttattagagtttttcctcgttttgcgtgccagcgtgtagaatccgtcgtttcggaagtccgcggtcgcgaggaaaagagttcggaagattgtttgaagaagcaaggcaagtcacacattccccttgagcatgttgatcccaatttacaaatgttttactgtttgcaaataaatatgcatattttgctaattacatggggtcagggtattacctatctgctcgcttgtgccatgtttacttgatatctgttctttgtcaactttgggtaatgaatcgactagctcatgttacttatgtgacctagctagaactatatgcttagccatgcttaattaccactagctcagttgatgggataattacagtattagacctttttagtatcagaatgagctgtgtgctcaagacatctggccatgcttcatggtcataattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagacgacacatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagttcaggtgggttggttgggcctgttcaatgtggtgtagcgttgatcagtggagatttaaagttactttaattactcaactattgtactgttttgctcaataaaatattttacaaccgcctttatgcaaatagccacaaaccgtccttgtgttccccttgcacgtctgcatcgttggtgtggcttgttgagtacggtggttgtactcagccttgctattattcccccttttcagaagtgtagtgcttctgagctgaagacgaagttagaagaccaaggctcagaccccagttgagttttgcctgtggagtggagctaaagccccgctaggatcgcctttttccgctgctgccgttctctttcggtgtgaggactaagtgcctcttctgtaagtatttacgttttatttacgttgggaactgtatattacttgtcgttttgtgtaccctggctggtcctggacagggatttaatacgcaaaatagtctggaaatttgggttaaatttctggacgtgacaaagtggtatcagagccaactcgactataggttgagccaaacggtcaaaccctaaggacaagctttctgaaaaccctatttgaaaaatgtctcccctcgcccttcggcttttctttgcgaaacagtttttcaaaattctcctccctgtccctccaattcttatagttgttaaaccgtggaggataaaccgtcagctttgtgtctgttcggaagtcaagtcaagcatcaagcttcatgcagcaaagagcgggaaggtccgcccagagtcgtcatcccgcgaaggtcaaggagagttttcctggagtttacctaaacccaatccttcctggaagagtagtttcgttagctgctagggcgtgtgttgtttgcttgtgtgtaggggtatggtttgcatcattggtggggatgcgaccatactaggttgtttgcttaagcaacttgaacaataaaagtctactcacaacagatcagtaggcaagtggtttagtacctcatctctagtaatccctctcattccctccccctctctctcgtgcctgcagcagatggtcagtgtgaggggcaatttcaacggatcaggatcccgtcagtttcatggatcaactcagctcaattctataagcttcccacgtcaacctctcaaagatcagccacaaccccaagtcatggctaatcagactcagacagtggaagagttgttacagcagatgcgacatcggtaccagatctatctgatgcagcagatgcaacggcaatgtcaggagccgcgtcaagtccaccagccacaaatgcaagtccaggtgccagcccggaacctgaatcagagtcagagtcaggagttcccaatatcggcacctaagacccctgtcaaagtgctgtccagatccccgaagataacttcagccaactcaccgtcggaccaaaggaaaataagtgctacctgttatgactgtggtgagcaaggtcattatgtaaggaacggtccatggaagatgttcgccaggtcacctgaaaaatacaagaagcagtgcccagaaagtaaccaagctccaagtcagtctaccgaccagaaggatggtactttgcagcccaactctggagcgaacaggacagtaaaatggaagatggataatggtaggaccatgatcatcaccagttcagaatttactcctgaagacgcagcaaggatacccaagcgtcagaaaggaagaaataccttccgtggagcacgccagctaacccgacatctcataaagtacggtccgcccagacccgaagatgatat

SEQ ID NO: 63218 - DNA, 8690 bp, Oryza sativa
ctttagtcccggttgttgaaaacaaccgggagtaaagatccaggggtatatatattcccggtgcgccctcggcttcttcaccaacacttaaacgttttcggccgatcgatctctctcggcccctctccttcgccgccactgcatagggcaaatccccgcgccgacgccgccatatctcgccgtcgtctcgagctcgtcgtcctcgccgccgcctccgcctcctcccccgcctccgcctcctccgctgccgccgcatctctggggtgagagccgccgcatctctggggtgagagccggcgcatctcccttcatgcatctcgatctctccgatctcgatctctctccgtcgccttcgacgccgccgccttcgacgccgcgcaacgccgccgccgcatgccaacgccacgccgtcgccgccgtcgccacgccgccgccgccttcgccgccgcgcgcgcaatgccgccgccgccacgccacgccgccgccgccacgccacgccacgccaccgccgccacgccacgccgccgctgccactgccccacaacgccacaccgccgccgccgtcgccacgccgccacgccaaccgccgccccgatgtcgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatatatatatacatgtatatatatatatatatatatatatatatatatatatatatatatatatgttacttcgcatttatcctaatacattttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggatgcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctaaagaaaatggcagaacaatttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagtgtcgcgatgccgaagtgggagcagatggaggctagcttgattgagatgggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggagatggcaaggaaggtcgatgaacgcatggccgcacatcggtcccatgatccccaccgaccattcctcctgcaatggtgagcccatcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccaccatctcctcctcaggatcctgcaccgtctcctcctcatgctccgccagcaccgtctccaccttaggctccagcatcgactcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagatcaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagagacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtaggacttggtatcggttccgtcatttggtccgcggcaaatagagagaaagacttaggcggaagttcaaatttccagtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatatatatatatatatatatatatataaaccatgcagcaagaggggcatgcaaaaaaaaaaggtcagctctatctttagtcccggttatttcacccgggactaaagatagcgatctttagtcccggattggtactcccggtttggaaaccgggactaaaggggggttacgaaccgggactacaaagggtttctccaccagtgtatctcagctcacggaaaacggagtggtccattagcgcgtgattaattaagtattagatttttttttcaaaaatggactaatttgatttttttaagaaacttccatatataattttttttttacaaaaaacacaccgtttagcagtttgaaaagcgtgctcgcagaaaacgagggagaagggttggcaaaatggggtgccaaacacacccataagactatacaaactaagggcccctttgaatcgtaatcgtaggaatgaaaaaacggaggaataggaaaacataagattctgacaggaatgtaagtataaaatagagaattgcaaaacacaggaaaaatacaggaatgatcgtttgattggaccacaggaaaaacacaggaattagatgagacactactagaaaaataatttgttgccatgaaaaaaatcgtagcatcaatgctaaaattgtggcaatagatacatgttgccacaatcttaaaatcgttgttagccgtggtaataaatagcgtggtaacaggttattgcaacgatttttatttagttgtaataaaatttgatattgccataaaatggatgtggcaaaaaatatatattgcaacacttcacatggttgtaataaataactattgccaccactctatgtgtggcattagttgtacgtaccaaattaaatgtctcaatattaatttatcatcctaactatcttcttttgatatcttgtcatgttcaggattcgaacccaagatctctcccttacgcgcgctctccatgagcatcttacctacgcatcagttttgtttaaaaatgcttacaattccatttgagactgcctaacttagatttgaatcatgaatttgagtatttaaaagatttcaaataaaaaatttaagttgtagatctcatcgagagctataaatttcatataaaatttatcctaatccgtgtccatatgaaaagaataagtcaaattatgagatgataaattttttattgcaacgaactaaatgtgtggcgatagaacatgtttttttgcaatagtaatgttttttttggcgatagctcatttcctattgcaacaaaaatactgaataaaacaacgattgtaaatcgttgcaacaaaatatagttatttgccacagaaaaaatatcattgtgatagtataatatattgccatgaattatttttcgttgtaataaattggtggcgatagctcaaccctcttgtagtgagagagatagactcaaagaattcttaccaagaggttggacctcttgctaagctttctccaaaacctatatgcaataagccattccatatgaattttggaggatttggaaaacttcaatcctttgaattaaagggctacataggaaaaattcctataggattcaatcctatgaaattctttcataatttctttgattcaaatgggctctaaaatcatataactatttttttatgcacttctcgtacgtttgttgcataattcaagacccaaatcaactatatttaacaagtaactttggactagctattggacactcgagacacaatttttagggaaatcatagagtttaaaacacttgattgatagcacctagcttatattagaacatcatgaaacacagagaattaattaataagacttaaatattaagtagtagaaaaaatatatcattttggttcacgaagattatatttatgtttaaatatatataactctaaacggtaaatccgttaattggatctatctcaatctatccgtagcctcatctcccatataatttatctgttaataaacaatgatagtctatatcaatcttactgcttaaagataaaagattattggatttattttttttagaaaaatgacacataaggtgtaacactatcactatgtatcatatagtaaaatttgaactgaaaataagatttgtataaaataacatagaaaatagaaaaatctccatagagtgtaaattgaaccaatctatctatcactacaaacgttctcaagccaccacgtggcattctacaaacactctaaactcgccatgtgtcatgtcctaaaaatcagaaataatcttataaattctgaacaaaatgaaacctatcagcatcagttttaagttccattatttatataagttagaaaaataaatcgcatgcacctcctcgcctactcatatgcacataccactacctgtcccctccctatttttagctattaaacaataaatatataatcaataatttatatgttagaaaaccataatatttaagatgcacgtttgatttttttctctagttataattaaaccaagaatttaagatccgtatgcttatattttcttatatacaaagtatgccattcgcccatattcgacctacatgctttgtatattatacaaataaaattgaaataccttaaacaaattggctgcatatattacgtcattatacacgagtctgcaaacaagctaaattaaataaatagtataactacaaaactatttttgtagggtgaacacccctgcccttttacatgttactggaattgccgtaaaagaattatgaaataatccaacaacacaggttgcatcatcatatgttgtttttgcaaacttgcatagctaaattaggtagacattatctaagtaaatagaactaactaaaatatgaatagcaaatccaatgcccatagttagagaaaacaaagtccaattatttcgtgaattttcttaaatgtgctgaaataatgcaagccagctaaatgatctttcgtgtatttgctctaaactatgttaccatcaaattaacattgtgtgtggttgtggctttctacaccttcctggtaattctgtttattttctttgtgcatagaccattcaaaaggtaaatcaactatatg

SEQ ID NO: 63219 - DNA, 3165 bp, Oryza sativa
atatccctccttcccctccgggttttgaagccgagcccgatgagccagaggaagagctcgaggatccatttgctgggttgcctcctgacttcgacttcattattgttactactttttattgtgagttactaccattccatcatgacgttattgtatgtgtgcagtaacaactataatttttacagtaacagtgcatgttactgcaatttcttaatagcgttactgcaaaacatgtggtaacaaccaaacacacaggtacatgacctaccacccactttgaaccagtaaatgtaagtgcaagtgatatcttttgaattctcatctttaaacaatgatatctctcacaccatctattatatttttgaaccgtttgcatcgtaatgctttaaaaaaagaactctacaaaactagatccgtcatgactatattttaactatattttattagtgttactgcatggtggttgttgacggtccttaaatcataatatctgaccgtcaataccttcgtataatgaaataaaacatggtatccaacgtagtggtaggcattattactaatcatttccactagtgttggtgaaatatgtgtatgcaggtattttgagaagaaaacacatccgtcaagcgacaaactgcacctccgcgcattcaggacacatttacacggattggaggccccataagtcaattaaacaactccaaatgggcccaactatcatgccaatgggctgagggcctcaaaattagtgtccacgacgaaaaacgggccgaacggagccgtcccgggttcggccgaagctccagttcggccgaaccgttttggtggtcgttgatcgtcaaattttgcgtggatggccctgatcgcatcctaatggcggttccggggtagtttggtcatttcgcataggctgtaaccgtcatacctgcctataaaaggaggagctcactctcatttccaacacacaactttgggctgaattacaagaggctctattgtatcttttgtacattagaataaggtagagagtgaggggaagctctggaggagtgcctagaagtttggcgctcatccgacttctacctcgacgagtgtaacttcctaggaggaattctggaggagtaccggagctgttggtacactctgctccgggttcggggaaacttctataaagtaagcattcgtgttcctttcttatgttatttaattactttgtttaagtaagatttacatctttgcaggttcgttgtttagtatttatactaagtgctctagtactaggactccggatagagaaggaagttcctgcgcaagtattagagtagtaattaataacttagacatggtgtctaggttagagattacctttgtttgttgtgtatcccacggatttgtcagaggtaggcggcaggtggtgacagccctgaatcccatcctagtaatcctccacgttcggatacatcatagagctatagccggaaccacgctggcagaccagcaggggtcggtgcccttagcaacagataggaaattacctttgcttagcttagataattaaaacacatagaaagtcctctctagcctgcctagcctacctatagttgttgtccttggattgtcttagccttaggtagattacacacgttccctgagttcgatatccttttggggtcacccgaaggtgaagtgctacagcggtattccgtgcgcttgcggatttatttgtggacataagaaataccaacagtggttgtcctgttactgcaccgttcatacgagacgaggacaacaaataggtgaacgtgggaggaagttagcacatgggttgaccgacgtggcagtgttggtatttcttaacgacattactagaaatataattctcaacaatggcgcagaaatacttctggtatattatggttacagagttcatccacaagcgcacggatataccattgtagcatttcacccgagagtattccaagagtatcgtatttattttatcccgtgagaagatcatgtagagacaactcaactaataatttatatattacttgtgataatcatattctaagcagggattaagataatccaagggtagagtgacacacaagcattaactactcattctcataatatatcatctaagctaagtggagagaaaagagaaagaaaatctattcctatacttctaatagtatacatacattctagttaactaatatactagctaataccctctatccgatgcccgcctagtacttcgagaagccacccctgactgccgagttccttacgacagcccgtcatgaccatacaaccggggctaaatacggagtaataccctcccagggaattaacttaggattatataccggcgcgaaggaatacccgtactgagctgtcaccatcagcggcccacctctcatccgtaatatataaccccaaataatgatatcctgtaatctagacaccacgcctaaactaccagatactactctaatatcatcgtcatgacatagagtaattgcataagcaaacattatacccgcaccaaaggatctcccagataagctagccgtatattcagtataacatgaacataatgtaaagtaggtattcatatacttgaaaagtatttcaataccataaatgtatttagaagagtattctaataaaagtacaaagcttacaaaagaggaaaggaaatctgctagagctatacccgaactcttccgaaggcttccggactcctgatttctactctattcctattccaccagctagatactactaaactaaacttgagagaaatgagagagctattgcttgaggtgtatgagtgaagtgaggagagcagctccttaaataggctgccaatgacggttgtggcagttggaatggtcggaattgccctccaaccttcattggggagttgatccacgctttccatccaaaactctgtatccaacggcaccgggggaggttcggccgaaccaggggccggtccatacctggcccatattcgtgtcaggtggcctcctctgttgttcttcttcgtagacttgtgaaatttggcccagtatgtcgtgttcaattctgagttcttggcccattcatgcataagtctactctcaacatcgtccgattgatttatcgtctatgttg

SEQ ID NO: 63220 - DNA, 3918 bp, Oryza sativa
  unsure (1)..(3918): unsure at all n locations
taaataatttaaaattagaaactcagcgactacaatgtgttttctaaggacatatagtctgaataactatatgaagtatacaatatctgacagcttagtttctgaagaaaatgaaaatatccccatatattttgttttcctttattcttgtgttttaaaaagaatcggcacgaggttatgctatttcattaaatatagaaggagaaaaatacacccctacgcgtaagaatgaaaaaaatctatacaaatctatccgaggttggaaggagctcctggagctttttttgctcctgctagggtccatgttcttgcttcctcctttattttcgccacgaggccaggtgtcgctatcttcttgtgctcgaagacttgccggttcctctctgtcgagatttctcagacaaccaacaagattaagctacgcatgcctttcttgggtacctcctttttgttagcaagtatctcccaacaggcttggacatcgaggcaaggctcccattggtttggatccaactgttgataggccacccaagaggctaggagtctccagactcttcctttattcttgttaagccctctatgaatgccttttgaagagaaaaaaaattgaagcttttggtccattaagagtctatttggttgaagggatgaaaatagatgaaagataatcatcccatttttacatgtttttgtttcatgggcgagagtggatgggatgggatggacactgaagagaatatatattctcttaagatgttggatgagcccccatctaaattgattgatgagaccatccacttttgtcaacgcaaatgattagacatagttagttttttcgttaattaataattttcatttcaagatctattatattattaaaacaactttgaaaggaggcaccacgttcgctgtggtgactaaaaattcccacattaatcggagaaaaagaaaaggagagtccaagcagaaatacaatttaaaaatagctgaaattcggaattaaaaataagcaatattgaaataagagtccatataagaacccaataggagattaatcaaaattcagaataaaaataaaataaaatatgaaattagaaaagaaaaaggagagtccaagtagaaatacaattttaaaataattaaaattcggaattaaaaataaggaatactgagagaagagtccatataagaatctaatacgagattaattaatattcaaaaataaaagtaaaatccaaaattagcaaaaagaaaagaagaattcaattaggaatacaatttaaaattaactgaaattcggaattaaaaaataagaaatattgaaagaagaattcacataagaaccctatacgagattaattaaaatttagaataaaaaataaaataatatccaaaattagacaaaattaaaagagagttncagttgaaatacaattttaaaacaattgattntttnttaaaaaaaataaaatatttaaagaacactatgcgatataattaaaatttgaaaaaataaattctgaataagaaaatgaaaaaaagattttattttgaatacattttataaagaaaagaccatctaaaacacatgacaagatatattaagtgccaggcctataaaagagtagagtgttgacggctgatacgatatataaaaactgttaataaaacaccaaatagaatcctaataacgattaaaaggagggacgacatgcaggccgtgaagcaaatgggcagggcggttgttgggacttctagaaagttaaaaagtgaacctcattgataatcatattcgatttttaaaatctcaatgacaataaaaaggtgaagcagcgggcggggtgtataggagtatagctgcaaagccgccgacggttggcgggacttctagaaaataaaaaataaattccaacgatagttatgctcgatttttagaatcccaatgacaataaagagtaggcggcatatgggccgtagaggagtatagtggcatcgtttaacgggacttctaaaaattaaaaaaaaaatgaaacccaacgagacaataaactctaaaaactacgaggtccaatttttaaaggtttggaacttctaaaaagtaaaaaaaaaaccaataataactatgttcgattttaaaatctcaatgataataaagaatggaggcagcgggcgagccataaaggagtacaatggcaaagccgctaacggtttggcggaacccgaacgataattatgttcgatttttaaaatcccaatgacaataaagagaaaagacagtgccgggttgtagaggagtataatgacagtgtttgactggacttctagaaattataaaaacgaaacccaacgagacaataaactttaaaaattataagatccaatttttaaaggtttcaaagagaatgaataaaaatagtgataaatcgagtaagcaaataaagaaggatatgacagaagtaaggggtagcagctggtgtgacttttaaaagctatataattagaaatacgtggatgataaggttttgtctttcaaagtcttaagacaacgagatagctatttaataaattttaagtaaaatcagactggaaaatatatgattttgtttgggtgctagccgcgcaattgcgcgggccacccagctagttagtgtttattaggacaattaatctgttttattactaattattatgaaatccaataagattaatgataattactatattttgtaattagagtttcaacagagcaaattataagagtttctaaaaaaaacaatgcatgtactatttggagtttggaatgtaaggaatcaccaccaatatctattggcaacatgtaaatatacttctgcacgattttgtacactcttctctgttgtacttttatgaaagtgtagtgatatctccatgacaaacaatgtcattttgttttgtcatgacaaatcctaatacatttaatacattattttgttttgtcatatatattctctcgacgtttttttaacaactggaacaatacagtttcgctagcttcaaagatatcacttctcgccggcaggagaactgataatgcatcgacgtgatctaggcgactaacaagcgaatgcgcacggatcataagttaatccaaatatttttcaccaatcactagcaaaccagcttccctgtccctccgactttagcccacaaacaaaaaacacacaaaattattccttgttagttagcattatctgaagttcctatatagggaggcaaaagatcagaatccatgatttgaaacaaacacatttattttcactctgaaattataatgacatgacatgaaactcttccccacgatcttgccaactccttcacgaccatttttttttctcttatttcttttcttccaactacagtcctaccatccaacacaaatcactgacataataagaccagctctgctcattactctagtatgtaagtcacctaatcattagcttagtctctcactcattgcaccccaaattcaatcgccctcattgcacggacgaaatggtgttttttatgtgcgattcccggccttgtgttttttctattcgtctttgcacgaatttcagcggtttttgttagctgtctggcatcgccaactgtgcagtagttttcccaaaatgtttcgaattaaattatgaatggtcagaattgtacgctcgaacattctgttcctgaactgatgaaaaaaaaaatagtgcccctgctatataaatactaggacaggtatggccatctacgagatcatattttgttacagatttcttcgccattggagatgatggagtcctcggaggcgagctggcactcgttcgatccgtcagtcgcaatggaggactccgaggcgatggcgcagctgctcggcggtgcagtgcttcggcaatgacc

SEQ ID NO: 63221 - DNA, 2733 bp, Oryza sativa
tttcctcttttttcttttttttagttttgttttcccacacatacaatgtttccttgagtaacaaatttactaattgggtttatggtagacaatgcttttccctttacaatgaagtaccccaaaaatatcatatcagtaaaaaaattactactggttctatatagggtactgctcgttcttcttcttgcacatattacacaggcatcttctcttagtaaaaaaattactactggttctataaatggtactgctcattcttcttacacagattgtagaggcatcttctcttagtaaatagattacttctgtataatcaggtagagttgcaaatgtagtaatagatttactcttcgactaaactcaaatggcacaaaatttacattttaaccatactgccacataacgtagtaatacttttactcaagtgtatttttcacgtgaagtaatacttttacttttagtcaggtatatttttcactggatcactcaggagaaaccaaattaggagtaaacgatcaacattttcaccaaattaggagtaaatgatcaacatgtcactgtatgggtaaaaaaaattacacatccacaggcaaaaaaaaaaaagagaaggaaacatgaagctaaatccacaatgtgtcggcgtgactgcttggtacgtgttggatctggtgttgagggagcagtcggcagaggccacttcgtcggtgcatcaatcttccccagcggcgagcagaggggcaagccgtgttgatggatagaaaaattacgcatttgtcatctccagcatgaatttaagcacctcttcaattctgatttctaaactggataaagagattccacttgaaatcattcttgcaagcagcagggttaggcttcataatcctgatcagcaagtgcagctaatctatggactggttgcactgcttcccagcaatatctggcactatattttcagtggatggttccatgcacacaatatgttaatatacctgtgaacttaggctgtgtttgaggagaaggaaatagagaagattgggaagatatgcaaaacgaggtgagccattagcacatgattaattgagtattaactattttaaacttaaaaaatggattaatatgattttttaaagcaactttcctatagaaaatttttgcgaaaaacgcaacgtatagtagtttgaaaagcgtgcgcgcggaaaacgagggacaatcccccctatctcccctgaaagaacgcagccttaatgcagttgttagtaagttttttgtatgcgcttgtaaattacaccaaagctgttatccttcgacctcaccaaaccccacaactttcacaatatttcagagcttcgatgccaacagagtatcaaactgtccagccaaccaaaatgaaaattttaaaatggcttcacttggacaaaatgacattcagagctctgaaaaacatctctctcaatgaagattctccatccatctttcagccattcaaagaagtattcttaaaaaaattcagaggactgtttagcctatcagctaggtgttgtgctgaactacgaaatttcagaagctaataagatatcaactactactacaaaatttcagaaacttatcaggtagaaaatttcagaaactgctagcatatcaactaaatgttctcagaagactaatgaaaacaatacaagaggcagtcgagctgctctgctctattcaggaggaaaaaaatccccaaaaataaatcctagttaccaacatatttggatgcatgtgaaaaacataccgcaggcacccagagagatcaaagcatgtgaagggtcatatttgtacctggagggtggggtgttgatgatcttgttggcaaaaatagccaatgcagagaaacaccagagtatgtgcatgttgcaggtggtgttctactgctctgatcaggaaacctgcaaatcaatgaaaacggaatgcaaaacagatgtatgtatcccaacaaagatctgatgcactgttgtgtacattatgaatctctgatcaaatgcctacgcctggccaccgccggaagctgccgcctgctcctccaataggtctcaacttgggggagtggagcagcaccagtcgtcgctccagccaccgcaggatgccaccgccctctcctgctgacggtcactcggttggaggggagcaccaccaaccgtctgaatgcattatgagaacagtactcagcaggcatcaccacagtgaaatctttgcaaaatcaatgggcgtgtcagagaaaagaaggaaagaaaacgaagacgaacaggagaaagaagatgatcagatcgatggggttgatgccaggcgcacagaggagacgttgcattgcagcatcactggcatccctttcttctccctctttgtctctcttcgtggggaaaagaagcaagaagcacctggatctggtccgccgcatcactggtgtggatatggagccggcaacgaccagtcttcccacccctttgatggcatcgtcgcccacctcgatggctcggattgcaccagccaccgcatggaggaggtgaaccggacgccgggatgtggcctcctctccgccgctgtcgattccgtcatatccgccctatccaggacctccaccaccatcggcagagcaggggactaagcataagtgaagagggaacaaaccatcgccgcgtccctgatcctcctccatcctccacctccgctgcagtgctccgaccctagggagga

SEQ ID NO: 63222 - DNA, 5082 bp, Oryza sativa
attatctaagtaaatagaactaactaaaatatgaatagcaaatccaatgcccatagttagagaaaacaaagtccaattatttcgtgaattttcttaaatgtgctgaaataatgcaagccagctaaatgatctttcgtgtatttgctctaaactatgttaccatcaaattaacattgtgtgtggttgtggctttctacaccttcctggtaattctgtttattttctttgtgcatagaccattcaaaaggtaaatcaactatatgagcattaataatctatgaatatacacttgaagcattaactttggagtccatttagattttaatgtgagaaaatcgtacggtaggggaaaaaggaacaatgagtttagctaggtcttactttttcactaaccccaaaaactaatgaaaataaaaaccaccttgattttaatatacaattaatttgttgaacatgttctaaacaaactaagtctactattttttatatagtgataaagattatagataattggttatactgataaattaaatattatatagtatatgacttagaggaattatcaaagtgatgttgacgaagaatatttatcgaggaaacgtacttccgaaagatggtagaggctatctggttaatatgatccgttctcaacgcagcccacaatacatgccagcgcgcgtgcttgggctaccttcctagttttttaccaaaacgaagaaagctattttccaacaaaaaaaagaatacagaagtacgcaaaaagtcaacgtagcaaagggatacctatgaaaatagttttttaagtagttcaattgcacattacacaccccagcgtatagagaggacatatagatcgatatgtaagttccctgcttcaaaattattatgaaacaactcattctttggtgaactagtagatttttactgtcagtcgaccatgataaaacaactccatcgatacgccaaagatcgtaataatttcaaacaaaattgaaaatatgttccagaaattatatgtacagtaacatcaccaaagggaatatataacctgtattttaatttcttgccatgattgcactgttgttgacagtacgttccatcatcccacatgcatgtagccttgttcctcgtctactcagttgtttatttttattctgaattaaaataaattgaaaagttgttagtaccatcgatgaagccccggccaggagctgtcgaacctgaaaatcatgatcaatatggtggggctgaccgtcttggcggacgattccgtcgaatggtcgctcctcacgacgctgtcgcggttgcgtatcgtgctgcccaatccgccattaattccaatcagcatcagctaggctgctacgtacatacgtggttagcacatcccgatccgttgatataacttgagataggataggatacgtacagatataggtggactctctatacacgttaggttcacttaaaaatgccaatgataacacatagattacaatgtacggtcaagattttataatccatagatttagatttttctagttaacatgcgagctaaaaaaatgtccagttagtatgggtatacatagatggttggaacaccaggatttgatttgtgttcatagataaaggtatatgtatataggtagtattgattggatctgttgattcaatcaattttaattttagggttaaatattcttaatgacatacatttttatccagactacccattgttgacattctaatttttcagcaagtttataatcttctaaaagtttcaaatttcactaatggtaatgataaaatgtactacaccaatgttaatgcaaaatgaattgtccatggcagtttcaacagtttcttaggatgttagcttgaggagttgattttgtttactgaaatagagtagtttaaaccttaaatcagtgattttagtccagccattcactttatttgaagatatagtcattgatacagctggagtaaacattaaattactacctcggctgccttaatatgctgtggctgtgaagcagaacatatgcatgttctttggagtagtatatgacaagaattggggaaagaaacttattagtttttctttactactactctcacataggcataacaaaatagtgatattagctgttgttttaacgcaaacttccaaagcaggccgctttactaaatgttattactttgtgataccattactttcaagtttcaactatatatttatatatttattatatactccctccatctcaaaatataaaaagttttagggttagacacggttattaataaagtacgtagaagtgagtggtggagggttgtgattggatgagtagtggaggtatgtgggaaaagtgaatggtggagggttatgattggttaggaagagaatgttggtagagaagctgttatattttgggataaatcctaagagctaaaagttattatattttgagacgggtgagtatttattattcgaatgtgaaatgaaccgtacagaataacagtggggctcttaccgctgtggaaaatgcccacggcatgattgatatgggagggtatagctgatcgcatccattcagataacatatttgtttgcggattcagtcaaggtatggaaaactaagttttccagagctgtgggaagttgtaccatcaattaagtattgaacatattgtcttgcatgtgctctcacgttagtaattgtttactctatgccaagatgctacgtggtgagtcacataggtgtttggataggacttaaaacttttaaaactttttagtccctatcacaacggatgtttggacactaattagacgtattaaacgtagactaatgacaaaacctattccataaccctgaactaattcgcgagacgaatctattgagcctgattaatccatgattagcctatgtgatgctatagtaaacattctctaattatggattaattaggcttaaaaaaattttctcgcgaattagttctcatttatgtaattagttttcgatgtagtctatgtttaatactttaaatcattatccaaacatccgatgtgacatggacaaaagttttatccctagatccaaacaccaccaagacttcacaataatcaaggaaggtatgcaactctgtcgatccctttattcatctagtttagtttattgttcatatggtgtaaccgtgcaaccttaagagttggaactacgttactattcgaaaaacaacgaaacaacaaataaaattaacccaggataaatttattaggattgaaatgtattattatcttatatgaactaatttaccaagaatatttttatatggaatctgcacatcttatgtagtcagcttaatgtctttatctgaaaaaaaaagctgaaatgaattctgaagattttcaatgaatatattttaggcaaaatcgtatgaaattaagcaaagtttgaaactggcagcacatatcgagggtatcaaagttagcgagatgatgagggcatgtttttcaatcctgtatcaccttggtgcttgcaaatattcaactgtatttaccttttcttttctttcagtgaacttgataacatcaagagcagtaaactcaattactgatttatttatttattttgcatgtataacatctaaaaaaaagattggaaactactctgaatgaagcaaggtatgaaaagcacatgcagtcagccttatttggttaatgaaaaataaaataaaattaagggaaagctatcattacagacggtttggcttacatgaaagtacatgaatttgaacctaaatcgtattctatcatggaatttgacttgctgtttgtgctcatataaagctaaattagttggaagtgtaggatcgaatcataataactaagccaaccagagagggggtgaatggttggtagagaactcttttttctgcccctgcaaagctaattatttgtaattattttggttcataacttgtatatgtatcaatggtttaggcaatgaacacaacaaggcagagcggattacagagggaacggttggcttgagagttaatcatgtgaagtatgacggtggtaagaatgggcatcaaagaatgacaagatatagtgtgactgtttaggaaatatagtagtgatagtctttacgaccccttctttttagcaagaaacataattacaatgaaggatcacatcaaaacaagtcacctcctatattaattcttttctaccttcaacaaatgattttactcattcatcatgtgacacatccaacgatcgaaaattatctgatgacgtcgatcaaacggctccccacctccctcccgattcgatccagatcacatcgcttcgcctcaccccagcaaaatcaccgcgccctccctcctcctctttctatctttcacgcgctcctgcccatccgcctcgccttccactgccctccatctcaccgcactcctcagctcgcttcttcgtcaatccgccttgcatttcgccaccctctatctcgccgccgccaccccccatccacccgccggcccctcctcctatcgcatcggtctgcgcctccgggacagttaccggccagttcgctattgccggagtcaccatcccgcacccgccgcatcctccctcccgcacctccctctctcccacacccgtcgccaccgatccagctctctactggtagtagaaaataatctagaccgttgatctcaattcattaaaaggttgagatttatttctattaccacctcacttaatggtagtagaattgtggaaaaaatatctgtgcagggtataatcattctttacactcgctaactgctctctctctctctcgttcattccttagtccccgaaatcccccaaatcgcatccgagccgacccctgcgagcaacaaaagtttgtatttgtgtatagaatgtttgtatatagtatattgtgtacgtacgtatttaaaaaaccgaaaaaaacagggaaaaaccagggaaaatactgaaaatatacgcccaaaaatttgtatatgtgtataaaaaatttgtatttgtgtatcaaaagtttgtatatacgt

SEQ ID NO: 63223 - DNA, 2925 bp, Oryza sativa
ttcctgcacccctggtgaatacacccattactcacatgaatgccctttgaggaaggtcacatgtttcctgtgtgagggaaccgatcatgtgcctaaggattgtcagcggaactcggtcctagctttgaccaagaaagaacaagggacaaccgtgcaacccattcgtcaaccaatggcagtcgacgacatcagtcacaatccttctgctcttcctccaattccagcccgagtggaagccaaccatggaagaagcaacgtcgctagggatgttcataaatcactacttgttccagtttcagctgtcaatgtgcataaccagaagcttgcacctcaggaccaagcaagtcggttttgtctcaattgtcgtaagccaggacattgtttcagtgattgtcctcttccaagagcagcaaaggcagttcatcgtgattcacaagttaccagcactgcccacgacaccaatcgacacctgaatgtgcaacctccgcctcaacggattatcgtcaagggcaccgtcagaggccgcattgttccaccggccatcgtttcaagcctacagcaccagcgccagcagggtaagcaatgccaggagaacaacagctcgctacagttacaaaggggaggtacgctccttcgtcagcacccgcagcaagtgtcgccagcaccaggtcgctcgactattgtcagttctagcaatgcacctcgtattgctccaattcggaggtccatcggcaaatcaccgcttggtaaccccacgggcaagaagatcctacctgttacagctgtcaagacagttgccactccaccatcaaagattagcaagcagggcaacgttcccggtgaagcttcagctagtaggagttaaagaacgagtcagtcaggttcgaacaatggaagcaattgcagctctagtcaagccctttacttttccatcccagcagtagccttcaagtgtttatctttgtcgcatttcatcttgtacatagaagtttatggcagttatctaatgaaaagggaatattgaataaagtatgagtcaattagttttgctctccacttatatggtccattttgagcatgccaaagcaagttaacctgtgtatctgtcagtgctacaagaaaccaagagtttctcttctgactcatcgcaattttgttgagctcccaaaaccgatttgcgagccaatagaggaatggtttaccaacggagtgaaaatgattagaccctcaacactcgacatgatgagatctctctaaaggcagtgtcagtggtactcaaatgaaaagagtaatggaatatttgaaaaacgacatcatataaagaatcttgagaactttctaaccttggaagctgttagggggttgtaatcgacagttacaccctagtggtgcgagcatgaattcagtatgtgtttccttagttcaaggcaaccagtataagttccaggaatcatttcaaggtttctcagaagttgaaaaaaaaaaaaagaaattgttccatacatgggtcagaagtatatagagtcaagtccagaaatgtgtagtcaagtagggtatatggcagagtatccccttttaacggatcatcttcaccaaaaatatgaaagcgaagttgttatgatcaaagagcagaaactcttggcagcatcaaagccagtttccgatagttgttcagattgcaatattttccggaaaactgttgcaggatctatggtccgtcaacccaggaagagtcagcaaaggatggtcgaagaagtgaaatgtcatgccatgggaaggacctcttgagttcgatctgttaagtgatcagtgcttgtttcaaggaaggtcaactatgcaatctgtttaggtatatgacaacaaaaatcaagtcagaaccaagacagttgtaccagcagttagaactggttggggaagtagtcaagagttagtatgatcaggagctaaatgagaatttatgtatgtggaatttcctatcagcaactgagggttaagttccaaatcttgttgggatgatagtgcgtcgtcattgctctattttgatgaatcggtgaagtttcagttttcaaagtgagggtctttgtaagtccgagaagtgttggttattttccaaggacaatagtccagttgtttccagtcaggcgaaagtaagactactccctgtaaggggggtaggtctcggagatgagttttggctcacctcatcgctgtttcagttgaaggttcaacccactgcaacaatccgggtagtacttgaagaagtcagttgcaaagtgtcagcagagttacatcgattacaagttatctgattgaattctgaggtacactggtgaggcctggtcaacagctcagctttgagaagcagcatcagggacggttgcagttcagacgaaagacagttcaagcaggtttcctggaattacgtgtcattcgagtcaggacccgttcaagcggacgtaggatcaatgagttacaaatggtcgatgcaagtttcaccctcttctaccagcttggtgaattgtcaggttattaaattgctagtattgacagttcagcccaggataagtaagttttatgagtatctgcagtcctagtctgcgtcagttcaagcagaaccaatcaattcaggtttgggaagcaacgggacaacagtgttgaatccagccagatcgctcgtataggtttgatcagctaatcggtcgtgttgggtaccagaactccagggatctaatccgatgataccagtcagttcagtcgtttggatcaaagtaacagaaaggtcaaatctaacctgttcagttatgcaggtttggtccatcaagcaatcagatagttgaatcagaaagagtgtcacgtcccacaacgaccctaaaattcatcctgaaaattgtgcaaagaataattaaaattcatgtgaaagcctcc

SEQ ID NO: 63224 - DNA, 2293 bp, Oryza sativa
gctatagccggaaccacgctggcagaccagcaggggtcgatgcccgaagcaatagataggaaattacatttgcttagcttagataattaaaacacatagaaagtcctctctagcccacctaccactagttgttgtcctttgctagtcttagccttaggtagattacacacgttccctgagttcgatatccttttggggtcacccgaaggtgaagtgctacagcagtattctgtgcgcttgcggatttatctgtggtcgcaagaaataccaacagtggttgtcctgttggtgcgcagttggttgggggtgaggtgtgaggtagggatgaaaacggagcggatatggacggataatgtttataccatattcgttttcatatttttttaccggatacgaaaacgaatacggatagctcgaatacgaaaacaaatacggattatctcgaatacgaataagaatcgaatatgatcggacacgaatacggaaataaatttttctcggaacacgaaaaccaactcaacttctaatagaaacaaatatcaacatatataattagctcattttatataaaatgaggtataatttataaatattttttaaaatttaaataatattaatagtatggactagtgttagagataaactactattaaaatctataaaggtatattgaaggttatagagttaaaaagaaatggggtatgtctcatgggtcctgcggatatccgaatagcactgttcaccggatatccgaattattatccgtatccgacggaaaccctggtaccatattcgtatttgtatccgggagaaaatatccgtattcgtatctgtatccgaactatccgagaattatccgatccgaaagttatccgtatccgtttttgtccggagcggacggaaactatccgctccgttttcatccctagtgtgagggggagtgttttagttattaggatgcggtatagtatgtctatatatagacacacatatatatatatatacacagtggcgctcacatgcgcttcgcgccacggtttaaatggcgccacacacaaatgaggaatgtcagcccaccaaaaccaaaccaacctattagagagttaaaaattaactgacggaaattgtggcgcaaacgatacctgcagttcgcatgtcaaagggagagcgaatgtgatagtaaaaatttaactgttttaaatattggtgatgagttaagatgttgcagataacaagttaaatttttaccgtggtccacccgtacgacagagtcatgtttatgttaaaatcggtggtggttgattgtgcatatgaggtcaaatagtttaaaattaacttgcatagaccgatcggtgatgaagacgttccgtgtgtgagaagttatagtttaactgattgagataattgttttgcctttcgatgtcgcatgtaaggagttaaaaatttgtctttgtttcgggagtactatagggccatggggagaatttaagtaaacgttggcaaagttaaaaaataactggaatgagcctatagatgctgaaagacgtatcagaggatttttttacacgacatgatttacatattgttatttaataactttacacgacatgatttaaatatagttatttaataactttacgtcgctatgctgtggtggcattatggttgtttatccatgcgcacattactccagatatatcgcgcatgcatgcaaacaagaatcgctacaaaatcgctgagattgtttgccctgatatgtgggaatcaaccatcctgtcagtttccccaatataaactgcccggctcatcatttgtattacgcagccaactcaaccatgggtgataaacaagagaccgaatccacaaagacacattttgtcgatcccactcacaaccccaccaccgatgccacgctgcaacaggatgagcatgagagtgatctccccgaagagtttggggtgacaagccctcctccactgtcgccacccccttacccgctgtcgccatcgatggaagatgatggcatgatctacgcggaggacttggggtacatgtctaccctatgcccttcccccccttctgacgttgacgatctaaatccgccggaagaccccaacaacaagattattctgcacccagctttcatcgacgacggcggtgaccttgatattatacaagaggacatttacaactttcgatatgaccagaccccgccaagagatgctcagtcaccagtaacccggttcaagcgccataaacgtgattagttttgatatgtctatttaatttttgc

SEQ ID NO: 63225 - DNA, 1819 bp, Oryza sativa
ctgcagcccagccttcctgtcttttccaggctagcgcttacacatgttgtatggttgcaaaacctaattataataatccgcaaatctccatataacagcattaaacttcggatgatcatctcttggtcatacgaaccccgaatcgacccgttcaagtctcctaatatttgttataacctaaagaagcatgtgctttcttttttatgtattgttatcgcttctttacaggcttatagctttgcatgtgtgcttcgcgtagtttctgtcgttccgaaagttcccgaagcgtggtttgctgtcacgaccggaaataacccaatgggcattccttacgtgcgtgtattattccttgtcccaggaggcaaggtacaccaaaagttgatacaattcagagtttaacaagcagaagcgtaaatagttaattattacatgggcagcgagggcccagcacacacgaagacaacgaataaacagcggaagactagggcgacgaccacaggcgcttgacggcaggcacgagctagacaccaaagccttcatcatccaggggctcctcttctgggtttgggaaaaattgagcaagactgagtacaaccaccgtactcaacaagacacacccacaagtgcagcataaatgcaaaggagtacaatggagttataatatagggggttagggtttgcagtaaacagcatttaagagacacttagttgctcaaagctaaatttaaaacgtgatcctagaactatttgatattattaaacaaggccgtgaacccacacgaacctgccttaacccaaggcctacgatgattcagaccgatctggcaacccgaccctgggtcccagctcgtcccaagccaacccaggccgaccattccaccttttagttgttaagcaggttttaagaattaaaacgctaacttgggtacattgcttggcttgcccataaccgagggcgcggctattcgaataggttttactctgatcagaggtgtacatctttacccacaagacacgtcttcctcatgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccagccctgtgctatgacatctcgactaccgggctgcagcccgtgtagccttcatttgtcctagagatgtccatcgacccccgacttcgtccatctctatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccaagcccagcctaaaaccattttgagagttttgaatagagggggaggtgtgcgtccaattccacaataatccaaccattccatagtgtccaagtgatatgaatattcccaaagtctagagttacgaaaccacctaatgttgcctaattaatcagcgaagcatctacctaaattcatactagtggaaccatgaatagagtgcccactagttggggttttgtttattctagggtgaacaaggtaataataacaataacaacaataataaggtcataacaaaggtaaataggcatggctaaataaaacagtgataacgcgggaatttaaataaagcgataatgcaataatttaaatcaaagtaatttcacaaagtgggatccaatatgttcaaagaa

SEQ ID NO: 63226 - DNA, 7285 bp, Oryza sativa
agtgcatctaaacccaaaattgttcgaggatccactcaaatttgatccatggagatggacggtaagtgggaatattacattctaatcttctcaatgggatttattaaatcggtctacgcttaggttatatcataacttatattaaaactaatcacaaatacaggaggagaagagaatctcgatgcaaaggaatttcatgccatttggaggaggaatcaggatgtgtcctgcggcagagtttaacaagctttttatcacactctttctccacatcgtggtgaccgagtataggtacatacacaagctcgcattcctttgttgtacattatattatgctcacttttcagcaaacacgcaagaaagttgcacaatttttattaaggaagaacattgaataggctgggaatgaacgacagagaagaaataacctagaaaaaacagaggaaaacagaaggctataatcttatgccatgaattgaaaatgctcgacaagatgatcacccattcattaaaaaaaaacttccactgaaatattctaacactattttcttttcgtcaacctggtgaatagatggaaggatatcgacggagggaatgtaaagcgtatctccgaggttttggtcgctcaagagtatcatattcaactagttcctcagacgtaacatacctatgggatattcatctataaaaaaccaagtgtcaatggatcctacggagctattcgtacatgtacttcaatattttcatcatatggtcctcttatgtgtgtgtgtgtgcaagtttgaatttccatatattgttccatacttccattaaagtctcatatgattttcctcgaatttgatgaactagccgccaaaccgtgcattgtatcacttttcatatattgttataatatcattaatgtattggttatctatatcacttttcattgttctaagtcagatcgtgataaagtactggtagtttcattcaagttatacgttgaaagcatgtcacgagggcctttgactgaacctgccgaaacaacactggcgaacaaggcagagccattttggtgaaacaagatggcgaagcaccaaggagaaggcaaagacaaagctctttgccatcgccaccaccgtgccgaagatatacggtgccaagaatgggccgaaccgtcaaggacggcccacttagcagcccaactaggggcccatgaccaatttgtttttaattaagagcgtctgcagcataaacataaaatcgattttacagcaaaagaactgaaccatgcacgttgtagctatcgaactgtatgtgtcggataacaaatcgaactccagattggagtcgaaaggaactagtacaaacctattttactatgcatacgtgcgtgaaaggtagactagtgattggttgattcattttttgcgggtcccacaaagcaattttaacgctacagctatcaaactgaaattttattcggctcttggatcagatcagtcgaaccaaatactacagatgccctaaatatcgctatcataagactaaccatgtaaattcctctataatatgtaaccctagggcatgtaatctataaataggcccaaaggggcatgtattagggaaatcccaaaattttcaatcttaataaactgcttttgcttttccactatgtgaaccctgccatttagtaaacacagttgttattcgacaacagctggtgacgatcatggggaaccctagccgaaatcactgatgccaccaaataagtctgtgagtgagaaagtggtgcggatgaggtgtgagagcgaaggagaagtcgaggcgagcaagggcaaattggccgcaggggccgaagctgaagccgagtcatgaagagtcaaagctgggattcagcctgccagagcagagggcgaagctcgagtcgaagcgaccacaactcaagtgactgcttcaaccatagctgcggtgactactttcgttagtccagaagtcgacgcttcagcagccccaaccatagctgcggcgactactttcgttagtccagaaatcgacgcttcggcagcccaaggagcggagatttttttagagaaggatattttttacccggcctctatatcctaccggataaatgcagtatttttcaatttagaacttagcctatcaaatagggaacttaaccctcaaataacccaatctgaaatttgctcttatgaagatttgaactcagaaccttatggtgctacccaggtcactgccaccactaggctacatgcctaaggaggggagatgaaaaccatgcggcaagacacactacgccgaatgcaggagcaacaccaggcgtacgaagcagctatacaagccaagtcaacagcttctaccaggccagctgtcacttcattggcaacgaccactgtggcattgactgcttcgacgccacaagtttcggctgcaacaacttcatcgctattgccaatcaatgcctcaagtctctccatactccaaatcactatcgcgcaatcgaccatggcaacatgcacaacttcaatcgaccacatcttccgcattttcacttctgaaaattaactagtaatttctgaactaatttgtgcataaaattcttgtaaaggaatcattgagataaacaaatcgataatttaatatatagattcatcaataactaaaacgattgaatgcttacaaagaaaagaaacaacagcgaacaaacgatatagcgacggcttcaactccactcccacaggcatccccattgtggtataagccaaacgtgttctctttcacaactttcttcaactgaggttgattgattattgcaaggtgagtacatcgaatactccgcaagccacacagcaaatatggaagtgcacagggatgcaaaggatggaataatagggttcatttgtaaaagcaacatttggcaaacatttgagaattgtaaaacattagagtaattaattatcaatattaatcaatcattaagcatcacacccatactacataggcccaactatctatgaacaaccattcccgattgcactgatctaacctctaaactaagaattatccattccaaaccatgagctaacagttatcatcaattaccatcttattattattattactagtaatttgcccgtgctaacgctatggaattttttttaatcattcgggtataacgcacgttatgaattaaatttaacatttgcaagaatttattatcttttgaagaatcaatgtctagactttgaagttcctaaaaagggataatacatagaatccagaataatcgaccaaaattcataaatattagatagacgagtttctgatttgttgtttacatagccaccttaaggactctattgtcaggttaaggtatgtcagaatatgagacaataggatcacagtatctagaatttctaccatcatatgtaacaagataatagtacaatagttataattcttttttttacaaaatcaaaacataaaatcattatagtaaagacttattagccatcaagctcatgccgttcgtcactgtacatctacaatactcaacaagtctaaaattataaggaacttcttttagccttgaatgcccagtagaatttctatagaaaaacgcgcatctgctgtttgtcatagtagattggatttggcaaacaactaaaaattctatccaaaaacacacatttgctaaagcacaatacatgttaagattgttagtgatatgccctagaggcaatcatagagatgattgtatcacatactatgtttaaatatttatccgacattgttccttgaaatagataactcattattggttaatgaatatgtgattctttcatgagactctttatgttgtttgttactatttctaaaggatccttgatcaaatatcatatgtggaacaaatatgtttaaatgatcagcacatgtattaattgatgatcatgtctcatggatcatggcatagagataccaaattaataatgtggacacatgttggtgaacatgttgttggatagacccaacatgagacactgcaaaagccatatgtgttgtgtcatcagtgatctcatcatggttcctaacatgtgtagtagcttacttagggactgctaaacgctactctaattctagaggttaaatccagtaagttattactgaaattctagaggttaaatccagtaagttattactatctctaattaactatttatgaaatcaagattcatcttacagggtcttttggtctttactgaaccttaccccacataactatttatatatctagttttgaagcccaacagcacaattaccatatttcttagcaatataaaatacttcttgctgctagctacatgatgatacaaataattttgaactataactaatctttctacttgtgagctaaatcaaaatatttataccctattgtttacacatgttctgcagctgaaattattatatgatccttttactgatttcagagatattcttgttcatattatgatggatgagaatgcaacacacaactcctacacatactagtatatgcatcacacaagaatcatgtcatgatatgatttcacttccattttaatcttctaattacctgccatgctttagggtgactgatatgttattcccttctgactttgcagctgctcctctaaactatggttcaagggttctcctgatggaactctgctggaacaccacttgctccttcttcaggttggtttctctgctatctcacttcagcatctccttgctgctttggtttatatggtaagataagtgaaaatcttgattggcatctggatttgctacttcccttggttttcctggagtttatcctctttcttgatttctgctccatcttgcttgagctactaatggttgcttctcctactactcctctgacctctcattcactcaccctagcctctcctggctgtacacacaaggctgctacggctgtggtgaagcatgggtgagatgttgaactactgatttgctagctgtgattatttctctttagcttgagttgaatccctagctgaactgctggtgttgatttccgttgcggcagctgctgctattgctctactgcggcaggtgcttgaggtggttttccaaccgatgcaaccgaggctggggttcactgaatagcttggttgatgtatatgtgaatttggtgaagactaggtgactcacctactttagttttgatggttgtttactgactgacacctaagcagtgcttgatcggtggagtaatgtgggatttcactaaattttttctagttagataaattctgatacaattaggtacttttacacttgagtccctcggggtctctaaaattgaaggttactctgagattagggactgatttgtaattgttctagaactcaagagtttttctgaaaactaaatgattattgaatctttgactgaggtgtttcagtttatgatatggtatcaataaacaccttatatatgcacaatatatgcgatgcatactgtataagatttctagagtacaattatatgcatatatgtatgcagacctgtagtggtaaattgtaaataacgaactgtggtttctactgtgcacatgtgtagctcacttcgtgacgactaatctatgctataatttaaccaaaactaaattatcccactcctcactaggtctactctaactaaaaataatgatgcatatggatatgacttgataaataaatgacaaggaaacgatcgaaaaatcatttaagatccataatagaacaacaatcaacatatttataggtcctagccagcatcgtggctcaatcgacaccgctctcagccagtgtgaccaagtcatttgcgtgactaagactatagctgatatgatctttatgtatgtccggtgggtcaatacgttctgctaggggccgctgttgacatgtggaccgagaaggagttttcggtttacagccgagtgtacatgaacctacagggtcgcacgcttaatgggccaaaataaggggattggatagagatctaatatgagcttaattcggatagggatccgaataggagtcctacgggccttggaggcccgagtgatggattctatatattcgtgaggggtgtgaccggcggaggtattgcatcacgtgagaaaccctagctgccattttcctccctgagcaaaaccctagttgcgcgcgggtgctagcacatctgcgcgtggcattccgtccctatacgtgtggataccggtagaggcaccgctggtttgcggtgctgatcggcgtgggagtacggcgaggaggacgcacgaggaggagaaggtcgagccggtgcgattgactacttcctctacatcgacgcgcgctacatcgcgagggttccttcgactccttagcgctttcttccactgcgcagcgcgtcgagtggtaacgatctatgatctaatgcttgcatggttcctggtttacgcggtagaaaaattttgatttatgctatcgtagcctacgcatatcccaacagtggtatgagagccgccttgtattgtttatgatctagatcattgcatatagttgatatgcgggtgtagtagatgagatctattatattgtatatgagttcttagatgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaggagccctcaatttttggtggaattttcagagcacaaataataattattaagaaataaacaaagttaaaatggtttcataaaaagaaaaaccctaaaaagtctttcccccccccttttccctcttgggccggctcggcccatccctttctctctctctcctcttccccgcggcccatccggcctcctccccgcgcgcgcgccgctgacgggtgggcccgcccgccaccctcgctgacgggtggggcccacctgtcatccctgtcctcccgccgctcccgccgcctcgcccgtgccctagcgccgtcgccgccgcgaatcccgccgcctcccgtcgtacacgcgcgcaataaagtggggggaaatattccccgtgattccctctctctttccccccatttctccctctctctaccgcgttcaaacgggcggatttgcccccgcaaatctcgccggcgccattgatggcggc

SEQ ID NO: 63227 - DNA, 1251 bp, Oryza sativa
tagtcatataccaaaatgaccaaaacaaaaaagttgtagatattgatgatttatacaactttgttgttgatgactttttctgttgaaatcatttattatttgaaaatgttgtttgaagttgttataatttgaaattcaaattcaaattattgaaacagagtcatatagcaaaatgaccaaaataaaagttatagatattgatgagttatacaactttgttattgatgacattttcagttgaaatcatttagtatttgaaaatgttgtttgaagttatcataatttgaaattcaaattcaaattattgaaacaaagtcatctagaaaaatgaccaaaacaaaagttgtagatattgatgatttatacaactttgttgtttatgacttttttagttgaaatcgtttagtatttgaaaatattgtttgaagttgtcataatttgaaattcaaattttacataggtcaattaaactcagatggagaaataaccaaaataaaattggtagatctcaataagttatacaactttgtttttgacaacttttttcacataagttcatttagtatgataaattccgattcgaagttttaatattttgaaattaattgaaaggggggaggcaaaatgcacttctcggtgagggaggagcaaaaggcctgttatgggccagcccttttgcttccgctagtgtttaagcagtcggacttaccgttagtgttgtcaatgagcttgctcgtgcttctcggtcaccacacacaagaagcgacagacaagccgactggtgagagacagctcatggcatgacagacataaattcattctgagattggagtcagggggcgtactttgcaggggttaaggcataagcgcatacctgcctatccatacgactgtatggacatatagccgataagggtataccttgcacgtatatggagttgttcccagtaaatatcgcggtggaatctgttttgcaaatatatggaacaatatgctgctacgatgtcagcgtgattattgccaagagtgcctactacggcaagggcatagaggtttgctgttatactgtactaggtcctatatcctcaaacctttccttgggggtcaagatgatccacggtataaaagggaccccctgggaggggttcaggaaatccaattccatcaccaacacacgcaccaaagtttacgaagtcggagtacacggagccaagtcgccaggagatcttgtcgaatccctcgactacgatc

SEQ ID NO: 63228 - DNA, 1864 bp, Oryza sativa
catttggattgaagtgatttcaacacaagtttggtggatctcaattgtttgggaaaaaaatcctatcattttatttgaaatgaaggaatatgattaagccattccctaatatccacgtcttttttttctttgaaacgaaggaatatgattgacaaaaaaaactaacaatttgcttctcataccaaactaaacgaattcatacttcatgcttttatttttatatgagaagccccatgcattctctctcgcgcacacactcataaaaaaacaatttcttctaaatttctatatttcatttcctacatatcttccaaacacaaactctttaattcatgtgttttataaaccacacttcaagggagatctaattaattaatgtctttatagtccattggttctcaacccttccaaattccagtatattggcagtaaaattttgcactaccaaatcgttgataggggtaaagttttgttgtcaatgtttggtttgttaacaatattgagccaaatcttataatagagtgaataaagttctaagaccctgtttagatgggactaaaacttttaagaccctatcacatcagatgtttggacactaattaaaaatattaaacgtagattattaataaaacccatccataatcttggactaatttgcgagacgaatctattgagcctaattaatccatgattagcctatgtgatgctacagtaaacattatctaattatgaattaattaggcttaaaaaatttgtctcgcgaattagctttcatttatgtaataagttttgtaagtagtctatatttaatactctaaattagtatctaaatatagagactaaagttaagtccctagattcaaacaccacctaaaaattgtgtcaaataaagcataggcattaccaaataggagtagttgacatcaaaccaaactatcacatttatgatctgagctaccgataaatttatagggtatgttttggcatcaatctaaaacggtcatctgactgactgaacccattttgaaatgtgattttctttccaagtctttcttttttacaaaattcgtgtgattcaaaagaatcctagttttgttggttcatccgatgtactccggagtactaaagaggtggttaggagcaatatgcattatttctgcctacacgaaataccagctagtagatgccaattccacaattcccatttgcattagtcccagaaagggacagtgcagaaatgtcggtggccaggagtactactacttgtactatcaacagtgcagcatgactgacgataccgtggcactgtggcagcctatgcctgcagctcgatcctgtggatcggccgtgctactagtatgactactgtatatacgtcgcaatctcgctaattccacgcgtttattatgccatccaagaaccgacctgacgctctgacacatttatgcgtatgtggacagtagatcggtgagcctcaacggagtaatcgctgcttgatgccatgtcgtattgtctttctggtccttgcatttaagccacgtgtttcgatgcgttgcttggtgttcatgcagtagtatgagtatgtgggatggatgatgcctcaggttatcttcaggtacgatgctttgaggcaatcttttcatttctgaactttctatcagtatgcctttgcttcgaaattctgctcctattaaccagtttatgcgcccaaacatactccaaagcgtgccccccaatgagaatgacgtcctgaagctccagctccttgtcctcgttgtcgtttagtactattttttagatcagtccagcaaattcaacagacgagaagtttgggccatctgattgtgtagaataactttgtctt

SEQ ID NO: 63229 - DNA, 2119 bp, Oryza sativa
tgctgcaaaaattaggattcaaatatggcattaaaattaacaaagtagcacccgacagacaaaggccagcattaaaaaaaaatactctttaccttctgaaaatgtgatatgtcattgtcagtcagctttgcacattgtgcacgcagatggtcgattttttgtttggtaattgcctctttcctctgttcattttcaaaatattttgaacccttgctcatttcgtagattaccttctgcaccttctctttgtcaactccctccattcctaaggcagaataacaagagaataaagaccaaagccatgctttgcacactggggttccatgttgtttccacagatatcacatattcacctaaacatgtaatataacttcctaagtaaagctccatctaattcgtgttctctctaccttaatcttttggatttatttgtaccagtgatttgcgcgatgcagaccccctaatgcccaaaaccctaccccctactggcaacaatcttacgcgacgggaagaggggaaatgcacactcaccagctttggcgttggtgtaggcggtgtggtacgactcccacggcctatctcctccgccatcgggtggcgtccccgccatcgcgtgcgacggcgaggttcttccccccaccgcaggcgggcgtcacgcgaggctaacagaggatgggaaggactgatcgagccgtcggtacgtcgggcaccggcgagctctccgccgtcgttggcaatcaggacgaggaagaatggaggggggattaaactccggcgaggtgaggtcggctccgccgccagccagcggtcgcgcgcgaggaaaggggttgccttttcctctcttttccttagaaaaaatgtcccgcccgtgggtgaaagctattttaattttattattagcttaggtaaagtaaaatttattatagaaataggatatatatatatatatatatctttttagaaaattataagctgtaattaggagtttgatcgtgtcaagttagcatgtaagtttttttttaaaagatttcttatacgacttcatttgtatttccaaaaacgaacgagcttgaaaactaactaaaatacggatttgtattttcaaaagcgaaccaacttaaaaatcgactcatagacggatgatttactaaagtacaggtaaaaacatctttaatttttataataaaatagagatttcaattaataactttttcttttttttctattcttctgtgagcggaagggaaaatttatattcacacaccacttctgcaattcgaacgctttttatatgagtttctaatgtttcaatgtgcatctttattattttaaaagaacacttattattttagtgcagctttattattttattattttagtttgctaccatgtataatcatagatatatacagagtttgtcagggttatggataaggtataccgtctatcctcggatatacgatgggtaccgatacggtatacccgcgcgtgtacgaatagtttccgaatacattaaggaaatctatcccgcgatagaagcagaatctacgtttggaaggagtcctacttggatgaggctgggtttttaccatatcgtgaggactccgatatctccgagtcctacttggagatcaactgacctgcggtatataagggaccccctgggcgggacctaaggcatcgaatctcaccgccaacacacccatcacagcctacggagccggagcctacaggagtcaagtcgccgggagatctagtcggaccaactcgactatggtctcgtcggtatcatcgagttctgttattccctttgtaatctgtggtgtccatcatataatcccataccaactggattagggctgacggagcgtggggctcctcaccgggagaccgcgcaggcccccctttgccggttcggccgggggcgctacgtgaggttcttcgcccttgatctgaagaacgtcagcgagagaggaaatgcacaagacacgagcgacgtagacaggttcgggccgctgagaagcgtaacaccctactcctgtgttctggtggatctgtgcgtgaaggaatccagagagccggagagcgagagagagttcaggctctcccgcccattccc

SEQ ID NO: 63230 - DNA, 6832 bp, Oryza sativa
ttcctcctcgccggatttgagctcgcgacgtcgctctctctctccgccgtcgccgccgagctccggtccgccgccgtcgtcaccccggaccgcctcccacctcggcgccgcctccttcggcttcgccgcatcctcgccgacctcgtccacctctccgtttcggtcgccgaccgccggaacgccgccgtccccgtcgacccgagccgcgccgccgcctctctccgctccggtcgccgttcccgtcgtcgccgtcgatccggggtgagccgtgggccgccgtttcgcttcccccttccctcccctctctcgggcgccgctccgccgcgccggtggccgcgctggcttggccgccctcgggcgcgccgagtggctgccgcgtggggcccggccgtcagccgcccgcgccctcgggtgcggctgacgcgtgggacccccggcgccggccggtgtgagccgggtgcacccggtccaccgtggaccgtggggctgccgcgtgggccccactcccgtggactcggtccgcgcgcccctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttatttctgcttgttatatggagtttattagagtaaaagccttttcttttccattggtcgtgtagacgctgcagcttcggaagatccgctcttcgtggaagttgaagccggcgtttgggaaagcgagcaaggcaagtcacatcatccttgaacatattgaatcccagtttataaaattattttgatttaaattattgcattgtcgctttatttaaattcccgcgttatcactgttttatttagccatgcctatttacctttgttatgaccttattattattgttattgttattattaccttgttcaccctagattaaacaaaaccccaactagtggatactctactcatggtaccactagtatgattttaggtagatgcttcgctgtttaattaggtatcattaggtggttttacaactctagactctgggatattctcatcacctggacactttggaattgttggattattgcggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattagagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggctaggatgggttgaaaactatgtcacgtcttccgtctgtataccgtggtggtatgtggcacgtggttgcacgtgagggagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctaggacccagggtcgggttgccagttcggtctgaatcatcgtaggccttgggttaaggcaggttcgtgagggttcacggccttgattaataatactgtgtaactctaggatcgtctctataaaatggctttgggcaactaagtgacttttaaatgctgttttctgtaaaacttaacccctatattattatccccttgtactcccttgcattaattatgcatctccggtgtggcttgctgagtactgtggttgtactcattcttgctcaatctttctccccctttcagtaagagaagctttggagaagatgtcttaggtggagtcttggcttataccccagttgagcgcctgtgaagttggagccgtaggcccgcaagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggaaattttctcggtcgcgacattagatgatcggaacatgagatgaaccgatagccgcttgggttgatgagatcaatcggtatgtgtgttggtgacttcactggaatgtctagtactcaccaaggccgagcgcaattgtgttcatcggatagtccgatgtccacaagaaccgcacgccaatgagaaaaacgagccaatgagattgacttggtttcggcataattcgattactccgttaaggttttgacatggcgaatcgtagatgagatctatgtacacggctagcgggaccgccgtgtgcgttgccccttagatttcgcttagggttttatatctatcttattttattgctgttgtatatttgatatgacatggtaggatagattccctcagaaaaattaagtgtaatttatgctcttccaataattgcacctattacggttgtgatcataagtgataggtttgccatagcaaagtgtcactttttatcatgataaaataggatagatgtcggacatctatctgcggagattattggtttacttgacaaggagatgtcaccccaacagcacgagagtcacatatgatgtgattagcaaggtgttgcttacctattttgatagttatctagctgtgatgccaaagctcactagacactaataaaaatgaggatcttgactcactatgttattagagggaattttgtttcacaatacatagtgggagtatctttcgttaaactgtttaatgaaaggttaaatgtagacatggtgctgattttgcctacatatatttctattgtagatcatggcagctcctgcaccatccagttttaacttgcggtctattcttgaaaaagagaagttgactggaacaaacatcatggattggtatcgcaacctgagaattgttctcaggcaagagcacaaagagtttgtgcttacacagccttttccagctgacttgcccaacaatgctcctgctgctcaacgtagggagcatgaaaagcgatgtaatgattatcttgatattagctgtctcatgcttgctactatgtcccctgagcttcaaaggcaatatgaggcattggatgctcatacgataatcacgggactgcgtaacatgtttgaggaccaagcaagagctaagaggtttaatacctcaaagtccttgtttgcgtgcaggcttgcagaaggtaatccagtgagcccacatgtgatcaaaatgattggttacaacgagactctggaaaagcttggttttccccttagccaagagttggctactgatttgattctccagtcgctccctcccagctttgagccgttcatattaaatttcaacatgaacaacatgaacaggaccttgacaaaattgcctgggatgctaaagactgccgaggaaagcattaagaaaaactccaaccatgtgatggttatgcataagcgcaagcccaacaacaagaagagtggttagaagagaaagctaaactctgatgagatcacgagtactagcaactctaagaccaaggttcaaaggacagggcctgctaaggatgcagagtgcttcttttgcaaggaggcaggtcattggaagagaaactgtaagaaatacctagagcagctcaagcagaagcagcaggatggaaagagttccacctcaggtattaatgttatagaaattaatcttgctacttcctctactgattcttgggtatttgacaccgggtcagttgctcacatatgcaaatcgttgcaagggctgaaaagaagtaggagcttagcaagaggcgaagtggacattcgcgtgggcaatggagcaagagttgctgctgttgcggtcggcactatgccattatctttaccgtcaagattagtttggagttaaataattattattgcattccagctttgtgtaagaacgttatctctgcttcttgtttgcaagcagagggttatggttttagatctgtggacaatgattgttcagtctattataatgacattttctatttccatgcacccatgatgagtggcttatacattgtgaatcttaatggatattcagtctataacattaatgcaaaaaggcaacgtcctaatgatttgaatcccacttttatttggcattgtcgcttgggtcatataaatgagaaacgcatggagaagattcatagagatggacttctacactcttttgattttgaatcatttgagacatgcgaatcttgtttacttggcaagatgacaaaggcacctttcacgggtcaaagtgaaagggcaagtgaactattggcactagtacatactgatgtatgtggaccaatgagctcaactgccagaggtggttttgggtacttttttacctttaccgatgactttagtagatatggttatgtctacttaatgaggcataagtctgagtcctttgaaaagttcaaggaatttcataatgaggtacaaaatcatttgggaaagacaatcaagtatctacgatctgatcgtggtggagagtacttgagccttgaatttggcaatcatctaaaggagtgtggaattgttccacaactcactccgccaggaacgcctcaatggaatggggtgtccgaatggaggaatcgtacattgttggacatggtgcgatcaatgatgagccaaactaatcttctgctaagcttttggggttacgctctagagacaactgcgttcacactaaacagtgttccatctaaatcggtggataagacaccatacgagatatggacagggaagcgtcccagtttgtctttcctaaagatttggggatgtgaggtctatgtaaaacgtttgcaatcggacaaactcacacccaaatcagataaatgcttctttgtggggtatcctaaagaaacgaaaggatattatttttataatcaggaagagggcaaagtgtttgtcgcccgacacggtgttttcttggaaaaagagtttatttcaagaaaggatattgggagcatggtgcgacttgaagaaattaaggaaacaccggaaaatgcttccacgtccacacaaccacaacaagctaagcaagatgttgttcaccaggttgaacaagttgttgttgaaccagttgtggaagcaccggtttcgcgaagatccgaagaaaaagacagatgtagatggcaatgttcacatctacaaggcacgattggtggcgaaaggtttcagacaaattcaaggtgttgactatgatgaaactttctcaccagtcgccatgctaaaatttatttggattgttttagcgattgctgcctatttcgattatgagatatggcaaatgtatgtcaaaactgctttccttaatggaaatctggatgaggatgtatacatgacacaacctaagggatttgacgatccacaatcagctaaaaagatatgcaagttgcatcaatccatttatgggttgaagcaagcatctcggagttggaatattcgttttgacgaagttgtcaaggcgttgggctttgtcagaaacgaagaagaaccttgtgtatacaagaagattagtgggagcgcactagtgtttctaatcttatatgtagatgacatattgttgattgggaatgatatttctatgcttgaatccgttaagacatcgttgaaaaatagtttttcaatgaaggacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatggcattaatcttggcaagaatcagtgtcctcaaacgactgatgagcgaaataagatgagtgtgattccatatgcttcggcaattggatccatcatgtatgctatgctatgtacacgtccagatgtttcatatgcacttagtgcaacaagccgataccaatcagatccaggtgagagtcactggatagctgtaaagaatatcctgaagtacttgagaagaactaaggatatgttccttgcctatggaggacaggaagagctcgttgtaaatggttacactgacgcaagcttccaaatcgacaaagatgattttagatcgcagtctggatttgtgttctgcctgaatggaggcgctgtgagttggaagagttccaagcaagatatagtcgttgattctaccacagaagccgaatacattgccgcttctgaggctgtttggataaagaaatttgtttctcaactgggtgtgatgacgagtgcttctagctctatggacctctattgcgataatagtggtgccattgcgcaagccaaggagcctaggtcgcatcaaaagtccaaacacattttacggcagtatcacctcattcgcgagaagtgggtagaggagatgtgaagatatgcaaaatacatacggatttgaatgttgcagatccgttg

SEQ ID NO: 63231 - DNA, 8711 bp, Oryza sativa
aagattacgtgtggctcagtctcgtcacaagagttatgccgacaatcgccgtagagatctaagttttgaagaaggagatcatgtgtaccttcgtgtcacgcctcttcgaggggttcatcgttttgataccaaaggaaaattggcactgcgtttcgtgtgaccttataagattgtcagtagaagaggagaggtcgcttatcagttggagttacctcaatctttggcaggagtccataatgtgtttcatgtgtcacagttgaaaaagtgtttatgggtacctacttaagaggccaatcttgaacagatagaagtccaagaggatctgacgtatgttgagaaaccaatccgtatcttggagacagatgagagaagaaccaggaattgagttatccgtttctgtaaggttcaatggagtaatcactcggaagaagaatctacttgggaacgagaagatgaattaaagtcagctcatccgcatctgttcgccagttcttccgaatctcgaggacgagattctatttaaggggggtaggtttgtcacaccctaaaaatcccaaatatataaattgttgtttaattagaattattagaattgattttaaaagcctagaagagaagatctaattttaaataataaattccaatataaaattgggccagataaaattttattaaatactttgcttgattctatagttcctagatttttctgggatttatttgagccaaggaagtatttttaataaatggaattgcatttcatgaataatttaaattggaaaagttttaaaaagtcttcttttggctttgggccgaaagtcggcccaaacctctctctctctctcctccccggcccaggtcagcccgcagtcgagcgccgcccgcgcgcgcgtcccgctcactgacaggtggggcccacttgtcagtcttcgtctacctccagccgccgccgcgcccgaaccctaactgagccgcgctgccgtctccttccaaattcattcatccctttcccgatccggtcaaattgatagaggggaaatgatccccgagatccactcaaacttttctcttttggaatcgtcggctaaaatcgtttggaaatccgtggattcgatctcgaatcagattcgtctctctctccgaaccctaacctttccatcgccgccgccggtcgccgtgggccttcgccgccgccccctagcctctataaaaggacccccggtgtctcctctacccgccaccaccctcgcttttgtctctcgtcaccggtagagccctagtgtcacgtcctgataaattcatcccaaaaataaaaatcgttctctaaaaaggaataatagaattaattaaaatttgaaaagaaattggcaaacactaaaatacgtacaagaaaaattcgaatgtggcccagagaatttttgttaaattctccttggtctaaaaggagccctcaaattttgcttgaattttcagagcaccggaaataattattaagcaacaaaaacaataatcaaagtttattaaaaagaaaacctaaaaataatcctccttttcctttgggccaagtctggcccaaagtctccctctctccccctcggcccgcagtccaagtccctctcccctccctttgtttttctctctttcctcccgggcagcccactccctcctcctccttcctcctggcctgcctcggcccagccgcccggcccaagccgcgcccttgcccgagtcgcagcgccctcctgtcgtagccgcgtgcgcacgagcgccgcacgtgcactgaccgcgcccccgcgtgggacccgcctgccaggcgcttcttcctcctcccgcacagctcttctctctctcccgtgaaccctagtttcttgctctctcgaatccgcgcgattcaagcgttggattccaaaattaattggggggaattaatcccctttccttcctctcccttttccccctaatctcccctttaatcgtgcactattttgaccggagcggctgcgccattcatggctgccttccatggccgtcgggcgccttttccgccgccattccccgctcctcccgtcgccggctcgttcccttccgctataaatggaaccccttctttgcgttctatcgttttagccccttcccgagctcccccgcgaccacaccacctctccccgcctcctccttctctttcctcggtgccggccaccctccagccgcccctaccgcctcacccacgcgccgtccggccgtgccgccgccttccccggcgtcgcagcagcctcctctcccccggcctgccctccgtttcgcgcggagaccccttgaggtgcgcccccgccggcaactgtggcgttgccaccactgttccgcctccggccgccactgtcgcgtttcccgtgcgccggccgacgtcgccatcacctccctcgtctccgcgacgctgccctcatccccggcatcacctcctccccgcccgaagctcgccggagtggccttctcgtcggcatccagtacctccccgcctccggccggctcctgtacgtcgccggtacgccgatcgacgttgcagcgttgtcctctcctccagctgctcctctgtttcgccggaacgccgtcgcccgtgctggcctctccatcctcattgtcgctgatgtcccttcggccgcccgttcatcctcgccggctcgtcgtctcgcggcgccacctccgtcgtcggcatcacagcggcgtgttccgcgccgtcctcgtctccgtgcagctgctgctggctgtccctcgtcgcctcctcgccggccccggtcatcgttgtcgtcgtcctctcatcgttcccggtcgtcgtggcgttcgtccctccgtcaagccgttcgcgttcgccgcccgcgtttcgtcaagtgtgcagcagccccgtcatcgtctacgtcctcggctccgcgtcgtcaagtctcgtgtcggccgtgtctcgccttcgtccaaggatcgccaccgaagccatcccctcgccgttcgtctccgttgtgcccgtccgtctccgccgcgcccgttcgtcgtggtcgttcccacgcctcgtcgcgtggtggtaaggatctctctcctttcgctgccccgtcctcgtcctttcggtgtcgcccgtgcccgttgtgcggttgtcgaccccggtgcccgtgtaccggtgtcggtaatcgttcgtgggtgcgtgtggtgaccgtgtttgtgtgcccgctcggtagccgcgtggtttccacgtgtgcagcccgcgtggtgtctagtggagtccgtttgtcggccactcgcctcggttgacacacggggtccgcttccgtcgacccgtggaccgtctctgtgtactcggtctaccgtggtcccttaggttgacatgtggggtccgcatgtcaacagtgcagccttcctgtcttttccaggctagcgcttacacatgttttatagttgcaaagcctaattataataatccgcaaatctccatataacagcattaaacttcggatgatcatatcttggtcatacgaactctgaatcgacccgttcaagtctcctaatgttggttataacctaaagaaccgtgtgcttcctttttatgtattgttattgcttctttataggcttgaagctttgcttgtgtgcttcgcgtagcttctgtcgttccggaggttcccgaagcgtggtttgcggtcgacgccgaaggttcggaaggccgttctctctgagcaaggcaagtcacatcatccttgagcatattgaatcccagtttataaaattattttgatttaaattaatgcattattgctttatttaaattcccgcgttaccattgttttatttagcattacctattaatccttgttatagccttattattgcaattgttattatcaccttgcttaccctaggcaaacaaaaccccaactagtgggtactctattcatggttccactagtattaatttaggtagatgcttcgctgattaattaggcaacattaggtggttttataactctagactttgggaatattcatatcacttgaacactatggaatggttggattactgtggaattggatgcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcagcccggtagtcgagatgtcatggcacagggctggtgtcctgctgctaggggctcaattctgcctgcctgtccgggggttccggccgtaggtgggttgggtcggtactcttgtctatggctaggatgggttggaaactatgtcatgtcttccgtccatatgccgtggtggtatgtggcacgtggttgcacgtgaggaagacgtgtcttgtgggtaaagatgtacacctctgatcagagtaaaacctattcgaatagccgcgccctcggttatgggcaagcctagcaatgtacccaagtttgtgttttaaattcttaaaacctacttaataactaaaatgtggaatggttggcctgggttggcttgggacgagctgggacccagggtcgggttgccagttcggtctgaatcatcgtaggccttgggttaaggcaggttcgtgtgggttcacggccctgattaataatactatgtagcaataggatcgtctttataaaatggctttgggcaactaagtgacttttaaatgctgtttactgtaaaacttaacccctatattattatccccttgcactcccttgcattaattatgcatctccggtgtggcttgctgagtactgtggttgtactcatttttgctcaatctttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgccttttgtatcatgtttgtttggtgtaccccggcttttcctgggacggggattaatacactagcgttcgggaaaaggcaattttctcggtcgcgacaagctggtatcagagccatctcgactgtaggataagccaagtggataaaacctaaggacatattttataaatgaaactatttgcgaaagttcctttttcctcctttcccctgtgctatttgcaaaatgtttactctttcttccttcttcaaatttcaactagtactagatggtcagctttgcggagaagaagatgtcgtcaattgtctgccgaagctccggaagactgcaggatccgctagcgaagtggaggaagcagtgaagctagctgtgaagaagcagtgaagatcttagagaacccgtcgcagaacccaagccaccctctagggtagagtcgttagtcgtgtgtttccttgcttgtgtgtgtagcgcgtggtttgcatcagtggggtgtgatgtaaccatgttaggttgtttgcttaatcaacttgcagaataagtgaaacagacaacacatcaacaagaagagttagttcctttaaggtcctgtctctagtgctggtctattctttcctggcttgttttcctctctcacctcaatccctgtcacagatgtttaacagagaaaaaggaaagaatgtcagcgggtatgcctccagtaactcaagttttcaactcaatccaccattggcctcaagagagttaacaagggcacacccttggtccattccaagcatgctgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttagcagggcagacatcgctaaaccagcctcctcgcaccaagtcaagcttgcagcctagtgtgcaaagtagagagcccaatggagagaatccattgaatcccgggaaatgctttcctcctagcctttcgtaccatgtggggtcacgtactaagcaagccaaaggcaagaagagtaagaatcagaagagaaaagcaccgatgcgaactgaagaagaagtatgtaagatgactattaccagcaccgaatggcctccggcagggataactattcctagacgtcaaagaggaaataccttccgaggtgcacgacagttgacccagcacctcctaagccatggtggcagagtatctgatagtgaagggtcagatcaagtctcctcggatgatgaagatgagtctccctgacatctcggcgaggaagagatggaatcaaaagcatgcacccgttgtggagaaattggacacgttgctagcatgtgtctcacactctgccctcattgtgaagaggaccatccaccaggggagtgttccactcgtaaggtcacatgttttctatgcgaaggtacaaaccatgtgcccaaggattgccaactcattgtgttgttgaccaagaccacagaaatccaacgaacaaccctacgattgtctcatcagctagtcagctccaaccacaacatcgacgatatcctccacagcaccgatgctcctcctgctgcacctgactctgcaataaatcatagcaataataccttcagcaccaaccattctctgcaccgacagcctcagcaaagagttgtcatcgatggaagaagttgtgtctctccccgacctactccaggccgagggaagggcaatcaacctcaggagggcgataccaagcagaagaccgttatccgcttcaaccagcaatcagaaggaagcttctcctatgaatgatagcaatatgcagtcctatcacatcatcacagaaccaatcaaggatgatgtagtcactagaacaatgccagctatatctctccagaatcagaatgagtagccatgtttgtgattttcagttcgctacttatcactgtaatcgggagtttgcagcaatcatgtaataaataaatatattcatgattataaataatgagcttgttatgtttatggaagattcatgttgaggatgcaatgtaccgatgttaagcaccttccctttttgtttaaggcagggccttgtattcgtgtaataagggagacatgtgtaataaaaacaagttctatgaggactcttttggaagatgctgatatgggattatgtgtataattgtttactgtcaaaggagacctagggtctcatttcagaggaactatgttctaacctcgagttaataaccaacctgaggatggaaaagaaaatcaagtgattaaccaaagagacatttgtttggactaagagtttcagatgtgtctttttcggatcaaaggcaaagacagtcagtacagcttttggcgaaacacttcaaagtttcattgaaaggcagcagaccaaaggacctcattaaagagtaccacctgttagatgtaggccgaaaggtgattgataaaggataatcagaaacatgctctgcatcactcaaaggagacccctgatagtaatcgccctgcaacagacaccttgttattgaggtagaaaaaaaatcgtgagtaagcaagatgacctaggtaaaagtgtttctatgaaggcaaggagtgaaatcttcaactcagtatcagatgctacacggagtgaaaactgcaagcaccggttaccaggcaatgccatgtcttgggagatgatccaatgggaaggaactcatcaaggtcaaaggtgtaaaggaatacggtgaatgctaaataatgacaacctgaagataatagtgggaagtaaactgaatgtaaagaaccaagtgatatgttcgaagatagtctacagaggtcagattaaaatcacatctaacaacgaagcttcagatttggcaggataacgatcagacaataagaagtacagcagtaaagccatttgggaagacgtcaaagcatgtcaagtgggaaaagttggttcggttgagaaacataattcaaaggcaaagttatcgacactcgcatcgaatagcagaagtagctagcacccggagagcaggaaagctaatatgaggcagttggtggcaagttagaagtaaatgacaagcatggtattctcatgatgacaagcatggtatcctagtaatgacgagctgatctcgacgcataacgtgaagtgggtaacttgtatgaggttgacgccaaagatatgaactatgcgaagttctggaactgaagtcccatcttcaagtgccacatcccagtcgaagtcagctagaggtgcaaccagggaaaagtcaggtgaagagaagattccatttgcaacaggagatcgagccaagcagtccagagtggagaagttttgttaggcaagtttgttatagaagatggagcggaagaagtcagacaagaagagaagaccacccaacctatcttcatgctagcctcctcgaatctcggggacgagattcctgtaaggggg

SEQ ID NO: 63232 - DNA, 6407 bp, Oryza sativa
tgaggcacacactagggcaatgggtataagatacattcatgattgactctagtgcaagtgggagactgttagtgatatgccctagaggcaatcatagagatgattgtatcacatactatgtttacatatttatccgacattgttccttgaaatagataactcattattggttaatgaatatgtgattccttcatgagactttatgttatttgttactatttttaaaggatccctgatcaaatatcatatgtggaacaaatatatttaaatgatcagcacatgtattaattgatgatcatgtctcatggatcatggtatagagataccaaattaataatgtagacacatggttgtgaacatgttgttggatagtgtggaccctcgtttttataacaggaatcaatcgtgtaaacagtactatttccctggatcaagtagtctggtacacacgagttcatagcctggtgctcctcttccagctgaagctgctgcactgtgaggtcagtcacctcagtctctaactctcccacacgcctctgctggtcgtcgatctccaacagagcctcctcgtaaaagtcgtctactgcctcagcccatcgtgacagtcgggtcactatcgggttgtagcagcaaggtgtgtcctgaactgtgcagacggagttgctctcctctcgaaacaggtggtgagcaaactcagtactcgccaactcagctcggtggatagagctaagtcggaggaatgcctcccgggctgcatcctgcatcgcagtctccggtaagtcgcgacggtggcgggtcgggaagcggtagtctgactctgaaggaactcgtgtgtgaacctcgacccgagcctcccaaacagatccacactgtctcactcggtagatcggaaatctggggtatcgcagacgcctcatcagccggttagctcaatgacgtatccctctgagcggggtacgcccatctcccaggtagcggatgaatcctgatctgccatctaattttaaaaaacccaaggtcagctaagagtaaaactcgttttgtgaagaaaatagttaagagtaagatgaaaatcgtacaaagttttgtaaacatagcgtttttatttttgaaagtattactaaatgggaatttctcccttggccaacttagaaaaggggtggggcgccttttggtcttttcctacagtcgtatggctctgataccagctctgtggacccctgtttttataacaggaatcaatcgtgtaaacagtaccatttccctggatcaagtagtctgttacacacgagttcatagctgaaataccaaatgcacacacacgaaagtctagtgcgaattattacatcaaaagcccgcaggcatagtcttaaatcatcggaccgagcggtctagaatacattccaaaaacagaagtagataaggcagcggagttaaggcagcggcacgccattgccacaggcaacgaccgtaactaagacctagcgagtgccatcgtcttcatcaccctcctggtagtaagtgtagggatcctccaaagcttcatctccgacctctgattaagtttgtatattgcaagggtgagtagcaaccgtactcaacaagccaccacagcaacaatgcacatgataggggtattcaaaggatggctatggttcttttgcgcaaagcaagttttataattcttttcacaaacctaagacctatcacaaactgatcaaattttagtaccagtgttcatattaaacaatgacggttctgtccaccatccattgtgagtcatcatggttttctgaggacgtccacattcccgcctctcaggaagtggtttcatcagtatagaaatcatcatgcaatatcccatcccacacaagttaagaatttagagtctagccaagtgtaatacatgtcccggtgctcaataaccgtgagcacggctattcgaatagatttggtttactcacactgcagtggatgtacactttacttgcactccgcgactgcccaacacatgagcctcgtcccaacacatgagacgcgtcacggcaaagcttttcgataacctcgccttggcagtacccgctccatgaactttacatcctcatgcactctaggcgtacacggtttctagcagtgagaggagttctggcgcacccgggaagggaagactcatgcatgcattaagttataattatgtttagattctcacatggcagtcctaccgatggcgacaccactgtagacacccgcctcgcggttctaccaatggttgccccaccgtagagcccctgcctcacacatcaagaaaccactatgcatggatattacctccgctcagctatctactccgctaggtctatacccatacgagaagtgcggttgtacgggggtcgtttcatgcttaacttcatggctcagtccttaacttgccaaggacggcactagccttttccggacaacacccaaatcttccgtccgcctcagtcgaaaacagttgtttaattttatttctcctttcacaaatcatgtcatcaacatcatggcaatatggcgctcctgtccccacatgccgcatctcaattaccttcccaaaggtaattgcccaagcatatagcatttgataaatatgagtatgcatgattctagaatagcatttctaagcaattgtcataattaactagggactcatacgtaaacatggttacgaagccataaggggtaaacaagaatcaaggcatggcataatcacaagtaggatgttcatcattgcatgtagtttatttgtaaacaaaataatttcgcaattgggatcaacatgttcaaggaatagtgatgacttgccttgctcaaagtcttgcgggtcttggccttcacttggatccgcaactcccttgggctctatagttacgtgcaaaaattgatttgaattcggttagaattcaaataaaaatccaaataaatccaaatggaagtcgaatgcgaaagtcgattcttttatattaactttactattcgcgaactagggcaaacctaatttcaatttatacatcctaaactatttttgcggggataaatattttgttatcataagtttttaatttaatgtacccgagtattatatccatataataggttagaaatttctatcgcgagctaaatatcagacggaatccaaaaattatcttataatattatacgatttaatttagtctatgactaaacgattaaatataatatacgtctaaaattcctattaattaaatccgagtacctaccgtgaattgatcacctatagagattaccaaaataatctataattatattaaatttttgcaattctacgactataattgatctataattaaattccaattattttaaattttctaacttccctaatctctctctaatttctatttatttattcttttcttttctttttctctcctcttttctttcttttcttttcccttctttcttttctttctttctctcctttttctttctttcttcttttctctctttctctccctcccggcttcttctccctcctctctctctctcagctctctggcgacgacgaccgagcaaggagaggaggcggcggcttaccgacgacggcgacggcggtgatgacggcgcaacggcggcgcacggcgcggcgccacgaaggcggcggtgcgagggcggcgcgacgacggcgcacggcgcggtggcacaaaggcggcggtgcagcggcgcgatggcggcagcgcggcggcacgaaggtagtggctcggtggagagggaagagcggagaaagagggagatggagtggggcaaatggagagggggtgtggagtatttataggggagagggggaagaaagagagggggaggggtggccggcctgacgcgacggcggcgcggggcggcgacacgacggcggggacgcgacgggcggcaacgtgatggcggcgcggggcttggggcggcgcagggctcggcgcgcggtgatgggacggcgcggcgcggcgtggggctcggcgcgcggcgatggaatggcgacgacgacagcggcgcaggctcgaggcggcgatggaacacgcgtggcgacgggacgggcggtgatggggtgcgtgggcgcgcgggtcggtgggatgacggcgcgccggctcggggcgtgaggcgcgcgcagcaggggagatgggacgggcgcacggctgggaaggggcgcggggcgcgaggcgacgacgcgacggcgacatgagataccttgtacatacgccacactttggttctagtcctcttttcagcttcatccaatatccggactgggtgttctggatacatgagatcattgctaatacgaatttcttccaatgtagcttgttcttccggcactcgcaagcacttctttaactgagacacgtggaagactgggtgcacatcggcgatgtttttcggtagctgtaactgatatgcaacttctcctcgtctagcgatgatttggaatggtcccacatatcttggtgctagttttcctttgaccttaaaccttttcgttcccctcatcggagaaacctttagataaatgtaatctccttccttaaattccaggtttcttcttcgggtgtcggcgtaactcttctatcgtgattgtgccacttttagatggtctcgaatcaggcgaaccttttcttcggcttctttgataatgtcaggtccaaatactgcctgttcatctgtctcggaccacatcagtggggttcaacatcgtcgaccaaacaatgcctcattgggtgacatctttaggcttgcttgaaagctgttgttgtaggagaattcggcgtagggcaaacatctctcccagtctttgctaaaatccaatgcacaagctctcagcatgtcctccaagacctggtttgttctctccgtctggccatctgtctgtggatgataagctgtgctaaaagcaagataacttcctaggacttcatgtactttttcccagaaatgcgaggtaaactatgtgcctcgatcggatataatcctcttaggcacaccatgaagacacactatcctggtcatgtacaactcggtgagtttagcactgctatagtttgtcttgacggggatgaatcttgccgtcttggtgagtcgatccacaatcacccagatggaatcgtaccctgttgcggtcttgggcaaccccgactatgaaatccatacctatctcatcccatttccattcggtaatcctaaggggttgcaacagacctgccggtctctggtgctcagccttcacctctggcatacgtcacagagcgctacgtattcggccacatctctcttcatattgggccaccagtatccttccttcagatcctggtacatcttggtacttccggggtgcaatgaatatgccgattcgtgagcttcctttaagattaatcctctcagtccaccctgttcgggtacatagatcctctttttataccatagaacatctttttcgtcggttgaaaattcctttgcaaatcctgcggctaggcgttccttcacctctcggatttcctcgttgtccttctgggctttttctatttgggttctcagaagaggttgaatgtccaaggtgtttatctgtccacgaggtactatatgtaggtttagttgggccatttcctccttaagctcaggagccatcccttccgtcctcagatgattgcaatggctcttccgactcaaagcgtcggccacaacgttggccttgccggggtgatagtgaacctctagatcatagtccttgattaattccaaccatcgcctttgcctcaagttgagatctgactgggtgaaaatatacttcagactcttgtggtcagtgtagatatcacaatgatttcaaatcagataatgtctccaaatctttagcgcatgaaccacagctgcgagttctaggtcatgagtagggtagttttcctcatgtggtcacaattgtcacgacgcataggccacaacttttccgtcctgcatcagtactcctcctagtccttgcctcgatgcatcacaatatataagaaagtctttcctgttgtcgggaagaaacagaataggtgccgaggtcagcttttctttgagctgctcaaagctttcttgacactgttctgaccatacaaacttcttttctttcttgagtagttgtgttataggtcgggctatcttagagaacccctcaatgaacctccggtagtatccggccaaacctagaaaactccgaatcttagtcacagatttgggtgccttccattccgtaatggcctcaactttagcaggatccactgctactccaccggctgagattacatggcctagaaaagcgacttctctaaccagaactcacatttactaaactttgcatataattt

SEQ ID NO: 63233 - DNA, 2423 bp, Oryza sativa
aatggatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgaccggtcacggaccggataagcgtgcgcggcgccgcattaaatgcggcgtggtgcactcgtccaacctgctataaatgcggcgaggtgagccccgctgcgctcacctaacccacacacgtggcgccaaaaccacagggggtcggggcgccccagccctcggggccgaaacgggagcggtccgacccctcggggagacagagggaggggtggccacgtcatcctcgggcccgacccccccgagggggtcaggccaagtgggtgaccgcggctacccaagcctctagtcacgatacctccggccccatgtcaccgacagtagcccccggcgttacgccagggcgatcgcccccctcgagggaagcgctcgggcgtgacgccactccttaggcccggtgacaggtggggccggtccctacaggcggacagaaacccagcggtcgcaaatcgcgcgcatcggcaagggaaaaccgaccgacaataatgagcggcctctttaagaccgctacattactcgagcagcgcgcgaatcgggatgagccggttcgtttcgcctggagacatgatgatggcgcttttcacggttggcaaccgtagttaatgcgcgcacaatctgccccatctcaaccgccacggccgcacatttgccgcgtgcgccgcaaacgggcgagtggggttagtggaggcgtgggcgcgagaaacgagggggcgaggtagtgggcacgggaagcgaggagccgggcatagcgttggcaagggtgtaaagacgccgagaaagggattcgtttctttcctctcgccactcttccccttgccttcgccacttgtgctctaactcttcgtttcctgtgccctacccttgccgcactcgctcgctctcaagctcctcctccgccggcgtcatggcacggggctccgcaccgctcgacggtagcgtgctgccgccttcccgcatcgtgagcgagaggcaggccaggctgccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgcgcccatttctccggctgttccggtggttcttcaccgtacagccggtgtcgccgccgacggtagtcggtggctgctacttccagccgcgggggcaggtgctgaaccgctacattccctacgtcctccgcaaaaagtgggacgactggaagagcgattggttctacaccccctcgccgacgaagcgcacctccgacttccgagccagcccccggcgcaggcctccagctggcgggcggcggtagatctgggagacggctacgacgccgttcttgaccgcctggcgggctctgcgaatcccaggggctcacgggggccatgtgttcggcgactacgttcgtcgccggatcgcgccgctccagcggcgcgcccgaggcgcctgggagtacaccgggcccgaggactacatgaggacccaccaggggcgcaaatgggactgggaccctgaggacttcaggatggtggtccaacgggtgctgaatctcagctccgtggaggcatccctcatccctcaaggggtcctccccctctgctgcgatccagagcgcgccaagattctggccatcatgcaggcggtcggggcgtcgggggagcgggccccccgaggccacgatggcgtgggcgggagccgcaggggggaacaatctaccccgggagggggtcgtgcttctgggccccgcgacgggggcccggggggcagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggccccgcaagatgggggggatcgtgccatgccgggggaacctcatctcgccgccgaggtggtcgtttagccgacctccccgcaggttcgtccccgcgcccaccgcggccgtattcattctcccatctcccaaggcgagttttcactcacccgtttctttttgtcttctgg

SEQ ID NO: 63234 - DNA, 2140 bp, Oryza sativa
agggcgaattcgagctcggtacccagcacagaaaactgggaaatcaactcaggaaaacaaagagcttgaaccgtaggatgtaaactgtgaatattgatacgatactcatcttgatgcaattaacgagttgagctgaagaatcagatggttactatctccacgacatcctatatccccacaccttggaatttccaagtgatggatttacagtagataatgtgttctaactatagatgttaagtgtgctccagaggccagagcaatgcaaaacgaacaattgaacccttgaatcgaattgttatgtgaggagccaacagctggctagaatcagaagtgtatttttcatctgagatttctatattttcatagtattagttttgctgtagtgctagttgttcccgatgttttgctatctgagttataaattacgcggacttgtattcttatgaagtctgactttttgtataaaaaaatgcttaacataccaaagcactgtaatatcgtccttgtactttttcgcttttcttcgagcatttatgggagatatatagcattcgattgttacacatcgcaggctgtgctcagttgacaaacggaaaaaatctgagatagaaagttcttatattatatctgaataccgaatgattagtgaagttattatactgagaatgatgagttagtgttcgagaatgtataatgagttagtgttcgagaatggataatggatgagttagtgttcgagaatggatgagttagtgttcttatacctaataatgaatgagttagggagtgtttgaggagaaggggattgaggagattgggaagatacgcaaaacgaggtgagccattagctcatgattaattgagtattaactattttaaaatttaaaaatggattaatatgattttttaaagcaacttcctataaaattttttgaaaaaacacaccgtttagtagtttaaaagtgtgcgccggaaacgagagccaatctcccctatcacccctaaacgaacgatgccttagtgttcttagccgaatgattagttatagagcattgtttaaattagaaacgtttaacatcctaaacaacaccatcagagtggcgcagcggaagcgtggtgggcccataacccacaggtcccaggatcgaaacctggctctgataattaatttttgacttcttaatcgtctaattttattttatttattcatcttttttgaatcgtctaaatttattttatttattcatcttttttgaattattgcttcttaatcttctacgctagctctatgcaaccacaatctcaccaaatggcgaagtaatattagtgtctttttttgataattaatttttgctgatttatcattcatttatcgaatttgttcttaatgcatacgtacttaacctatctcatgagcacctctaaaaaaattggtccgtatatcttgagctcgatgaaaacatcacagacatataagctcactcttatataatacacacgtgtacatttggttctaatgaatacttttgaagattgagttagtaatatgttaagattgacgaggttaccggtcaccactggtgtctgtatatacctacaaattttgagttcgacgaagtcaccacaagtaatatggtacgttgtccaccactaaaaataattagctataaatacaagcacatcatagactcgctgtcaacatgtatatcgctaccagtgaaaataattactccttccggacatgtctcatgtccagattcatagtcttagatgggtctcatcccatcatagtttgctatattttgaaacggaggtagtagctgtaaatacaagtattcgtgctaaaattagaacttaaacttagattagcaggttccatcataagaaaccttactagtagctaaggtatcctcaattcgccataaatatcaggcaaaaaaggatcctcaaagtttatggtatttgttgtatgacatccaaagaatgtgtatttattacatgacaccactaaaaacatggtaattagctggtggatgctgaacgtattattttattatatcggatctaaatggagagagaaactttcaaaaaagacaactttttacctatggtgcatgtttctttttaacccaaccag

SEQ ID NO: 63235 - DNA, 1135 bp, Oryza sativa
tccgtggtagtgggtacttgtttttgaaagttacttcgttcagtgagcggtagtccacacacattctcatgctaccatctttcttcttaacgaataacactggggctccccaaggtgacgaactgggacgtacaaatcccttttcttgcaactctctgatttgctttttaagttcttccaactcattgactggcatccgatatggtctcttggatatgggagcagttccgggtatcaggtcaataatgaactctatgtcacgatctggtggcattccaggtaaatcttctgggaacacatcaggaaatcgcttcactacgggcattccctttaggggtagcttggtaaatatgcctctggcacgttcggttagtctaggatcttgatccacggtcgctgtcatatccgatccccaaggtgtggtcagggtaacttccctacgtctacagtcgattactgtcacaccccgaagttttccccccaagccaaaattttaatttataaatgaccctataaagatgccggtgcaaagcaagagtaaacccttttaaatcaatgcaaataataatcggaattggcatgtggaatttttcttgagttctacatgtcgaaattcactaacaggatttttagtggaattttcagagctctagaaataattttaaccaattaaaattgagcaagcaatattttaattccagggaaaatcctttttcctttttctttttctttttcctctctttttcctcctttttttcgaatgggccgccggcccattctctcctttcttccccctcctccctgtagggccggccgcaggccgaggcccatccaggccgtcccgcctccctcctctctcggggtcgccgacaggtggggcccacctgtcgggcccgtctccatcctccagccgacgccgcgcccgcaaccgccgccgcgtccacgcctccgcctcctccgggccacgtcgaccacgcccacgcgtgcgccgcgtttcccgcgcccactcccctctctctcccgctcgcgcccgcgcccgagatggccgggattcgattttagaatcccgcctctctctcctcccccacttcccccacgttggccggcgaaatcccgcctctcccggccacgtccg

SEQ ID NO: 63236 - DNA, 1322 bp, Oryza sativa
cccataacaccgcagctaaacataataggaataagttcacttgaggattcttatcttgttatcgagttttaaaatcgtccctgaaccagaataccagatataacacatccataatcttataaaatcaggttatattgggtcccaagacaatattaaggtgactttggatgacgtggcgctataagaaaaataaaaacccatgtgagatttgtatgtcagtgaaacaatatagtattcttcttatttctctccccatccttcgggtctcgagtctcggcggcgacagatgtggcggcggcgtgcggggtgaggagatggcggccggtgtgcggcgtgcctaacgacggcggcgaaggaggctcaacagtcggcggaggcacgccgcatgcaaaccgagcatcgacgtcgctcgctcttcccgcggcggagtggaaaggaccgcgaccaacagggagaggagcggcttccacggcggattggaaggcctcctagtctcctcctatggcgtgctcggtggcggccgaactaaggagatggcaaagcccatgccacgcacagcggcgaggaggacgtacgtgcccatggcggagacgctgaaccgcatcgtggattggttgccggactatgacgcgaaggggaagaagtggaggcggaggacgagtgtaagttattttagaagacagagatccctataaggattgtgaagcaatggacaatccaatttatcttttactacctccgtttcaggttataagacgttttgactttggttaaaatcaaactgcttcaagtttgactaagtttgtacaaaaataatagcattttcaacccaagacaaatttattaagaaaatgggagcgaattttccaggatttaatagctttgtgctttcagtggtaagtgacgtacctgtctacagcgaggcgtctgtggtgacttcattaatctccaggatagatttgccagcccagtcttcgaagatggcaagatgctcataggggtatggtttgcgtgtgtgttgtgagtatctgcgttgtaccatgtaattaaaaaaatattaatttaataaaactaatttaatattataaatattactatatttgtctataaacttgtatttgaagcacaatgatgtgaaaatctatgtctcgggaataatgatgagaaaagcacaatggtgaagcaacgcaaagctgggatcaatcgccctgttgaaataattttccgctaacaaagaatggattctttgctattgggtacactgtaaaacagattctcgcaccctgtaaaaatgatgatttttatttttcattcgatgtgta

SEQ ID NO: 63237 - DNA, 5858 bp, Oryza sativa
tgcaaaattataatggcatggttccaattcaccctagtaggtaatagccctaatccagttggtatgggattatatgatggacaccacagattacaaaggaaataacagaactcgatgataccgacgagaccgtagttgagttggtccgactagatctcccggcgacttgactcctgtaggctccggctccgtaggctgtgatgggtgtgttggtggtgagattcgatgccttaggtcctgcctagggggtcccttatataccgcgggtcagttgatctccaagtaggactcggaaatatcggacccctcacgatatggtaaaaacccagcctcatccgagtaggactcgttccaaacgtagattctgcttctatcgcgggatagatttccttaatgtattcggaaactattcgtacacgcgcgggtataccgtatcggtacccattgtatatctgaggatagagggtataccttatccataaccctgacagtagcccccgacttctgcttaaatgaactcatgtagtcgatcatgactcccaatgtcggaattgttgtcgttctcatctggttgatctcggtgtaaaaaaccatagagacaaagagccatcgacaacatcgcatgaagtccaacggtcatgagtgaatttaaattgaagtctgaaaactaccgagcgcaacgaacccaaaaatttccgacggcaatctctctcctttccttggaatacgcactgtcggcagagcgcttattgaaaggaattttgggaatccatttgaagtccgtttgccataaaactcttctgccttctagcgcccttcgtcttctctgttccccgcaaagaaaaccctagcttgcttcttccctcttgtttctcggcgatcctccggcgacgatggaccttgagaagtctacctcaaccacagggagacaggaggtatagaacctgaacccatcatgtgccacatggttgtggtcgaagattacatttcttgcgattttcttcctccgccttcggaatttcttcttctcgtcttgaatttctatggcctttctttgcttcacttgaaccctaactccatcgcattccttagcatcttttctcatctttgcgatgcctacattggggtagagcccttccttgatctattccgcttttactatgagctgcgatggatggaacccaacagggtatctggatgcgttggattccgacttcaggatcgcctgaagtcgcgttacatccccttccaatgcccctcttctcgcagcaagtggcgggcgagatggttctatcttcagatcgaaaactcggatcccgtccttgttgtccctgaagaacagccagaccaaatcccagagtggactgccaaacccgccctgactccctccctccaatcttttatcgagatcgtcgatgatctccgaaatcgggggttgtcggggtatgaagtcgctgtcgacttcgtaggtaggcggattcaaccgctgtaggcccgcgcccatccggcctttgattactctgggccagaggacacgacccgggtctctcctcgggatattttttttcttgcatgtcacatcctgatttttgtttcaggatttataaatcatttaataaattattattagaatttatattaaatgttctttaatttacaagtgaagttaaatgtgggaaataaaatttcccaaatataaagcatggatggatttaatttttattaaattctccatgattaagtcaactctctgaaatattctcggatttttcagagctcaattcctaaatgatacaaagaacagttcagtaattatttgatcattaatgatctaattataattgttaagagcttttcttgtttaaaaatccttaaattataaattgttggttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaaggaagtatttttaataaatggaattgcatttcatgaataatttaaatagaaaaaggttttaaaatcctccttttggctttgggccgaaagtcagcccaagtctctctttccttctccctctctcctccccggcccagtcggcccagtccgccgctctcctctctctctctgtcgctgacaggtgggtcccgcctgtcggagtcgtcgtcttcctccggccgccgccgcccgaaccctagcgccgcgccgccgtcgtctccttccaaattcggccgcgcctttccttctccggtgaaatctttagaggggaaatgatctccgggatctcctctaccttttctcttttggaatcgtcggctaatttcctttggaaataggcggattcgagtttgattcggattcgtgtttccccaatctttccttccgacgccggccgccgtgggccttcgccgccgcctccttgcccctataaaaggacccccggtgtctcctctacccgccgccaccctcgccttcgtctctcggccgtctgttttggataggatcgatctcggccgttcgttctcgtgaaccgccgccgtgcacccggtccaccgcaaaccctaggcgatgacgcaataattcccttttccttctcaaaaataattcattattgcgtcataattcaattaaaatccatataagtgttttaatcctatttaatctttaaaaattcataactaattctttgtaactcagtttaatgtggttcaagttgcaaaagttgtataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcccacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggtggagataagcccacgggggtcgctggggagtccatgccttgtttataagggggtgactatgatccgggaacggtgcactgtggtgggttgtgttatgcaaggggtaatgtcacagctcctttccgaggtaccgtggtggtaccgaggcacatggtgacatgttgtggggctgtgtcttgtgggtacagtggtacacctctggccagagtaaaactattcgaatagccgtgcccgcggttatgggcaggttgagcaatgtttttcgtgattagtcccacacctctcacaataattatggatgttatatctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaaagctgcttttgcaaatgagcctatattatgccatcctttggtatccttgtgcacttgcatatttgctgtgtggcttgctgagtatgtcatatgctcaccttgcaataatcaatcaacctcagttaaagaaaaaggatccagaaggagaagacatttggcttataccccagttgagctgcctgtgggagtggagccggagcttcgctagattttattttccgctgcagttttcttcttggtgaggacttagtgcctcttaagtaagtatttattgttttagttaatttgatgaatctgtatattaaattgtcagtttgtgtacctcggctgattcctggacgaggattttatgcacaaataagttcggaaattactagtgaattttcgggcgtgacattgcatttctaatcttgttccgagtgcatctgtttctcctgacttatcgagttctcattttcgattcacaggtctagacagtgacaccgtggggtgccgcgtcagtcaggtgatgatcagcgccccctcagcagggagcgacatcccgatccccctttgcgaaaagggcccagccgaacgcgccgctgcgatcaatgtgagtgtactcgatgattcctttacatctttctccttgagatcacgtcgtgacttcacattgtgcaggctctccctttacggacgtcatcgggccactagtggaccaccaggcggcggtgtcattgaagaagggcgtcgccaaggaggcgtccgacgctgctgctgctaccacgagtggcagcaatgttccgaagaaggggaggaaattctcctccgtacttgggacccgtcggaagatgccaaactctgctgtaagcttctctatcgttccctagtgcgtagtcggaacaatttgatctcataccatttcatcttactcaggactcggacgcgtctcctccgcctcaccgaaggcaaaggttggtgactatcggcgagaagtaagtaaacgttcttgagatcttgttattttccaaattccgatcacctcgcctcatggggaagagaaaaaactttgcagggcggcatgggcaaaggcggcgcaaggcgggactgatgccgcttccagcgcgtcccctacggcgacctcgacaggagtcgtggtcgctactatggaccaggaggtggcaccgagcggccctgccgtcagcctcgtgcctacccggggtccgtccaccgatgccctcacctgggggggagctccaagcagagatggagcgcatcctctaggccggtactcgcggcgtaggtcgcgagatcgaggaggctagggcggcggcggcgtcggcaaaccagcgtgccgaccagctagtgcgcgacctggcggaggcccgtgaggacctcctaaagatgagggagctggtggccggcaacgagatgcagcggcgcggactcgagcaccggatattggagctcgagggccatatgattgacatccgcggttcgctgcgaacatcgttcaccagcctgcaccaactcgccggggagtgtggtgtcacgactaccatcccggcgcaccccgatgagttctcgctgacgtcatcgcttgtggaactggctacggtgatggaggagatcccctccaagcatgcggctaggatcggcgaggagacgtccaacggcatctacaccggggcatgccatgtccttgcgtgcatgaggctggcacatcccgatctggacctta

SEQ ID NO: 63238 - DNA, 919 bp, Oryza sativa
agcgtgagcggtccaagaaagcagctggtttaggtaaaccgttctctttccattttatgtggctttgacaagcatagcgcaccaggtgatatttttttaaataaaaccctataggaaaatcaccttatttactagtgaatttggttacatactaagccagataaaaaccataagaatcggtagcatctttttaaaaatgatgctcgattggtcgagaaatgatcatattatcaatttttatatgtagctaaagatagttcgattggaaatggtaccagcttcatctctcaaaaaccactcatcatgcttggaagaatagtcttggatcgtagtgtaccaactcagattcagattccagagaacatgaaaaacttggtaaagaatcctgtatgattgtaccagacggtacggtatgaggtgagtacatgctaaacagctacgcgtagtaggagtactagtcatttgtgtgcctaaattatgctattccctccatttcatatcataaattattttatgggtatattctctccgtcccattttaaacgcaaccataagtttctttgtgcaactttaatccgctgtattatttaattttttaaaaaaaataaaaaacataagtcacgtataaagtactattcatattttagcatctaataacaataaaaatattaatttaaaaaatttaaataaaatggacgatcaaagttgaacccagaaacttatgggtacgcttaaaatggaatgaagggagtacctaatcaatccttcttaagtttaaaaaagcaacatttttaaactgggataaacttgtaaatatactataaaaacatatcgacatgaatttaatgaaactactaaatgttttcatctgtttttgattaagaaatagatttacctcaattttcgttagcacgctttt

SEQ ID NO: 63239 - DNA, 24379 bp, Oryza sativa
caactgaggtttgatgattattgcaagaatgagcatatgacatactcaacaagccacacagcaaatatgcaagtgcacaaggattccaaaggatggcataatacaagctcatttgcaaaagcagcatttagcaaaacatttaagagaaataaaacagtgaagtaattaatcagaaattttaatcaacactgaacagcacacccatgctgcacaggcccaaccatcctgaacaaccatacccggctgtacagatctaatctccaaaccaggagctaaacaaattattaccaggtataacatccataattattgtgagaggtgtgagactaatcacgaaaaacattgctcaactcgcccataaccgcgggcacggctattcgaatagttttactctagccagaggtgtaccactgtacccacaagacacgatttcgcacatgttgccatgccccgaaataccaccacggcattgcaaagggggaaattgtgacaataccctttgcacaacacaactcaaaacagtgcaccgttcctggatcataatcaccccctctacaatcagaggcatggactccccagcgacccccatggacttctcgccacttcacagtctggcacactataatgaatcatgctatacaaaagataaagccattgcccatgctggcttgtggttggtacggttaatgtttcacaacagtagctcgcgaaccggtccttaattgtcatgagcacgactctcaaaaccatgtgctcacaacccaccattaatcatattttaattaccaattaattatcataacacgattaaccatcgtgagctaccattaaaaataaccataaataataatgtagtatatatgattcatcccattagtgagctaatgtttctaagcatggctaagcaattatatctaacatctagttgaaccaatatatataaagctcaactagtcaagttataataacccaaggtatcaaggaatagggtaatcaatgcaaactggccataataaaggaataggttcacaccacccggtgacattcaaaaataaatgcacagttgaaataaatagagaatttaaatatagaatcaacatgctcaaaggattgtgtttaggatctgtgtgacttgccttgcaataatcggtcttcaattaatcttcttgatgacttccgacgcactcacgaacctttgcaacgacggaaacgacaagctaacacgtaaaacgaagaaaaagactaataaaaaccaaataaacagtacataacaagtaaacaaacacgtagatcataattttagatgaattatgagacttgaacggcctcattctgaattcaaatgaatttattatgaattttacaagattaaatctaattaaagcccatttaaaaagaattaaataaatttaatttaatttatggacaattttaatatgtagatctttattttagaaaaatttagcaacttgaaccacctgaaacggatctacggttatttacttatgatttccgaagatttaatctattagaaaaagggcaaaagaaaagatgatgatgtcacgatgacgtcatcgacggcagccacggcatgggtggcgacctcaccggagctagagaggtcggccgggctatctaagggcatctacacgtagacgacgacgacgcgatctcaacgatactcaccaacgcaacgaacgacgacggatgacggccggcggcgagcttgtgcggcggtggcgactcggtcgtcggcggcggcgactctccggtgaccggcgacggcggggagggggcggccgagcttcccctcttccacgcgcacccgacggcggcgagaggagacagcggcgacggccaaaacgacggcgcgaggcggctgttcgtcggccggcgacggcggcggctaagacgacgtggcggcagctctacggttgacgagagagctcgggagatggggcaaaagaaagaggagaactaggggatgctttatatagtcttggactagagagatcggactccaaacgagaggaatcgatgccggaaaatcttcgggttagtttggagagataaactcaaaacgaattttatttggataaaatacaaggaattaggttccgattcttgggggaaacgaaagaggaagataaaggaaatatttcccctcaactaattttgcaaacggagctcgggatgcggcggatttggtggagaaagcggcggctgcacagggcacaggacggcagctcgggctctgtccagagctggaagatgaacagtagtagagggaggaacagtagacttttctggctgggctgagaggagaggaggcggctcaggttgggccggcggaagagagaggaaggaaaggaaagaatgggccgaaaatggcccaagctgaggaggaggattttattacttttccaattaaaataatcacttaaatgatctttgaattgttaaaaatacttccaatgctcaaataattccaagaaaaatcctgaaaatacttggacactcaaagtacttaccaaaattataattagaccatttaatgattaatttaatatgtgggtaattactgaaatgctctttgtagattaaaattaataattgagctccgaaaaatccgagaaaattccagagagtataattaaccatggagaatttaataaaaaattaaatccatccatgctttatatttaggaaattttatttcccacatttaacttcacttgtaaattaatgaacatttaatataaattctaataataatttattaaataatctataaatcctgaaaaaatcaggatgtgacaccgtccacccctcctccgtcgaggttcgtcgccggagccctcgttccctcgcactcgggtgagcaccacctccaccgccgccttcggccatggtttccggtcgccgtggtccatctctctctctaatccctctcttctccttccttagggcaccccgaagctcgtccgcccaccgacgtcgtcctcccgtggcttgccgtcgccgttcgccatcatcttcttccgcgccggccaccctcggtgaggcatccctcccctcttttccccttcctctcctcctagtgccgcgccgccgcttcgagtcgcatgccgtcgccttcggccgccggcgccgcctcccgtgccgccggtcgccgccgtcgttggccgcatgccgtcgccgctagacctggccggcaggtcggctttgatgccgagccgagccggcggtcgcctttaacgccgcccgtcccctccccttcctagccgccgcttagcgtagccgccttcgcgtcgccttttgcgccgtcgccctcgccgccggttgccgtcgccggcaacgcgttcgcgcgcgcgccgtcgccgtcgccgcggccggtcggccggccttgagccaagccgagctgggtgccgccgccccttttctttctccccgccgctgaccagtgggcccgcgtgccggcgcccttcctccctctcccgagccgctgaccagtgggcccgcgtgccggcgcccttcctccctctcccgagccgctgaccggtgggccccgcatgtcggcgccgcttcccttgtgctgacgtcagccctggaatatattgcgcaataaatgatttagggtttttcttttatagtaataaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtactttgagatagtcgccgaggttcctccagcagcagagcaaggcaagtcatgcttgtcacttgaacatgttgatcctatattgcaaatgctctattgttttctttcaaatattgcattgttttataatattactatgggatggttacctattgttacagccatgctttttggataccatgctcctttgttagcttggggttatgacatgattagagtttggactaggaattgcttagctatgcttagttcaactagttcacaatggggaaaatcatattaatgtttagactgttggttctaatggtaatgttggattataccaccgctctggtgttggttaattaaaatgaatcatatggtgggctgtgggtgcatggttttgctggtcgcacccatggcagttaaggaccggttcgcgggatgccctggaagaacttaacgtacttaccacaagccagcgtgggcaacggctgggcttgtagtgtagctttcctctagccgacgcatccaggcaagggtgggcgtgatggagtttggatgggccctgcgacggcctatgcggcttccagattcacctaggcacgagaggggactgcccgctgccttgcgaggagtgggggtgaaacctgaggtgtggtgtgcttggttagagggggttatgcgaatggtcctgtcacggcctctttccggtatgtcgtggtgacatgttggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggttagcgttggacaacggatgattaatatgaattaattattacaactgtttaaatctttcaatttctgtttataaatgctcgctttatgcaaatgaaccacttcagctcttctttgttaattccctgcatcatacccctattccggtatgacttgctgagtatagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaggcttagctcctgttgtctttcttttcttccgctgcatttatgtaagactttatgatgtttgtaagacgtggatctgaatgtcaacattgtcgtttgtgtaccccggctggtcctggacggggattttaatgcacattctgcttggaattctattcgggaatttctgggcgtgacaacatccagggtctggggtatcaaaaccataaggttggagggaaacaccacaaccctaagacgaataggtacatctatgcaagcatgactcacagttatctcgcccccaggtgagtgtactatcataggctttctaagtcccactagggttaagttgtgcttttgactagccttcagagatatgaatgaatgcgatgcaccagaatcgaagaggactttaaccggggtagaattgacagagaacatacccattagtacgccctgatcttcctgggcctcttcagctcgaacatggttcacttgtccgcgtccaaatccggtagcggtcctgttagtttgcggagtcttgaatagacctcgtccggtagtaggggtagtagttccacgaacaatcattgcattagcgccagtacggacaggagttttgtgtggatgagggcagttgttggcgtagtgcccatactccccgcagttcaagcagtccacattcttcttggctccaggggcagccagggttggtgtaggggtgcggttctgaatcgcaaccgacctgttgaatttgctaggtgcagcggggcggttggttgccacaataggggttttccacccagacgaagtggcttccttgagtcgctgaggcactccctgaggtaggcgattcatagaaagcctccttttgcggttgtgctctacagtcctttgatcgttctccagcctaacgaccttgttgattaggctctggaaactctcttgatcttgcccaatcataggtccacgcaactcatcattcagcccttctatgaacttgtcgatcttttcttcttcatctgcgaggtctccaattgcatagcgggccaactgagtgaatcggttcagatattcctgcaccgttgtgttcccttgtcgcagccttctaaactcgttcctcttcatacgcattaccgcagtaggcacgaagttctcgcgaaatgctgcagtgaactcttcccaagtgggttctccatcatcctcttcccgagcttccttgtaagtatcccaccaatcaccagcgggtccctccagttaatttactgcgaagatcactttgtcggcttcgcgtacccggacaagggtcagtttattctctatgatacgtagccaatcttctgcctccataggctcgtctaccgtagcgaacgtgggtggcttggtcctcataaactctccaaagctcgatccgccgcggttgccttggttattcgcaatggcttgtagaagttgggtttcagtggccataactctggccagggtggttaggtcaggtgtcgaagtttcttcattgctggttgacgcccgacgtcggcttgccatctgtgtaggccgattaagtaagtatcctaattttctaactagctcttatggttttatcccattaagggagttgtttcgatgtgaactttgttttgcaagcatggtggaataaactcatttataacacaacaacaataatatcataaataacatcatagagttccacaaatagtacataaatcatgatgcaatcgactgcacacatacgcagtccaaataaggttcatccaaaagatgcatcgaactaaccatcaagctactcgtcaatctaggtaagggggggtgtgtctcgcatactatccaaaaaccatctgaagcgagatcgaagctgcaataatcctccagtctagtcatccaaccatccgcaggatcctggggcaggtagagggtggtcgctggcacgggcaaacctgagtccccacggctcggaagtagtggcctctggatctggcttgggcttcttgctcgggggtcgggtgctcttgcgggcagtgctgagggtgcgagggcctccgaggaaggtgatgcggggaacaggggtctcatcctctgaaggattagtgatgtctggctcgatctctggctcggtgtcggtcccctctgtctcggagtcgacttggatcggagtctccaaactggaacccagctgcggagaaggtgtagggatcagtggagtgtgcacaatctccggggcaggtggctgtgtcactgtcgggtccaccaagtaaggtgctgactcagtagccagcataccaacctctcccaaaagagcgtgcaacgctggtgggtatggcagggtgaggaaaaagtagcggtcacgtcctactgttgtggaagtagaagctcctatggtgctgaccgtggctgctcgaagctgctcctccagctagctgacgtgctcctgactctctctcagctgctcctcaagtgtatccatcatcccgcggctgtcgttgtactggtcagataactgctggaactggtcgccgtggacctggagctgtgcctttagtgagtctatctcactgccccaagcctggtgctcctcttccagctgaagctgctgcactgtgaggtcagtcacctcggtctctaactctcccatatgcctctgctggtcgtcgatctctaacagagcctcctcgtaaaagtcgtctactgcctcagcccatcgtgacagtagggtcactatcgggttgtagcagcaaggtgtgtcctgaactgtgcagacggagttgctctcctctcgaaacaggtggtgagcaaactcagtactcaccaactcagctcggtggatagagctaagtcggaggaaggcctcccgggctgcatcctgcatcgcggtctccggtaagtcgtgacggtggcgggtcgggaagcggtagtctgactctgaaggaactcgtgtgtgaacctcgacccgagcctcccaaacagatccacactgtctcactcggtagatcggaaatctggggtatcgcagatgcctcatcagccggtgtagctcaatgacgtatccctctaagcgaggtacgcccatctcccaggtagcgggtgaatcctgatctgccatctaattttaaaaaacccaaggtcaactaagagtaaaactcgttttgtgaagaaaatagttaagagtaagatgaaaatcatacaaagttttgtaagcatagcgtttttatttttgaaagtattactaaatgggaatttctcccttcgccaacttagaaaaggggtggggcgccttttggtcttttcctacagtcgtatggctctgataccagctctgtggacccccgtttttataacaggaatcaatcgtgtaaacagtaccatttccctggatcaagtagtctggtacacacgagttcatagctgaaatatgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattatccatggttaattatactctctggaattttctcagatttttcggagctcaattcctaattttaatcatacaaagagcatttcagtaattacccacatattaaattaatcattaaatgctctaattataatttttttaagtactttgagtgtccaagtattttcaggatttttcttgaaattatttgagcattggaagtatttttaacaattcaaagatcatttaagtgattattttaattggaaaagtaataataatcctcttcctagtcttgggccctttccggccgatctccctcttttgtgtgcacggccgtgcagccctagtcggcccagccgagtttcccccttctctttctttctttgctttgttttcagccagcccaagacgaaaagtctaatttgcgtccctcgacactgtttatcttctacctctagcagccgaactgagaccgatttggctcggtttttctcctccaaatctgacctttccccttgtgtttttctaaaattagttgaggggaaatattcctcttatcctcctctatctttacccccaaaaaatcggagctaatcgttgagtatctcatccgaatcgaactcgttttcgagtttatctccaaaaccgagtttttgatttcccggatcgatttcttgcgggaggagtccgatctcttcaatccaaggctataaaaaggaccccctagtcctcctctttcgtttgccccctctcccgtgatcttccgtgcctcgtagcgccgccgccacgtgctccaccccgccgtcgtcgccggccgagctccatccgcgtcgcgccgtcgcctccgtcgtcgccgccggtcgctgtcaccgccgtaaggtgcgcgggagggtggagaagcccggccgcctgacccccgaagccgctgatcaccggagccccgtcgccgccgtcgaccgaagccgcgccgccgctagaccccgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcagaaattcataactaaatcatcttagctcggatttagttggttcaagtctctaaatttttctaaaattgagatctacatgctaaaaatatccacatatactgttcatgcttgtttatgtgctgttttggtgtttttgctcttttctgtttagattccgatgtttccggagagtccgttttcgcaggagaagaatttgaagagttccaaggccagcaaggcaagtcacacagatcccaaacaaccctttgagcatgttgaacctgtttaaagctattgatttatttcaactgatgcattgttttcgaatgtcattgggtggtgagcctttcccctttaattatggccgaagatgacttgggatttttctatgggttataatttgactagtatggaccttatatattggattggttcagctagatgttatttatagttgcttagccatgcttagaaacaatagctcactaatgtgataatcatgcttcactatcacttatggatatttaatggaagttcacgacggttgatcgtgattggttaattaattacttgtcaactaaaacctgataatggtgggttgtgagcacatggttttgatggtcgtgctcatgacaattaaggaccggttcacgagtttcggttgtgaaacatttaccgtgccaaccacaagccagcgtgggcaacggctttaccttttgtatagcatggttcattgcggggcacccgactgagaagtgtcggagataagcccacgggggtcgctggggagtccatgcctctggtttttgagggggtgattatgatccaggaatggtgcgctgcagtggattgtgttatgcaagctcctttccgaggtaccgtggtggtattgaggcacatggtgacatgatgtggggctgtgtcttgtgggtacagtggtacacctctgatcagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagctgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaaaataccaaatacacacacgaaagtctagtgcgaattattacatcaaaagcccgcaggcatagtcttaaatcatcggaccgagcggtctggaatacattccaaaaacagaagtagataaagcagcggagttaaggcagcggcacgccattgccacaggcaacaaccgtaactaagacctagcgagcgccatcgtcttcatcaccctcctggtagtaagcgtagggatcctccaaagcttcatctccgacctctgattaagtttgtatattgcaagggtgagtaccaaccgtactcaacaagccaccacagcaacaatgcacatgacaggggtattcaaaggatggctatggttcttttgcgcaaaacaagttttataattcttttcacaaacctaagacctagcacagactgatcaaattttagtaccattgttcatattaaacaatgacggttctgtccaccatccattgtgatcccaaggatagcttcctgccattgagtcatcatggttttctgaggacgtccacattcccgcctctcaggaagtggctccatcagtatagaaatcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcctaacacatgagatgcgtcacggcaaagcttttcgataacctcgcattggcagtacccgctccatgaactttacatcctcatgcactctaggcgtacacggtttctagcagtgagaggagttctggcgcacccgggaagggaagactcacacatgcattaagttataattatgtttagattctcacatggcagtcctaccgatggcgacaccactgtagacacccgcctcgcggttctaccaatggttgccccaccgtagagcccctgcctcacacatcaagaaaccactatgcatagatactacctccgctcagctatctactccgctaggtctatacccatacgagaagtgcggttgtacgggggtcgtttcatgcttaacttcatggctcggtccttaactgaccaaggacggcactagccttttccggacaccacccaaatctttatatccataccaattaagtttttaatttaatctacccgagtattatatccatataataggttagaaatttctatcgcgagctaaatatcggacggaatccaaaaattatcttataatattatacgatttaatttagtctatgactaaacgattaaatataatatacgtctaaaattcctattaattaaatccgagtacctaccgtgaattgatcacctatagagattaccaaaataatctataattatattaaatttttgcaattctacgactatatttgatctataattaaattctaattattttaaattttctaacttccctaatctccctctaatttctatttttttttcttttctttgtctctcctcttttctttcttttcttttcccttctttcttttctctctttctctcctttttctttctttcttcttttctctctttctctccctcccggcttcttctccctcctctctctgtcggctctctagcgacggcgaccgagcatggggaggaggcggcggcttaccgacgacggcggcggcggtgacgacggcgcatggcgcggcgccacgaaggcggcggtgcggcggcgcgacgacggcacatggcgcggtggcacgaaggcggcggcgcggcggcacgaaggcggtggctcggtggagagggaagaggggagaacgagggagatggagtgggggaaatggagagggggtgtggagtatttataggggagagggggaagaaagagagggggacgggtggccggcctgatgcgacagcggcgcgggggctcggggcggcgacacgatggcggtgacgtgacgggcggcgacgtgatggcggtgcggggctcggggtggcgcgcggggctcggggcagcgcggggctcggcgcgcggtgatgggacggcacagcgcggcacggggctcggcgcacggagatgggatggcgacggcgacagcggcgcaggctcgaggcggcgatggaacgcgcgcggcgacgggacgggcggtgacggggcgcgtgggcacgcggggcggcgggatggcagcgcggcggctcggggcgcgaggcgcgtgcggcaggggagatgggacgggcgcgcggcggggcaggggcgcggggcgcaaggcgacgacgcgacagcgacggcgatggcgcgcggcgcgtggtgacggcgacgcgacgcggtagcggcgcggggcgacggcgcgcggcggcaggcggcgatggctacgtcggcgcggctcggggtggctaggggcaggcgacggaggaggggcagggctacggaaccacatcgagcaccttccgcgcaatgaacagtgctagttttcattttatccttatttaacctattctctatataaatcttattcattaattccaaatttttacgcaaatgaagtttacataacatttgtgttatttcaaccaaaagattcactctagattaacattacccatattttatttttatctaattttcttgaatttaattaattcttatttcatcgtactaaaatttaattattgctaatatggtcgcgataatattttatttatttccaacctcacctaatctttattttaatttatattttaattatttatttagccaatttgatttttagggtttattcctagttagttattcattattcacgattaataaattccgagatcaaaatccaatgaaataggcgaataaaatcggcatgatgcaatttatttaaaaagtttttgaaggtccgtatttttagagttttgatttttgtcggtcgaattttcagggtgttacagatagacccaacatgagacactgcaagagccatatgtgttgtgtcatcagtgatctcatttagtgttggtgttgaatccttagacctgagattatcatggttcccaacatgtgtagtagcttacttagagactgctaaacgctactccgtaattggatagttataaaagtagtttttgggtatgctatgaaacatgtagtgggatatgaataatcaagatgggatttgcccctcctatggagagatatctttgggcctctcgatgttatagattataaaagtgcatggccatgccaaaggtgattgaggagtcaatcacaagttatataatctatcacaggttcgagtgaatgattgagctattagaggatggcacatatctagccttgagcttaattgatatcgtggcaaaagggttcatacaagtatacactagaggttcagccgatatgatctttatgtatgaccggtgggtcaatacattctgctaggggccgctgttgacatgtggaccgaaaaggagttttcgggttacagccgagtgtacatgaacctatagggtcgcacgcttaatgggccagaataaggggattggatatagatccaatatgagcttaattcggatagggatccgaataggagtcctacgggccttggaggcccgagtgatggatcctatatattcgtgaggggtgtgaccggcggaggtattgcatcacgtgagaaaccctagccgccattttcctccccgagcaaaaccctagtagcgtgcgggtgctagcacatctgcgcgtggcgttccatccctatacgtgtggataccggtagaggcgccgcgccgttggtttgcggtgctgatcggcgtgggagtacggcaaggaggacgaacgaggaggagaagatcgagccggtgcgatcgactacttcctctacatcgacgcgcgctacatcgcgagggttccttcgaccccttagcgctttcttccgctgcgcaacgtgtcgagtggtaacgatctatgatctaaagcttgcatggtttctggtttacgcgatagaaaaattttgatttatgctatcgtagcctacgtgtatcccaacaaagaccacatcattgatcaaataaacttgttcaagtgtcaatgcacctggtaagagctgccagcctactccatacatgcatattttgcttgcttgtagaactgaaaacagaaacgcataacacaagccagaggttgttgctatgaacatatcagattcccggaacaagggaaaatttcatgaggcataatggaagctgtcacctcatgagcgtccagccccaactgagactttcatgaacaaatcaagaaaactctttctaaagaattaagaaatcaagttttacacccattcccattgaaaacaagcatgagaatgaaaagaaaaaaaaagtgttttgttctgtgcaccagcaccgccacctcgcccacatccacattttttaaacgaaaaacccatatccacattcaccagcccgaaaaatagatcgattgaaactttagaaatgtgttaaagttttgtatatgtgagagataagatactacggaagatgatctattttaccaaggatggaggctagacaaccttaatttggttgtgacctgcgactgttattggtcagaaaacactatatatccattgaaccatacatgttacagagtttctaataacatggttaagctgtagtattgctccaataactgaacaatatttaattcattttgttgaaaacctagatgaagaaaagggaaaagaagatggttgttggatttattcagaagctgaaagtgggtatcacagagtcgccccgtagaaaaaaagaagaagaaagtttcacgtcttatgtcaggtaaatgaggcaatcaagtcatgaactccttatcaggtggcagctagaaacacatgaactatcacttgcacaagttttcacagttcacaggtgcaaaatacaaactgtcaaacccaaaagcaaggtgcaccagtgaatcacattgcactatccaatatagagagttctaagcataacttccattctctagccacttatttgctaaaagaaatttgttctctgagctgctaaatagtaagtacacaatcaatcaaaaggcaggcaatcaggacactatggttgcaaacctttataaataattttaccagttaattaacaacaactttaatttggctcctagaactaattgaagttatacatgttctaattttactacacttcagctttctaaataataatagcaaggaaattttacttacaaaatacacaccagtgatgaaatacaatataactgtgatccttctaagtgctatctactgtccacaaatcgtatagagaaatgcatattttctgcaatatatatgatatatgagatcaggtgaagaggcaagaataacaaaggagacctgcaccttactgtacatgagaatccttacaattgcactggtggagaaaccatctttggttggtcgcccgaaatccacaatagttccggttccacaaaaaaccgggactaaagatgatcttttgtcccggttggggctacaatgggcatatgtgatctttagtcccgattctaaagttgtcaggccccccgggatctttagtcccggttggtgttaccaatcgggactaaagatcctaactttagtcctggttggtgctaccaaccgggacaaaagatctccccctttatatatgtcttcttcctcctccagcccgagcaagcttcaaaatttctccaaaaaagaggggaggtcatgccaaaatttcttgcgaaatttttttagtgataatatacaaatcggaggtgtctaaaaggttagtaacttcattcttcaatgttttttgttgttataatacttttggagctatgtttcacacattttttttttgtctctaaaacgttgttgtaagttgatgagagagaaaatttttgtggggaagatgaatatatagaaattttgtttgtttacttaaaaagttttattctcatagtttaaaatataatgaaaattaatcttaaaaatagaaaataaaataaattgaaaattaaaagaagtacaacattaatattagtttagaacttcaaaaataatataatacaacattaatattagtttagaacttcaaaaataatataaaagaattgtttgttggattattttataattattaattgtatgagtaatgatatgtcattattgtatgactgtttaaagagtttttaattattttatcattattgtatgactgtcattattgtacgaaaatttatttatgtacgattttttttcatttcatgtaagatggatcggcaatggatgtacgctgaccggcggtccaaagagtttatcgatggcgtgcattattttttgagagtggccgaagctaacaagcataagggttttatgtgttgtccatgcaataagtaagaaccagaaggagtattctgcatctaggactattcatttccacttctttgagtcggggttcatgccaagctataattgttggacatcccacggtgagcaaggggttgaaatggaagaagatgaagtggaggatgagaacattccggactaggctcagtacgctggatttgaatgaaatcaaacgggcgaggtggacagggatgatgacgataacagcgttgcggatgatcttggtcagatgttgtaggacgccaaggaggactgtgaaagtgaaaaggatgcccataaattggagcatatgttagaggaccacagaacttcgttgtacccaggttgcgagcaggggcacaaaaagttggataccactctagagttcttgcaatggaaggcaaaaaatagtgttagtaacaaggtatttggcgatttattgaaactcgtcaagaacattctttcggagggaaacaaatttcccgagacaacgtacgaggctaagaagatagtctgccctctaggactggaagttcagaagattcacgcatgtctgaatgattgtatcctatatcgcggtgaggagtacgagaagctagaagcatgccctgtttgtaaagcactacgatacaagattagacgagatgatccaggtgaagttgacgggcagccaatgaagaagaaaattcttgctaaggtgatgtggtatttccctataataccacggctacggcgtttgttcagaaacaaggggaatgctagaatgatgcgttggcacgctgaataacgtcaacaggacgggatgctgagacaccccgccgatggttcgcaggggcgaaacatcgacagaacatttaaagactttggaaaggacgcacgaaacatacggtttggtttaagtacgaatggcatgaatccttttggagagatgagcaacggccagcggccatagcacttggcccgttacgatgtgtatctacaacctccccccttggctatgcatgaagaggaagtacataatgatgccgattattattcaaggcgccaagcaacatggtaacgacatcaatgtgtacctaagaccactgttcaaagatcttaaactgttgtggaagaaggaaggtgtctccgtgtgggacgaggacaaacatgaggagtttaacctacgagccctgctgttcgtaaccatcaacgattggcctacacttagcaacctatccggacagtctaacaaggggtacaaggcttgcactcactgtatggatgaaacagaaagtacgtatcttaagcactgtaggaaggttgtgtacataggtcatcgtcgattccttgctgcaaaccacccagtacggaagaaaggcaagcactttgaacataaggcggaccaccgtacgaagcctaaacattgcagcaggaaaacaatttgctatggtgaaagatcttaaagtagtgtttggaaaggggcctggcagccagcctatagagagcgaagatagtcacgcggcgatgtggaaaaagaactctatattttgggagttaccctattgggaattcttagacgtccgccatgcaatcgacgtgatgcacctcactaagaacctttgcgtaaacctgcttggcttcctagctgtatatggaaagtcgaaagatacactggaagcacgtaaagatctgaagcatatagaacaacgcggcgaccttcacccggaaccaaaggagaaaggaagccattacttgagtccagccagctacactcttagcaaggcagagaaggaaagtatgtttaaatgcttgtagagcatcaaggtactgtctggatactctatgaatataaagtgaataataagcacgaaggagaagaagttcacaaacataaagtctcatgactgtcacgtgttgatgacacaactgctaccagttataattcggggtatctttccagacaatgtccgggcaacaataacaaagctatgtgctttcatgtacgcaatttcgtgaaaggtcatcgatccggatagattagaagcccttcaaaatgacgtggtgcaatgtcttatcagctttgagctgatatttccaccttcatttttcaatataatgacgcatctgctttgtcaccttgtcaaagagattggtattctcgggcctgtgtacctacacaacatgtttcctttcaagaggtacatgagcgttctgaagaattatgttcgtaaccgtgctcgtctagaggcaagcatcgccaaggggtatggagcagaggaggtcattgaattctgcgtagaatttattgaagaccttcgcccaatcggggtgcctgaatcacgccataaagggagactacagggaaaggggactctcggaaggaaagcaataatgacggtagacaacaatttattccgtaaagcccatttcacggttctgcagcaatcttcattggtggctccttacatcgaggagcacttggctctagttcgcgccagaaacatcggtaagtccgatgcatggattacacggcatcacattgatactttccccgtggctgcgacaacatctcatggttaacgaaacgattaaccaacaactggccttcctggcgaggagaccatccggctcaattgcgacattccagggatatgagatcaatgggtacacattctacacgagagcccaagacatgaaatccacgaaccagaacagtgctattcatatcgatgccatgggacacgatggtacaactggcacgtattacggtgccatcgaggacatatgggaacttgactatggacctctcaaggtccctctgttctggtgccaatgggttaggttgaccggtggaggcgtaacgattgatgacagtgggatgtcaacggttgaccttaacaaggttggatactcggacgaaccttttattctcgccaataatgtaacgcaagtattttacgtgaaggacatgtctagcaaaggaaagaagggaaaagggcctgacgagccgaagcgccacgtggttctcccaggcaaaaggaaaattgtcggagtagaggacaagattgacgaggattatgatcagtttgatgggcaaccctctttcacggtgaggattgacgctagcatcctcctatcaaatgaagacaccctttactcacgtagcgatcacaaggaaggaacaatagtgaggagaaagtacgtgtggtcaaccgtcaccgtcgatgtattgccgtaattgttgtgtacacgatgtaaactattttggatatattgaatatccatataaattaattgttgtatggcatatgttaattatgtatgattattagaatttttaacaaatttaaatcatgcatatgctagttatatatgataattacagtttttaacagttttaaatcatgcatatgcatattatatttttttttgaggaaccgacggcaggagtttctcttgccggagtatatagaggaagagaattggcccagttaataagggaaactggacccaaaaaccgaacaagcacggttaattaatcgggaaaccggcaaaacctatacaaaaaaggaaaaagaagacaactattgagacctcacaaaagtcgtcgttgccgagcttaccaaaggcaagcagcttcgataacataatgcaaacgaggcctccagaaccaccaaacatcctctagtggagcagaaaccttctaagcgaagccttcaataagggaacaacatcaaggatgctatcaacacccgttccgaaaggaacccggttttcacctgaagggagagagagccaacatgacgatacctccaaggaggaaacggcgcccataggcgtcgatatcatcaacctaggatacactaggcaaggttttcacccgaggctctctcaaaatgctccacctccaaaccctcgtcacattgccgggacatctgttgggggtcatcgttgccgagcttgcaagacaaacagctccgactccgcctcaacattcaatcacactacagctcgaccaaagaccacctcacccacaggaacccagctgcagcaaacctacggcgtggccgatgaccagacaggacgccagaatccaattccgcacgccatccctaccgaaacaaggacctccccggcatcgactggaagcaccctagcctaagaagggaggagcacctaagaagaggggagcgggcgccgcaccgccagtgaccaccggaagaacaaccactgaagaaggggagaaaccggatctagaggaacaagactcccgtggtatatcgcgtggattcgaagtgtagtttatcttctattttgccgacgaaccctagctctttcgccgccgattcccctcgtatccgagccgatccccccctcctttggcagcccctcggcctcctcatccgtttcctcctttttttttgaatttttccctagccctagagccgccgccacgctcggcttctctctcctttgccggccgccgctccagccacgtcgcgccgcctcctcggtcatcccagaactgcgccgtcgccttcctcggcttcgcagtgaagagctctaccccgtccaccggttccttttcgccaaatcccgccggaagccgcttgccgacgcgaacccgagggtttcggcctttgccgcttctccagccgcacatcgccgtcgactccgtggtcgccgaaccccgccgtctcctccgttggtatcgcagcgccaagccgaagcctgttcacccatgcgctgccgctgcaaaccaccggagcttcgacgttgctgtcgatcagtacaccgtcgtccccgtgaggccgatctattcgatcctcagccaagctgcgtcgccgttgccgtctccgctggtcatcgcagaagcctgcgtcggcatcgcaaggtcctcaggaagcccgtccacccatcctttttccccggagttcgccgtctcaatctcgtcgccggccatctcccgtcatcgtctgtggtcgtgccgcccctcggtgagttcgtctcgtcgtcctattcgcgttggtgcactcggatagcccgccgagcctcctagcgcttgcgaccttgcggtccggtgcgttgccggcgatgatgtcatcgctgacgtcagcgtctatttttctgttccaaataaatcgtaattccttttgctaaattatattaaatcttgtaaaattcatagctaattcatacgaactcattcgttcaagtctcataattcatctaaattcaaactctacctactgtttatttggtttttatttgtgtttttccttttttgcgttctaggtttagttttcgatcatttcgaaggattgttagttcgttgaagaagttcctgaagacgaattgaagacgcttgtttgcaaggcaagtcatacaaattccaaacaaccctttgagcatgttgaatctgtttaaagctattgttttatttcaacttatgcattattttcgaatgtcatcgggtggtgagcctttcccaattaattatggccgaagatgactttattttcctatgggtaataaattgattagtttagaccttatatattggattgattcaggtaaatgctatatatatataattgcttagccatgcttagaaacattagctcattaatgggatgaatcatactacattattatttatggttatatttaatggtagctcacgatggttaattgtgttatgataattaattgataattaaaacttgacaatggtgggttgttagcacatggttttgaaggtcgtgctcatgacaattaaggactggtttgcgagctactgttgtgaaacattaaccgtgccaaccacaagccagcatgggcaacggctttaccttttgtatagcatggttcattacggggtgccagactaagaagcggcgagaagtccgtgggggtcgctgggagtccatgcctctggttgtagaggaggtgattatgatctaggaacggtgcactgtggtgagttgtgttatgcgaagggtattgtcacgatttcccccttttagtgccgtgggggtacttcggggcatggcaacatgtgtggaatcgtgtcttgtgggtacagtggtatatctctggccagagtaaaactattcgaatagccgtgcccgcgattatgggcaggtctaacaatgttttcgtgattagtcccacactactcattaatgttaataatgtgataattaatttgactcttggtttggaatggtaaattcctagtttggaggattgatctgtacgaccggggttggttgttcaggtttggttgggcctaagcagcatgggtgcgctgttcagtgttgattaatattgatgattaattactctgctgtgttactactcttagatctttgctaaatgttgttttcgcaaatgaacactatattatgccatcctttagtatccttgtgcacttgcatacttgctgtgtggcttgcggagtattccatgtactcaccttgcaatcatcatcaaatctcaattgaagaaaaaggatccagaaggagaagacctttggcttagatcccagttgagctgc

SEQ ID NO: 63240 - DNA, 1319 bp, Oryza sativa
gaaaaaaaggcagggaaacgatggcattttccgcccacggcgttgcgttttttcttcgtgttgtgttgacggggggtgaggcgtgtataatgctggtaatgttgacgggttaggggcgtacgtgtgcagcgctgcagccagtcgtgagggcctgaggggcgctacccgagcattgtctggtgtgttacttactgattgggcaggtctgggccccggtgtttagtagggcttgggctcggatggtaagctttagtttgggtagaaaaatagggtcactcactctgacttattactatcttctagaagtgcagattatcatcggagtataaatgcaatttctatactaacgtaaaaagtagtagtggtggtggtggcgctaccaccatcctactaccatatggaacccataaaatatgatataaaactttactggtttcttagccttcatatgttagacctggtcgaaaataaaatatgacaataaaaatttatagaatttttcatctttatgaaatgatggcaaaattatcacaatgataatatattagagaaaaaaaccattgcaatgcatgggcattatactagtgatttaaagagttaaaaagtggcgatttcaagagttcgataatttcatattagaaaagtttcgtctatggctacataggagagggttaaccagatctactacctccattcgactttaaatataagcatttctgattatacaagctttttgtaccattttttacattgaacttagtctgggtacttattcaaacattttttgtgaatgaaatcaacatgagattgtgctatttttaatatagtagaagagaaatacaacccctgagagtaagttatgcagaatttagtataagctcccgaagccgatttgctccaaccgaagccatcttcttgctttctcctttattttcaccagtaggctaggtgctcgaaaactcgctggtttctctttttccagatcccaaacaaccaagagaatcagggcacgcaggtctttcttgggcacttcttttttgttggccagcatcttacaccaggctcgaacgttacaactgttgatatgccacccaggatgctattaggcttcgaatccttctattatatctatattggacgagtatgtggcatgctgactttattaaaacagattcacccatataaatatataattaagctagtgaggaaaggtgaacaatattattcttatctgctcccacttgtttagcctacaaactcttcctttggagcatgtttcgaactcaagacatctttttcgaaatgagaaaaatatggat

SEQ ID NO: 63241 - DNA, 1045 bp, Oryza sativa
atttataaaagcctggataagatggtttgtccctcacacacacacacacacacacacacacacacaacaaaaaataatttcacaccaacagaaactgggtcttctcgtggacaggccaccagcaactacagctagcagtacatcttggactgtgttgaacacaatgtatgccctgcgacggtttacaatattgccataacgtaatcaccccgctctaaaaaaataataatcacgtaatcacttggtacttcgaatattaactaaaacacatgcgcttgaaatatgtatacttattatcatgaaaaaggatttaagtctcccattccagtaatttctgttcatacgttgtatcagctggtaatctgaaatctcacattccagcgttacaggaatttcagttcatacgttatattcaaacgtttccaaattccaacacagaccggtagtcgtccttgactcctctcgccatttttcgagtatgcctttgagtcataactgcagcatactgatacgagaggatacattgacaaaatgaatttgtcagatgcctgatacacagagaatataattgtgatggagatgcaaaagaaaaatactacatgattgctaatttgatatatatgttccgggaaagccatccttaaccatatagtactagtatatgtcctctgggtttacatcctcctctgatgatgtagacacaagatcaatctcaatgtgtccaatgtgcatgcatgcatgtaagcaccactaatccttgaagttgcgtttaattccctacaacagatcctagagatagtagatccaatcactctttacacaaatataactcatcgatctctacccaaatagtaaattaaatataggtcttaatttatacaatagctagctagttacagaatgccgtaagagaattcattaacaaactgccaacttctgaattaactgacctgaagaatctgagtaacagaaagtcaatgtttagctggctagctgcccctgaaagtggatttcggcaatgatctcagtaaaaccttctaggcct

SEQ ID NO: 63242 - DNA, 586 bp, Oryza sativa
tcatatgccctcttcttcctcataataccaatggctttgttactgtcatactttaaaaaacacatcggctcggctccgaagggcttggctgtagctccaaaggaagggctcggctccaaaggaagggcttggctatagctgcaaaggaagggcttggcggtagcaggacatcggatcggggacgcaccgcagagaattttatcccaatagaactgcatgtgtaattgttttggttgttgcaaaatctcttaaattttgaacgcacatctaactaacatgaactaactatcctattttttatagctcttcctacatgtatatattcacgtatggttacaacaagctacgatcatcacttcatattcgtagtggcggcgatggagttgccagggaagaagagggcagaggaatcgtggttggagaaggaacggctctggaggaatatcgtgctatcgatggagttggagtgggctggatataggcccaatatcggtgtactaaaatacccttgattaagtgctaatcctatttttaatctcagctactgatgatctttaattttcgtgcaactttttttagagcacat

SEQ ID NO: 63243 - DNA, 13371 bp, Oryza sativa
catgtggattttttaacatgtagatctcaattttagaaaaaattagagacttgaaccaactaaaacggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacgggcgacggttcacgcgaacggacggccgagatcgatccatccaaaacggacggccgagatcgatcgttctacgaccggctcacggaagagggcgacgatgacgtcagcgatgacgtcaccaccggcggcggcggctcggcggctcgggcttgcatgctcgccggcgaacggcggcgcttcggcacgaacggagagcaccaaagggtagagcgcgacgcggcgaactcaccgatgaccaaaggagcggcggaagaccaagggacggcgacggcgacgacgaagaaacggcggcggtcttcgggtcgacggcggcgatggtgctccggcgatcttcggcggcggcgaaggagcggacgagaacggcggcgacttggcgatcacgacggtggccttcccgagcgatgacgacgaccgagacggcggcggcgcacagctggagcgacggcggcgacggcggcgctaggttgcacagcgctagagctcttccggcgacaagaggcgaaggcgagagtggcggcaggtagagaagagctcgggggtccttttaaaggggctaggaggcgacggcgaaggcccatggcggctggcgacgagaaggaaggtttagggttcggaggagagagacgaatccgattcgaactcgaatcaaacacattccaaaccgatttagccgatgtttccaaaggagaaaaggtagaggagatcccaaagattgtttcccctcaatcaatttcaccggaaacgaaaaggaatggccggattttggaaaggaacggcggcggcgcgaaactagggtgggccccacctgtcagcgggcggacgcgcgcgcgcgcgacggcggactgggccgacttgggccgaggagagagagagcggttttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattatttctaaaaattccaattaaacaacaatttatatattttgaattttcagggtgtgacagtagtcttgtgtgtttgctgtgaaattgacaggcttcacaccgctgaaccatgtcgcaggcgtctttgagcgcggttggccagaaaaacccttgtcgaaaggcttttccgaccaatgtctgaccgccggcgtgtgacccgcagatcccttcatgtatatccaggaggagatgtttgccatcgtcgaacgatatgcatttgagaagtactccgtttggcgcctttttgtatagatcgttgctgatcatacagtaaatcttggcttgtcgggttatcctctcagcttctgcgtcgtcctcgggcagctcatcactactcaggaacttgatgagcggggtccaccattcttatgtggtctcgatgtcggcaatgacgtgttccgcctctgtagcccccgagatgatgtctggggaacagccgtgctatctgcgtcatttgcttctttcaccgatggttttgtcaagacgtccagaaaagtgccaagttccagtggctctcgtctggatgcgtgccgtgctaggtcgtctagttcgatgttgtgcttacggtatacgtgtcggacctcaatcccatcaaaccttttctccagcttcctgacttccgcgaggtacttggataactcggggctagagcacttgtagtctttgtgcacctggttcgcgactagttctgaatcccctttcacgattagttgcttgactcctagtgcagctgctgctcttatcccggcaagtagtccttcatactcggctgtgttgttggtcgccctgaagttgaggtggattgcatgcttgaactgatctcacaaaggtgatgtcaagatgaaccctgcccctgctccttggctgttgagtgcgccgtcgaatgccattgtccatgtttcgctgtccgtttgactgtccgacctgttctcaagcatagtccagtcagctaaaaaatcagcgaggacctgggacttaatagctgttcgtggcacaaagtggacatcaaactggcttagctcgactacccatttcgcaatgcggccaacaacgtctttgtttctcacgactctccaagagggaaggaggaaacaactgtgactctgtgggcttgaaagtagtggcgtagctttcttgatgtcatgattaccgcataaagcagcttttggatctgtgggtatcttgttttcgcgtcgtggagagctgcgctgacgtagtaaaccagtctttgcaccttcgctctctcgacaatgatgatagtactctcagaatatggcgtggcagcgatatagaggaataactcttcattaggttggggggcaacaagtacagggggatctgacaggtagcgcttgagtgcaatgaacgcatcttcggcttcctgtgtccacacaaatttgtcttgtttcttcagcagggtgaagaaaggttgtcctcgctcccccatcctagcgacgaatctgctcagtgccgccatgcatccagttagcttctggacttccttgagtcttgtgggtgacttcatgttctcgattgccttgatcttctcgggattttcttcgatccctcttccagagacgaggaatccgaggagcttgcccgatggtactccgaacgttcacttctccgggttgagcatgaggcgataccgtcggaggttgtcgaacgtttcccggaggtcatcgatcaatgagtcgcttgtttttgtcttgaaaacaatgtcatcgacgtaggcctcaacattgtgtccaagtaggtcattgagtgccccttgaaccgtgcgctggaaagtgtttcctgcggttatcagtccgaatggcatcttgacgtagcagaatacgccgaacggcgtgattaatgttgtcttctcctcgtcctcttttgccatgctgatctggtggtagccagagtaagcgtcaagaaaacttaacaactcacaaccagctgttgagtccaccaattggtctatccgaggaagaggaaagtgatccttgggacacgccttgttgaggtcggtgaaatcgacacacatcctccatttcccgttggccttgcgcaccatgactgggttggctagccactctggatgaagaacttctctgatgaaactagctttgagaagcttgtcgagctcttctcgtatggcttgtttctagtctggtgcaaatctccgcagtttttgttttactggcttggcatcgggtcgcaccatgagtttgtgctcaatcacctcgctggggactcccggcatgtcggacggctgccaagcgaacacgtctgcattgtcgcagaggaaggtgatgagcgcgagttcctatttcttatccagtgacggcccgatcttgacattcttgtcggggttggcactggagagcggaacgatcttgattgcgccgtctggcttcggcgttttgttggtttttcttactttcttgggcggctcagttgtggcgggcgggttgggagtgtgctcgaccatgtcgaggctccgcttgtcgcactgcactaccagcttcgtgtttccctgaatagtaattgttcccttcggcccaggcatcttgagcacttgatgcgcgtagtgagatgcagccatgaacttcgcgagtgcattcctcccgatgatggcgttatatgttgtgtcaaactcagcaacatcaaaggtgatctgctctgttcggaagttatttgcttggccgaaagtcacaggtagcgtgatcttgcccaacggcttggacgatgactgaggagtaattccatggaaggtttgatcagtgggcgtcaactcgcttcgtgggatccccatcgcgtccaaggtgctggcgaagagtaggtcgatggagctgccgccgtcgatgagaacccatgcgaccttgatgttccgaatagtgggctcgaccacgatcggatatcgtcctggagtgacaggagtcttggggtggtctgcctctaagaattcgatcttctgctacgccgtggaacctccgaagatgttcgaaacatgaaggtcggagtctaggttggctgagtctgagtcctgagtagccgcttctgcggcgttctcgactacacgtactcgcttgcctttctccaacgctagttgctttgtgagtgcatttttgaagacgaaacaagtctccagagagtgcttgtctgacttgtgtatgggacaccatattttcttcgtgtcatcgccttgtgggtccgggtgtttgggtgggtcagcatattctgctgtgaggacctccgtttgagccttccgtttcccactcctgcgactctttttcttgcttgactcaggcgtgtccttggctggtttattctctctccctgtcttcagtttgtcattcttgcgcctcaaggcgtcatccacgtgagcgcatcgatcgacaatctcgaataacttgcgagcagttgtgatccgtcttgtcgccagttcctgggttgtgtagcgatctcggacaccagacttaaaagcgcggattatagaagcatcggtgatcttggggatcgtatttctgcactcattaaagcgccgaataaagtccctcaatgattcacccgaattctgcgtcaacgcgtgttagtcgtcctcgatcgcgtggcgcttgtatgttccttggaagttagtgacgaactgctgccacagatctgcccatgaagaaatcgagtaggacgggaggtgaactagccatgaacgtgcagatcccttcaatgccgccgacaaataatttaccaatgcgttgtcgtctactccggcaacgtagagtactgtggaatagacctgtagaaactcctcagggtcggtgcttccgtcgtatttctctatcgctcccggtcgaaatttctcaggccatcgaacatctcgtagagaacgagtgaaagctctgcacccgccgccaggggcggtgggttgtcgacgatcatgtgctcgtcgtggatgtctgtccgatgatgaagatgacgaagatgacgaggatgatgacgagccacttggttccggggcagggttctgaggacgacgctcgggttcttgcgagcctcgtcgtcgtccatcgttgttttctcggcgtcgatctccatcgtcgtcgtcgtcgcggcgtcgacctcgacttgtatcgcccggcagccgctgctcgtgattagcatgttctcgacggttgtggcgatcatcacggtctcggtcctcgctcggacgtcctccttgctcttcgttctcgcgatgtcgcgaagagacgcgatgtcgggaacggttttcattatcttgagtgcgtcgtgcttctcggcagccattcagatggtcacggaaatcactgttgccgtgaggtggagggtagcttgacgaggcggagtccgctattcaggtaattctccgttagcatcgccgatcggcggttgttttggcggtaccctggtagcggcctcctcgaacgcgttattgagattaatcactgattcccatagtcgttccgccctgttaacgaccaaatttggtaatctgagtatcaaagataaagatcagatcgaagcggaatctaaatccaagattgtttcggaaacagagcaagaatcggctgaagtccgaatcggctgtgatcaggatcggcagagtccaagttggacagggttagccgattgagctggatccgacaatatgacgaagaatacgttgtcaggttgagttaataagcttcatgatgattgccacgcatggatagagtcctgagaaggcaattgtatctattaattaggatattttatgtaatttccttagagatatgtttgggcaaaagtctgccgcaaagacttatggtatcttagagtttgttagagataagtgtcgtgtccgatatggacatattttgtaatctcggatataaatagaccccgaaccccatgtaatcaacaacacacgttcaatacaacctcggcgcatcgccacccttttacttttgttttgtttcgacgagttcttgctttcgggttgagctgcatcagtttcgatcttcaacaagaggtaaaacttgttatggcggcttgcgttctcaggattagtgcttccatctttatgatactctaatcttgtttatgtaattcgtcgagttatcatatatcttatataatctctgacaatatcgctatctaatctccaatcggctaacgtttgttaccagaaggcagccgattaggttaaataccgacgttgacttagattatataagatatctaccactctatgaaacatccaacggcttgattgtctagatattgtccttcttttcatacttatagctgtatcagttgagtttgatcttataagtcgtgattagaatcctaatctctagcctgcttttggttgccgattagggtagcatcggggtttcagccgatcttaccttatttttatgcttgattgacatgttaaatatgccctttatgttaagatcttgtcgcatttaagtatattaggctgtttgtttggtatattctacttgccttaatatcttaatatagagtggtaccggagtattagccgatacatgctagatttatctgatcggctatgctatgaacatatatggtctcgttgttaatatatatttcgatctaagtgatttatactgtctcggcatggcgaccgatctatcccaatcacttgacttaagtatatatcgacataaggattatatattgttaatatctacagctgatcgagtagatttagttctttcttacatattaataactgccgatcgatgcacatatgacatcggctcaaagataaatgatatgtcatcggcaactagccgatcggctatcatttatagatttaaccgcggtttctttgtctttatttcttattgattgcaggatcaaatcaactggcatgctcatacatctaaagacaagcttttagacctgcactggagttaagcagatctcctaggcctcgtgtttttacatcaacacgcccactgatcgagatcagcgttcaggacaggatcaaaaggggtttccctcagtatcgcgttgagggttctgatgtgttgggctggtgtaatcaattgatcttccgtttctgcgccgcctctagatgtgctggtcccatcgatagcgtacacgtcgcgtggtgtacttgttgatgatgaggcttggtcttcgagcagatgtaggacatatggctcgaggggatcgatatcgattgccccgatgagtcgatctgaaatagtcgccgctccttgttccttgtccgcatctctagaagagattcgtgactgctggaccttaggaggtgacgtcctcatggcgctgagaaggaccttgcagcttgagaggtcgtgagtctttgccttgtgaatgggacaatagacatcacgagttggagaagtacattgaattccacgctctttgcaggcacggatttcagcttgtacgtcgaagaaaaccgaacaagcttgcaaggtgtgccttctggtcttgtggataggacaccaggtccttgtcgcctcggaagttatccttgttggctcatgcttcttatcaggaggacaagatttggccgcgttaggatccttctcaggcccagatgttgtcgatgttccgttctctgcttctgcgggaggatctttcgacatagagtcgaccggggtcgtaaccacgccgttctcgctcccggtaattgatgggccagtcgagatcggcatcgtggtgtagaccgggaagacaatttcgtcgacttgagtccacaccagcatcgttgaagttgaagctccttggttgatgccggggttgacgctatcgtcgagaaggcttgaagtcatagtagtagaaccttgagcaccaagtttccctacctggcgcgccactgtcgacgggggatacccgtagaccggatatagagggtattggggtccgttggtacgaggatctacgtaatacgacatcaagcaagtagaagacaaggattatactagttcaggccccttagtaggtaatagcccttgtcggtgacatggggctgggggtatcgtgactagaggcttgggtagccgcggtcacccacgtggcctgaccccctcgggggggtcgggcccgaggatgacatggccacccctccctctatctccccgatgggtcggaccgctcctgtttcggccccgagggatgggcgccccgaccccctgtggttttggcgccacgtgtgtgggttaggtgagcgcagcggggctcacctaaccgcatttatagtaggttggacgagtgcaccacgccgcatttaatgcggcgccgcgcacgcttatccggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgggaaggcaggcgagcggggcaggaggcatgtgctctgcttgtcagacgttacttccggctgtagactagccctcattgtaaaaagcatgtttcccttcttaggcagggaggggcccatgtggtgacccgggaccagagaaaaaggaggcccaggcctaggagaaaaaaggagggaaggagggggaatgggcgggagagcctgaactctctctcgctctccggctctctggattccttcacgcacagatccaccagaacacaggagtagggtgttacgcttctcagcggcccgaacctatctacgtcgcccgtgtcttgtgcatttcctctctcgctgacgttcttcagatcgagggcgaagaacctcacttagtgcccccggccgaaccggcaaaggggggcctgcgcggtctcccggtgaggagccccacgctccatcatctggcgcgccaggtagggggcgcgcgtgtctttctaagccctcgtcctctttcgtatgcgccaagcttctccggctcagcccaatggccgaacgggcagtggcgcacagcctctctccgaacgctagcggtgacgacgaggagcagaacccgtgccgtcgggctcgcaccccaccgtccccctctcgccgaaatcttgggcggggggaagcgctcggggaggtcgaaggatccgcgacttcgcctcccgcgggcgacgggggaggacggcgagacggggcgcgtcgccgcctcgtctacgacgatggcggcacgccccagggcgcgctccaggctgcgggcgcgctcctgcgtcacccgcccatcgtccccgatccagagactccagcccgacgttggctggatgacgtggccgacttggtcatgacggcgcagcagcgcctaagcgcctgcgggcggtcctccgccaccgaggcctctggcgcagccgccgccggctccatgtcgtcgaggcagagggcgcggcgagcggcggccgttacccgccgttcgtccgccattccctcgccaacgcctccgacccaagaagatgtgtgtggggggccggatgcccgcctcgatatcgagcgccggcgcgacgctcgtcgcgccgcccacgcaacggagggcgcttcctcgtccggagcgccacttcggtccgggcacgggggccggccccccgtgtccccggttggtggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtctactcttgggaggatttgtgccagcagttcaccacgaacttccagggcatatatccgcacccaggcgaagaagcggacttgcatgcggtacagcgaagggacgatgagtctcttcgctcgtacattcagcggttctgtcaagtccgcaacaccataccctgcattcccgcacacgcggtgatctacgctttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccctgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagtgccgtgagggcaagaccccggcggctcccgccggcaaccggcgaggtgaggccaagcagaaggccaccgccgaggacattgacgatggcgacgatgacctggggttccaggagcctgaggccaccgtcgccaccgtcgatgggggagcgtgcgctcacgcttctcgccggagcctcaaggccatgaagcgagagctcctggccgcggcccctacccatgaggcgacgcggcgggcgcggtagtcggaggttgccctcaccttcgaccacaccgaccacccgccgtgcgttgcccggggaggacagatcgcgatggtggtttcccccaccgtttgcaatgtgaagttggggcgtgtcctcatagatgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctggggaggcccacgttggtgaagttcatggcggcggtccactacgcctatctccagatgaagatgccgggccctggtggccccatcaccgtccatggcgacctcaaagtcgcgcttgcttgtatggagcagcgcgcggaccacctcgccgcggcgtccaagcccgcgggtggcgacgagaggctcgccacctccgtcccggccgccccaaggcagcggatggtcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcttggagaccggcggacatgcccggagtccccagggaggtgattgagcaccgtctcgccgtgcggtcgggcgcaaggccggtctggcagaaagtgcggcggcaggccccggaacgtcaagccttcatccgcgaggaggtagcgcgacttctggaggtcggtttcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcaggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggatggaggaggctgagcgggccttcactcagttgaaggcgtacctcagttctcccccagtcctggtcgccccggagccagatgagccgttgctactctacctggcggcaaccccgcaggtggtcagcgcggcgttggtcgtggagcgcgacgaggaaaaccctcactccgcgcatccccaccctgcgtcgactcgacccgggagagagcagggaggagaggcccccgagccgaacggcggcccaaggcccccgacggccggagctggccctccgcctgcttgtccgatggtgccaggcgcccccgacccccaggatggccccggggccactgcgggaaggccgcgcctgtcgccctctgacctcgaggtcgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctga

SEQ ID NO: 63244 - DNA, 3156 bp, Oryza sativa
accaaaagctggagcacacacgcgcacacagtagccactatcatcggataaaaaagagtgtctttgctaagttgctaggccacagggatgaatcagattcccacgatgtgttatccatctccctgatcatgactggacacttacaacctgatccacatgtgtgtatgcaccgcactgtgcaccaggtacccttgggattttgcttcagcttaatttcggtttgtagtctaacctctatgaagcaattggccaagctcttgtgattgatgtcttatctaccccaagcactgccttaatcattcattttgtcgaataatggttcccgtattaaaaacgtgcatatagtttggacttaatcgttaagctattcgttcctctcttttttgggttagtggaatgtgatctttgtgtcttatactttggtgccaagtatatatatattgctagttcacctggaagtttgcactttgcactttgaggacgtgctgtaaaatccctctcctgttttttgttgggaaaaatataaaagccactccaaatattatcttaggtttgagattcccttctataagacaatttgttgcaaatatctcttcctaattcccttggtttgagattctcccaattaaaccttgttgggcagtgtgatgagtctccatgcttgaacatcatggttatcgaaagatgggctgttgcgcttgcctcatgaggaagggcgactggtttctcagcaaagacgacgaaaataagttttggtgtgaagctgttttgttgagaaagatgtgctaaggcctggtttaattccctaatttttttttctaaaaacatcacatcgaatctttagacatgtatggagcattaaatatagattaaaaaaactaattgcacggttagagagggaattgcgatacgaattttttgagcctaattagtccatgattagctataggtgttacaataacctacatgtgctaatgacggattaattaggctcaaaggatttgtctcgcggtttccaggcgagttatgaaaaaaaattttcatttgtgtctaaaaatcccttctgacatccgggcaaacattcgatgtgacaccaaaaattttcttttcacgaattaaacggggcccagttatataacacatacagaaagaaggaaaaagaaagtgaacctagggaggaatctcaaactaaggtatagtttttcaaaaaaaaaagaaaagaaaaaagtttgcatcgtgggttttgacttctggcaacatctttgcaatggatgaaatttctcgttcattcgttgaatatctgtaaaatatttgcagcatcaaccagaaggagaagttcatggtttccccactaacaaaagagcagatgtgttggtcaacctgaaccccacgagttgacccaaagtatttccatgctcaacccaacccaacatgcaccaggatttcctctcccatcttcgcatgcgcaatctgcaattctccccctccttttttttcccatcaagatattgttcttgatttgttagttccagttttgtcttgcagccatcatgaggcttatcttcaaccatcatgtttttacataggatgcacaaaaaaggctagagcttcctggaggctccatcctctcttttgtaccctttgttgctgactttttggccctctaacctgcactactactgataccagttgcaaagctcttgcctccagtttacattgggccacgtgtgccaatgccttgtcactcctagtcagcacacttctcccactaaccagagaagtccaagcacaaaagttaaagcctctcaaatcgcgcgttccgtgcactatgcaacctcctaatccatctaaattatgcacaggcatcttcagtcataagcccgtaaccaattttgaattttagtatgacttaaaagttcttttcattattatttttgccactcaactttggttctagaagttagaacaacatggagtataaagtttatcataaaatccagttttaccaccaaactattttccactacttccattaagataagcagtcatcatcttcaatctctcttgggggtgatgaatgttgtgaaatcccatgaattccattcaaaactcaacaagggaacgcccgcaataaattcaaacagttttctgaatgcagcaaagccgcagcctcaaaaaaaaaaaacgccttgccatgcataaataaagtccaatggacacttaatatctgcacaggagatcagaggctcacgtcacccgatctgtcatgaggagccagagtcctttggtcctcagagcaagtttaatagtataccctattactagctctatagccaatctaataactaattcatacaatatttgcttactatactattaatatatggtcctacctgtcatacacatattgcgtcttagagttcatgctgctattctctttaatcttttactccctctgttttttaattgatgatgtcgctgactttttctcacatgtttgaccattcgtcttatttaaaaattttatgcaaatatataagatacaaatcacatttaaagtactatgagtgataaaacaactcataacaaaataaattataattacgtaaattttttaaataagacgatggtcaaacatataagaaaaagtcaatggtatcatctattaaaaaacaaaacggggtagtatttcattaagggggtgtttagatggggctaaaactttttagtccgtgtcacatcgaatgtttgacgctaatttggagtattaaacatagactaataaaaaaactaattttataaatgaaagctaatctgcgagacgaattttttaatcctaattaatctataattatgaaaagtttactgaagcatcacattgtcaaatcatggtgtaattagactcaaaagattcgtctcgcgaattagccaaagggtatagaatatgttttataattagtgtatgtttaatacctctaaattggtgtataaacatccgatatgataagtcctgtttcccaaacagaccttaaaatatacatgctctcaccggcgagaacacccgtcacccgtgccgtcgtccaattattgggcccgtgtcccgtcagaaatcccgcacgccacgccagagagaaccccaagccgccacccgcgcgt

SEQ ID NO: 63245 - DNA, 658 bp, Oryza sativa
atccactcctccaccatctcctcctcctcctcatccccacgctcgccgccgccgccgccgccggcacacctctccttggacagcatcagcgcgaggtactcatcgtcccggtccatgagcaacacatggtcgtcgtcagcaatggataactcccagtcgccgccgctgccgccgccgccatcgtcgtcggcggggtcggcggagaagaggtcgttgccatcctcccggcagatgagcgtggacgtgggcgtcgcgggcgcggaggtggatgcccaggcgtcccccatggtcggcgtcacagcccgccgcgcatgcagaagaagaagaaaaaggaaagaatcgagaaaagggaggcagaaatccaccgggacgaaaaggcggcgtgcgggtagcgggcgatcgaggcggccggaacagaaagggatcgattcccaccacctcctccgccgcctccgcctcgtgccgtgcctccccccaccacccgcgcgcgcgttgaaaggggagggaaatctgcagttagagagagagagcgaaggaaaggggtggactgattcaggactggattggaatagagagagagagagagagagagagagatacaggtgtgtgcgtggaggagtggccgcgtgggggggttggatggtggtggatggagaag

SEQ ID NO: 63246 - DNA, 46869 bp, Oryza sativa
  unsure (1)..(46869): unsure at all n locations
atcatattataatgattataataagctgggaaccagattataataaactacttcaataagttgtctattttttcagcttactctaaataatttggattataataattccaatccgaaagaagcagtgcctaaaacagggcagagtttcgcttgggtgttgctctcgtccgtcactttgtccaattgtccatcattggtacgcttgctcccccaggctcctgccagttgcttctctttgtccggccggtgtcaccgctgcatgcgtcggcgacacgatcgagcccgtgtgatagatatattaggcactgggcagcgtggcaaggtaataattaacgatttaatagcaaatatatagattgtggattgcggtcgctataatttgtataaaattacctgtgtcaaaataatatgtttcgctgctgtttatcgaatttttagtggaaaaagttttcaccgctgtagtaccaatcattactgagaaaatatattaagttgtcctaagatatcgcattagtgacaattatgtagtgataaaatactccctctgtttcacaatgtaagggattctaacattttccacgttcataatgatgttaatgaatctagacatatcaatctagatttattaatatcaatataaatatggaaaatgctagaatgacttacactgtgaaacggagaaataatatttttgccactacattgtatttattagtgggagaacattgtatcaggaggcctcatcaatgatgaatttattgtggcgaatcctttcagtgctaccctttaattcatcatatttgttgttttacttgcgacagatctttgggctcctatcttttactttttcattcgaagattttaatttgcatcaagatttgtttttttatatgtaacatagcacttattcagttacagtgcacttacacttggttaattacagtgcataagagtaaaattttacaacagtttttctttagattttaagatttttaacatgtttatctctttttggttattttattgaaaacgggctatatccattagttaaaaatttgcaagattcaaagcaataaacttatcgaaagattaataggtagtcccttaatttataattagtgatcatttgctatattgttgtagtaatatctagttgtgacaaactcatacggcgctaattcattttttgagttggaaaatttcatgtcacccgtgggtctgtttggtttgctatgttatcatgtctgtttggttctaaggaataagactgtgtttagttcgtgtgctaaaatttttgtgaagtatacggacacatatttgaagtattaaacgtagactaatagcaaaacaaattacagattctgcctgtaaactgtgagatgaatttattaagactaattaatccatcattagcaaatgtttactgtagcatcacattgtcaagtcatgacgtaattagactcaaaagattcatctcgcaatttacatacaaactgtgcaattggttttttatcacatttgatacttcatgcatgtgtccaaatatttgatgtgacggaaatgttggaagtttggccaaaaatttttgactctaaacacggccttagtcaatttttcctcccgattgaatcatcttcctcaaccacaaaatcggtctcccattttcgaaaacaagggcaaatgaataaaagcagtttctattgacgtggcaagttgaccgtagctaacccgctgagttagcaagtggaacccacatgtctggctcacatgtaagcctctcaagggaaaaatctgtagggtccacatgccatctgtatccactttcctccccttcctctctattctcttttttttttctccatcgctcttatgggcaatggagaaagggcaagacggcgaagggcagtgaagcagaggacgcgggcggcgcgacggcgtaatctgagacattgtcgcgtgcaaccatgcctcttttcctccgctaccgcaggaaagaaggcgccaggcggaaacggcggtggtggacggcacgacagcgcggaatccgagatatcgccgcgcacctggctccatatgaatcagagaagacagaatataagcaaggacattagtaaagaagaatggtgctaaaaaatctgagttcagcaaagaagaatgtttcatcacttgtggctctgagctttgccacagcttcctctagagagactgggatgttcagagttcatcagacaggaaggtgttggtacctgcctagctacacatactgctcccggacctcctcccttagcggcatcctctcggctctcgccgttctggctctcacagtggatagagcggcttcaaagctacggatagaagtggggtacttggttgggtcgaacaggtctgctactcacggtggtggcatctgcgccgatcgttgagccatcctgcagcacgatcgccagcaggccgaggcagagctcggccttctacgcaccgaggagggcggcgttgatgaccagccacgccgaccggggtctgctccgactccgagatccccgatgtgagcgcgtcgggggcgcgcgcactcgggcgcctcgatggtgtagaacggcacggcgaagaacgcgaactgcggatgcaccgccggtccgccgcgttgtaaatgtggcgcggaggacacgcagtggcggtgagccggcgagcccatgagcgtggagttcccaggtgagttgaagcattgggctctgttggccctggaaccgtggctgatgctcccatgccttcttctcttcagacagtggccatcctgaaatcatcagggaagggtagagattgattaagagaggtggctgacctgtgggtcccacttgctgattcaacaagtcaatttgccatgtcagcataatcaaccatttaaggagtcgatttacaccagttttaaaaaacaggagagacatcacttatacctgattttgtagttgagggagacgatccaatcaagagcagttgagagagaaaaatagacttatctaatattctaaagctgacgggttttcatgcaaaaatgcgcgccacgtggtacaaatagtcgaacgacgcgtgttccatgcaccatcgtgcgctcaagccccgcgtcgcgcacatgtgagtaggggtgaaactgaaaacggtacggaaactttccggattacggacctatttttagaaacggaatatgtcgcttggaattttttcagaattattcggaaacggaagagaaattggaaatattttctcagaaacaggatcggaaatgataatggcagtttccgtcggaactcggaattggtcggaaactttccggaaatttctcggaatttctagaaattttgtgactgaaataccctgtactcttttttttaagcactgaacagtaaataccatagtgtttggcttttatttttttgaaaaaatattttttatgcaaatctgaagttgcataagaatattttctttgtgcattgagatttatcaatagcattactctcttaagcatagataatttatttcatagattgtgttttgtgatgcccttttgagacttaacaattggacttatatgattgtgttttatgatgaattgttgaccgttgagacttgagaattggatttatcagtttgaagggtttctgtattccgataaattttcgttcccgtattcgcgccggttcattttcgctccgttttcggtttcgataatattcgattccgttttcgtatccggggtttccgattccgattcgaaaataatatgaaaacaaaaacgataaagatggtttccgtctatttccgtaccgttttcatccctacgtgttgtgcgagccgaactggccatttgggctgcagcttggctggcccaacaacagagggaaggcgcagggccagtttccttaggccctccccatttcctttttgttttccttctcattcttttcttttgttatttcactcctccatgttctaaaatttaatttatattatgaagaataccacaactcatggtaagtaaaaaaaaatataatcataaaataatctgaataaacaaataggtatgtactttacatatagccacggtctaatggaagaataatcaaatgtagtaaatcttttgtttaacttatgtaacaaatatttattaccctaccaaactttgaaataccaatctcctcatcttatgataaaaaatgttggcatcttatgataaaaaatgttggcatcaaataccaatctcctagatcactaatttcatatgtatgcatcatatcctttttaaattattgcatcatcttctcactattgccagtatatatcaaatcatcaagataaagtgagacgattaggggcctgttcactttgatgccattttcaaccttaccaaattttgataaagttaccaaaaaagtggttacatttagtttactactaaattttggtaactatataagaaatcctgccaaaattttggcaagttggaattgccaaaatttggtaagttttttttttttttgcatcaaagtgaacagaccctagaatatccgtacctgttttcttgacatatagagtaggctcacttatgctcttggcaaattatttatgaataaagtacttgtcaatttgattataccacgctcgaggcgcttactttaatccatataatgcctttttaagtatgaataccttgttttctcccccttgaactgaaaacccttcaggttgttcaacatagatttcttcatcaagatagccatttaagaaagccgatttaacatcaagttgatatatattccatctcttttgagctgctagagcaattattgtgcgaattgtctctagcatggcaataggagcatatgtctcataataatcaatctcaggcttttgcttaaagccttttgccacaagtcttgccttatatttctgaactgagccatctggatttaattttgtcttataaacccatttaaatctaataacttctctgtctctaggacgatcagccaactccaaggtattatttttctcaatcatataaatctcatcttccatggcctttatccaattatcatgtttttctgcttcttgaaaactttgtggctcaacaacagaatagttgcaaaattcatgttgttctgacctccttatttgagaagtagattctaataaatcaaccatacttcttacccgtcttggagctgattccggtgtagaaatttgctcttcactgctcgggcttgaatctaaactagcacttgagcttgaccttggactttatgactgtggacttggagtatgatattccacttcatcactcatatgtggttggcttagcgtgatggtagtggttggcaataatggagtactagaagcttctggagacttccagttccatgtagcactctcataaaaaatcacatctctgctgataataattttctttttctccagattataaagtctatagcctttgataccatcggcatagccaacaaatttgcaacgatcacttttattatcaaagtttactctcttttgtgctggcacttgagtatagcaaatgcaaccaaatattctcatatgaccaatgacaggctttttaccataccaagcttcaaaaggtgtacgatttggtactgcctttgtaggacttatatttaaaatataaactgcagtgttaactgcttcagcccagaaagatttaggcatacctttgtcttgaagcatagaattggccatatcattgatcgtccgatttttcctttctgcactccattttgttgagcactatagcctgcgttcactgtcttcggatgccagcattttcacaatatttctcaaattcttttgagatatattctcttccttgatcgtcgcgcaatactttaatttttcgattactctgattttccaccatggccttgaaatttttaaatgtctccagggctgcagactgttcttttagaaaataaacccagatcattcttgtataatcatcgataaatgtgataaagtaccaatttcctccttctgaaattgttggtactttactaactatatcagtatgcactagttccaatggtgcacttgctctccaagctccactgtgtgggaaagaagctcgaatttgttttccaaatacacaaccttcacatgggtcatatttcagagtaataaatggaaggccttgaaccataccttttgttctgagtagcttcaatgctctgtaattaagatgacccattctcttgtaccatagatcaaaaatatcgacttcacttctgagagccatttgagttggatgattcatccttaatagaaaatttctgttcttctccatatttattttggcaaccagacattatttttacggtctaatattttgcaagaaaaatcctcaaaataaagtgcgtacccgtgttctagaatctgcccaatacttagcaaatttttctttaaatcgggtacaagcaagacatcttttataaattttggatcgtctgctgtttgaacagcaactgtacctttgccttcactttgggctatagagccattacccatgtgaatctttgcatgatacgatgagtccatttctcgaaataaatttggatcaactgccatgtggtttgtaaaaccactgtcaataacccaaacatcatccttttcttcttgagcagtatggcaagagaaaaccatttcttcagatttttccttttcttctgaaaaattagcccgattaatttctcgggttctgcaatattttgcaatatgactctttctttttcacttattgcatgtcattttcttccggcacatatctgtagtatgactagatttttggcaaatgtcacaccacaaatttgaattggacgtacctttttctcttctctcttgaccatcttccttctgcatgttcagcttggaaaaaccgttttttctgaaaaccacggtctcgcattggaaatccatttttctgaaaattcccgcgaaacctttgagatctgaagctcaactttgactgaaatgcattttcaacggagctcccttcacatggaagctttctttcttcatgagattacaacaagctcattagttgttgaattgtgagagttgacagatctttggactcctcaatagcagccacaatgtactcatatttttcaggtagactgattaaaattttctccacgaccttttggtcgtttatatcttcaccatagaggcgcatctaattaacgatctcaataactcttgagaaatagtcttttaccttctctgactccttcatttgcaaattctgaaattgccttctcaaagtttgaagcttcactgcaagtaccttctgagatccttaaaactcctccttcaacttgtcccatgcttccttagatttcttggcgccaataatacgcggaaatagactttccgcaactccttgttggatcaataacaaggccttggcgtccatcatccgatcctctgccaaagattttttctgttccgccgtaagagtttctccagcaaaatactccctgtaaccattctcaacaatatcccacaatccttaagatagtagcagcgtccgcatcttgatgctccatatatcataattaattttctctaacaaatataggaaccatggactgtgccattgtggcgccctaacttgaagctatacttgtagcttcaattgagaataccgatacgccgcgctactccatcacaccctactcgaacctgggcgctctgataccagttgttggtgttgattattttgctaagaagggaaccaagacgaggagcagagaagcttgtgcttgttttaagtgtttcttttacttgctttgcttgagggctgaacagtacacttggttgtacgttgggcagcacatcatcaggcacatacacaagcattggctgcctatttataggcttacaaccaacgttacttgaagcttcatgaacctagtagaattagtactactggctgcctagtattactgcacattgatggatagaactacactaatctagaacctttttttttttgaccggggcactaatctagaaccttttactgagtagtagtagcactggtcttttgaccataggttctagagtaattgagaagaataagatgtctagaaaattcaggaaatggattaacatcaacaccctcggcgttccacccccgccgtgccctgtcgatcatccgctctagcaccggcgcagcgacgaagggatgcgccgcgatcttcttcccgtctgacgtgacgagctgcacgtcggccaccaccgccggccggagcgcgtccagatcaacaaattctcctcgctcacgatcaacaacaattcaataggctggttaaccaagaaagaagaggaggggagtgggatgacacgtgggccccaccattttatattattatttgtgtgtagctggcatgtgggcccacggattatattatttttcggatcaaaatgctacgtaagcgctatgtcaatgctatgtgggacgaagaactagtcaaaacagccatgtaagcgccatgtcagccaaaaccgccttccaaacgtcgagggacctcgtttgcaccggttttgatacttcagggaccggttgtgtcgacggggatacccgtagaccggatatagagggtattggagtacgctggtacgaggatctacatagtacgacatcaagcaaacaggaaaaaaggattatactggttcatgccccttgataggtaatagccctaatccagttgatatgggattatataatagaaaccacagattacaaagggaatagcagaactcgatgataccgacgagaccgtagtcgagttggttcgactagatcatcccggcgacttagctcctgtaggctccgacttcataggctgtggtggttgtattggctgtgacattcgattccttaggtcctcccggggggtcccttttataccgcgggtcagttggtctccaagtagaactcgaagacatcggaccccacacgatacagtaacgacccagttttgtccgagtaggactccttccatccgtagactctatttctgttacgtgatgaatttccttaacgtatacaagaaacatccgtatacgcgcaggtataccatatcagtatacaacgtatatccaagggtagagggtatatccaatccgtaaccctgacagtagcccccgacttctgcttaaatgaactcatgtaaccgatcgcgacttctgatgtcggggtcgttgtcgttgtcaactggtcgatctcggtgtgagaaccgtagagacaaggagtaatcaacaacaccatgtgaagttcaacggtcatgagtgaatttaaattaaagtccgaaaactgttgcgcttaacggacccagaaatttccggcggccatctctctcctttccttggaattcgcaccgtcggtagtgcgtttatttaagggagttttggggatccattttgaagtctgcttgctgcagaaaactttctaacctccaagcgctcctcgtcttctccactcccgcaaaaaaccctagcttgctcatctcagtcccttctccggtgatctccagcggcaatggatctcgacaagtccacttctgccagcgcgtccctaaagaagctgcaggaggacggtactctccctggttgcgggaccatggagagagaaccaggaggtattgaacccaaacctgtcctaggccgcatggttgcggttgaggattatattctttgcggttttcttcccccgccctccgagtttcttcttctcgtcttgaatttctacagcctttccttgctccatctgaaccccaattccatcgccttcctcagtattttctcgtatctttgtgaggcctacattggggtagagccgtttcttgatctcttccgcttctactatgagttgcgctagatggaacctaaaaaggtgtccggatgtgtcggtttccgacttcgagatggcctgaagtcgcgatacatccccttctagtgcccctcttctcgtagcaaatggcgggcgaggtggttctatcttcagatagaaaattcggatccagtctttgttgttcctgagaagcaaccagacaagatcccagaatggaccgccaagcccaccctaactccctcccttcagtctttcatcgatatcatcgatgacctccgagtacgagggttgtcgggatatgaagtcgctgccgacttcatcggtaggtggatccaaccgctccaggcccgagtccacccagcctttgacaattctgggccggaggacgcgacccggatttctcctcggggtatttttcttgtatttcagatttcattcttcatgtgcatgttcctccggacttatcgagttctggttctcgatcctacaggtttaaacagcgaaactgtggagcgccgcgttggtcaggtgatgatcagcagccctacgacggcgagcaacgtccccgtccccctttgcgagaaggggaaggccgatcgtgaggctgcgatcaatgtgagtgtatttgaggactcctttacttctgcttctctgggatcgcattgtgacttcatgtatgcaggctcttcctctgaccgacgtcatcgggccgctcgcggaccaccaggcggcggcgtcgttaaaggagggcgtcgccaaggaggcatccgacattgctgctgctgctgccacgacgagtggcaccaacgttccgaagagagggaggaagttctccgccgtgctcgggactcgtcggaaggcgcccattgtcacatcctgattttcgtttcaggatttataaattatttaataaattatttatagaatttatattaaatgttcattaatttacaagtgaagttaaatgtgggaaataaaattttctaaatataaagaatggttggatttattttttattaaattctccatgattaattatactctctggaattttctcggatttttcagagctcaattcttaattttaataatacaaagaacagtttagcaattatttaaataataaattaatctttaaatgatctggatattattatgttaaatactttgagtgtccaagtatgttcaagatttttcttggaattatttgagcattggaagtatttttaacaattgaaagatcatctcattggttaatttatttggaaaagtaataaaagtcgtcctcatcagcttgggccgaattcagcccattctctcctattctctctcccttcctctcagcccgcagagaagtctgtttgacctccctggtgctacagtgctccttcttccagctcaggcagagcccgagctctccagcccgtgcacagtgccgccgcctcctcccaccaatccgacctccccgttgctcctatttccaaattagttgcgggaatggaatcctctcaatctcctcttccttttccccaagaaatcctcaaaagtttctatggaaatcctttccaatttcgcggttcaatcttacctttttccggcgagaaccctagactttcccgagtttttcccgtcgttgtgggctcgatcccggcctcccatggctatatatagagccccctccttcccctctttctgccgccacctctccctctctccgccgtcgccggaaacactcttcccgcgactccctctctctccacctccggccgccgctccagccgccgtgcgccgtcgccccggccgtcgccggtcagcgccgccacttccctcggctccgcaaagtcgagctctaccccggctattggttcctttgtgccaaaaaccgccggaagccgcttgccgacgcgaaccagaaggtttcggccattgccgagcttccagccgcagctagcagccgccttagctgccgctttcggtcgccgtcgactctattgggttctcaggagcatggtgaagcccggccactggtttttcttcgccgaagatcgctgaaacgtcgccgccatcgctgacccgaccccgtcgccgcctctacctcgctgccggccgtctgccgtcatcatccatcgtcgcgccgcccctcagtgagctttcctctctccgatgtcgttcatcggtgtggtttatccatagggttttaatccaatctaatctaatttggccctaatgtcgtcatcgtcttcatgtgttgtcgccagaaaatcgtcgccgcagtggatagtacctcgccgcccttcgaagctcgtcgccggccatcttccgtcgctgtccgtcgtcgcgtaagtgttggtaagaatcgacgtcgccttctctacctcccggtgccctccgtttgcattattgtgccgtggttcgccgacaaccgccgctcctatgcctttcacctgtgagcttttccttaatccaatctaacctaatccgctgtctgtctagcgtagtcgtcgtctccgtgtgttgccgccgggtagccattgtcatctctccctctccgatcattttggttcggtgacacttctattcgtgttccctcggtttagtttttaatctctcgtttgtgtcgtcgagtagccgctgcctagccgagccaagtcgccctagtgccgccgtgtcgcagctgtgtgccgctttaacctagccgccgctttaaccgtttgtccgtagtcaagttgtctagccgtaggtgcatccctaaattcctaccggcatatcgtttgccgtaccagggctttaccgtgaatagtgtctagcttaccggtttagccgtagccgttgttgagtcgttcgctcgttcgtttcaacgaggtgtccccggtgcttcgtttgttcgtccgtgtggagtcgtcctttagtttagagccgttcagagccgccggttccgttcgccggtttcggttgatcatttgggtgatcccgtgtcacgtagaattgactcgttaagtcggtatctcatgaggctcgcttgccagatcaatctaatccgttgaatcttggtcaactctcggtcaagattaatctcagccgtcaaaaattgatataaatccgttctctcttttcagtggcatattatttctttttaatatatgtcatccaccaaatatgatctaatctttttcggaggttgttttaatcttttgtctcagttataaatcatttgtaaatggtttaactaatttggaatagtcttttctttaataggtttaattggaattagatcttgtaaaatttgtaattaattcatatgaaatcggaatgagaccgttcaggtctctaaatttatctaaaatcatgatctacatgtttgtttactttatatgtattgtttatttggttttattagtctttttcctcattttgcgtgttagcttgtcgtttctgtcgtttcgaaggatcgtgagtgcgtcggaagtgttcaagaagattaattgaagaccgattattgcaaggcaaatcatacagatcccaaacacgattcctttgagcatgttgatcatatatttaaattctctatttatttcaactgcgcatttatttttgaatgtcactgggtggtgtgaacttattcctttgttatgaccaatttgcattgattaccctatttcttgattaccttgggttattataatttgactagttgagctttatatattggttcagctagatgttagacataattgcttagccatgcttagaaacattagcacaccattgggataactaatgtttcactattacttaatggtgatatttaatgatagctcacgatggttaatcgttattggttaattaattaatttgctaactaaaacttgataatggtgggttgtgagcacatggttttgatagtcgtgctcatgacaattaaggaccggttcacgagtttcggttgtgaaacattaaccgtgccaaccaaaagccagagtgggcaacggctggacactttgtataacaaggctcattgcagagcaccagactgagaagtggcggagataagcccacgggggtcgctggggagtccatgcctctggtttttgagggggtgactatgatccaggaaaggtgcgctgctttgagttgagttatgcgaggggtcttgtcacaactacacaaatggtgacatgttcagcatgggcacatgatgatatggtgacatgacggtgggttgtgtctcgtgggtacagtggtacacctctagcgagagtaaaactattcgaatagccgtgcccgcggttatgggcgggtcgaacaatgtttttcgtgattagtcccacactactcattaataataatgtggtaattgatggtaattaatttagctcctggtttggaatggtatattcctggtttggagatagtaatgtgatgccgggtatggttgttcaggatggttgggcctgtgcagcatgggtatgttgttctgtgttgattaatattgatgattaattactctactgttttacaactctcaattgtttgctaaatgctgcttttgcaaatgagccctatattatgccatcatttggtatccttgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagctgaagccgtcgctagacgttaattccgctgcagttttcttttcttttgtaagtatgtaacgttgtattattgatgattctgtatattaaattgtcagtttgtgtacctcggctgattcctggatgacgatttaatgcacaaataagttcggaaattactagtgaatttctgggcgtgacacctaccccatcggtaagcctctcttgtcctttaacgcgtagtcggaaaatcttgacctcacaccatgcttatcttacttaggcctcaaacgcgtctcccccgcctcagcgacggcaaaggcttgtgatgcttggcgaaaagtaagtagatgaatttgaggtcttccaatttacaaaactttggtagcctgactttatgaaaatcacggggcggcgcgggcgaaggcggcgcaagatgggtctggagcagcctctagtgcgtctcctgcagcagcctcgacagatgttgtggtcgtgcccagggactgggaggcgatgcccagcggccctgccggtggccttgtgcctgctcggggcccacccgctgacgtcctcacctggggggagctccaagctgagatggagcgcatcctccaggccggcgctcgcagcataggacgcgagatcgaggaggccaaggctgcggcggcggcgtcggcgaatgaacgcgccgacaagctagcacatgacctggtggaggtccgcgaggacttccagaaaatgagggagctggtggccgaaaacgagaggcagcggcaggggcttgagcaccgcatgtcggagctcgagaacaacttgttggagatccgtggctcgctgcgagtcacctacactggcatgcaccagctcgccggggagtgcggcgtcacgaccaccatcccggcgaaccccgatgagttctcactgacgtcttcactcgcggaactagccacggcgatggaggagatcccctccaagcatgcggccaggatcggggacgagacgtccaacgggatctacacctgggcatgccacgtcctcgcgtgcgtaaggttggcgcaccctgatctcgacctcctgaggatcttggatcagggggctgctaatgacgcgtgtaagggcatgatggaagaagtcagtgacttgggggagtctgttctccccctttttgaagggtaggatttcagtccccttgtactccttaatcaattgtgcttgtaaaactttcgtaggttcaaactgtctttgtgtgtgcagtcatcaccttcgctttctttagcatattgatcccgagtactttgttgtcgttgtagagatgtcgatgtcgatgtcgaggatgtccagcagcgcgggcagcctgagtcgccggtagtcgttccggcacttgcgctcaagccgtatgtgccgcgggacgacgttgatcaaaacttgtccgtggaggcgggcatggcgacgacttccttaggttggtactttggtcctcatctcctttgctctttttgttcggatcgacttaatttgccgtgttctcggaagaggggaacgacttgacttagtcatttccatattgagcagacctcgagagtgcattggccgaccgagatcatcgaatccaatattggaggacgaaattcgaggtggccgaactcgagaggactatggtgcaagtcaaaaaggaccaagccgtggaagcactacgaggtcgcgaggtgtggttcgactcgtaccttaggagctgttatacggccatggccggagtctgtagggatctccgagtacctcgcgggaatcccgagtcggcggccgaatacatctcgtggttgaatggggcctgctctcagcttgaaggcatcggcaagtgtatcgacgaggccctgaagcaggagtgtcgtcgatcgagccgatatgctggagggcacgtgctagcctgtatccgagatcactgcccgcagctacacctcgagttcctccacgaagggttttcacattctcggaggactcccgcagagagagatgatctggcgaagtcgatggcgccgcttgcagagaaagtcttccagtccctggactggcgttggccttcctggtagtctttatatcctgtgacaaatatctcaaggagacatgtaatatattttggaatatttacgaattgtaagaagtacttgtgaaatagaaaagaaatctatctaactaagttttcttactctggatgcgttgtgtatgagtgttttctcacttcgcgacttcgattagtcacttgagtcatacactctccctagcccccagccttgtcatcggagaattgttctcggaagataaggctcttggacctttgacctgcctcggttgaacaagcactgatcctagcccccagccgtgaagttggaaaacccaatttccgattacacggcttggttaatacgcacggcgagaactcttacacgaccaaatcttacatggtcttttgtctcttcatgatccgacaaggccttatctgctctgggcgtccccagccgaagttcccttaggttcctcggaggccttgtcaagacggcgtaaagggacctgaggataggtttcaacgctaggtgtcatcgtggtaagggatcgtcaggaaggaacactttgattgtgatctttacctgaaaacaaactttattgaagctgtaagatgttttacaagtatggatactattgatttatacatagaatttacgtaattgatcaatgttccaagaatttgctaactcgcgaccatcgccgtctgcaatcttgaatgcacctggccacaagacttgcgtgatcgtgtacggtccttcccacttgggtgagagcttgttacgccctgcttggctttgaacccgtcgaaggacgtagtcgccgatcgaaagtgtgcgtgctctgatgcgcttctcgtggtatcggcaaagggcctgttggtagcgggctgctctgacgacgactctttctcgatgttccttgagtagatttacgtcgtcgtttcgccgctcctcctggtcctcgtcggagtacttctatactcgtgtactctgatgtcgtatctcagtggggagcatagcctttgagccgtacacgaggaagaagggtgtctccttgttggaagttgtcggtctggtatgcatggcccatagtacagaggggagttcttcaacccacttcttgtcatgtgatatcagtctgtcatagacacgggtcttgattccttgtagtactatgccgtttgccctctcgacctatccattgctctgagggtgagaaaccgaagcgaagcagatcttgactcccagcccaatgcaataatctttgaagtcggcactaatgaactgggagccgttgtccgttatgatgcagtgaggcaatccatatctgcagaatatccctttaatgaatttgatggcgttgtcggccttgatttcccccgtgggtgtagcttcaatccacttggtgaatttgtcgaacgccacgaataggaatttgtggccgccctgtcctcatgggaatggtccgagtatgtcgagcccccagcacgagaacggccaagtaagagggatagtctggagcgcttgcgctggtagctttgtgtgtttactacgaaattgacaggcttcacaccgttgtaccatgtcgcaagcatctttgagtgcagtcggctagaaaaacccttgttgaaaagctttttttgaccaatgtgcgaccggcggcgtgtgacccacagatcccttcgtgtatgtcgagtaggagatgtttgccgtcgtcggacgagacgcatttgagaagtaccccgtttggcgccttcttgtatagatcattgccgatcatatagtagattttggcttgacgggttattttctcggcctctgtatcgtcctcgggcaacttatcgctacctaggaatttaatgagtgggatccgccagtcgtctgtggtttctatgtcggcaacggcgcgttctgcatctgtagcccccgagctaatgtcggggactaccacgctatcttcatcgtttgcctctttcaccgatggctttgtcaggacgtccaggaaggtgccgggttcgagtggctctcgtttagacgcacgccgtgtcaggtcgtctggttcgatgttgtccttgcggtatgtgtgccggacctcgattccatcaaaccttttttccagcttcctgacttctgcgaggtacttagataactcggggctagagcacttgtagtctttgtgcacctggtttgcgactagttcggaatcctctttcacgatcagtcgcttgactccaagtgaggctgctgctcttatcctagcgagtagtccttcgcattcggctgtgttgttggtcgccctgaagttgaggtgaattgcatgcttgaactgatctcccgaaggtgatgtcaagatgaaccctgcccctgctccttcactgttgagtgcgccgtcgaacgccattgtccatgtttcgctgtcggtttgactgtccgacctgttttcgggcatagtccagtcagctacgaaatcagcggggacttgggacttgatggctgttcgtggcacaaagtggacatcaaactggcttagctcgactacccatttcggaatgcggccgacaacgtccttgtttctcacgacttcaccaagtgggaaggaggaaacaactgtgactctgtgggcttgaaagtagtggcgcaacatcttgatgtcatgattactgcatagagcagcttttagatctgtgtgtatcttgtctttgcatcgtggagagcttcgctgacgtaataaactggtctttgcaccttctctctctcgacaacaatgatggtactcacagaatatggcatggtggcgatatagaggaataattcttcattagattgggtagcaacaagtagagggggatttgacaggtagcgcttgagtgcgatgaacgcctcttcggcttcctgtgtctatacaaatttgtcttgtttcttcagcagagcgaagaaaggttgtcctcgttctcccatcctagcgacgaacctgctcagtgccgccatgcatccagttagcttctggacttccttgagtcttgtgggcgacttcatgttctcgattgccttgattttctcgggatttgcttcgatccctcgtccaaagacaaggaacccgagcaacttgcccgatggtactccgaacgtgcacttctctggattgagcatgaggcgatatcgtcggaggttgtcgaacgtttcccggagatggtccatcaatgagtcgcttgtcttggtcttgacaacaatgtcatcggcgtaggcctcgatattgttcccaagctgatcgttaagtgccccttggaccgtgcgttggaaagtgtttcctgcggttatcagtccaaatggcatcttaacataacagaatacaccgaacggcgtgatgaatactgtcttctcctcgtcctctttcgccatgctgatctggtggtagctggagtaggcgtcaagaaagcttaacaactcacaaccagctgctgagtccaccaattggtctattcaaggaagagggaagtgattcttgggacacgccttgttaaggtcggtgaagtcgacacacatcctccacttcccgttggccagtatcgcctggcatccgttgttcgcgatcatcgcgttcgtgacggctgtggcggttatcacggtctcggttctcgctcgggtgccctcctcgctcttcgttttctcgacgtcgtgaagagacgcgatgtcgggaacgatttttgttgtctcgcgcatgtcgtgcttctcggcggccattcaaatggtcacggagatcactggtgccgtgaggtggaggagtggcttgtcgaggtgatgtccgctgctcaggtggttcgccattggcaacgccagctggcggttgttctggctgtgctccggcagcggcctcctcgaacgcgttactgagattagccactgactcccgtagtcgttctgtccaccgtgcgagatcatcgttcagaacgggatcataaggggtttccctcggtattgcgttgatggcctcgatgtgctgggccggtgtagccacttgattctccgcttctgcgttagcgcgtgtagacgtgctagtcccaccgatagcaaacacatcacgtggtgtactcgtcaacgatgagccctggtcttcgagcaagtgtagaacttacggctcatggggatcgatgtcgattaccccaacgaatcggtctgagataactgtcaccccttcttccttgtccgcgcatctaagagggattggcaggcacgaatctcagcttgtacatcgagaaaaacccagcaagcttgcaaggtgtgtttcctggttttgtggatagaacaccaagaccttgtcgcctcggaagttgtccttgccggctcgtgattctcgtcggaaggacaagatttggccgcacaaggatccttctcaggctcggatgtcgtcgatgttccgttctccacttctgcgggaggatccttcgacatggagtcgcccagggttgtaaccacggcattctcgcttccggtcattgatggaccagtcgagatcgacaccgtggtgtaaaccgggaagacgatttcgccgacttgagtccacaccagcattgttgaagtagaaactccttggcttgtgccggggttgacgctgttgtcgacgaagcttgattacatagtagtagaaccttgagcaccaagtccccctacctggcgcgccacagtcgacgggggatacccgtaaaccggatatagagggtattggggtacgctggtacgaggatctacgtagtacgacatcaagcaaacaggaaacaaggattatactggttcaggccccttgataggtaatagcccttatctagttgatatgggattatataatggaaaccaaagattacaaagggaatagcagaactcgataataccgacgagactgtagtcgagttggttcgactagatcaccccggcgacttggctcctgtaggctccgacttcgtaggctgtggtggttgtattggctgtgagattcgattccttaggtcctctcgggggttccttttattccgcgggtcagttggtctccaagtagaactcggaggcatcggaccccacacgatacagtaacgacccagttctgtccgagtaggactccttccatccgtagactctgtttctgctacgtgatgaatttccttaacgtataccggaaacatccttatacgcgcaggtataccacatcagtatacaacgtatatccaagggtagagggtataccctatccgtaaccctgacaggttgtacctggttttgtggttcaaggacgaaaatcgaattcggtgtagagtcaagggacgttagatgaacttattcctacttaaaataaaccggtttctagtggaaaaagtacaccgaaggtctctcaacttgtcatcgaattacaaactcgtaccctaaccgtcaaaccggatacaacgcatccctcaacttacaaaactcatgcaaacaagctccctcagcagtttagactccggttttttccgacctggcagctgtctcaccgtgagacccacatgggccccacacgtcagggtgtccacgtcagcacctactctctttttcccctcttctctttctctcgctctgttctcgcatggggacggcgctagggccgccgcccacaacggcgcgcgcggtcgaagggtggtgcggccggcggctcccgggtggcagcgcgttggctcagggtggcgcgagctcgccggcctccccgctcccctcgtgcgggctggccgacggggcgaggcaggaaacaggcggtggggtggcgtggcgacgcggtggcgatgggcgcggaggtggaagcaggcgcgggcggcggccggttgcggagcagctgggcgcggtcgaagatgttcggcgccgccagcgctttcgccagatccaatcgtcagttcatgcaacgagagacgcatcttcagctaacaactgtattgcagttcaagtattaaaccatgaagaatatatgctcaaattaaaaggcattgcatttgtgcttacatggcttggggatgtgctcctcgaggtcgccgcggacggagcgctcgacggtgactagcgactgcagcgcgacgatggtcagggagtccttggcctccacgcatgacatgcggcgcatgtccccgactttgcgggctgccacggtggcgccgcccctcccatctgtcgctctcgtcgtgccggggccttccacgccggcgtcggcgtggtcgccattgcgcccaaccttggtcgtcgttgtgccttgcatccctccgcttctgcttggtgcgacaaatgactgaaacacactcgattccctgtgagagcttgtggtcttgagaaatctatgagatcgtactggtcttgagctcgctgctcgccgtcgccgagagcggcttcaggggaaacccaccgaaacgaaccaccctcctcctcacccttcgccaccgatggcggagcgcgagggcacgccggcttcccaccccgtgtcggccgtggcgccgcctcccctcgccgccctctctccctctctccgtttgcttcctcttctcctgttgttgaagtcgtgtgcgttctgtgcctgcagggtgcccgcggcggagggagaaagcggaaaggcacggcggccggaccgcaacctccgcgctggggcagcgctgcgcgcgcgcggcgtcgctcagacacgtggacacgctccgggagctcgggcactgcctgtagaagggctacggcgtgcgctgctccatgctagacggccgccgcctcctcatccagaccaacgcccgcgagatcgcgccgcggtcaccgcgtcggcctcgctcctccgcgccaccagcaagctggctacctcctgcgcggcactcttgcctcttctgtgacttcggctgccatgccgcggccaaggcacccagctgctcccccgtcgccacccgtggagaggagacggggatgagaagaggtggagaggggagaggaatcagaggctgacgtgtggggccgcgtgggtctgacgctgagtcagctgccacgtcgaacaaaaccggagtcaaacctaaaccgctgagggatctagtttacactggttttataagttgggggatgcgttgtatctggttttgtggtttggggacgatgttgtaactcgatgacaagttgagggaccttcggtgtacttttttcttttctagttcctggttctaattcagaggtaggtttagctgccctagtaaggcttagaaacgtatgggctgggacgacccaaataaggcccaactagaatgaaagcaaaagagacgcaaagccacctgaagccggccattccttccgcgtttccgtcgacgttccgccgccgacacaaacgctttgatgccttggcacggtgggccggccctgcactgcacggcacggtcaaagaaaaatagtagagggatgcaaaatagattcaatcagccatataatacatggctaaggtagaagagaaatataaaatagacttatttccagtcatataagctcaaaaagttaatggatgaaaaatagacttattctatggagaagcacaataagctatcatgtcttcgggctgacacgacccaaatcttattgggccgtgtgcgcagcccatgggctagcccggcacagcccgacatgtagatcgggtcgtgccgacccaattgaccttggcccaaggccgagtcgtgtctaggccctgacgtgctggacgggccgtttggctatctatagctgtgccgtccaccacaccgcgttgtcaatttaaagttggattcaaaataaacatatgagatatgttcacattgtagagtaaaagtttcaaatttaactacgactaaaaattttactctcaatgaaaaaagtttattcttaatacagtaaacatatctcaaacatccaattctatattcaacgatagtttcaagactttcaccgtatatttttcaatgttgtacagtgtccactatccagtcaaaagccccatctttatgaagtcatctacctctcctgtctcgtctcaatcccctccaccaccacgcgcgcacgaaacccgcgcactttcccctcctcttcccttcctcgcgccgcgtccaaccgcatcgcatctcaccccacctcctccctcgggttcttggtgcggggagccatggcggccgccgccggggcgccaccggggttcttctccttcctcaagcacggcgtgctcgtcccggcgcgtggccgcggcgtgttcctgccgctgctcgcgctcaccgcggcgctcgcgggcgcgctcctcctcgcgaactcgctcgccgtgcagccgcgcgccgtcgccgcgctcctcgacgccgacgccctcagccgcgccgacccggccagcgccgcgtacccgaagctcgtccggaggttccgcgacgacctgcgggggctcctcgtcgacgccgccgcgtgcgtcgccgccgcggtggtcgccgggtcggcgatcaagatcgccaccgtgttcggcgccgtcgcggcgttctcccccgccggcggcgaggaccgccgcgccaccgtgtccgggctcatcggcgcggcgagggggaacgtgtgggggcccgtgctgaccatcgccttcgggtacgtcctcgaggtggtctgcgccgcggccatcgtcgccatggcgatgctcgtggtgcccctcctcgagtactccctgctgctcctcttcctcgacgccatggccgtgctcctcgcctcgctcttcctcgtctacctcaccgtcgtctgcgcggtggcgctcgccgtgtcggccgcggagcccggggggcgcggcgccggggcggtgtcgcgcgcgtggcgcctcatgagcggcaagaacgcgcaggccgtgctctacgtcgtcgccacgttcgcgctcgccgccgcggtctcgccggtgtacacgctcgcgctcaggtggtggcctcgcagcgcgccggccggcatcgccgccggcgtcgcgtacgtgctcctcctcggcgccgtcgaggtgttctccgtcgccgccgtcacggcgtactacttcgagtgcagggagatgaagcaggtggaagaagacatggcggcgggtcaccaccactacaccaagctctctaatggcgacgaggcaaacatttgaccaaacatttgtgaatttttctctcttccgaattcattgtatgagtagtgtttgatagatgctactactaatattcttacattgggattgacattgcaaattccatacaaaccttcaagcaaggaacagtagtaccatagcaatatcatgttacatctatgcctacattttagtgtggtgaattttgctcaaattgactgtaaattttgtgattgcacatgtgaaaactgcaatcttttaaaaattatgcgaattctaaaacatattgaaagatgatgcaaattctcataattagggggttcctgatcaccatcatccatctaagttatcacagcgattgattgtgttagttgggaacaaacaatccctttaccagtgattctttcagcccaatatattatttaaacaaaaaaatatgagatcagaactaagcaagttgctgccacatccctatcacacattaaatccacccgaacaatctaagcaagtacaggtaaaatccatcacaaaaatggagaaaaatatctctgcgaaaacaactatgcatatgctctgattcttctctcaggaaggagccaggaatatgccaatcttattggcaccaagaaagcatacaattctctgctgtgcttttgaatccatcgaaagaaaaaataaataaattcagcatgtagttttcagagagaccgtcaaattaaggcagctaagctcgccatcgccacacggatttcttctcgtggagaaacggatgattccactatgcgtcgctgtcagctgcggcgactgatcgttggacacaattctggactccgtttgtccaatcggatcgcaacggtgactgggttatgactagcttgataacccatggtcgactgctttcccatggaattcggccggggaagacagtgacctcgccggagctgggggtgagctccagccaaagaggtcgacggcgttacgctggcttgaaatcgcgaggccgagatggggtccagaagaagattgtagaacagaaagattttgaatagttttttagaaactcaataaagaatttgtagttttagtagtgatgggcacattgttgtgtcatgtgctgatccaacatgtttaagctaataatgcagctgttttcttgatgaaattgttcacgtggaagggagagatgatgaccattgactccaacccaatcatgccttgaaggctcatgcaccacaatatagtgcacatgtatgtaatcacttatataaaaaagaagtatttgagtcagatggggaggaatgccagcagggaaaaatcacatgcccatgatgtactgttggtcccaatcaatcacacatgaagggcccaagtgaaacatacattcgatagttgcagtaggataaaattaaagtacacacattcgaaacggggctttacattgttgccttgaagccaaccagggcaatttttatacaaaccttaggtcaactttgcgcatgagttcatgtcagatagattacaagtcctccaatccctattgtcttatatggcatgtattaaaaaaatacgatacaattattgaaatttacagtgtaaacttaagtaatttatggtgtaaaaattattcgactaattttaaacgaaaatctgtaatagagaagtccctttattctttgttttttttgttttgttatcctcccaaggtacagtctaaaaaagttttacaaacttccttgggtcgtcggctctcgatgctggacgccctcctcccgtgagcaactgagcatcgccagccactacggcgcactataacatacaggccgtgtttagtatttttggcaaaaaaaaaattgacgtatatggacacccatttgaagtaacaaacgtgaattaataacaaaacaaattacagattctgcctgtaaactacgagaagaatctattaaacctaattaatccgtgattagcaaatgtttactgtagcaccacattgtcaaatcatggcgtaaataggctcaaaagattcgtctcacaatttgtaattggttttttttcgtccacatttaatgcttcatgcatatgtctaatattgatgtgacgaaaaagttgaagtttgaagggaactaaacacagctaggggtggacgttcggtcggaccgaaaaattcggtctcggtcttcggtttttcggtcagttcggtctttgcaaagtcaggaccaaatttctccaaaaaaactctggaccggcaaattcggtctcggtctgaccgaaatttttgagaataaagtttggaacgaaaaaatttgacataggcatctccggcgctgtggagggcggaggcttcggccgctgcgcggtggangacccggctgcggccgcgcggtggagggtggaggcggcggccgcgtgggggagggtggaggcggcggccgcgtggtggagggcggagccggcggcaacggcgcggtggaggctggaggaggcggtggcgcggtgggggcggagccggtggcggcggcgcgggaggggctggaggagtgcggcagacggcagtggtggtagactggtagggttgtatcacttctagggtatgttttagtaggcttattgggcttcctaggcctattgggccaaaatttcggttaattcggttaaccgagcccaataaccgaaatgaccgaaataaattcggtcttttgaggactagaaccaaacagataaccgaatatctcggtctcggtctcggtcttttcagttcggtctaaatatgcccacccctaaacacagccataggcttacaacctttgaggccaaccaatgaaccgtcactcacttgacagttatatgattgtagaagatgatccataattacttctatcatgtttatctatatctattctactatataaaagtatagccgtgctcgttgtctctcacaatgtattaaaaaaaatcgaaatgctgtgctccggaaagtaaaatcactaaagaaaaatggagggggggggatgtggttggataaaaaattatccgttttttatgttagatgtacatcacagttttttttttcaaggaaccgatgacaggagtttctcctgtcggaatttatagaagaagagcccatttttaatagtatggctcgttgcaatgaacgatcatatattacaaggtagaagttggaagagttgcattctaacacaaaaccgggtatggctcaagttttattcactggttctcaatcatgaaaccggataaagagagttctataattatcaaaaccaatctaaagtagtattgtggatggtcttggctaacgacctaatgtggcatcatagtcgaaaaaaaacacattcggacccgcatataagtggtcacctcaccttctgtttctatcttcccctctttctcttcatcctcttattcgaggcatttaactactcttcatctcgaggcatttgaacaaacatcccttcatatatattttataatcatttaaaaaaacaagaacaaatcatcaacatgtaaaatttaaataagtttatatatttaattcttcaaaatcttaatgataaatttcaagttgacaaataataactccataaaaaaataatctatataaacacatgatagcctagactcacgagccacctcggccttggctcgtttggcttacaagccaagcaaaccaagctcgagccaagcctgagctttttttccacccggggggggggggggtggggttgaaatagaatggggttatggatgtggatatggaactgatgtcaatttggatattgccaatgtgaatgaatgtgtgtatgttgacgaatggacgtggaattgaatagagtttggatgaataatgatgtggctgtatgttcatgaagtggctgtatattggcgaatggatgcgaatttctgttattgtgtgatttgtatgtgaaattggtaggtcctaccatttttatttggttttcctgccaagatataggtaccggtttttttacaaaccgacacctataatctttgccacgtgtcctagctgcctagtcaacaaccggcatcttatatgcttctataggtgccggtagtatttaagaaccgacatatataagatcatccatgtggcaatcgatttaagaatcggcacctatacttctatataggtgtgtcatgggtgtcggttatagatccgacatcgatgatcgaggtcaaacgtaccgccaactaggtgtcggttgggatatccggcacctatgaccggttcccaactgacaccgaagtggttttctgtagtagtgaagcttcatatgctaatgtatcacatatcacaaatatgacaacttcaattttctggtaactttgagtattgaggaattgatatactctcatatttgatctagatctaattaaagctgtgccaaatctttgtgtttttcatatcggcgatcactgaatttgtttatctatagtacctcccattgacccataggtgaacatgtttcctaaaaaaaattactagattcatgcgccctacaattgttcttttaagatctcatataccagcatatatatgcatgcatcactattcgtattttctctttgttttctcgcagaaaaagaaatattttcttagctattgaaaatatgacaatgagatcttaagtcactttagtacatgatgaaaaataatatcatgtttgcttaccatccatggttcttccatttcgtccgcggttcttcgaaataggagaatcttaattggtatcatgtcatttatattcatagcaatacaatacaaaccttgaagaatgttgattcttttaggtaacttgcatgggaaaatatgtggtggaatccacatgtgtagtggaaacttagaaactagcgttagatcaaatgggtggtgtggcataaatggtatatttgaggccacatcaagattcttcataccatttggaccacacgtgtatttgaggccatacggccatactatttaaactttattcatatagactatacataaatactacgtgcatataaactttatacatagaaatttcacacgcataaacttcatacatataaactttgagcatataaatttaaaacgaattaaaaacaacaacttaaaaagcaaaacaaaacgtatgtgtggatcgcgtgcgtactctctcctccttgaactcggtctgctttaagaaaagaaaagtagataggctaagcctaaaacgaaaataactgtaggcccaagaacagaaatttggctgatagcggtgcgcgagctgtcgcgtcgcgcacattagtcttctcgagattgtagatgcatccaattaaccctggttgaaactgttgcttttagtggcagtggagtcgagtcccacgcggcttttcttcaccatccagatctcatgaggaggtccactgctctcatggcggcggcggcggcgcagctcctgctggctgctgctgctgtcgctggcggcgtatgcgtatatgtcggtcatatcgcacagggagacggagacccggcggatgttcgtggagtggaaggccaagtacgacaaggcctacgcctccatcgccgaggaggagtgccggtacgcggtgttcagggagacccgccgcgccgtcgaccagcacaacgccgggttccactcgtaccgcgtcggcctcaacatgtccgccgacctcaccgacgacgatgcccccccccccccccccggggtgcgtactgggagagaaagaagctgagctgatccaacaaggacttgctcgactccatccactgtaggacatcgagcggttttgcaggtaaaacatgctgctttttatttactagtccgttttttatttattatttctttgattaaagaagatgttcattggatacatacaattagcaagtaacaatgtttgtatcaagacatcaagtggggaagatttgtttgactagtatagctgcatgaaaaatgcaggtaagcatgaaccattcaaactgtaattaaggtgttgttgttgctgcttactcctccctcctaaaatataagcatttttagcacagtgataagtcaaacatttttcaactttgactattaatagctataaaataaaaaatcaatcatgtaaaattaatgctactagatttatcattaaacaaactatcataatatgtaactctttttatttaaaactttttacttttattgatattgttagttaaagtagtgtctcggagaccgtgtcagagttcaaaaatagttatattttagaacggatgaagaagtatatattcacccaaagattcacatcgccacatgttcttttagctcacagccatggagggcagaaaagctgctgtgttgcttgatcatttagcttgtgttagcacttggcaatcctacttctgtgggttaacagttaactctctctctctctctctcgtttcatgaatttttcttggccggggcctccaggttcatgaatagtctcacagaaactgaatcatcagttcattaatctaatgtgttcttccgcgcgcggacaaacagggagtgattttaagtcttttggtttggtggatatatacttgatccagtgtttcatgtgaatatgtgattaaggcttaatacgttcataagttattgtttccagtgcattaaagatgaagtgagaggtcactgtaaatctgtaattgagttactgattgattggtaatttttttttcttgcaggagtatgctggcaatgtgataccaagatgccttctgtgcgggttttatgttcaagtacgttctcctgctggatctcctcgaaattcacctagcaaaatgtcaagacatacaagtgcaggggatcaggtcccaagggcagatatgcatatgctactgtaatatttgcgcaaaatcagaagggatcagtgatatctcacaattcttcaataaatatggcaatagttattgtcaccgatccgattgatttgtactagttcgatcatagttctgttgctacaatattgtgatcctgttatttcggtctcgagggctgcgtatatatggccggacgatctccgatgggctgcttagttgggcgcttgggcttcagctgcgcatggccgcatgtcatggcaaggcagcatgcctatcgggcccgtgatctcgagagtttcaaggatgccatcaaatctctatctctatctctgtcttctcttctcttctctactctctatctctactacttcctccgtacttcctccatttcatattataagactttcttgcattgcccacattcatatatatgctaatgaatctagacatatatgtgtgcatagattcattaacatctatatgaatatggggaatgctagaaagtcttataacgtgacacggagatagcacttaaaaaaaagaggtgtttctgacgtctgtgcaaaaaaaccgggcgaaaaaactgggaaaggaatccgattccatgtaaaaaaaggacgaaaaaaacgaacctgtccgattccaaaaaaagaagaaatcgggcaaaaaaaaaaaccgggcgaaaaaaatcaagtgaaaaagccccggaaaaaaaaagaatccgattccgtggacgcggtaaaaaaggggtgaaaaaaattaaaaaactaaactgtccgattcaaaaaacaggaattatatgtgacgtggtaaaaaaaaccgaatcctattatatgtgacacggtactatatatctctatctctatctctactacttaaaaatttgaaaacatttccgtcgtccgtaataacaaaaaaatggcgaaaaaagcgttaaaacaaaaaaaaagaaagtccgattcaatttacttccgtcatccatgaaaatcttatcttatcttactctcaatctttccgaggggaccgagcggcgccctccgtccccgcccgcgcgatgaaacgccagccaaagcaaaaaaaaaagggaaattgagcaaagagataaactagattgaagttcccaaaattaaaagaggataaacgatattgaaactcctgtaactcgaaaagagggaataaaatagattgaaatttctctacaaaattccgcaaattcgaagaaccctaattttcaggtaagaaccctaagagtcaagatccaaatcaattaagctaagggttcgggttacttaccggacttgaagcccctaagctcaccggagctttccaggaagcggcaccaccgcatcttcacctcctcgcagtcgcgtcggattccccgtgcgcgctgtcctggagcacccctccaccgtcccttgccgaagacgggaagggtcgcaccacccgccaacgaggtccaggccgcttggcgctcgtcgccgtttgtgcgcccgcctagccagaccaccgacgccgtggcacggctttgcgctgcccttgggtgcgccccccagccggcgaagcaggagccgctcggcggttgtcaccgcatgcacacaccagctcgctggaccaccgttgttccgctcgctcgttgccggaaagaaatgggatcgggagagagggatttgggagctagggttttatccctctctcctagtcggcgcttcatctagcgcggggaatcggagccgtccatttgatccgacggctcagatttgcccagcgtcaggcctccaccgccgcggaaagtgcatcagaccgtccccacatatgtgagccacgctcagatgctcggcttgcgggccgttgaattgcctcggctcgccgaagtgggccagcccaagtttgggccggcttgggaagacttgggccgaaagcaaatttgatcaaacaatgtggctcagattttttaaattaaagtccgttggataaactcctaagtaggctcgaaaattaaatctaaaactaaatcttaaatcctatgctaattcatcaaattagactcggttctacctatttgttaatatatcaaattagacttgattttttaccgatttgaggttttcaaggtgtcacactatcaaacggtgtttttcctgttgcaacgcatgggcactattgctagtcaaaattaaaatcaaatatttcattttatttcatttttgttttggcagtggcagcaggccgtttttttgtctgacacgtgggttctatcgtattgtttttcctaactttaagtgctacgtcagcttcatgtcatgcaaaaccggccttaatattgtcctaggactttatgtacaccgcttttggaagttgatatatatataacctgcacaagatagtgcgacgtttctattgatgtagcaggaaaaaatacaagtctatagtcctgggagactatagttaggaaaaagaaaagacagccacatcacgcgtctacgtctgatcctattgctaaaacagaacaagcacacaatacccctaaggaatggatattctaaatgatgcctccaaggaggcgaacgacaccaagagcgccgccgacgcctgtcctagaaccaagactcggttttcacctaaataacccattgggagaggagagaacaaagcaacgccctaaggggaaagcggcgcccgtaggtgtcgccattgccggcccgaaggctaggtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcaaattattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagggggcgacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgactagcaaaaccatgcacccacagcccaccattcagttgcattttagttggataattacgaccatgaagcatggccagatgtctcgagcacgcagctcaacaagatactagaaaggtctaaaactgtaattatcccatcaactgagctagtggtaattaagcatggctaagcatatagttctagctaggtcacataagtaacatgagctagtcggttcattacccaaggttgccaaagaatagatatcaagtaaacatggcacaagcgagcagataggtaatacccagatcccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacgggaactacgcgctggcacgcaaaacgaggaaaaactctaataaaaaccaaggaaacagtacataaaaactaaacaaacatgtagagctcaattttagatgaattttgcaagttgaacggctcaattcggagttcgaatgaattagatatgaattttagaagttttgagccatttaaatgaatttctagaattattaatgatttattgcgcaattattatttatttttacaaaggaaaaggacctcgctgacgtcagcaaggggcggccggcgccgacacgcgggccccgcacgtcagcggcacaaaggggcggcgcatggtggaccaagtccacacgtggcctcgggtgcgcgtccaccacatggacggcccagatcggcccgaagccgatcggacggccacgaggcggcgcggctagggcacgggcacggcacaaggccggcctggctgagccatggcgcggcggcggcgcacgagagaaagcggcgacgcggcgcggcaaagggggggggtccgggcggcccaggcgagcggagcggcggcaagccggccggccgacctaacagtggcggcgcacggcccggtggtcgcaggcggcggccaccggcgcggcagcgcgcacgggagacagaggagggaggcatggtgggagaggaggagctcaccaaggacgcggcgacgagggatggggaaaggcggggaagctcggcgtcggcgctcctcggggcgaaggcggaacggcggcccggcggcgttccgcgagcgagaaccggcggacggcggccggagggaccggcgcgaggggaaccgtgttccggcgggatcccggccgtgaaaagcggcggccgaggtgctcctcggcgctgcgaagcgagcggcggcgacggcgcgaattggggtgattaggagcggcgccaagcggcggctggaagtggtaaaggcggtggagagaggtggtgcgcgtggcgacggtgcctcggaagcggggaggggaaaaggagcggatgccggggtagagcttggcatggcgttgccgacgacgcaaacggcgaggtgcggcgacgactaacgcggcagcagcggccggctgaaggcggcggcagcggggaagagaggtggtgctcgaggcggcagtgttccagaggcggagaggggaaatggagtggaggccgggctgcggcacggcgccgcgaagccgacagaggtggcggattggcacggcggtgggtggagcggctgaatcgccggccggagctcgccggaaagcgccggtgcgcgggagcagcgtggggagggcggtagggtggcgcggggagctcgggaaaacggggaaaaaggaagaggagtccacggggattgattttataggttcatggggcgaggagacgtccggggaatggcggattttgagagcaagtgggacggcgttgtgggggagatagagacgcgggaggcggcgacgtggccggattttgcggggagagtggggggaaacggcgcggacgtgggcggcgaggtcccaccaataaacgcgcgcgcgcggggtggaggaggtgggcggaaacggcggcgacgttggacggctcgggcggccatggcggttgctggcccgggctggaggttgggggtgaccccgacaggtggggcccacctgtcggcggctcgggggaaaggagagaggaggagacggttggggggggacgatgacaggtggggcctcgggtcccacctgtcggagagagagggagggagaggccggctggggaggcaaagcagacttgagggagagagagagagccgagcggcgagctgggccgagggagagagagagcccgagaggggaaaggggaggaatttgggccgagcccgaaagcaaggaaggggaaaattattttcttttctttttatttaaattagtttaatgaactttgtgactttaaaactatttctcgagctccgaaaattcacggaaaattccggagagtacattagggcacaaagaatattacaaaatattcccggccaatgatttttaagggaaaattttaattctcccattaattcacttgattaagttgatttaacttttatttaatttctagaaaatgcattatttaatgatttttaatcccgaacgaaaatcggggcgttacactaggctttcgcccatagttcctacacccccgcactgaagagtgcatgtcagattcaacagagccaccagctaatccccttcaacgcgcagccaccgcgccgacgcctcgccgccggccgaccatcaaagtagagtctcaacctccgacgcgcttcaaatccatccacgtagttaggttggagaaagagagagatggtgatcagagagaagaatggatcccctctcccccgcactagcccgtccaacgtggtcatcttccagcggtaagccaccgctgcaagaggacaattgcctggaaagaagttcgtcgcaggcttcgacgcctccctcatggcgctaccgccgtcgccgcctcgaccatgttgcccgtgttcccgcaatgggtcacctagtcgcatcgccgtcgcctccatcctcccaccacgatagccttgctgccgctgcgcaccacccatgccgtgcttgcaccacggcaccatccgcgccgaccttccacggcccctgtcagtcttccaccgccacctcgctgcaccggaggcccccagagcctccgggcacgcctctaatcaccaccgtgcccgcctactaccaccatccgctgctcccagtcggctcctctccatccccgccgccgtctccgcttgcctcccaccgacggcgacgcgggtgtgcgcccaccgtcgacgtcgtcgtcatcgcgcccttctacctccagacgtcgcccccgccacctccacgctgccgcgtctcgctgccgccggctcgagggttggctccccgtgcgacgctcggggaggccgcccttacacctcggacgtccgccgcctccacgccgccacgccctgacaccgttgtctcgaggggatccgggcggaaggcggccggatttgggccatcccaccaccttcacgtccacaccgccaccgaagcccacgtcgccacctccacgcagcctcgccaccgccaccaccggatttggacgggagggtgccggatctggccggcggcgccgcctcgccgtcgtggcgtctcccgtacggtcggagtcgtgggcgtgaactacgcgacctagagggaagaaaagaaggccccaccaccgccgtccttgcggccgcgtggtttccgacggtccgctagggcggcgaagaggcagaggggggagggaggcgtaggggtggacgaaaagctcgtgactcgttagctcgctcgactcgtgatcaagctcgttgtatttttctaacgagccgagctggtattttaactcgttagagataacgagccagcagctcgcgagccaaactgagccaagaagacatcagtcttccagtccaaaatggccatccttctggcccaattaggcccaactatgccatgctacaacggtgcgttcacatgatgtggccatatggggccactggccagcctcacgctcgtagatggggataaaccagtacacgatgacctgaaaagaaagaaaagaaaataaaaaagaatctgagaggagcgaggagcctctctaccgctgattttgccggcctgccgctcgcccgatctgctagtcgcgggcgtcccctgctgccgaagctacgggatgcgatgaccttcagtctgaggctatgggaactggtggcgtcaggctcatgccgccggattcgattgtctcctagaagcacacgaagccatggcggtgagtggaacccagtggccgaagatgcagataaaggtctggcgggaggcagtccccgagaccttcctcgagctctgtccaaccaatcttcgttggacagcgtatctcgctctcaccaccaccatctctcgttggcgccgccgcaaggggtcacgggctcgccacgccaccgccggagcccatcgatgtccggccgctcgtagcagcagtgcaacaccagcaccagaccaacacatgttcttcctagccttctccaagtcgaatcgatcccaactccagcgcctgacaacgccgtcgtgccgccagccacctcctgcattgcttggctcgcgagccaaacgagctagctcgagcttcaaaacgagccgagccgagctagcagtttagctcgttaggataacgagccgagccagctcgttatcctagcgagccaggccgagccgagctagcttgatatccatccctagggaggcggttgtagtggagcggcggctaagggcacctcccgtgtcgtccctgccctaggggcgacgcgggggcaaggatgcaaatacaagaagtagacgtgttatatttgatattgcgttttaaggatataatccaaactcaacgatatctaaagtaatcttatatcgcttttgctattatgcagtcgcctgcaaattagcaatcgatcagtcgatcacgctggccgttgattctgcttcaatatttgtgcgtgttatcgggctagtggggaggctcttttggatatgggccacgcttcctaggccttctttttaattaaaaaaaactaaaaaaattgtgtccgccgcgtgcaccatcgaacagatatgccgatgacttttccccaccaccgctgccccgactcaatctcagaaattactgcggagaaggcaatccatcacctccctctcccgtctccctggtggcgcgattttgtccatcggcggccacgagcggcggcgtcaccttcctctcccatctcgtcgagcggcggcatgaggtcagcgcgactttttctcaggtatttaggcttcatcagccacccatcctcctcccatttgttcttttgctcttgcgcctctgcttctggaacgagggagtggcacaggaagtggcagccacagacaacaagtgacggggcggggaattgtagttttttttcttcgttttgttcggagggttgaggagatcccatcatgcatctacagggcagagagaaatttttgctagggtttggatgattttggatggttacatgtaccactgggattagcgcatagatgtctgatttgggattagcggaccagtgttcagcaacagttctgctatatcatctgctatgtgtggctatgtacagtagttacttttttcgttttagttattcaggcagtggataaatacttttgtctatccttttgaccatgcttgtggtcattgctcagttctgcccattctgaaatattttgaaacttgcacattactgggagtaaaagtgtagatgttgtagcagcagttcgattaatggcagcatgtatgttccttgtttgtcggtgcttgatttgtacccctatcacctgaacaattttgcatcactggtgatggcagtcagttctgacagacctcacaagcaacaaagcattagcgactatagttcatgaactgggggtgcatttagcgcatcattatttctgcaatcaaccaatagtgcaatgtgaaaatgttcctaagaatgcttagatttttgtagatagaagcatgctttgcatttgcttgatttgtattaccgttatgtagttttcagttgcacaacgcattacttgtaccccctttcagttattgcagttgccattttgaaatcatatgcaactttagttataaatttatgcaaacttagctataattttgtgcaactattgattttcagttataaacttagttaaaaattgaaaacataagtcgtgctgcctgttttgtttgtacagtacttagcgtggtagtgataattaaagctagattgctttttcacttatgaaccattagtagatataattgttgttcttctctaacggacaatattatctactgtttttgattgcatgactaaatattttcggtagatccatatacatatctggggtaatataatttataactaaactatccaccccttgtacacaaattgcatccctcggttattgtagtttccatttttaaatcatatgcaactttagttataaatttacgcaaacttagatataattttgtgcaactattgattttcagttacaaacttagttaaaaatcgaaaacttagcgtcatgctgcctgttctgtttctggactacttgtgcgctagtgataagtaaagctagactgctttttttttactaatgaactgttaacagatgtaactgttgttcttctctaatggacaatattatctactgcttttgattgtacgaataaatattttcggtagatccatatacatatctggggtaatataatttataactgaactatttaccccttgtatgcaaattgcaccctcttggttattgtagttgccattttgaaattgtatgcaactttagttacaaatttatgcaaacttagctataaatttgtacaacttttgattttagagttacaaacttgttaaaaatcgaaaacatggcgtcctactacatgttctgttttctagactatgagtgtgctaggcataagtaaggatagactgctttttttacttaccaactgttagcagatataaccgtttgtcttctctaatgggcaatattttgtcaacttcttttgattacagtactaaattttttttggtagggttttttcttacccgtgcgtgggatttcagtagctctttaatgttagtttgatctgattttttctgggactagggactgtgagtgcctttgtgaattttttttgggataaatctgagatttatatgcttggatgcatttgggtggcaggttccaaattagaggagaggtcagaggcaacagggataccaatgttttggttgacaatttttgcttttgtgtccattactacatgcatgcgataagggtgtctcttttctacagatgatgaaaaaaaagtatatgcagttggaaccatagctatcgaattttggattacaaatgtgaatttagctctcatatgcttttgcttgttcttttctgttaggtgcagtatacgaattcatcaatgtgcaagcaagcaagagaagaatttttttcagcagcttgctcttgtggcgaagcagaacttgtttttgctagaggtggtgcaacatatgagttctaatttttaggcggcattgtcctgatacttcacatgattttcatgcgttcactcttttttgtgtgtgacactgatggtgttctttagctgcatctgtgtaaaattaatgcctgaaatctcagtctagattataacctttttttcaagccatatatctgctgcatacagtatacaacattttttgggctgatgtcagatgcaagggcccaaatattagtccaaactattaggcaaaaccaaaagcccaaagcgatcaaattaggggcttgtcatgggcccccgaaagtggtttcataaatagcgcaatgggctgcttcatcctattttgttttttcgcacaaagctctttttttttctcgggttagtattgccgtaagatgcaaatctaatgacgcatgggatcaactgatcaaatccgaaattgcaatcgattgcagaataggtgcccccatcttatattcctcgttgaccttgtcttagctattttgtgcctcctgttttgcttgttcaattcatgggcctatcctcttgtaccgacttttttatgcgcccatgcatgtagacgggaatatagctgattaggcggcgctaactgtactcatgataagactagatctactaatcgatcatttcggaactgaacagggccatgcatacaagatgcaggtaatcaaacattcaaactctgaggtgttgctgctgcttatatattcacccaaagattgacatagctacacattcttttgctcacaaccatggatggcagaaaagctgctgtttgcttgatcattgtgcttgtgttaacacttggcaatcctacttctgcaggttaactctctctctctctctctctctctctctctctctccagtttcatgaatagtcatcacagaaactaaatcatcagttcactaatttccataacgtgttcttcgaaacaaacaagaagtgtttttaagtcattatttgtctggtagatatatactacttcatacttgacccaccaatgtttcatgtgaatttgtgattaagttattgtttccagtgtattaaagataaagtgagaggtcaccgtaattgagttgctcattaatgggtaaaattttcttgcaggagtgtgctggcaatctaataccaagatgcctttctgtgcgggttttatgtgcaagatctcctgctggatctcctcgaaattcaccaagcaaaatgtcaagagttacaggtgcaggggatcgggtcccaagggcagatgctactgtaatatttgcgacaaaaattactgattcagatagattttaaccatttatcagatcgaagggatcagtgatattttttttgcgttttttttctgcgggggttagtgatatctaattcttcaattattattagttagtctcattgggtaatttgttctggttattagctcatagttgtttggagttgtatttgttaatttggcaataattttgaagggggacatatccggtaaaaaccatcaaataagtgaaaacccgtaaaaaccatttctaaaagttttataaattcatgaaaaaattactagagataggtataggcatgaaatatattcataccaaatcttaagttaaaactcaacttcatttgagagaaatctcttaaatgaagttgagtttggacttaaatttagtatgaatatatttcatgcctaattttttcatgaatttacaaaacttttagatatggttttcacttatttgatggttttcactggatattccccagatggatctgtgctacaatgttatatgatcatattatttcgctttagtcggagtacggaacggctgcgtatatttgactggatgatccaagcgcttgagctgcacgcgcatggccacgcatggcatggcaaggcaaacatgcttatcagggcaatatagtacaattattatataattacattgtaacttgtatatagctacaatttaatttgtatgcaaattttaaaaatcctatggtaccacgctattttcgtgaagcgaaagccatgggaccgaatcgatctcctcaccggcgtgtgcactatgattttttttcttcccaacatgcacgaatcttgaagcaaatcgacgcttcaaaaccatgtgaaagccacattattaattatatgcgagttacaatataattacactacaattatagtttatttacatttgataaatttttgagagaatttactgagaaatatataggaaaattgttttaaaaaaaattaaacccctactacctccggccaaagaggttgtctaaattcgtaaaactaaaatatgtctagattcgtaaaactaaaatatgcatgtctcatctagtatccggtagcaacatcttagtaagacggatgaagtacatgatactgcacataccaaacatcggcaatagcaatacttatgatacctagaagaaccatgataatgggcgacagagataatatgtttgttttccattgtaccaggtgtaatctgttattttcattttcttttggaaaaagtacgaattaccatcttcccgaactattgcggtcagccgaattaccctcctgaatcacaaaaccggacatctttcacccccaactttgcaaactggataattaaccctccggctcaatccgcggtggttttgatcctacgtggcagtccaatcagcaattcttttataaaaaagtaggtggaccccacttgtcagtttctccctctcttctatctctcccaatctctcattctctctcctctccatcacgggcgacggcggaggcagcagcggggtctctcctctccatcacgggcgacggcggaggcagcagcggggcgaggtgagtgcggc

SEQ ID NO: 63247 - DNA, 1541 bp, Oryza sativa
accgagacagaagtcggtatgaaaatcctttttccaaaagtatctggcctgttcctcatgtcttccttgaacagaatcgagctgaacgggtctatgaatagcccctctgtcagattcccattggagaacgatttgagtacatcgtatccatacgcaacggagctgtcaatctctagcaatttcacgctgcaagcataccatgaaaaaataacacgaaaacccgtaaaaatgaaagcaagccaaaaaaaggaggggggaacggatgaaaacatgatgcaccataaggacataatcaatagtgtgatgtacaccgacctgtccatacgaccaccattggtcaataagaagtccctgagctgaacgctcagcgacacgtcagatggcatgatacttgggccaacaaccaccggcgacaaaaatcttggaggctttcgaataaaccgctttggctgagaccatggtgttgaatttacgacatcggtgtcctcattggtctcggccaatagctggcagaaaaaaaaagtgtttaaggtggaaaaaaaaggttaacccaacgtagttgtcgatcgaactaagtgaaatgttaacttccatctttacgtgagtcactgtatgactccacatgcatatcacactataattgttgactgctccttttatatgtgacaaaaaaagacagatagttgaaaacatgtgtggaaaaagggtatttcagtaataagttaacaatcggttttgtcattgggataagtctagaacagagttttttaagttggagttaattatttactctacagttttgcttaaatgtacactagcaaaattacccttgtgttgatcctaaaaaagatgaactaaatgaattataacttaactcacaatgaaaacttgttgagtactcatccatatgtaataagattatttgtttgaaccacttgctgacttattgcttggtcagtggagttaagacatgactgcctaactataatttattactctactatttgttatattgtacactagcatatatacctctgttatattgtgcactagcaaatataccctaagtgtacatgctccagccggtgcaaaaaaaatgtgtgcagggaaaaacccaactatgtgaataggaatttatgctatgaagcacaagtgaactcattaaaaatggatggttgggagtacaacctctgacagtgtaggagccccctcgaccctgcaaatctcctcgattttatcgtacacttgtgtgtcggttgtcacgtcccaaaacgaccctaaaatatatcccttaaattatgcttagaataattaaaatcctagtgaaagcctccaaaaattaaaatgtgcaaagctaaaagtcaaataaggcttggaggatttttgtatatttcctaaaagcctaaaatgtgtaaataaaatttagtggaattttcagagcacaaataataattatcaagaaataaacaaagttaaaaaggtttataaaaagaaaaacaaccctaaaaccctcgcccctctctcttgggccgaattcggcc

SEQ ID NO: 63248 - DNA, 4265 bp, Oryza sativa
aagtcaagaacccatttttgtagctttgcctctgcttgttatatggagtttattagagtaaaagcctttttctttccgttggtcgtgtagacgctgcagcttcggaagatccgctcttcgtggaggttgacgccgacgtttgggaaagcgagcaaggcaagtcacatctcctttgaaaatattgttgtcctatgttttgttttaaattaatgcattatcgctttatttaaattcccgcgttatcactgttttacttagccatgcctatttacccttgttataaccttattattattgctattgttattaataccttgttcaccctaggaaaatgaaaccccaactagtgggtactctattcatggttccactagtatgaatttaggtagatgcttcgctgattaattaggcaacattaggtggttttataatttttagactttgggaattctcatatcacctggacactatggaatgattagattatgtggaaatggacacacacctccccctcctttcaaaacccccaaaatggttttaggctgggctcgaggtacatggttttgatagcagcacctcggccactataaggaccggtcttcggggctctgttacaaagcactaccgtacttccacatgtctagtgggtaaggcctagtttgtagctcagtctggtcataaacaaaagtacacggatagggatggacgaagtcggggctcgatggacatctctaggacaaatgaaggctacataagctgcggcctagtagtcgagatgtcataacacagggttggtgtcctgctgctaggggctcaatcttggttacctgtctcgggaatcccggccgtagccagggttgggtcggtactcttgtttacggctaggatgggttgggaactatgtcatgtcctccgtccgtatgccgtggtggtatgtggcacgtggttacacgtgaggaagatgtgtcttgtgggtaaagatgtacacctctgatcagagtataatctattcgaatagtcgcgccctcggttatgggcaagcctagcaatgtacccaagttagtgttttaattcctaaaacctgcttaacaactaaaatgtggaatggttagcctgggttggcttgggacgagctgggacccagggtcgggttgccagttctgtctgaatcatcgtaggccttgggttaaggcaggttcgtgtgggttcacggccttgattaacaacattgtgtagcttcaggatcgcctttacaaaatggccctgagcaactaaaagtcttggaaatgctatttactgcaaaccctaacccctttattataactcccttgtactcctttgcatttattctgcattcgtgggtgtttcttgttgagtacggtggttgtactcaatcttgctcaatttttccccaacccagaagtggagttcctggaggatgaaggctttggtgtctagctcgtgcctgccgtcaagtgcctgtggtcgtcgccctagtcttccgctgttttccgtttgtcttcgtgtgtgctgggccttcgccgcccatgtaataatttatctatttacacttctgcttgttaaactctgaattgtatcaacttttggtgtaccttgcctcctgggacaaggaataatacacgcacgtatggaatgcatgttgggttaattccagtcgtgataagttggtatcagagcctccttgaccctaggacgaaccctagaacccaagccttagcagtattttgaaataaaaatcatctcttatttgtgaaaatcctttagtctctctctgtcttgctgcttcatttctcatcaaaagctgatctctaaaatttttcttttgtctttatttatagatggccgccaacctcaaccgtcgtggtctggatctgactggctttgctttggagctgcggggcatgtgcgttgtcctgggatatccgcatggagtggactaccagggcaagaggcttccggagcaggatggtgacgatgcggagccccgcgccgcttgggaggtcactgcgatgatcctcaccggctcccctaagaggacttcgctggccgtcaccgcgggtagggactccttccccgccacctgccagaacgctgcactcctcgccatcggcactcttcaccagcgctacccggacgagttgcagcactcgccctaccgctactaccctcgtcgtggaggagcccgcgactacgccaccttccaggatgctagctcggaggatgacgctaccatcatgcatctggcgcgcatggtagaggcgtacgacgcggcccgtatcgacttctaccgcatggcgcgccgtggcctggtcgagaacaacatgaagatcctggagctgcgtcaagagaatctgcagttgaaggacttggacgctatggaggcgcagctgtgtcagctcaagattgctcagggggagatctgccgccccaagcgccgccgcgtttgccgcagctagaagattaccgcccgcaagagtacctccaggcctgagctggttcgtcagtccttggcatggacctgcttcgtggagactccttgcgctgagcctgcgcctgtggttcctcaggagttgggagcctctggcgttggcagcacggaggatgtgctattgctcaccttccgccccgacccatcgcagaagtagacgagcagctagtaggcccgcgcgtgtgttcttttcgtttgttctcttgctgagttgtgtggggcatggttataccggtgtgtggtataactgtgtcggagcctgtctttattttatttgcgtaagcaacttgaaccttaatgaaccaatttaatagcagaaataaatttaagaattatggtagtcgtgggtggttagttttaatcgtcagctctttctgtttgctggttctgtgtggaatcttcatatggtgacaaccaggagaagcactgctaccggttagggcagtcaccccgaaggcagccacaacaacaaccatggcagtccacctccacctccacctccccctccgccgccaccaccgccacatggcaccagccccatcctcacccaaatcctcgcccagcaggccaacatgatggctgctctcctccaccatatctagaatccgccgcaacacaatgctccaccaccgccaccaccacccccacagcactccaagcttgccgagttcctccgcattcgcccacctaccttctctagctccaataaccacgtggatgccttggattggttgcatgccgttgggaaaaagttggacaccgtccagtgcaatgataaggagaaagttatcttcgtaacccatcagctgcaggggcccgcatcgctatggtgggaccatttccaggctacgcagccagaaggacagccaatcacctgggcccgcttcaccgccgctttccagaggacccatgtgccagctggggtcgtagcccttaagaagagggaatttcgggagttgaagcaaggcaaccgctctgttatggagtatttgcatgagttcaacaacttggcccggtatgccccggaggatgttcgtaaagatgaagaaaaacaggagaagtttctggcagggatggaccctgaactttctgtgcgtctggtctctggggactatcccgatttccagcgcctggtggacaagagcattcgcctggaagccaagcacaaggaactggagtcgcacaagcgtcgcttggcgaatttccgtaatcaacagggggctaaccaaaggatccgctacaccaatccctatctagggggatcctcctcacagcagcagcagcagcagcctcgccccgtgccacgccctcagtatgtggttcgtgtcccacagccgcagcagcaacggcagaatcaacaagggaaccgtgcaccccgacctcctgcaccggctatgcagcctggtcaaggtcgcaaggatgctcaaggccagcagcgtctgtgcttcaactgtttcgagcctgggcatttcgccgataaatgcccaaagccgaggcgtcagcaaggcccagcgccaaagccgaggcgtcagccgaggcgtcagcaaggcccagcgccacccggccccaacaacggtggtaaggatgccacccggggtcgtgtgaatcacgttactgcggaggatgtcctgacaactccagatgtcatcctcgatacgttcttcattcattccatccccgctaccattttgttggactctggagcttcccactcatttatatctgtgcaattcgtggggagaaatcaactaagggt

SEQ ID NO: 63249 - DNA, 1667 bp, Oryza sativa
  unsure (1)..(1667): unsure at all n locations
tttggcaagggaccaagcccctttcccccttctttttccttttgcccgacaccgccggcgtcatcacctgccgccgccttggctgcacgcgtcgacgaccgccagctcgccgcccttgcatccttgaccgcccacgaggtcggtttcctccctccccaaaccgacattccccgcgcctataaagcccgagcctcctccccatatccctctcgtttttccctcgccttcaccgcgccattgttgccttcccgctgtccttgccgtcgccgtctgtcgccgagcaccgagggagccggtgcgagcgtgaacgcgtgacgaggagctctgggcgccacctctccctctcttctcccccggcgcactcgcctcgacgccgcgccgcctcggcgtcatccgccgtgcgccgccgctcggtcgcgtgccgccatcggccttccacccctttccatccccaaatcgccgccgataccgttcccgcacaccggtgagctcctcgcccaaattctcgccatctgcatcatcttggataagccccgagccattcggttgctcgctcgtccccttaaacatgccggcccgccgttgctctacttcgccgccgccgcgcccgcctgcgaggccgcctgggccctctcgccaatacctcgcgccaccaccgtncttgagctccctagggtctccccaaaccattccctagcgccgtcgccggccggcacagnctcgccgncattggcgtccgctcccgaaggccgctgctcgtcgccagccctcctcagtgattttcccgcccatacgacaccggaaacggattccttgaaccccggagatgcctcactccttttgaatcgaaccctcatcgtctcgtcgtgattcccctctttgctcgccggcgattgccgccgccacaatccgccggattccggccatcctccggcgaatctgagccgtcggctcgcttcgtctcgtctctccccttcccccggtgtgcttactttttccattgaggtcgcgccttgctcctgcgaacgccgccgccgtccgccgtccatcccggccggcctcgtcttcgtccttccgccgacccgcgtggctgccgccacgtcggcgccacctcggcacgaccgagtcaacagacccggtcggcccctcctttccgtttccccctccgtgcgcgcggaccacggtgtgccatgcggctgcacgtgggcccgccgcgcctcgatccgtccggtgcacccaaaaccctagcgcccgccccgcgtgcgccgcttccaccgtgcaccgtctagccgacatatgggccccacccgggaccccgcgtggtgggctcagtccaccggaccgcccccctcccttccgcgcgccctcatgggcagcccctcgcgcccgcgccggtccacttggttcggccgagccgcgttagcctttgggcagcaccaatgccaccgaacaagtctaatatacatccctccatccttttctttttccagggatttaataaatcctttttcctttgtcccataaatcaattccttattccaaaatccaataagccatttcctttggtcccgcatgacagtgactgttaataatattcttgggatattatttcttcaaaccccataaaccatttctcgtattccagaaaaatccgataaatcatttcc

SEQ ID NO: 63250 - DNA, 3974 bp, Oryza sativa
  unsure (1)..(3974): unsure at all n locations
aagtctaatatacatccctccatccttttctttttccagggatttaataaatcctttttcctttgtcccataaatcaattccttattccaaaattccataaaccatttcctttggtcccgcatgacagtgactgttaataatattcttgggaatattatttcttcaaaccccataaaccatttctcgtattccagaaaaatccgataaatcatttccttgtccggaaaatcccattcgagcttccaaaaattcatatcttctcaaccgctcatccgattgactccgttccacttccagtaattccgtaaaattgagatctatttaatggcactactaattagtctaaataggatctatcttttggtcttttgtttaggttttcgattgtttgcgtatagttgcggttatcggactttcgtcgatcgcgggttttctcgaagattcgtgaagcttcgtgaagaccttgagcaaggcaagtcaccctttgatcaattgctcctataattgaaaagtaattattatttcgtttgcaacttgcattattagaatcacacacttaacttgcttggcctcggtttgcgtgccagaccgacggacctacccagtagtcacactaatttccgtaggtcgtactaccctgattccttgtcgctccacccttgtggtacctcggtattcgtgctctctgagcgcgtataccaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaagtgcaaccacaaggtggaatgggacaccctggctaagtaactagacggttcagggaaacctcgcatgccaatagttgggaacgccggggcggggtcggacaaaccgggttcctggtaaggcaagaacgagaagcttgctcacttaccgatcaaggtggttggagtttgatttgtgcacgcctaaaaaggcctatgtttatgagaggatttgatccttctatgtggcatgaggtaaccctgggtcggctggggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtaaaaagttgttgtggtgtgggaatcgtaaccagaatcagcctatgtggaagatgaatgacctgagtggtcagaaacgaatctgtgtgattcgggatgtctgcgggcatcatagactaggcttcccgagtgaaagcggattgttgtgctgctgggcagctggactctgggagtccgagaaaatgaataaggctctgggagccgcttaattaagtgaaatggctctgggagccgagaagtaatgatctgacccgggaggtcggtacattgctaaatgagctgttgaaaagcatctcttaaagtcgaatcgagacgcaagtctcttttcgcccaaacatagaaagaaataaatcacttagtgatttcaaaatgtcttcaaacaaaagatttgcaaaacaaccttgcctctcttccaagcttgcattaaacacctaagttcccgtgacttgctgagtacgaaagtactcacccttgctctataaatatatatatagttcctccgccctgaagagaagataaagtgaagtgaagattagggtttcgtcctggttcccagccgtcgcctgtggtgttgggtgttagtccgttggttccgctgctgctgctgttgttggtgtttcctcgtctgtgtcgtcggttgtattctcgggctgtctgagctgcaacctaagttaaggtaaataagtcctctatttatattaaggattgctatgattcatatttgtcaccgtgggtaccagcactatgtcctgggactggtaccgagatcgcggtttcgtaggaagcggttcgcgccgtttttcctacgacacgctcctatcaggtgccgttgtacggcggtatcagattggggtgtgacaaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgactgaacctgctcctgctacaacatttgcacatttggatgctactaccgtactttctagaggattagcttccaaagggatttatcctgcagtagatcctttagattcaacctcaactatgttacaacctcggatcgttggcaacgaacattctgaaactgcgcaaagagttaagcaaactttacaacgttacaaagaacttcaggacattatcgcaattcttgggttggatgaattatcgcagnaggatcgtttaactgtagcaagagcacgaaaaattgagcgcttcttatcacactcatttttnnnnnnnnnnnnnnnnnnnnnnnnnnnnnaaagtatgttgtcttgcagaaactattaggggatttcaactaatcctttccggagaattagacggcctacccgaacaggctttttatttggtgggtaacatcgatgaagctaatacgaaagctataaacttagaagaggagaacaaattgaagaaatgaaattaaatctttatgtactgactcctaagcgaattatttgggattgtgaagtgaaagaaatcattttatctactaatagtggccaaattggcgtattaccaaaccacgcccccattaacacagctgtagatatgggtcccttgagaatacgcctcctcaacgatcaatggttaacggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaatggtttagttgatacaaagaaaaagggaagaggggtagaaaaaattattagatagcgaagtaaagtagggccaatgctatctagtaatttttctacctacctacctactattggatttgaaccaatgactcccgccgtatgaaagcaatactctgaccactgagttaagtaggcaatttatcaccacaaaggaagaccctttacttcgatcgattatagatcgaatcctttttataagcaaataccgcttcgttattggtatgttattatagtataaacagatcaaaggatatcctctactattagagaatattcatcttgccaagaaattctctatatattaagatatctctgacaagggctatagctcagttcggtagagcaactacacgtgcgccaatgcttttcaaggtatatgtgagggaacagtgtccgaattccctgcagatggattcggatcctctgcaataccgcagagaggtactttaaaatgttagttagcttaaatatcgatttataggaaatcgatgccaagggctaaatacttcaaactttcagccaactgttttaccattaagctctgtatacagattaatctcaaggtgggcaaatagtttttggacagatgatgtttctgctcgcct

SEQ ID NO: 63251 - DNA, 9568 bp, Oryza sativa
agtgcttgagaactatgaatgtcgtgccactgatgacaattctttctttagcggcactccgaacatgcaagtaaagatgagctagggaaggcatctctgcaaggataagaatgtcatccttcaaaagcttccctaaagaaagttccaagctgtgtagcacattgagttcgcctatccagcttggaaccctagagaactgccagtctgaaagaaagagcctttgaagatggtgcgcggacttgaacaaaccattcaaactatcacaacacatagtagacagatgatgatttatatgtagatctttgaggttgcaatctgcaagtcttgcaagagattggaatagaacatctttatatcccacaaaagatgatcctctagaacaagagagatgcagatctttcaaattggtaagctcttgtaagctcgcaatattatgtagggaattcgtccccagatcaaaatattttagagtttgcaagttcttcaagttgccgattccatctggcatgattgtttggtctggtataatcagatgtagcaagcgaggcaaatgaataatatctgatggcaaaatgatgtccaaatgatggagcgaattgaacccgaaatgtggtaccttttcgatttcaaatgtctccaaatgttgtagaccccgtatttgagatgggagcttaaattgttccatagtccgaatcttgaaatacctcagtttggtcaaggtgcaaattccagtgagatcttgttgatcagaattttctaggattaggacctgaagactccgaaagtctagaacatttggaatgaatccataacttaacataacaagtgaacgaacttgcgataggcaaatagttgcaactattttattatatttttccatattaatccaagagtggaatgagagccgtcgaaccttaccacacaaccttctcatgaactttgaatcattaacaattgtaaaaagattctcatctgttgacttggatatgataagatcaagtatcatatcatgtagtctacatgttaatacatcatcattatggtctagaagtatcgattggatcatgcttctgttgataagctcattgaaatagccacgtgcaacacagtatgcatcatgatcattatgtgctgtacgtacaaaaccttcagctacccatagcttgatcaaatcatctttttttattgtgaaatcttctggatatatcccgacataaagaaagcatgccttaatacaatgaggaagatttgtgtagctaaggttcaatatttttctcattccatctagtgtgagattttctccatggctggtgcctagagaattccgtgttattgctgcatcatgttgttgaagttggcgaactgcgcatcagcagattgttgccattcttgcgtttgagctgtgttccgtgaggttgtactggatctccccagtctgcacatcaagggtgtccattctcctagtgatttcaaccaagtcccaacgagaggaacttgagcgccattcacttggagatggaggcacaccacttgatctgggaggttgattgtcccccattggatgtcatgaggcgcacgccaccggtcctcactagcacttgcctagcttgagactccgatgctgtggcgtggagcttgggtccatccgggtgcatccccagttggctcccaacctgcctcatacatttgcacgggtgttgaggatgatgaactctctcattcattccttgtcatggtgcgctttttcctgtatgctccacctgcacgagattcttctatggtctgcaggggaatggttagttcatggcagttgtacaaatcataccccgcatttggcaacgggatttcatttgtacaaccagggaaaaagtaaatcaaagatccatctactccatgcttcagaatatgcccttgtactagataggtctcatcaatacacggatgagcggctgagataaaagcaatttgatcactaacaacccctagcccttttgctatccgagtaattagagaagtgcacttaacaggagtagagaactttatactttctaaccattgccttatcatacatttcaaaggagcaattttgatctttctaaccatggcaaacatgataatcaattcatcccccctaatgggtctaagatcacctctaggaaacaaagtcatagcaatttatttgtgcatgagcctaagtgtaggattatggatatcattcgtcctaggtttcttgcaaattgtagcaccagaaatgtcttcccaaaacctatttttctcgaacccagaaattcctttctgaagatcgattttacaggaatcgtgaaaccaagaagtgtactaaagcctttccatgtaagtgtgtactccttatggaaaaagcgaaaggaaattccatcttctatttctttcaaagtgcacagaaattgcaaagtaagcaaacgagaaccaggctcatctaccacagcaaatctctgccaaccaaccgctttccaaatagaacgaaattcaatatccatacctatctttttcagcagctccggagagtattctcgtgtgtgagaatactcctggtcgctcagcatgtagtaggcttgtctctcccgatcactgacaacgtcgaggtcggtgtcattcaggagtcgtcacggagcttcggcgtcttccatcgagacatcagctgatgaacaagtactagactcgtcatgatgacttgatgaagagctggaccccttgaacagacgagacaatcgcctcctcattctgtataatggacaaagaacggactaactcggtggggattaggaatgataagaatttcgcccgccggttagtttcaccaaagcaaattgtatatatgcaactaagtatttgaatttgagggaaactatcaaagcttgaatgaacttaagagcaaactttggagagggaatgaaaatgtgttgaaatggggtggagttccctctcccggccggttggcttaagtagtgcacccacaacggtcaaaatcgacctgtggggcccactagctgttgcctcaaagagggaggcagccgaccgttgcctggccagtttggccaaaccccctggtgggcccaaccagccccactttcgaccgttggattccaacggtcagtgtcgtcgtggcacaacgaattttcgttggaaattttattttggtttgctctgaaaaattcatttgaagaatttcctcaaaattcaaaaaatcctaaatgcaactttgaaattcaaacatgcgatgatgcaaaatttcaaagtgttgaaagcaaaaatgcaggtacataccaatttacctgttggcgaaggtcgcgtcatttaaagtctgacgtgcaagaccgtacctccttttagttcagtttgcggattttctacccgtcatcggaggtgatggagcgggcgtctttggcttctccctccacaccttcattggctttggtgcggacggtggcttcctctgagccgactgctctagcttcttggccggtatgggtggttttaccggcgtcctccaataacgattcctgggcattattgtttccttctccaggaaattttgcatgaacttcaccaggctgtccgtcttgggtggctccacttcgaccacttgaatattctgcggattcggtctgtactttatcctaaccatggaacattgttccttcctcggttgaaactcaaacttctcttccttcccgttgatgtggaaacggatactccccgtttccacgttaatgttggctcccgcggtgctaaggaacggacgccccaagatgagcggcgtctcttttcccctatccatgtccagcaccacgaagtcaaccgggatgaagaagtcccgtatcttgactggcacatcctccgctatccctgccgggtaacggactgacgaatcagccagttgaaggcacattggtgttggtgccaacaccgtaaagttgagcttgtcgaagacgtcttttggtatgacgctgacactggctccaaggtcgcacaaggcctggttgaactattgtgccccgatcgagcaggtgatcgtaggacaccccagatctttcttcttctccgggagcttgtggagtatcacgtcgctgcattgctccgttagctttacaacctccgttgttgggagcggtctcttgttgttgagtatgtccttgagataacgggtgtatgttggcacttgcatagcgtccaacaacggcacattgatgtggatcttctagattacttcaacaaaacaagcgaattgctcgtccactgatggtttcctactcctttggggaaatggcaacaaccgtgtgtcgcagtactcctgcggcacggtcttctctagctaggggtggatagcgagccagctcggctctgctcggctcgactcggtccagctcgttaggataacgagctggctcggctcggctcgttatcctaacgagctaaaaacccagctcggctcggctcatttaaaagctcgagctagctcgtttggctcgcgagcaaagcaaagcagtagtctggtagatggcaagaagatggctggcgacactcacatgacgacattggcgctggagttggaaacaacttgacttggagacgggcaggaagagcttgtgttgctacggctactggcaggacgatgatacctatctgcggtggccgcctacgggagatggtggcgatgagagcaagagacgatgcccaacgaagagaggctagaaaagcttgaggaaggtctcgaggaccgtctcccaccgcacctccatctccatcgtcgccaaccacgggattcccctcaccgctacacttcgctcgccgccatgcgccgcccatggaagcacccgacgccggccaccactgccgacgctgtggcttggcaccgcgccgccgacctcttcctctgcgaggtcgggctcctccttcgccgccgtattccactcaccttgcttgccgccatgcgctgcccgtccaagcacccgccgccgcagcggctcggcacggcgctgctgacctctgcctctgcgaggtcgggctcctcctccgccgctgcttcctccgccgtgcgacagcctccgaggtgcccccacccctcggccgacgaaatcagcggtagcgagctcctcgcctgagaggctgtcgtctcttctccgtttccatctttttttttcttttttttgtcttttggtttatccatctgagattacaagaggtcgggagctaggctggccagtgaccacatcacaatgtgctgatgcacacatcacatgaaaccggcaccgctgtatcgtggccgatgggcctagttgggccgtcaggatgtccatcctggcatctgacatgatttattcttggctcgtttgggctcacgagcggctcgctcgttatctctaacgagctaaaaagccagctcggcttgttaggaaaataaaacgagccgagcttgtcacgagctgagcgagctaacgagctacgagcttttcgtccacccctatctctagctgaacctccttgtcaaccgagtcactagatggcgctttttttgatatcccattagctcctgcagggttaggatatggcggatcatgagtggacttacctcccctcgttgtgatcgccttaacactttcaacggaggagtcgggttgccccgaaatcctcccagtttcatttgcagggactaaggatgctaagtgagctagctgggtctctatcattttattgaagctcagttggttttggaaagcagaagcgaagccatctaacttaacatttatattctctaggatcttgtcattggcaacaagcattttgcttagcgcattagtggttttagcttgcgcaaaaacgagatccttcaaggagggctggttagaaaagttaccgttgttgttacctccttgataatatgggcgtggttggttccacccctgacctccttgtggacggtacccattgttgcccatgtacatcgcctcctcacgggtttctgggcagtcattcccagagtgacccgtgccgccgcagacctcacacgtaacgtgtgagtccaaggccttgacggtgccttgtggccttttgtcgtggtcgtccaatcgcttcatgaggaggtccagcttggcagcaagcaactccatctccttgacggtatgcatgcctcactgacgggtctggagtcgttcctcgctccaacccatgttggagaccatcttctgtattagatcaacggctccttgaaccattttagagaagaaagctcctctagctaccacgtctaggtgatcgcgggacattggggtgagtccattgtaaaagttttgtaggatcagccagtcgtacatcccatgatgagggcaggcggccacgtactcctgcagtcgttcccatgcttcaggaatagacttgtccctcgtctgttggaaactggaaattcgtccacgaagggcattggtttttcccatcagaaataatatcgagaggaatgccgtagagcatttgtcccaggtattgacagcagcacggttggcatagaaccacttcttcactctcccgagaagggagaacggaaacagccgcagcctgacggtgtcgggactgacgcccttgatggtgtacgtgctacagatctccaggaactgttgcagatgagcattggcatcctcattaggcttgccacaaaacgggctagcctacgccatcgtgacgaggctggacttcaagtcaaaatccacatctcccatgttgatctgcggcccaatggctacattgtcagcagagggaacagcgaactcgtggagagtcttgttaattagccgtagtcatgaatgtcggtggcgctggtacggctggtttctctgtcggtagagttttctgcggagcagtgacttgcggcctgacgctccggaagaaagcttctgaatcttctttgaagttttctggcaagttgaaaccagtcatgcactaccctgttttcacaacaaaagtgaaaacaaccaaggttagcttgcaaaggaaaatgattatacagaggtaaatataaagtattagttcaggtaatctctattatgaatcttccccagtaacggcaccagaaatgcttgttggtatttcataacgtcattactagaaatataactcccagcaatggcgcagaaatactaatggtatattatggttacagagttcatccgcaagcgcacggatataccattgtagcatttcacccgagagtattccaagggtatcgtatttattttatcccgtgggaagatcatgtagagaggacttgactaatagtttatatattacttgtgataatcatattctaagcaggggttaagataatccaagggtagagtgacacacaagcattagttactcattctcataatatattatctaagctaagtgcaaaaaaaaaagagaaagaaaatctattcctatacttctaatatacatagtatacatacattctagttaaccgatatactagctaataccttctatctaatgccctcctggtactttgagaagccacccctgactgtcgagttccttatgatagcctgtcatgaccataccactggggctaaatacggaggaataccctccccagggaattaacttaggattatatacaggcgcggaggaatacccgtactaagctgtcaccatcagcgacacacctctcatccgcagcatataaccccaaataatgatatcccgtaatctagacaccacgtctaaactaccagatactactctaatatcatcgtcatcacatagagtaattgcataagcaaacattatacccgctccaaagcatctcccagataaactagccgtatattcagtataacatgaacataatgtaaagtaggcattcatatactcggaaagtatttcaataccataaatgtatgtagaagagtattctaataaaagtacaaagcttacaaaagaggaaaggaaagctactagagccatacccgaactcttccgaaggcttctggactcctgatttctactctattcctattccaccagctagatactactaagctaaacttgagagaaatgagagagctcttgcttgaggtgtgtgttgaagtgaagagagtgaagcctttatatagaggtggttatgacggttgtggaaggggaattgcccgaagtaccctccaaccgtcattggggtgcaatcttggacgtccatgccgaaccctggcctcaacggtggagatgggggttcggccgaaccccctggttcggccgaaccatgggctggcaaaaaccagcccatcttcggctggcaacctcctctattgcttcactttgtagacttgtgaattttggcccaattcatcgtgtcaattctgagttcttggcctattcatgcataagtctgattcttgacatcgtccgattgatttatcattcgagttgatgtcgattctcctccactttattgttattgtctgcaaaaagttagtagacctaatactagtggaatattattattctaacaaatttatgcattgcaagcatcactagttctcctctattttagtaatattgacggttcaaactgatcgataatgaccgtcaacacccaccacaccttatgactatggtcacaatgtttaagacaagaagtgatggtaagatgcgtcccacaactatgtaaaaaagtcctacgtaaaaataggtcccagcatatcatagagtcattctcaccctcgtctctagtgtgcttgtgtgttttatcttattattttatttctcgaggttgagccataagcgcatccataatgttgcatgcaaagtaaccttaagaaataaattagtatttttgttctatctttatgcattgggataagagaaagcaagaaatgttgttatggccaatcttaagcttaagacttaaggctagaccataagaaataaaaaaataatttatatatggtgctctttcattcacgttgaatagagttttctcataagtgggtcctaccttaagataaaaaaaaacatacacattgtagcatgtgctatatacaaatgaatataaagctgtgggtctcattttattgctctaatgaccataaacattgaggatgccctaagcttattactatttttggcatttaatgccttatgactaatgtccacaatgaatatgatttgttatatggccttatgtctcattcttatggtacattgtggatgccctaagagtggtatttagatagttattaaaagtagatgtactactctgtgtcattataagtgcagatatggtttttcgtgtctgacgtttaatcgtttgggcggttgtagtttttttttttgaacgactcgcatgagacggtgcgaagttctatcgatagagtaggaaaaaattacaagaatacaaccctggagggtcgtaacatggaaaaaggaaaaaatataccaccacctgcacaccgacagcgccaacactgaaagcgtgaccgaccgccgctagaccaacaaagaaacacagacgagatcacccccctaggggatgctaaaacga

SEQ ID NO: 63252 - DNA, 2614 bp, Oryza sativa
tttcggtatgttgtggtggcatgtcggcgcatggtaacgtgttgtgaggctgtgtcttgtgggtaaagttgtacacctctgatcagaataaaaatattcgaatagccgtgcccgcggttattgggcggtcaaccagctcgccgtgattaatctcattcttaatagtatgattttatgaactggtgtagttcaggtggtttggttgggcctgttgcaacgttgtttagcgttgggcagtgatgcttaatattgcttagtaatatttattgttttactacattcaaattatgatttataaatgttgttttatgcaaatatcctattgccaatcctttgttattaccttgcatcataccttcccattggtatgacttgttgagtacggtgccccagagacatagaattattcggatgatgattatttcgaggattaggcttgatccggatgttgaggatgcctgtggatttggaagaagctatgtttttctcgagaagatcttcgttcagagtttcaattattaattttattccgctacgtttgtaagacttatttattatttttgtaaggcgtggatctgtgtatcgatgtgtcgtttgtgtactctggctagtccttgacagagattttaatacacattccgcttgaaattcgagttagcgaatttctgggcgtgacacctgttagtccaaaggacatcaccttgtactcataatgcccagaatgtgtttggaaagctgttttgtgttcttcccctttagccatcctaatttcgtgataaccagctcttaagtccaatttggagaaccaatgtgaaccagataactcatccaacaactattcaattatgggaactggatatttatttttaacagtgattgaattcagctgcctgtagtcaatgcactgtctccaggtcccatcttttttcttatctagcaatgcaggagaagagaaagggctttggctatgttgaattaccccaatgttcaacatttcagtcacctatttttcaatttcattcttgtcaggcctaccttgatggcccaattgagttccttctcaccttgtaccgcacgtggaaagttgtttaccagctgctcgaccttagaactcagaatcccgagtgccgaattcagatcctccacctactaatcgacttggggaagacgcccctccaccgctgacttgagctcgacaagatcagctcgcgtgcgaccctccgacgcttccctctttttctcattctctgcgatcgtctttaggagcgagtcaaatttcccctccaaatccattccgcccatttactaagaactggatctcgctctcacacccctcaaatcctgctccgaactcagctaaccgattgaggcaagtttccttttcacggaattcctcttcaacgaagtggattccaatccccgatttggaatttcacagtcgagccaagagtttggtaggaattgaggcgtgatcttgtattaactggaaaccaactatacgcctaacaatctctctctctctctctcgctcgccagcaacatgccaactggagctaagctactaggcttcacttggtgttgatgtgaaaacacggcggcctgggagatctacttaactccagtgcaggtccaaggctagcctcgagtgtgtcaaggacgcgccaattgatttgatcctgcaatcagtgagaaagacaaaagcagaattagtcggccaatagcgtatcgttggtggtctcagccaatggagttagaccaaatcggctatgggctgagtatatcaaagaatattaaatcctaaatatgcctaatcagttgtaatactgtctatcaagtttgataaattggtttaagacaatatcataaaagtagccgatgtgacagtatttcgagcatgaaagataatgtactagctaatactctagtacaaacctatataaataaattgatctatataaacatgtcaaacaatgatcaagcatgatagtgtaaggatctggttgatagtgactaaagcttgatatgcttatataaaatgacctgtatgtataagtggcgaatatacatgaaacgaataaagaagcatgcatattaggtaagatcggctgaaaccccaatactatccttcttatgtctaattgcaggctagtttgcattgttctaagcacgactagggatgatgcatttgaaagtatgaaaagaagcatgcagtctagacaatcaagcaattaaacacttttaaggatggtagatgccttagctaaatctagcaagacaatttagccgaaaccagcataaaccctaaagcgagcaataaccgatagagcaaaattgagaagctaagaatatattaactaagacatatgatagcaatgactcgcgatatcgagcctaacacgtctaaagcgacatgttagccccgatagcgcatgccattgagacgggttacctcttgcgaagaactcgtcgaaaacgaagaagagtaaaaagggtggcgatgcgcgaagttgtattggattgtctcccgtattacaatgctatggggttcatatttataccccgagtacaaactattccattatggacacgactcgaacctttctaaaaacaagat

SEQ ID NO: 63253 - DNA, 741 bp, Oryza sativa
agccttcatgcgccgaagaccgcgccacacctaccggcagctcctcttcacaccgaggtcccctcctccaccgccggccgcgtctctcgcgccaaaccggcctccatctccgccgtccgcgcctctcaggatgagccggcctccgctgccatcggctgcgcctctctgcgccaagccgatctccgaccccacctccaaacgatgctgcgccggccagatgcagccatctaccatgccctcggcttgccgtccaaggctgccatgcctccggtgacctcagtcacagtcaccgccaccgcagccgctgctgccaaacgccaggccacctcgccatcgccatcctcaccttgcacctgaatccttccccgcatccaccgacgtcgccactgcctccacagtcacagccaccgcaagtcggccgccgttgccgctgccaccatcaccagccgccgatgctagccgccgcctccgcaaaccgccgccaccaccaacgcaactgccgcgccgtcaccctccgacaccaaagcagcctaccgccatgtcctccgccgttgttgccagccgccgccaccccgccaactaccgcgaccatgtcacgcatagaaattcccgaatagaattccaagtagaaagtgcattaaaacccctatccagaaccggccagggtacacaaacgacaaagttgacatacagatccacgtcttacaaacattgtaaaagtcttacataaatgtagcggaa

SEQ ID NO: 63254 - DNA, 4674 bp, Oryza sativa
ctgcttcaaccttgctccttcctctccgagtctgatgcaaaattatgttgttaacacatgccccccaattccgctgtattatataatgaggcagaattttctttcgtcgaacccgtgaaaatctagggtttctgctttgactgttaagcttataagcacatgcccactgtttcaaattttctttctccggctaagtccttcacaacctcccctgctgcacaagctctattatctccagtgattcctctagcgacccaaactcccggcggcgagcccctttgcttcgtcagctcaaactcttaacaatggcgaccacctctgacattcctgaggtaaattccttttctgccagtatctttcgtgtacagttctttcttaggccttagggtttcccgctctttcggcttttgttgtttcaacaccttagaagccaaatcttgattcatgtacttcatgtcgacacccaacactttcttggccctatgggtaatccagtgtaacatactgaaattttgaagaaaaaaatttgcgaaaagttttagttgtgctcttctcgacttttccattggagcaatcttgcttttaatcttttcttttatcttgaacctaaattttatttgcaaagttaaatgctctcttttaattttataaaatccttcttttattctctttttatttctttcgaactttataaaaacccctccatttatttttccctagcctctaacttttgttctggagcatatttcctttggatcctttcccaaacatttccagagtacatgaaacaccatttttcaatatccctagagttaacacttttcctttagaagcttatcatactatcaccaattctgttcctatagaaattcttacgattccccatctacatttatttccaaatccagttttatcctccaacaaatacttttcctttggaatctcgtatatcgaaattatccattcaaaatttcaaagcctactatttagcttggaccaatatttccccaatcggcccgtctctctgttacatctcattatccatttttaaccttgaggcaaaaccagcataattctaattttattggaatttattctagatcaaacctctatctagacctatctccaaaaatctttacttccactccatccaaaaatattatatcatttattctttggtcatgctcctatcttaatccagccgcctgtttaattgcggtggcttaatatccttcttggcacaagaataatattagcacaatattagagtgattgctcttgtgctaagaaaattattttaatccctttcttacaaaaatccaaattttctttagcccacaaatattttaccaaaaatccataccacatattttggggctacagtcctatttatttccctccatctatttctgccaccttcccaaaatttatccaaaattagaaaccttgccatttgtagtttctttccttcctatttgagtacttcaatttaaatttcaaattattagagaaaatttttcgtgacaagttttacatttgattcttattgaattctattaaaattggagcatttttattttgcatccttttcaaatttatatctcaaataaatatctttagttttattttaaaaatatttcaaacctctttagtactttaaaaactatattttatattatttgtcaaaatccaaaagtccacaaatatttttgtttcctttggatttcatctcctttgaattcaattcaaatttatctatgcaaaattctcaagagttactattcatccaggccaaatttccctctattcagcccattccttttctctccctccctccactttttttcttctcgggccacggcccagttggcgcatagcctagctgagccggcccagccgaagccgcctccttccttctctctctcctatgggcgcgccgctgcccacggcatggcgccatcgcccgtggtcctcctgccgccgccgccatcttgccgaccacggcaagtcgtcgtcgtgccgtgaatctccttttccgccgcccaactccactgtagccgccgtgtgtgcacgccgccctggccagccaatgaatggacgaggccagcaccgtgctccccttttccaagtcgctgccaccatggccaagtcgcccttctcctctgcgaactgccatcggcaaccgcctcttgtcgcctataaatagccggcaaggtttcctcttccttccccacacacaaccaagcacctcgagctctagctatctctcctgccatgaccggtcaccaccttgccactagccgatctcgtccaccggctctcctcacactaaatcctcacaccaccggcatggccttgcttcggtgattccatttttccactttttcccttcccttcctgtcgtaggctctccggaccttccattatatttgagagatgaagtgaataattcaagtcatcaaacaagcataatgaaacatccgacacctcgagagaggaatattggagacattgctgggcccttagcctgccagtcaacttcagcctgagatgtgcccgtcaaaccactcgaaggcggcgaccaaatgtgttacacattcaggagacttgacaaaaatggctaaagatctacaacctctcaaatattcctaactcatactcatgtgaatctagttcccaggatgtgcactagattcacactttcatcttaagcatgattacacatagcaaacacaactaagatgaaagaaacttaagacttacaacaacttaataattacataggccgaccggccaaatagacttattagagaacagcggaagcttgactacccaaacacaagcacaccgactaggggtataccccattaagttctcatcctagaagaagcaatcggaacccgcatcactcaaagactaagactaaacctgcaaacaaaaggttatatcaacagcaagagtcagtacattaaacaagttaatgtactggcaagcacaagtcaatcctaccatactacatgtaaggcatatattcaaaggaaggcaatatgtagttcattttcagcataaagcagttttgtttcgcaattcttttgtaaaagagttgatgcttcaattaacaaaacaaattttaagtttcaatatttaattcatcataattccattataatcaatctcctgttgtcatcctttgacaacaagtcataatatatcacctcacacacacacaactcaacacatttatcaatttcaaaccaatatcacatgatcacatttttaaaacatagtctatactcatgacacatcaccaaagcgctcatgaccgtgagcacggctaattgattagtttaaagaaccctgcagagtttgtacagctttacccacatgatatgaactctctagtttgttttgagtttgcaagactccatcacactcttcatgttgaatgtgatctagaggtcataacgaagcctttacactacttagaatctagccttgcaccagcacgatacgtgttcctccatcctaggcatacttggaaatatgtctagaaccgttaagtggcgggcccacgccttaaacttaacgccgtggtggcggacacaacgggaatccacccacgtggcacaataccgttgtattggacagacttagtcacctaaactaccacgtcggggcaaataggaagttcctctgaatcatcgactaattcctcagaattatcgactaactcatacacaccggcctaccagaatgcaaggctagtcctaaatagattaatcagcttaggccatcccatactagcacatgtggatgtacggataactttaaatgggtgacacaagttcggtccttatggacttgggcaaacacttcccctatcggtatgcaactaacaccatatgcacaccacttgccgcccaagtataaaatcacattttacacattttaattcgcaaatacccatcatattcattttattccagcaaaggttcaagtatcaaaaccacattttaattatagatggaatgagcatttgcatatttctaagcatggctaagcaagtaattgcacatagagcatatataaacccatttgagcacaaagagtgtactctaaccatttctaggggttcaaacagcaagaggatcaattattcaaggtggaatatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaattgttagcacctaatccacttcttcaccgattatgcaattatctagataaaggacacgacatgcaattaaacaccgaaagagctgaaaatccaaaatgctctaaaatgcatgatttatgcacagtgggttggaaatgatctaaaatgaatttaggtgaaataattcctattttattttattccatttgggagttatgaattttagaagttttatcggtttacaatagtatagtcttaggtagtgttatgaaatacttttgtaaagtgatttcttattagattagacttcacagggggtgtggagatgtgtttttctaagactaacacattatggtttcacaatttttgg

SEQ ID NO: 63255 - DNA, 860 bp, Oryza sativa
  unsure (1)..(860): unsure at all n locations
agtgactgataacgtaagtcaantngcaaacnacctcggtacccataagaggtctcagtagaaagacaaatgaactccacatcctcaaagtcaaaagcttctagcttaagcatgctaatatatactccctccattccaaattgggctacatatagtttttttgaggttattcctaaatgatctacatatttgtgttcataaaaaaacaagaaaggagaggagaaacccaagtgggaagacatatatgaatcactcaaagctgctaggcgagcaaggggtgaatgcttcaagtgtggggagaaatggggacctgggcacaaatgtccaaagtcagttcaattgcatgtgttagatgagttgcttgaagtattgatgttacaggatggaactgctgacatccagaaagaagaagaagaagataatgaataagagctaacactttcaaagtgtgcagctgctggaacaatgggaaagaaaacaattaggctgcaaggtatgattcagcatcaagaggtactgattctggtagattctgggagctctagtaattttattgtagagagtttggttagcaaattgcagcttcccacagaaagaatgcctgcaaattcagtgacccatagcagatggaggaaagatgacttgtgacaaatgtgtacaggttggaatggtggtgtcaaggtagtacattccaggatacactaaaagtgttgacaatatgaagggtccaacatgatcctaggaatggcattggttcgaggagtttaatccaatgtggatagaatgggagagaaagaaattgacgcttgttccaatggggaacaggatcattttgttaggactaaaacaggaaaataaat

SEQ ID NO: 63256 - DNA, 4451 bp, Oryza sativa
ctttctcgaatggatctttttctgctgattttggttccttttggcccgtttggtggagcggccacggaacggggaaaaaagctccgaccgcggctgcccgcacagaacgatttttatattcccgttttgccctccggattgtactatgtgctaatcgtgtttcttaacaaaaaagtataagggactaagggagggccttttatggtatttaccacttgggatttggtactgttttcacccaaacgatggtgttattatcctacccatttagattggattcatcacacttgtaataatataattcagtaaagcgtgtactccctctgtactcataaagaaattgtttaaaataatgtttaaatcaaaccttgggaatataaatcatgaataactctcaagttatttagtttgaaaatataaaaattatatgaatagatttgtcttgaaaaatacttttataaaagtatacatatatcactttttaataaatatttttatagaaactaagaagtcaaagttgtgttttggagaccgtgtcgctgtccaaaacgacttcctttacgagtatggagggagtatacataaatgtacgtagtgtacttctacaaaatccagcataattgtgggcaactagaaatctaaaaaaagaagatgctatcacaaagtctattggaggggttgaatgttgacaaggcatagtaaaacaacttaggttgcattcgctcgttatagttgggaacattcccctcttgcacggtaaacgaggtagtttattagcgcgtgattaattaagtattagtaaaaaaattaaaaaatagatcaatataatttttaaagcatttttcctatagaaattttttacaaataaaacacatcatttagccgtttgaaaaacgtgcacacgaaaaatgaaagaggagagttgggaactcttagtgccgaactcagccttagggaactatatgagaaaataaaacaagaataagttttttttttcatagaactagatttagaaaccaatccatccctgccaaaggtatctcacaatgccaactaatgcgctggttagcccaaagtgacctataaattcctatattatgattgcattaaatcaaatcacttacgagctatcaagtatcaatcatcgagcgaagccaaggagacctctttcaactgctccgccaaccacccttgaacaatccagtttatctaaatccctgatccctgatgaggttaattgacaggtctagattaggtctatataggtatagattaggtacatatactccctccgtccaaaaaaagataaaccctggtttccgtgcccaatatttgaccgtccgtcttatttaaaaaaattatgaaaaaaataaaaagacaagtcacgcataaaatattaagcatgttttatcatctaacagcaatgaaaatacgaattataaaaaaatttcatataagacggacagtcaaaattggacacggaaagccagggtttgtctttttttggacggagggagtacatccttataaccatagtgtttccatatatcaatcacaacagtagacatagcgttatatcactccaaagagggcacgaagctatgtaaaaataagtctctacgtttttaacttgcatatcacgggaggagagtaaacaaaacataatcgacgtatatattttaatatattcaaatgtttatcgacaaaagttacaaccgcaagaatatcaattctcaaaactattaaggagaatcaatatggctgtgtttgttacttcttgttggaagcaaatccctttcgcatgaaaaacagagcgatccattaaaatataattaattaaatattagctaatttttttttaaaaatggatcaatatgatttttttcaagcaactttcacatatatatatatatatatatatatatatatatatatatatatatatatatatatatatatatatatatatatatattgtcagggttatggataccacatacccaatagtaatcgactaagctcagcagagcccaccatataccatgtcttatatggaatcaaacctcatatatagaaggagttccggataaggaatgatgaatagagttctatatggaaacgacaaggactactcatatcgtatccatatttatctccctagttctacttggacaatgggttatctgtgggtataaatacaagccccctaggagaagaggggacagacccaccacaatctacgacgccacaaagccacaagccaatacgccgtcagatctcgacatcagatattagtctagccataccccatccggtacctacggaggccggcaagagggatccagcgtcgtctctgatctcgccgagtactgattcgaggaggaagactaccctgtcgtcgactacgagttgattatctagccgtcaagtcgatgacggatagatagattatcccaaatattggatttgtgtgatccagatgaataaagggcaacaccggcttcggccaacaggatgtagggctattacctgtaagatgaggggcccgaacatgtataaaaatccctgtctccatctcttttacctcaatctcatatatgccctgtaccaacgatccccataccatccaaataccttagtcgtgactatcaaatgttgacatatatatatatatttgaaaaaaaaatacaccgtttagtagtttgaaaagcgtgcgcacgaaaaacaaggagagtgagttgggaactcagccttagaagtgaagtgtgcatagctcaattagttaggtttctaatgatagaatagtgaggtttctaatgatagaatattctcaccgaagtttaatttctagtcttggtatatgtgctcatatctacagctaattattagtgaaagatgaaacgtgactgttacaagaaagggtggggtcacaagcaacatccaacatgtagcaaatattaaacatttgaaatatttatttctatacaagatttaaagcgaagcgcaatcgtcctccttcaattccatcctcgcaccgggtatccatacgctagcacgttcagtactttatccttaatcactcttcaagcccacgtgatcaaataatttatcctttatcacacttcaaacccatctactatgggtctctctacacatcattcgataaattttcaggccccaaatttgtcagatttctgagcccttggattagcatccaacggcagaatctaataatgaagcaaacatcaaagtgggagtacaatcaaactaaaaataacgtatgggccaaaaaaaacatcattttgggccaacacaaattttaaaataaacaaagattttcttaaaaggcctattgatactatggatcaaatgaaactttctcagcccaaacaaataacgaatcttggcagtcaagaaagctcgacaaaaatagaaaaacaagatcacgtgacttgtacctgctccaccccatcaccaccaaccctatttgtacctgctccacccctcaccaaccccgtccacatccaaaaaaaagggagatccaaaccaaatcagatcgagaagcaaccatggagcagcagaagaagaaaacaaagaagagaaaagatgaagaagatatcaaaaatccaaacccaagcaaggtcagtgcagatccttacatccttttcccattcaaacttcattaaaaatgaacagaatttcataaatctttcaaacttggaagatatatttcctgagaatccctacaaaaattgaaaaagtaagacctagtttgtacagaaatagtacaaaaatgacatcaaagtgtagtttgtcaacatgctacaacaaacaaaaatctgctacattcagaaacttgccattgcaatcatcaatatctgcatctcataataattctctcaacaatgtggtaagaagtagaaaaactaatgaacttagtatatagtaaagaacatgtgcttgaattgttaatgagcaagttacatagtaaaattgctgaagttacatttgtaactacaaaaaacccaccctgtaactgcattgctacagaagaggtgtatggaaaccaaatcacactaaaactaatcacttagtaaaattacagaaaaggcattaaagttaacaccctgtaactgaaatcacccttgaaaactgaattattataaaattacatacaaaaaagcataaagttacagttgtaagaataatacattgaacatgtaactatactgaaaactttcaaaacaaattcaccacaaaaaaatgcatataaaaaatgcatataagatggtagaatacaatcaagcatctgaacatgcatacatgcaatttcatcactttcaattgcagggccgagaaaaaaaacagaagaccagctaacatctaaaactgaacatgcatacaaaattaactttatttgaaagaaatcaccctgtaactaccaaaaaaaa

SEQ ID NO: 63257 - DNA, 14766 bp, Oryza sativa
cccatgccccccgctctcataaatctcagcatgcctatcgccatggacccccacaggggaggctataaaaacacggcacggtccctgtaacaaacagtgagtacccttcctccctgcagccgcatacacgcggtacatgagttgcggtcagtaattcgatcggctgtcgttgggagatcgggaagagtcgtcgccgtagcagggtagtgagggtgtatacgcgcatacacatacacatccaccagcccttccttttgtaggcgctccctgattactttctctctcttccttggactggcctcctccctctccatcccccaccatctttccttctttctttctcctttggaccctttccagttgtccacgctcccatctttttcaccatctcctcccatctcccctcccctcccctcatccggcgttccaccctgcccgcccttggccgcccggagtccccttccctacttgtaccagcccttcttttccaatttcatcctctccctccaattctactactcccatcgccacagtcgccaccctccctccctctctctctctcgccgcccacaccggcacactccactcggtgtgtgggagggagaggggaagaggaggccggctgcttgcttgcttgctagctagctagaattgcctacaattcagtaccgctgcttccccaattgctctactggttgcttgtacagctctacaagtacgcaattcaaggtgggggagggagccaagccggccggccatactagttctcgcctcccgagctctggtggtctctcctcctccagctggtgggcgttcaaggcggaaaagtaaagacggcggtgccgtggggcggcgcccatgcagcagcaccagggtggcgggtcccagtacggggccgtgccgccggacatggggccgttctcgccgacgcatcatgcttcggcgccggcccccctgccgctgagcagccggccaccgccggcggcgttgtctcagccaccgccgccgcagcagcagcagcagcaaccgaggacgagctacgacgagctggccgccgcgaccagcgccggcgcgggcggcttccccgacgacgacatgctgggcgacgccggcggcagcggcggcggcggtgggtcgggagcggccggcaaccggtggccgcgggaggagactctagccctcatcaggatccggtcggagatggacgccaccttccgcgacgccaccctcaagggtcccctctgggaggaggtctccaggtaagagagagacacacacagtgtgcatgcatgtgcgagcatggatgagagagagagagggggagggagaacgaatcccaaacacattcgcagttgagcagcacaagaatccttccttccgttcctcgggcataatttttccctgcagaaagcggctaacggtttcgtggaatttagcactcgtcccacatgaaatgatggataattatccagttactgcccccaaattctccaaaatttccaatttctctcccaactctaatcaaatacttctcggtttctgcgagacgggggaggcagggagtaggtgtaggtaggatgatgataagaatctgcgcgcctggggatcgtaccacggtgtgagtgctagcgcaggcaggcagcagctgctgccgcttcagtctgccacactgtcgtttttttgctttcatggtttccagtttttgggaaaagaaggaaggcagccttttgctcccatcccaatgcggcatcatcttaatttaagcatttcactccccctcttcactctcattttttttcactgccatcaacttcatcacatcgatctcctcctgatccctaaaaagacgagacggcctgtgattaactaatctcccttctgcatatacagcaccctcctccttgcctcctcttcgccattgtcctaattcccatctccttgtccctttctccccgggagaaaaaccactcatacgcagtcggccaagcacttgatgcttactatgcctctgcgttagatgcttctcctgcccgtagtaagcgctgccatcatttaatccccgatgttatttcaatctttggttgcacgcaagtgtgaagcggccggcggctgacagcaaagcttgggtcttttgtcgctctcgtgtctttcaggaagctcgcggagttgggctacaagagaagcgccaagaagtgcaaggagaagtttgagaacgtccacaagtactacaagcgcaccaaggaagggcgcgccgggaggcaggacggcaagagctaccgcttcttcactgagctggaggcgttgcatgccgctgcgccgcagacgccccagccgcagcagcagcagcagcagcagttgccgccggttacaagcagcgcacccgcgatgcacgccttcgcgccgccggttcccgcgccaccgccgatgagcgcaatgccaccgccgccggggccgatccagccggccccgatatcttctgcggctcccgcggtgcccctggagctgccgccgcagccgcccatcaacctgcaaggcttaagcttctcgtccatgtcggggtccgagtcggacgatgagtctgaagacgacgagatgacggcggagaccggcggcagccaggaccgcctcggcaagcgcaagcgaggcgccggcggcaaaaggctggcgactttcttcgaggggctcatcaagcaagtcgtcgacaggcaggaggagatgcagcggcggtttctggagactatggagaagcgagaggcggagcgcacggcgcgggaggaggcgtggcgcaggcaggaggtggcccgcctcaaccgcgagcaggagcagctcgcccaggagcgcgccgcggcggcctcccgcgacgccgccatcatctccttcctccaacgcatcggcggtcagtccgtacaggtcccacccgccgccaccgtcatccagatgcccacaccggtgcagctccagacccctccgccggtcaagcaacctgccaggcagcaccagccacagccaacgccgccgccgccgcaggcggcgccaatcccggccgcgcccctccagcagcaaccgccgcagccgcagcacaaggagacgattccccccgaggcagtgacgccgcgcagggcgccaccgacgtccggctcatcactcgagctggtgcccgcggcggagcagcacgtcgagagcgggctaggaggaggggagggcgggtcggcgtcgtcgtcgcggtggcccaagacggaggtgcaggcactcatacagctgcgcatggagctcgatatgcgctaccaggagaccgggccgaagggcccgctctgggaggagatctcgtcggggatgcggcggctggggtacaaccggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaaggtaatctcaattctcgcatagtactctccatccaaccaatttctgctagcgtttcaagctcaatatgcgaatgttcgtgcggaagctaaccggaaatccgcttgccgtgaagccagaagacattgtgagggagctgagcgagcagccgccccgggagttcacaacggacgagaccgacagtgacgacatgggcgatgactacaccgacgacggcgaggaaggcgaggacgacggcaaaatgcagtacaggatacagttccagaggccgaacccgggcggcgccaacaccgcacctccgccggcgacaaccccggcgtccgcggtgccaacctcgactccgacgagcaccttcctcgccatggttcaataggcgcgcgaacgatgcatcaccaagtacgtacttgttcaaagaaaaaaaatcaaagcatcgccatcaccatcgcatcctctcactacaccaccaccaacacaaacaccatgcatgcatcagcaatcagcaaccactctccttcgagttgggatctctcctgtaatgcatgtgcggtaagtgccaatgacatgtgggcccggaataggtgggacccacatgccagtgacaccagtacagcagtggatttgcatccctctccttcaccttgtaattctcccgtgccattccattatttattgatttctctgtgtaataagagccctccctgatctcaccttaacccgaggaagcagagggggtggtagagaaaatgagtccgggtaactttatctctataggtcacctcgtcgtggtaaaggaagaattgtacatcgatgtaacagtccctgatgtctctgttttttttttctctctctctttttctccttcccctccggcgacggcggtatacaagtttgtatacgggtatacaacaattacatacatttccagcaatttggagcagaggtcagaaggtgtcttgtttttgtttcttttctttctttgccgtggggaattttgtctccttttaacccgttttttttgcagtggtataaaacgttgttactgtgcacattgtgtggttactcttcgtatactttgcatttttgctcattgtctctgcaattaatgtagagatttttgtgtactctagcttggttttgccttcctactgagaagctatttaattaagcatcacatgcatgcatcccaaaatgactgcagaaatttaccagggggatatagtattatagtactactacttgcagggttaatataaaaaatggaatgcttactatataatcaataccataacctttgttgcttttttgcacttgtttttttccccagcgggatcagttgacaattcaatagtttcttttgccagctctaccatcagtcgtcgcttcacatgatacagtctttaatagtcagtccaagaattgtagaattattctgtagtcatactgtagttgttctgatgatataactagagcctagatcgaagggatataagcacatcactgttgctgtgagcatgctgcaggcatcagggaaaactatatcctgtaagaaaaaatatacttcaaaacagaaataggagcaaatctaaatgcatcaatattttttctagtagaattaatcattcaactagtatttttcttgactgaatagaacaaaattctatgaatgagccatgtgaaattaatggtaccaaatatgttacgaaggatatcttaccaaagttaaatgtgtgcagccttagcgtgtgctagggagctcaatatcaggtgtgtgaatgtgatatgcacatgtattgataagcatatgctatatgtgtgtatatcttccgactaagaaaaaagataaattgacagtctttgtaaaaaagagataggggtagcagcattcttcttatgagtagagggtactgtagatggtaagaatcaatttatttggattgagtaagtacgcattttggtcctcatcactgaactggaaatatagaaatttgatgtagaaatggacaatcatgatttttttttaaccgctcaacttactgctagtagtgttaaataaataagtttattttgggatggaagagtacaccttttagaaacttaagaaaatttatatatccaagtagtactactccgtaattttctctaggccaaaggacaccgagacaagatgtgatgtgcatgtcggcacgtgtcaggctgacccacgtcccgttgaggcagtttacactttagccctcataaacttgtttgttccagagagggcccatcgcagactagggaaggggaccgctactgtaaatcacaagtctgttcggcgtttgctcctcgatgcattgaacgccaacataaacagacgaaaattaacagtagcatcagatcatatttcaggtattaattttggcacatcaccaattggaacgcgtacatacttcctggacatacgtggtattttcgttcttccagtaccagtatactttcttctccaaaaaaaacacattttaaatgtggatttcatacataaacacaataaatctaatcgggtttgtctatattattgtacaaggttgtgtcacattttttttaaaaaaaattgggacgtaggaagtatgccgtaggcagtttttgaaccatggggagaggcaaaaattatcgaaccatatatatagaactcagaaattaatggtgatttaataggatctaagcatgataatggacctttatatcatgcgtttcttggaagtaggcatttcttttataaccaatgtgaaactgcgtatttaaattttatctagagctagatattaaaattttgattagattcgatattgatcagttcataatatagccgtacaatgtactaaaagcgtaatccattataaatctatacttagggagtgtttgaggagaaggggattgaggagattgggaagatacgcaaaacgaggtgagccattagctcatgattaattgagtattaactattttaaattttaaaaatggattaatatgattttttaaagcaactttcctatagaaattttttgcaaaaaacgcaccgtttagtagtttgaaaagtgtgcgcgcggaaaacgagagccaatctcccctatcacccctaaacgaacgatgccttacaccttgatttttctttttctttttaaatttttgggtcaaagactgaattcttcagtgatagtataacttgttgtgaatatctacatgtattttgagaaaataaggcagtattcccttgaaagacaaaaatattttttcatgttaaattatttttgcatgattagttagttatactccctctagttttagtgttttaacattgttaattttttatatacatttgaccattcatcttattttaaaaaattatacaaatataaatcttgataaaacatatcacaaaacataacaaatgattacttttttatatagcgaattaccaaaagcatgtccaaaagtcaacgatgttaacaactaaaaaactaagagattatgttcttatgctaaattacatataccttccaaaccacataaaaactagtcatatcatttttacactataaagtacctacacttacattataattataatgttaatttgaaaacttacacggtaagtattgtaaaatttctaatacacaacatataagaaaattaggattaaaaataagttactatttacttaaagtagtagataggataataatatgtgagaaattttatactccttgagaaaatatttcgagatacctaaattttacactaaatttttttacatcgaggtactaaattttaattagaaaatatgatacctcctgatatctttttacccaaaaacatacttatatataggagagggagcaatcgtaaagaaaaaatgactgaaattaagagaaaaatacgacgctataattttagcaatcatgttgaaaaaatatgtggtcaagcgaagcccgcgtagcgacaccaagagctcaaatcaaatcaaaagggatacaaacgggaaatatttccaattaagcgtaaccaagctgtaaaaggctagtaaatagtatctaaacaaatcaatcgtgcaattcaaccggattagacagcaaagtgcagactaagcgaggccaagtcaccactcgcgcgggtggataggctgagaattaagaacgcgcacgcgcagggcgccagatacaaatcaatcaaggaacagggaaaagaggtccctggttgcgagctccgattgaacccgaagccgagaatcattaggaggcggaaagtgaccgtaaattggcggtaagtggccgataatgaccaccatgctgcctaacaagacgacatcatcggttcacactgaagctcttctatacttatctctcctcgcttttttattttgtccatctttttcccggtatgcaattgtgtaggaatatgaaacaccttaaacttcatgaggaaacctgccgagtcaacatggaaattaagctcgtcaaaaagtgttttttttcttgctaaattatgcttagcttttaagtagtttgtactttatggaggacgccgacatcactcgagctacagtaaatccagcggagttcaaatcagcagggttggtgtacagtgaatccagattctttttcctgggatttacatatgttccaaagtactaacagggaatcgtatagaaaaaaatattgctttttattgcgaggaagaaaaaatagtttgttgcttcgagtagtttctccaattttcgtcattatattctgcactggctcaaagttaaatcgggaccatgcgccccacgaataactcagcatctcgcccatgggtccatgcatgtcgcgaaaaatcaaggaaattcatgtcttaacagtttggacaaatcaataattgttggatttatactcgttctctgaagaaattatatttgttgaaaatttgcatctactctcaagtttttgcacataaatacatacatcgatctctgatcaagtgtactcctaattgctagtatgtgattgcagcctactcgctagtaccaatttggatcaatttcgatgtgttcgatcgataccagtaccagcaataaattcgtaaccgagctagattattattacctagcacgtcactctgcgtgcatctttcctcaagctaataggaaatagctaatccctccgtcccaaaaaaagacaaaccttggttttcgtgtccaacgtttgatcgttcattttatttgaaaaaattatgaaaaaaattaaaaagataagtcacacataaagtattaatcatgttttatcatctaacaacaacgaaaatactaattataaaaaaatttcatataagacggacagtcaaacgttggcacaagaacccacggtttgtctttttttgggacagagggagtaggtcgctactgctcctgcacatatgtatcactgctgggatgggacaatgtttacctaacaagtaatctgaggcatctgtacgtattctgtggcaccgtgtatacaaacccacctaacgacgatcgatcgctaggtacccttacccgttagtagttgtcacatgcgtgcgctagctcatctatgctaggctacacatgaggatgtatgcttgcatggatgccacaatataatgccaccccaccgtagctatatatgtttgtccaatccacatccaccctcctttgcctaataccacggtcgcatgcagtgttgggggagtggcttcgacttgaacaagagagatcaccggtaccccctattaatttcctagagtaaccttgctcctcggaaatcaaatctctcagaggcctttcggagagcctccggacgtgccaagccacaatgcgctttggtaggttccggcggctctggataggagtccaaggcaaggcatccgaagaccccggccctggctatggagccaaagatccaaccacggaagccgcccgtgggagctttaatggcgcattgatcgatgtgctcagctacctcctaacaccctccgcacaataggtggggttgaggccgagacgtctcgttatcacgccatggcctcgagaagtgcaccctgcggaacataggagtcctcgagatggcagtctaatggctacaattccattcgttgtcccctagggttttacctcactacccctacctaggggccacctgttggcttctaccaaggggtaggcttagggagggcaatttgactcgtttacccatttacatgtaggtaaaaacctaatagagttgggtttgttctctatttagtacccatgggtttcttgttgggtcaaaacatgtacccaacgggcaaacgggcacgggcatgagtagtcactaactgacatgtggaccctcagttaatttcaatataaaagccaccacctagaattccagggtttctttcctttccttcccctttcctccacagccgccagccctaatttaatttcagtataaaagccaccacctaaattgatgagcttgtaatgtttgtatggttgaagtgctgaactatctcactgcttgtggagaattgtggttgaacatgtggcgggtaaacgggtgtgcccgcaggcacatggctcccgcaggtgacaggcatgggcagtgttccttgcccgtcatgtggtaataggcatgcccgcgggcgagaattacctcgcgggcactgggatgggtagtcacaacccatgcccgtcgtgcccgattgccatccctagataggctaaggaggaatactgctgtaattttctataactttgtactaagtgctatataactagatctcgccccccatgagggggcagatgaaagagagaaaccataccactctttcccggtgattggatccccgttggatttggttccaacacgtagtctcagtactccaaacaagtttaactaggaggaatgtaaccgtaatttagggcttctaatggttacagcttgtcccaaaaaaaacctttaaacaataacttttttatattctaaaaagatttaattgtagaattcagaaaataaactaaaacaaagatgaaaaaaatcaaactcctcaaattctcaaaaggtgactaccaattagttacttttcataatcttaagcttcttcaatcaggctcttagtgaagaattaggtagtgagtgaatcgaagagaaattaattaatcaggagagaggctaaattggatcgcggtaacttacggatgggatgagatgatagggtaagctatagctaggcagcagacgaacgaacgggggagcgcaatttgcatgactccatgttccgttgtcgatcgatcatgtcggcggtggccctcaccaccacccagcagctagcaatcgagctagtgcgcatgcacgcacagtcacgcacggcacagtgccttacaacccatgcgtagtatacatgcttcgatcggttgctgattagcccggccaggcggtgcgacgcgccgcacgcgtcacgcccacagctacctagctggctaccgctatctagcttaacccccacagtacaccaccaccaggccaggacacgcagcgcagcgccggtcgcatggccaaaccaaaaacgcattatatgcgtttcgtacgcacgcacacgcacgttacgctagcaatcacgtactctctcaaccataattccggccgtcccggcgctgcgtaattcaccgccgcctctcatgccactgctaggagaacggttttttccgtgtggtcaaatttaattttcacgtgtgatggaaaaatcataacttttgtgaatgggtggtgcacccgcacgtaaaaatcggtgcaagtacttatgttgcccgcacgaaaaaacaaaaatccggaaaaaaattcaaaaaattgaaaacctagaatccggcgccgccgccgccttctcatcgtcatcgtcggcctcctcctcctcctcgtcgttctcggcagccgaggatgctgctcccgccctcatcgtcgatggcggaggcctccgcgctcccctccggccgcaccgttgccgacgcccctcccctccgccggatatagggagggaaagaaggggaggggagccggatccggggggaggggggaggcccccggatccgtgttcccctacggccgcactgccgctgccggatccgtgcgagggttggccaccacccaccggatctcgcacgccgttgccacaccaccgtcgccacctacgccccccgccgccgccgttgggactcgggaggagaggagaggagaggacgggaaaaagagatagagaggagagaagaaaaagagatagagagatagagaggagagaggagagaggagagaagagaaaaaagggaaaaatttaaagtgggtaggagtgcagagagagtgtgtatttttttgcgtgcggctctcttaataggctacacgtgaaagcttattttttcagacgctctacaatttaaataggctctgttcaggaaaatcgttttttagcggtgcgcgcgcggccggtaaaatctcgcgcgcaccacaccactcgcgcgcgcgttgtacgtttggcaggagagaccacgagcacgtcaacgagcgtacgcgcgcgcccaacggcaacggatactgcgtggcgcgtcgtcctcgtcctcggcggccgatcacatgcgcgtcgccggtttcactcgctcgctcccgcctcctttggatttatatacaccagcactggtgcggtcgtcacgtactttttggtttgtttacatgatattcccttctgctgctccctcttttggtggatgaagtcaaactgctctagctgttggggttttattccagcataattttgagctagctagctagccatatgtacgtacgcatgtataaatacttggggtacaatggatcggagaagataattcgagttgttttatcgaccggaaagtgcggataatccagatagataggcagattagtattagatgggggaacacttgtatggatgcctttttttcgatctttcggagagacagagggaatcaccgcgctagcaagtatctcccccttgtgtattcgaacacgagatcgattgcgattatgagaagatgtagtaacttgcaagtctaggtttaaatactggactggaccaacttgaccccgaataaggtactactattcggttgcttcatcactgcttgaattgcctatgacactctggcatcatgcgtctgtttacccccaaaacaaagcagcgggctccaggtagtactatctatatatgccaggataactacgcgtagtgatgatcaatctaggtatatattgcgccgatgtgttctttactttaaagtagaaagctttagcattcataaaacccggccgcaatccgcacgaacctttgtgagctgtgacatcatgcacacaacgcttaaaatttacagttcggatttgggggacaagcccatgcctcatcaggttttttttttagtaattcttactacatctcatcagatgcagatgggctgccgctttggcattggactaataaactaatgcctcatgatccgagcttagctactactaccctcctcccctttttacatctgagagagagcgatgctttgatccaaagtcaccatcacatgcgcggctaaggaaaatggagttgctcctgcctctccttcccctccctctctgatgtgagttgctatcaccgtgacaacataagcagcaggcaacttcagattggacagacactaaagaaaagaggccagtggcatggttaatcttttttttctttctttctttctccctcactggctttattcttcttttagtacagcatgagcagtttgtgacgctgatgatgcctagtaggggcccctagcaacatgcaactgggaattcaacttggaagtgctgaagaagaatattatttgttcttactttcagtgtcagtcagtgcagccacaactgaattttatatgtccagctgattgggagcttggagtcactcgcatacccagctgatgtcaacagattggatccacgggttcttttgaagtggataggtttcctttcccttctacgaaacttttcacagcatgctcttccttttatcgtgttcgaaaattcgatgcggtaactttttgttgtgctaaataagacgatctagtgccaacgcgtcactgtgacaccggccagaatagttagttaccttaacaccatcaaagtagaagcgtgtccaagatagtgtctgttccagcccgaagccctgaaatgtagttccaaccggatgtttcaggtcagggacagacagagggactacatgattctgatcagtcatgattattaatgcagcataaataccgtaaacttttcttgggaattcacaaacagttggtctaggtttcaaaaaaaaacaaaaaaacaaacagttggtctgatgagaaaaatatttccgtttgttcagaagagtaaatcagaatagaaataacctgtagaataatagaattacacgattcagacttcagagtgttagtacatagaaaaaggcccattcaattcgtatggtcattgccgagaggttatgggttctgatgtggtctgagcctgcctcaggttagaacgtgtagaaggggaaaaatttggaatagtctaattcatctacctcatctcatgctcctgattaaatcgcttccctcaatcataaagctaggtataacgtctcccccgactttgaaaaccgtgcaaatcaactcattttatagtttagaaagtggtttccgcttatgtggcaggttaaccgcggtcgactcgctgagttagtaggtccaacttgtcaacgacttctgcctcatctcatcttcttccttgcccctcctatctctctttcctctcttccctcttcatcctctcttgagttatgtccaggtgaggccaaagtggagctcggtattgtggagccagctgaggtggtggcgtgactagccgatgcaccgatgaggaggtacggacgccgaagatgaagaccatacatggcgggggtgggggcgggggtgggggcgggggcgggggcgtgtggggg

SEQ ID NO: 63258 - DNA, 3651 bp, Oryza sativa
tacttaaacaacactatgtgtttaaattcttatttcactaagttaaggttttgatcaatgttctctacaaaaggtgacaaattttattttactatgttgaagataactatttgctggttctatagaaactttgttcatttcatttggactaaaaataaattttctacaagttttacaaattaaaggctgctctatgttagtaaatccttatatgaatatttagagacttttactacacagtaagtatataatattatttcataacatggaaatacatgtgttagtgatcctacataacttaattttattcaaattgaagctaaattgggttctacatgaatttctaaagtttagcttatctaaaactagtcattttaaagataatagttttagaggcttttgatgcaaagtaagtaattacttttatttcacttaatcagagactgtatgatgatgaatgatgaatctgtagaatttgattttgtttcaaaatgagttgaaatgaattttctatgtattttataagtttgtacatgttttatgcatgacttatcttagataaatcttagagacattatttgtacagtgagtgtcaagttttatattcctggaataaagttcataacttcaagaatctacagaaactggaatcacttcaaaatgagctatatttgattttatatagattttacaactttgtgcatctttctgctaaacatataattgtttgggcattttcctaatttttcttcagattttaaaggatgggtccacatggctgtgagggaccaatatgcacaaaggcccttgagttttctaggaatcaacccgcagtcctaggcccatatgtcagtgtgtttctacaattgtaaacggatccctgcacttaatctaattcacagaagtcatccctctgctctaggcagagcagagctagccatggctgagctcgatctggagctcgccggcggcaaacggtggctcatttgaggttgaggtcaaaagataaaatgaagacaaagctctcgcgattccattcctctagttttcttggttagaggacatcggagtagcgccgatggcgagtgtgagcggcggtggttttggggtgaaagtgcatgtgcgcatggaagtcgattacgaacgaaaaggatgcatgcatgtggtcttctagacttcaggatgctcaccgtgggtcgagctagggttgtcgaggtcttggcggcagcggtgacttgtggaacggctcggcgacggcgctcctcctcgggtgaacgacgacggctcgaacgggacaatgagctgcttcaagcaagcatgcacgagggttgtgaggtcaaggagatggtgtatgcgcaaggaatcgaacaatggctcaccgaggcagcggtaatcgacgatgacggcggaggcgatcctagattggcgccggtgaagaaaaggatgtgttctccgtgttcttgatgtttccggctggggttcttgaggtgttttgaagaggaggttgaggcgatgacaatggcgcagcggctttctctgaggtggatgagaatggccggacgacgacgatggttgaagcggcggcgctccggtgcgtgctccaggacgttgtcggcgtggtcgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcaaggtttggggcgatggagaggcagagaacctcctccctcggcttcttcagctccagagtgatgaatggagaatggcgacgcgtctgggaggagtagagagcgagaaaagggaaaccgagatcgacgacacgttgcggccacgcgtcggctcgctcaatctcttcctctctcggctggaacagtggaggaagtgatggacagagtcaaggcaagcttaagaggctgtcaggtgggtccaggtcgtggcaaactaggctagggtgagagggttgggtaagattctgggtaaacttgatttttagatcatttttttttcggaattattttctcctctaactttgtagcttcataacttaatgtgtagaccagaagaattagtgtagattttactggtggtagatgattacacctagattccattttctttggttgcactcaaaaataatgggtggactgctcacagaaattaaacaaagatgggctattagaaagctagattgaatttttaggaggcttaaacagaggaggaaaaatctagaaaaattacatttattcatgataactaatctagtatttgaataaattatttcccatgttcacttatgtgcagttaaatgtacttttggatgaaatatggttttagccgattaaatttaatttgatttcttttagttgtctgcttcgaccgattaatttgagatttcaacttgagtgttaacatgttaccaaaattacagaggatatgtttgtgctaatcactgtccacataaatttttccatgattttatcttgcacaaaatattttagagaattaggatgacctttgtttgtatatgtgttcccacttcataattgcatctaatattattatagggattacattaaacttcttttagactgagaagatgatatttgagtttaatattaagtccacatgttatcacccaagattaactataggtttgtttagtgaaataattcttttagattatgctcatgggacctattatggaatgcaagaccaaaactccaaatgcacaaagaactcgagcctaggcatgcattatgtacatgtatgcttgatgacatttctagtctaatgttgggaatgaaaagattttattttgttctcaaattataatcatgcaatggtttaaattggtcatcacctaaattaaaacggaaatttttggctctaaaaattggagaagttaacctctaactattttgacaagaaatttttaagtcctaaaatttcgggtatgttacacttccaccccaaataatgaggaaataggtcccgatcttttgataggtattgattaacaatcgatttggtggagtagcgacacaactcgatccggcttctgaacaaacacgctcttaagccccataatcgcagcaccatattttctctggttatcaaccatgccgaaacccggttgaccttgtcgagaaggctaatccctatatgcgaattcaagaacacaagcaagaacaagatagattgcaacacaattgcatatgaatgattagcactcgaatttggggttccacaaaccgatctagcggcgaaactgttcttgacagattaatctaagcaaaaccccctctaaacgatggtggctactgaataaatatgattagggacatcgtagggttgccttagggtgcacacccgcttgggttaagcccacgacacaattacaaggcccaaaacccaaatcagattcggactggataaggtatgtggcttgttttgcagattcccgacagctcggtaggaattttgatgtgggaccaaaaccatctgaaagtagactccataagtttttcaaaaccatctgacagtactcatgggccccgaaattccttctata

SEQ ID NO: 63259 - DNA, 37415 bp, Oryza sativa
gtggcggtgtcgccatggcggtgaagaaccagcagcgtgcaccccgaccccgagcgggggtgggcctggtgggggacctcagcgggaagattatcagcagcagcagccatgacagccggccggcttagttttactttgttgtgttctcgagagcgcttctggcacaaaacacacacacacatatatatatatatgcacatatacatatatgtatacatgtacatgtacatgtacagtacatgtacatgtacatgtgtacatgtacatgtatatgtatatgtgtgtgtatatatacccatgttaattcttaaaaaatatataaccatgttggatggcgaaactagctatacgtaggaaaaaaaaaatcaaccatgcatgttagatggcaaagctagttatacataggaaggaacaaagtatccctccgtttcaaaatgtttgacaccgttaactttttagcacatatgtttgaccgttcttcaaattttctctaaaaatatgggtttgttggaaccatgccaccctaattttgcaaaatttgagatatgccacctgtatctcaatgacatgtaggacccatatgagtcaatgacatgtgggtcagggtggcatattacaaattttgcaaaatttatgtggcatggttcaaattttccctaaaaaaatttatgaaatatgtaaaactatatgtgtacatgaaagtatatttaacaatgaatcaaatgataaaaaagaataaataattacttaaattttatgaataagacgaatggtcaaacacgtactaaaaaatcaatggtgtcaaatattttgaaacggagggagtgcttcctccactttttactccctccgtattttaatgtatgacgctgttgactttttaatcaacgtttgaccattcgtcttattcaattttttttatgcaaatataaaaatacttatgtcatgcttaaagcccacctcatgtaaatcaagtcacaataaaataaatgataattacataatttttttgaataagacgaaaggtcaaacgtttgtcaaaaagtcaacggcgtcatacattaaaatacggagggagtaatatatatgatgtcatcggttttttaaaataagtttaaccatattcatcttatttaaaaaatatgttattattatttattttattatgacttaatttattgtcaaatgtcatttaagcatgactttagtttcttatatttgtataaaatttttgaataagatgaataatcaaacgtttataaagtcaacaacgttatatattaaaaaacagatacgataatatccagatagttgatgtcgtactaacagccagcaatccctaacagctgggttagcatttctgtctaagctagtggccaatataaacaaatgttagttcaaccaccagtcacaaaataatatctcaccgttggcactggtacaaaaacgatttttgcaagaggctgctaacctttttacacgggcatttatcaagtctaacgatcgacgcgccacgctagctggaatattagaaaatattataagtgcggcagatggggagagctctcggcgtgtccacgtaggataggaacagtgcgcggggtggcgattttgtgaaaaagtccttcgattttgtgtaattcgatataggtccctagaaaatagtacctatgagacgatattttgcgtagaggtccttataaagtacgaatatttcatgtgaaggaaagaaaaatcacgaattaggactgtgctctaaaaagtggaaaacgaggggctttttcgcaagaagacgccactaaccctaccacccataaccctagccgccgccgcccgttctccctcgtcctcccctctttctctccctctcccgccgccgccgcctccggcttccccgtcgcctcgcgtcgccgtcgccgtcgatcgcccctcaaacccttgctgccgccgccgctcgctccccctcgtcccccactctctccctctcccgccgccgccgtctcgcgccgccacctccgcctcgcgccgccacctccgcctcgcgccgttgtcgccgtcgcctcgcgccgccacagacgtcgccgcctccggcttccccgtcgccgtcgaccgcccccgccaccatcgcgggcccccgaaaccctagccgctgccgcccgctccctctcgtcccaccccctccctcgatgctccttctcccgcgacgacgtctcgaggtcagcgcccaactactactcctcgtcattttggttttggttttggtttgggtggttgatgtgtgggtggtggtggtggtgtgccttgtgtaggtacgtggtgctgagcacggcggtgaactgtttggggaggtcagggggggggtgatcatcttgctggagaagaaggcgttcgtggtggagctgttcgacaagtatgtcaaagacgctcggctccgggatcgacgtgctcgcccccctcgtcgaccacatcgcctacgtccactcgctcaaggaggaggccatccccatccctgaccagtccgccatcaccaaggacaacgtctccatccagatcgacggcgtcctttgcgtcaaggttataactcgctcctcgccttaagccgtttctgctttgctgcatttccaattgctggtggtggtggatttaatgagttgtgttgtgcgcgatcgagcttgcaattttgggcggctcaaactggtgtgctcggtttagtgtcagtagcgtcgcggaggcttgtggattgggttgtggctgtaccctacttttgcttggtggcgtcggggccggcagttgcggcggctttagctctggtcctctggatgactggatgcgtccttgcattttggtggttgcgagctggaattagtaactgctttgttgtttcttcggctaactaggctggtcccttttttctttttcagaggtaactgaaagattggggtgactaaattgtttttcaaaacagtaattggggtgactaaattgtttttcaaaattaaacgctgtccaaattgtttttgttagaatttttggggaaatttcaaattgcatgttctaggtaattcaattaccctgaaacaattttgtggaagcacattgaaattcttttattaataaattgtcattcctggttcttatggtcatccattttgctaaggtagagctataagtgtgtcacagtgtactgcatttgattattgctgctctgtttatttgataactttgcatgattgctgatatgttcctgtttttacttacagtgccagcaatttgcctccctcatcagggccacatctacatgtggagttcatctcccataaaagaggatccacatagtatacctcacacatgaactctgtaataagctgaggtgatctttatatgcttcaccaactggtgaccaatgggctcttttctgagaaaacagcccagtttcctcttaattttgttaattctgcaccttggtgctcgtgaagcaagtgcactaagttcagatggtatgtgacagtccatagttatggttggtatttgtgtggtacattagacaatctgtgctcatttactatgattcttttgatggtttcctacagatgaagcacttcttgccttcaagaaggcagttacaacttctgatgggatattcctcaactggcgtgaacaagatgtgtatccttgcaattggaaggttgttagatgtcacagtcacaccaagagagtaatttatctgtaagaccaaaataaaccctacataaatattgtgaaatacttaaaatttcaacctggcaattatttttttcccttttgaatatggcattttctaatataaaaagttcaccgccatcttcgacattggcagctccaacctctgggtgccatcagccaattgttacttctcagtgagtccctgttcgatgcactgttcaagggaagttctcttaagagtctgccaattgcgacttgtgcagttgtgctaatgatggatttttcctggtgatgattgatgcaggttgtgtgcttcttccactctcactacaagtccgggcagtcaagcacttatcagaagaatggtctgtgtcttaaaactttccccaaccgtgctattatttgtgttgtgagtttgcaacaattatggctatcagtctatactattacatggatgcactgaaatcttccccctgtttttttttttttttttttttgttatttactctacagctggtggcatatcttgtattgtatgttgaaatttaaccttttaaagcaaaattggatttggtcgaaatgatgctagatggtggttatttggatttagttataaggatgctagatggtatgtttggattacagtgcgaatcaaattaggaggttgaagctaagaggtttttattcgagttaatgtttttttttataaaaaaaatctaccaaaaagatatatatttgatttgcatatatgcattgaaaattacacatttgcttggtggttataccgtttgtccttctgatgtatatgatgtatgtttacctgtaggatgttttcctccgttcctctatcatcattccctatgacgaggtatggctgcttcactttctgtgttggtcttgaatgattctgattcctaattattttggaagcttttctcataaaccaaaatggttttctaaacctttccacgagcaaataattgtttgcaatgcccttaagactagatgaatccatttttagcatctatgttgctacatcaattgaacaatcaccacctaccgatgcatttccttaagttaatgaatgaccgattcaaataaaagcgagaactattgaaattcttttaaattgcaaccttgccactgccagtgagtgatagaatcaagatgatcaattactccaaagtgatctttagaacatatgtggctctttgttcaaacttctcctaatttctctgcagtccaggtgatatcttcaataaatgtcaaaatcattaagaacaacccacagttgaataggcaggataaacggttggtgctcccatgtggcgatcgtggattaaagtaggaacaatggtttaattgggttattcacggagaagtgatattcgttggttgtcatggctgcctggaagggaattacaacatttgattttaagctttaatagcttaggtagcgtttgggctcactaaagtgcttcctttttcttatcttttagacttccactatgaattatttaacacccataaaagaactttccttgcatgattttctttattatgaaatcaacatttatattgacaaacctgcttagcttcagttggacaatgatacgctgcagtaaggcatctcattgaaggacattggtggattctgcactgctattctattacttaacttcagtagagaatatatttgcccttttgcttgacttcatatggtgttatatttctcattttagatggacattcgtctaatttatctgtaccgtgatctttttctgaaaatattctctgcaaagagaggtcatctgaagcattgttaaaaaacagtaagtagcaaaaaaaaatcatggtacaggagtcaatggtacgcagtagtgaaaacatagttaggagttgcatgttatgttgatttgctattccaaaacgtgtttgaactgtagcaggatgtttgttcctattaaaactagagcttttagccatgtattaccttttgtagcttccctgctgattacgttcgaagaaaacaaaaataatccttattgaaatatgcacattgtaaaacagtaaggggttcttatactgttttctttaattccacaatacagtaaaaagagtgagatcatatggcaacattctttgtgaaagcaacacatccatatctggatgtagtggttgccataatggagacaaggagctgttgaatgtagtattgcttgatgttaaaagtgggtcacaatttccagtgttggaatctaattcagtacatggcaatgaaatttcattgacctctgaaagtgaggtatcaaacttaaggttggtttctattcattcagggttttgactttcattcttctcatacaagtattttcctagaaaatcatgaaaaagcatggtgttttaaatagtggagtactaacattcctctctcaaaattcgctacaggtatactcccatggtacctcagatacatcatgttctaggtgttgaaactgaaagttgcattcattctggtgattcaaactttctggatcttgaatggctttcagcttcaggcaactcaagcgatgaaaggtgtttacttttgcattgctattgtatttttttagcgtttttgactgacagaatatcatcttctcagtgacagtcaatttgatttacacacattttctttgccttagtgtaggaaaaagtgaaggataattattagttgattatcctgtaaatttcttacccttcatgcttaattccatatcaatctattcagagttcttttgctctcactgcatttccatgtgataaacacaaatctgtagtatcgtgctgtaccacttgatataactatctgtattgagaagtaaaatggaaatattatgttgccacgcttcctaaatccaattaacaagtgtcttatgagcttccattgatactgatttgaaaatatcctccgaaacattttttttaaaactcatttaatgctgatggattgtgcttgaacaggtccattgcaattagtactccagatgtgaacctttcagcggagaatgttattgccacaatgtcttcttttgactggtagatttgtatgatcaaatatagttgtaccatcaccatggacacattactccgatcattatgtaaaactttattttcattttttatatgcattggtgcttcatctttagattgtaatgtgtaagagttttgttctcagtagaatctgtacaacgatgtatgcaaaattactcatcaacagcatcccctgcaaatgtattcgtgggttttttccttacataatcattgattcagcctgaaaacaaatgattagtctacagtaatcaaccaatctatgtgtaggtggcgcgccattggcgcgccccagcatctagtataatatgaagccgagcctactggcgagtcttaaaacaaaaaaaaaaagtacgatgagtgtgtaatagtttcagagaaacttagtaaagaatctatgtagcgtatgatgcgcatatctaacatggcaacaaaagctcagccaacaataattcaggctgtgtttagttcagcacaaagtttggattttcgttgaaattggagatgatgtgactgaaaaattgtgtgtttatgacatgttgatgtgatggaaaaggactgaagtttggatctaaactttagatctaaacaccccctcagccgctcacttgatcgaatgtccatgtggaagcgaataatggcgccacatatcaaaaaccgttgactccacaccaatcaagcctgtcaagctcatgcaccagattgtaatgcacatgtacgaaatcacctatatatatcgaaaaaaaaaacgcgtctgttaattagatggccggaggaatgtcagctgggaaaaatcacatgcccatgcttgtcagactgtgcagtggtgctctttcgcaatcaactatatataaatatttaagcaacaagtcaaattctaaaaaagaaatagtaaaatacacggccggtccttaaagttgagcgcgggtgtcacttaggtccataatcttgtaaattgcacatctaggcccaccatcttgtttaagtgactcattgaggtccaaaagacctctgaccgggttgactggcttacgtggcggtccagcgtggcaacatatttgcattttgccctcctttttgattccccgtgtccgatccaatcccttctttgcgtggcgcatgcaggaacgcgccgacggcaacgtgcgccagcacgcacacctgcggcacccacctgtctcaaccacgctgcgcccgctggcgtgcctcgtacccctctggcagccgctcgccggtgttgcgcagcgcccagagaaaccgcacaccgtcgtcgacgggaaggagaaggagcaggggaaggggaaggcccccgctctagccagccgtgggtgcacgcgacaagtggctgcggcagctgctcaagtcaagcttgccctgccgccccgctgccgccatggagctcgcacccgcccagctcgtgccgaactcgccgacgcctcccccacacacgcggccgcggtaggcgacccctccccccgggcatggccggcgacacctcccccgcgcgcgccaagctcaccgacgcctctagcaccaacgaccagcgggaagggagaccgatggatctggccgtcagtgaggcgtgagcgccaccggcacgctagctacgaagacagtgacggcgctccgcaagctctcctctagttccctccgccgcctgccaactgctgccacattcgcccgtcgctgctccgctcgcaccccgccgccgcgcttgccctccaccgttccgcccgccgcccattcgtcaagaaggatttgaggtccacgacggcgcggcgtcctgatcttcgagctcgtccgccgctcgcttcgtcccctctaatactgcgtcgttggcaatcatgcgtcgcttcgtcgaggtccacgatagcggcgacggaggacgctgatgttggcgaggcgaggccggagaacgtgacaagcgaggcggtgcagccgtggtgtgcgactaggcgccgcaacagctcagccatcggtatgacatggccagcgaaggggctgacgatgaggatgacgtgcggcggcggtgggcgatgtgacgacggaggcagctgagggatttgggggttctttttggtgcccagggctctactgaatgcaatgtagatggtcagcttcggtcaaaccgggtttggaccttaatgagtcacttaaacaaaatggtggacctagatgtgcaatttacaagattatgtacctaagtgacacccgcgcacaactttaaggaccggccgtgtattttactaaaaagaaatattaagcgacaagtgagacgtatattcacaacattcgacggttgcaacggggccaaattctacacggagctttgtattaatttttgggaacttttggagtagttgcctttcgtcgtgggtgctgctggctctcctcgaaattcaccaagcaaaatgtcaagaattacacgtgcagaggatcaggtccaaagggcagatgttactacggtatttgcccactatcagaagggacaagtgatgtatatgttaattctttaataattattagttagccttattagttagcctcatcgagtaatttttggtgatcatagtgccttggagatgtttttgtttgtcattgattaggatgatttaatttgtcgctccaatgttatgtgcccctacggatcaatctctctgtaattgtttttctgaatttgggtgcatctatcagtttatcatatcttcaacctcgatgtcatcaattttgtaatttttgtcgatggccatgatctcttccagtattgatgcacaaattagttgagaacagaaaaatgtttggaatgaatgaacaagcatgaattactaggctccactgtaccagtccaggtcaccaccgattgtcgaaactggatttcggcaataataaaagggggtggctatcaagctggaaaagtgtatgggtttggagacaaaggatttatacaggttcaggccttcttataaagaagtaataccctactcctgtccggggatgaatccgccgagtgtattattgattgtatgatttgggaaaaatcaacatctgcccctagaggcgcccggaccccccttatatatgggaaggagtccggattacaaaagataatctatattcctaacggaatatgaagatacaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacagtagcccccgagtcctttgcagtcgaccatcatagccttctcaaagatagtaatccgagtgcttcaaattattcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaaagacaaaataataacacaatttgtgcattatatgacaaaagcatacgcgacacctaaataggcatgctagccgactgctttttagccacaataaaagaaatccgagtggtgtacactctaaaaggttcacgaatgaacacacttgacaggcatccgaatataaaaactctaaagattacccaccaagtattataaagattatggtaataaataagtcaaatagcctaggccatgactatttaccatggaaacaggcatataacacgccaaggaaatgactataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaaatattgggctgaggtactgttcaggcctaggcccattcgtacctccgatacccttaactggaaaatccgatatccaagcgacgcttcgtcttccccgccggaactctcgccattttccccactccttgctacagtgcagaactgcgccggcgaactagggttcaccaatccacccaaatccaccttcgaaaagtacatcaaaatccttcccgtgatccaccgcctcaattcctcacctctcccaagccatccatcaaatcaaatcagcgcattcgggtaaaatcgatggcggaggagaaagaaagctttgaaggccaatgggcgccatccgacgtaacggaagagaacttgaaggagatggtggcgcacggcgttctcccagccaaggagatcattgggtggcggccagcgtgcggtgaggcttttccgacccctgatacacatgagatcgtggtcttctcgcatttcttctacggcggctttgctcttccgacctcaaaatttttccgcgggatcttgaatttctatggaatcagcttgcatcacctaaacccgaattccatagtgcatatcgccaatttcgtccatgtttgtgaagcctttttagggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggatggcatgcaaactggttctatgttcagaatcccgagcctgctcttcccgggtacacttgtcttcctccagtgtaccaagatacttggaactctcttccaatcggagatgaagcagtacaagccttggagttgttggatcgtatgttaaatcttaaagaacaaggattacagggagagcaaatcactcggcacttcatcaaatgccgactggcgccaatcaaggaaagatcccgcacagcattcgagttcgacggcaaacatgatcccaaccgtgaagaaccagactccctggatttcaaaatcatgaaggagaggatgtataaaatcttctcaaatgcaattgtagtcagctactctcaccaactgccagttgtgccatataatgcattcaatccgcctccacaggtatgcatcggaaaccctcaaaccgtgatcagaacataattttatcttcatgctgagttgactaactatggaggcatcttgttcaggaatatgcattgatgaagtcagatccaccagtcactcatcgccggtctcctcgccaacacaccgctcagggaggtggagggccaacgatcagaccagatccgcaacctcagacctccaaattgactggtcaaacaggtcctcgcaagagaaagctggtacttgatgatgatgaaggcgacgatgataaatctggggataagggctcgcctaataaacccccaaagcgtaccatgcccaggaaaaaactggctggccgtgcaatgccaaagatcagaacatcttccaggtatcagacctctcagtatgattccgcttcggaatgttttccgatgaaaataatgctgaatattgaaagaacactctgcaggaaaccatctgatatagatccatctgggaaagaccccgatcctgccatgacagagcaaaatatatccaaggaccccgagccgactgctgaaaaccagccgactgctgaaagccagccgactggcgcccatacttcgggcgataggaccaatccgagtgacctgccgccgactggaaaccagtcggcaacaactgaaacggcaacaactcaagagcccccgactggaaatcagtcggatgcaggtcctgatcaagagatccccgaagtagaagcgcagacgacgacttcgcaaggaccagaggctggtaacgactcgataatcgggtctccaaataaagaacaaagatcacctcacgctcagctaggtacatcttcaggttagttgtcttctcaaacaatggcgatttaaataacctcagtttatccgtctaacgtcttggaaacacatcaggaccatcaggtgatgacggagaggaaatccctcgcataaaggcaaccgacgactctcgtcctcctatcttgatcaaatggtgggacgagaactcacaagccgccggtatagtcataaaccgtcaaaaagaagatgaagaagtgtgccagctgaagaaagcgctcggagaagccactcgtattgtaaatgtaagtcctccgggtgacggccttcggtaactttgttttctttttagcagaacctaaccgtgaaccactatgcagagaatccatcttcgcaatgaggccaaaaccgcaactttagaaaggctggttcctcatttgggaactcttgaagcggttagggaccagctacatgaggccaaggagcacgccaagaagacggagaaggaattaagggaccgaatcgctcagctccaggattcaaactatgagctgagtggttcatcaaaaggtaatccctagatccgtttcatcggtttaaactggcataactgtatcctcaaccatctgaatttcaaacagcgcaagccgccaggatggaacagatggcgaagcaaattgaagccctggagagagacaagacagaactggctgcgcaaagggactcagccttaaaggaagttgaaggtaccgctagcagacaatctgagcttctctctttataatgcaataaatcctcatcataaatgtgttttgtagatcgcaaaataaaatcgcaagcccaatttgacgtcttggttggtaagatcaagaggcttgaaggagcaagggataacgtcgccaatgccgctgcaccaattatccaagccatgttcctcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgacaaaattgcgagcgatgttgtagagcaatttcgcaacaacgacctccgccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaggaagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgataaagttaagcgtagaaacgacgaagatgttcaatgttccaagaattgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacccttgtaagtaccgagctgactgaatcaaagctgcttcgcggacctcttccagtcggtgcaagtcgtccactcggtcttcttcatagcgttcttctcggaaattacggaagcgcaaagattcgaactcgacttcactcggcaacattgcttctgccccgtagacaaggaaaaaaggtgactggcctgtggcccgactgggcgtagtacgcaaagaccaaagtactgatggtaactgtgacacccatttgccggcatagggtttaagccggtcaaaaactcgagctttaatcccttgaagtatcatgccgttggccctctccacctgtccattgctcattgggtgtgctactgaggcatagcaaatcttgattccaaagtcttcacaaaagtctttgaaaactccgccggtgaattgtgtgccattatcagtgatgatccgattgggtactccgaatctgtgcacaatgttgatgaagaaatcgcgagcattatctgctgtaatcgtgacaacaggcttagcttcgatccacttggaaaatttgtcgatggccacgaagaggtgcgtgtaaccgccgactgcctttttaaacgggccaaccatgtcgagcccccaaaccgcaaacggccaagacagcgggatagtctgcaactcttgagctggtagatgaatttgtcgggcaaaaaattggcaaccttcacatgtgcgcacaattttgtcggcgtcggacactgcagtaggccagaaaaaaccctgccggtaagctttgccaacaatagtgcgcgctgcagcatggtttccgcatatcccagaatgtatgtccttcagcaattgtctcccttcctctaaagatacgcagcgttgcagaattcctgaagggcttttcttgtataactcggcttcatgcataacataaagtttgctccgccttgaaatccgctcggcctcatctttgtcttgagggagttcttgagaagtcaaaaatcgtatgaggggctctcgccagtcggcttcaaccatagctatgtcatgagtgtccgcagcttgagtagcatctttgtgaggtactgtcggcgaataaaggtgctcgacgaaaacatcagatggcgctgcctcgcgcttggatccaaagttcgcaagtctatcggcagcttcattgttgtgtcgaagaacatggctaagctcgagtccatcgaacttatcctccagtttgcgtacctcttgtcgatatgccatcatgttgtcgtcaatgcaggaccactctttcataacttggttgacaaccagctgtgaatcacctcgaacaattagacgctttatccctagggaaattgcaatccgtagcccatgaaggagcgcctcatactcggcgacgttgtgagacgccgaaaaatgtatccaaagcacataacttagtctttctccagtcggggaaattaaaaccaccccagctccagtgcccgaaagtctttttgacccgtcaaaatgcatggtccagtgctctattttctccacgggggtatcctcttggcactcggtccactcggcgacaaaatcagctaacgcttgagacttgattgaagtgcgaggcttgaatgatatgtccaaagacatcaactccaaagcccacttagcaatccgcccatttgcttcgcggttgtgcagtacatcgccgagtggaaacgatgtgaccaccgttaccgggtgaccttgaaagtaatgagacagcttcctggtagtaattaaaataccatataacagcttctgaacctgagggtacctcgttttggagtcggccaggacctcgctgacgaagtagattggtcgctgaactttctggacatgaccttcttcctcacgctcgacaaccaagactgtgctcacgacctgggaggtggctgatacatacagcaacaacggctcctgcgggtgtggtgaagctaagaccggtggcttggtgaggagttgtttgaaatcttcgaaggccttctgtgcttcgggtccccattggaaattatctgttttcttcagtagcttgaagaagggcatcccccgctcgccaagtcttgaaacgaatcggctgagcgccgccatgcatccagtcagcttctgaacatccttctgggtgcttggcggtttcatgttgaggatagcagtaactttctccgggttggcttggatgcccctatgagacaccataaaaccaagcagcttccctgacggtactccgaaggtgcacttttcagggttcaatttcatcctgaaagcacggatgctcgcaaaggtttcttctagatccgagatcaaatcatccttttgtttggtcttgacgactacatcatccacataggcttcaacgttgcggccaatttgtgttgagaagcatctctgaatcatacgttgataagttgctcctgcattttttaatccaaacggcatggtgacgtagcagtatgcaccaaaaggcgtgatgaatgaagtcttcaagcagtcggattccttcagtcggatctgatgataccccgagtagcagtccaaaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaactcctccttgatcgcgtccttcctgtcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtctcggcttcggtttctccactttttgaaatcttggcagcgggcacttctccttcgctcaccgtggttgcagccagtcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtatgtgtagtgcgggacggccatgaacttggctaacgccgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccaccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttctgcttccgtttagactcataagccaaggggccgccgaagatatggttgagctccttgcggtggtcttgaaatccagccggggtgtcgccgtcgtccttcttccttgacgtgctttgttcctcgtcggagttcttccgagcaggcttggtatactgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggtgatgtcggagatcttgttacgttgttcagaaaatcgtcggatatattctcgaagggattctccggatttctggataacgttgtaaagatcatattgtgtgccaggacgctcgaaggtgccttggaagttggcgatgaagtggtcgcgtaattcagcccaagatccgatcgtaccacggggcaatccatggagccaagatcgggcggaatctgctaaagccaccggtaaatagttcgccatggccttgttgtctcctcctgctgcgcggattgcgagaccgtagacggtaacccacgattcggggttagtggtgccgtcatacttctctattccagtcggtttgaagccggctggccaatccactcgacgcaggtcgtcggtgaaggctgctactccgtcaaggtcgtcgtcgtggcggtccggtgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgtgctgaggcttggatgacggtagtcatgagatcggaagtggggaactcggctgccagtcggcgtgtggacgctttcggagttaactgggaccgaggccgcaatcatggtcttcgtctggttcaagatgttgacgacgtggtcggatcgattgagctcgttttggttgaggagggtgtcgagaagagtgatcgcggcaaccgcattctgttgaggggtgcggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcttccagtcggcgacgttcttcggtctcccggacttggcgttgctcctccgtctcattattggccatgaaaacgccaaagtagagaggggtgtagttgtcatctaggcttccgtcgaagtcgtcgtagtcgtcgaagtcgttgtagcgagagctaaattcgtcgtactccacgatgtcagtaggacgtgagtcgacggtgggagagctgttgtagtcatctagctgatccgtcgaaaccgtgccgagtggttggaggatgacgccgacttccctgaagctaggcgaaatcggtgttgaagccgacttctgcctaggcctacgggatgaagacgctgtcgtggtgaagacggccgctaaatcgtcggggagcttcatcaggactggtgggtaagtcccatcatcttgatctggtgtcgtcggagaagatgcgatctcggccgagtggtttgaagccgactcggttgagatggtcttgaagtagctttcagccgcgttcgggaatccaaacgggaccgaaagccggttctctcccgactggtctgattccgagtcaaggagagaaatcttgccgaagttgttggtgacgaagtcgaggctgccgaaccgaaacgtctgcccgggtgggaagacgaggtcgtcgatgccggagaaaggacccattgcactgatcggcgaaaagcttgacgctacccctacctggcgcgccaactgtcgaaactggatttcggcaataataaaagggggtggctatcaagctggaaaagtgtatgggtttggagacaaaggatttatacaggttcaggccttcttataaagaagtaataccctactcctgtccggggatgaatccgccgagtgtattattgattgtatgatttgggaaaaatcaacatctgcccctagaggcgcccggaccccccttatatatgggaaggagtccggattacaaaagataatctatattcctaacggaatatgaagatacaggtaaaatacagtcgtaaccgactaagtctcagggtgtttccttgatacacaagttaagaaacaaacccgagatacagataagatattctatctacattaagtatccggtacccaatccaaataccgtcgccgtgtagatatgggatacccataatctccacaccgatgcacccataccatcacctcttacgagtttagctctcgtagaaattaggggtcagtgatgactgatctcatctctgacgggtgaaggcccgtcgatggtgactgtatagaacttgtcacagatgactcaatctcgatcgtctcataagttgtggcccatcagtgatgagtgtaacccaacaaaaagataaaagaataagagtgaagaataacttgtgacccatcacaattacaggtgtgaaaaacccagttaaaaaaataaaaactaaaatgatgctcggttgcaacaggaagcaaaatgtgtattaacagtaatatatctatggttattaacccaaaacattttacttcagactaactctttctacaagaaacaaatgacccgactcttcttctataatcagccatctgcctctccaaaccccagcagcacaaatcagtgggcttcaaaaagaacacaactcaatcagaaaattggcatcaaaacttgcaagatccaaaacatgacacaaacacaaaaaaaatacttgcaaaatccttgttgcctcgatgacttgagactccgaagaacgacatgacaatcctgaggagaccggagaagaggcagaggccgcggtggtgcacactctaggatggaccttggggtaaaggcagagaggcggtgatggcaacgggattatgggattcccgatcttccttcaggtgaagataactatcgatttggtggaaacttgacacacacgatccaacttccgatcaacatgatccaaaccctacaatcgtagtagcacgtcttctctgattatcagccatgctaaaaccgattgaccttgccgagaaggctaatccctgcgtgtgaatcaaagaacacaagtaagaacaagaaaaacaacaacttaattgcaaatgaatgattatttaagaactcgacgttggggtttcacaaaccaatctagcagcgaaactgcgaaggcagaaataatctaagcaaaacacaaccctaactcaatgataactactgaatatataggttctagggtcgaccttagacccctgtacgcctccctattagactccgagacgacacacggcccaatgggcccaaagacggggacatagcacctgatagattctgaatgcctttttgttttgaagattcccattgattcggaaggaattttgacgtgggatcagatccattggaaaggtggtctcgttagctttccatacatatgtagaacgtcgaaatcggagtccaaatacaacctggatgatgaatttagtgtggactgctcctggagcccgaagtggaccttcatcttgtcttgaacgtccatgatgatcttgtccatctcctaacctctctccaagtgctccatggttgtctctatagttcctaatcataattaaatcattaggtagcaatctatcctcaagagcacataaagaagtacttaggaacgagctcacttgtaaatttaattgtcgggcacgagctctagtgattggaccttacaaaacaacatgaggagtagcatgtgtatccaaaggagtgatgccttcatcaggtggccaccgatgatcttggagcggaggatggaggaggaggcggctagagcttaggggcgttcagatccagtggtccccaacctcctggagaccaaatctggtgtctcgtagctcggaggcggtgaagaggcagacaatggctaccatgcaggagagggtggaggaggtggcggccgaagctctagggaatttagatccggtggtctccaacttgttggataccagatctggcgtcccattgtttgttggcagcggagaggcggccgctgacaaccttagggcgaagggtagaggaggcaacagccgaagcttgggaatggacgatatgaggagatgacgacagtaccagccaaagctcagggcagataggcaagcttgccggtgcttgggggtcgacgtgatgaggacgttatggcggtgacggatggagctcaaatgcggagaagcgagctcgctgacactcgaggtcgatgtgacgacggcgacggcgacggtcgtcgcttggggtggaggaagcggcctctggcgctcggggcccgagaggacatgggggccactcagggggtgctcagctggggagggagagctatggttgattggttgctgagataaaaagaagggagagagatgtgtggataaggacttagtggtgtcttcgatttctttcgatgggagagagagaaagagctatgatgggtaaaagaatatacccatatacgaggagtgtcctcacttgtgacggtttatatttttttgtaccttcacaggtaaaagggtcatctatgatgggtctataggtgagcatgtcaaacgtgctatgtgtcgggtgcacatactggcctgccacaactggccccttatgtgtgatgggccacatctagaatgggctccaattgaacccatcacaaatgcgttcacctgtgatgagacactttggcccgttactgataggtcatcatagatggatcaatctggtatagttctctgtcaagaagataaaacagtgcgagacaacataatgttcagaaaatgtatccaacaagtacgtctggcttgaactacttttccctgttttcagtttcttgtttcagaaaggaatgcgatttaattcctagacatgttttcacaatatatatgcacatgagtgattagtcaagaatgacaacggtacagggtactggaacttcaaattaaggaacacaaaacatctttccctgtagaatttaataacgaaataatctcacaacaaccaaacactaccgagctcacacaccctcccagaacaacaaaaacaaaatacaaatccaaaccaataaattaatttccataaataatttgcatcgtgagtatttatgcaatacattcgttcaaaaaaaaagtattaatgaaataggacaagcatgccggaggagtttaattatggcctcacctttggtcagagcttgactgagcttggaggaggcggagccgaagactaagctgatcataaattctttcgataacagaattagatctagacatgtacatgctagctagtataagacgacgatctctttgtttaattttgcgtgtcaatgaatggataattttgctagctgctagtaggaagaaaaatctctgggatttaactagcatatatagggtaaattttgtggaaggacactcaacttttgcatgcgctattcgattcatgattacctttgctgaaatacggtgaactttattttgcgtggttgcctgcaaagtggcagtacaaaatattgaaaccgctagtttatgtctctttgagcaggtattgggagcacccttatatatggatgtgcggcaaggtcatttatttaataaaacatatttaattttctcattaatttttatactaacccaaagattaataataatataattaatttacttatgaggaataacaacccctcccaaaaaagaaaaaggatcactcagtctttgtagatgttgctacttaacccttcaaagattcacgttgcatttcttcaaagattcacgttgcatttcagcatcttcagttttattattctctcgatctatacatagacgtaatcttgcatgcaatgtagttcttcaaagattcacgttgcatttcagcatcttcagttttattattctctcgatctatacatagacgtaatcttgcatgcaatgtagttctttcttccagctgaacagggccaagcatgcctgcatggattctcctatctaattaacttcctctcacactcagtcagtcaaatgctgttacttatcctcgcatgatttacgttgcattacaacctacatcttcttcagttggattattctccctataaatacacatcatcatacagttaaacctcatcactctcttgtgtgacagaggagcttgaaactttaaagccgaggtcttagtattagccgttagctctctcacagccaattaacgagccatgggtgagagaaaagctggaatttgcttggttttggtacttcttctgtcaacacttgcgcaacatgcttatgctggttagttcttcatgctccttgacctcccttctctatccctctccaatgtattgtgttcgagtatcatttcatatgtattatctattattcaattgtatgtagaaactgaaatcttaatttaatttttatttcttatgtgatgactaagcaacggcaaatctaatgccccgagaccccggcccggggcggccgcctgatgtcatcggtagttggtacattaaaattctatataattggaaggcccgaagatagaagttttatagaatatactagctatggtataattaactatgttatgcctatgctagctgtaaaactgttatggattcaccactatgagtaaggattcaccactataagtaaggataaaagagattattataggttctattttccaatgttttgtgtgattaagatcatcaaccaagtgagattattgtaagttcactggctaaattaattttgtagaacaatggtgctggtatgaagtttccgtgtcgccgatctgtgccggtttcacttgcaagttcgactgctggtttttcgccaaagtcaacaaagccaaagtccagtctcacaagtgcttgggaaaaggttacaagatcaaatgtttgtgccaactttgtaagaatgtttagtaccactgaagacaagatattatgttatgttctattgtaattgtaggagttttattaataatttgcagaagtgatcttttagttggttgttgtcacatcctgattttcgtttcaggatttataaattatttaataaattaataatagaatttatattaaatgttcattaatttacaagtgaagttaaatgtggaaaataaaatttcctaaatttaaagcatggatggatttaatttttattaaattctccatggttaattatactctctggaatattctcggatttttcggagctcaattcctaatttttaatcttacaaagagcatttcagtaattacccacatattaaattaatcattaaatggtctaattataattttgttaagtactttgcgtgtccaagtattttcaagatttttcttggaattatttgagcataggaagtatttttaacaattcaaagatcatttcagtgattaatttaattggaaaagtatttaaaatccccttctccttttcgggccgaaataggaaaagttcagcttctgtcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatccggccttttatctcgtgtatttccaaaattagttgaggggaaatactcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccctctttcccgtgatctctcgtgctccgtagcctcgtcgccgcgtcgcgcaagccgccgacgtcgccggtcaacgtgcagccgcgctgcgccgtcgccctagccgtcgccgctgcctcctctcgccgccggcgggtgcgcgtgaccgagggctagcccggccgccccttccccgtcgtcgccggccaccggagcccctccgccgccggtcaaccgagccgccgccgtcgcccctctcgtcgccggccgtcgtcggtcgttgttcggcacttcggtgagcaccatcgggttcgtctcgtcgttctctacgtgtaggtgtcctccaaatccgcagccggtcgccctagctccggcgaggtcgccatccgagccggccgcctttgatgatgtcatcatgacatcatcggtttttctttttcccgtttttctaatagattaaatcttcggaaattcataactaaatcatcgtaactcggttttgagtggttcaagttgctaaattcatctaaaatcatgatctacatgttcgtttactttatatgtattgtttttttggtttttattagtctttttcttcgttttgcgtgttagcttgtcgtttccgtcgttgcgaaggttcgtgagtgcgtcggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcatactattgggataacttatgactcactattatttaaggatggcttaatgatagttcacgatggttaatcgtgattggttaattaattacttgccaactaaaacttgataatggtgggttgtgagcacatggttttgagagtcgtgctcatggcaattaaggaccggttcgcgagctactattgtgagacatttaccgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataactggtaacaatttgcttagctcctggtttggagttagatctgtacagccgggtatggttgttcaggatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgtaaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacagttgtcgatcgttagctagtagtgtcattgaataatttgtgctagtcatatgttcgtaagctagctagatccctaaatttatctctttgaagtacaccgtcgttgttaatttgtttggcattatgattaatttgacttctacctccaatggtgtactgtcacaatgtgcatcttatcaaattattatataatttcgatacatatataatgatatttctcggcgagggcgtttcagcccgagagaaaagaaaatcagagcactgttagtctcctgtgtattccggccggtggctatcatcatatcttattatcttatcttatatagtgaaagcaacaagctttcttacacgagaacacgccacatcatcaaaaacatatcaaccgttgaataaagaatttagataaataatggccattggatcaaaaggttacatatgcattaaaaaaataacaatagcataaacatatgggaatttatagaggtttctagtgcctcctcttatagacacatggtacaaagagagcgggggcaaagataatgaagaaaaaaaaaaccaagaagcttctagtgatttctcatatagcacgacttagctaaatctatagttagctagaccaatagatactttgtaaataaaataactcatctaaaatcttctataaactaatagatcctatacaacaaatagttcttatatggaatcaaaagtcgcgcaacgcatggcttgttatcattggggatattaaagagacgtttcaaagtttctaagatccaaaagtttcaaagacgcattacaaatcgatctatttaatttgtaattatttctgtcatttcagtatcatgatatgcaacctctgtccaggtgatgccatcagaatttgagttgatgatctctttcatcgtatcgatccaatgcagattgattagttgagaatatataggaaatgtcggaatgaacaatcatgaattattagaaaaatgtaaattaaggaaaatatatccaacatgccttaactctcaaattaaggaatgtgactcagtttcaagatttgtgtttcataacatgttccctctgctcaaaaatacatggccatgtgtcattttttttttcaaaattggcttataaaaaaagtaatgaatacttagtttgaaaacatatggtgtgttgtacatatgtcatgaaaagtacacatacaatctcataaaagtttctacggaaattagaaattataaccactagtcgctaacccatgcattacataggctactctttaatattaaaattatattattacattgcatgtgttggttgtgagttgatattgatctgctcatactaaaattagggtccacgttagttacaagttactacttatgaattttgaattctagattttaattaataaatactaaattcagagtataagatggatacgatatgatatttttaattatgaattttattactaaattagagtctgtgctattttcatttgtgtcatttgtttatttaacatgactctcagcatgaactacattcacaataatccgatgcatcaaatcaatttctagctaatgtgagagttcatagaaagttttaattagcataagtgcaaatagattgtattttgttttactgatgaaattacaatcatgaaatatgctatccaaccttcattaatctcttccaattaattcatgtttttatactacaataatattattatttgcagcttactattggaaccctcatatccagagaaaatttagtggtaaagaaaaatgtcaaagcacacctcattaatagaaaagtagtacacatgggtagacaaagaatgtacattgaagagataagatttctaagtttgcgaggtaagctaagctttcttccttgtccatgcccggtttaagttcaagcctttacacgaatgctcgtatttatgactaattattctttcaatatgtagtaggtgacgatatatccatcaatatcgagatatttgtgatgactttgtttattctatgatattctaatccagtcttaagaggtgctcatacatttagaatttgtgtgtgtgtgagtgtgtgtttataagagtatgtgtttgtgcgtgtgtatgagagtcgacgtttgtactgcatgtcagattatttaatttgccaagtgaggatagataaaaggacataaatcaaatttagagtttaagttattttgggacggaaaaaacagatatagcaagtgaaaagcagtttaccaaacaagaaaaaaatatagtttaccaaacggaaacgactatatatatatatagatgatagaaattattagtaccagacatctgacgcaacaagaaaaatgggacgagaaaattactaaatcttgtccactccacacatccatacatgctgtaatgattttcaaaatatttttttcttttgaactacttatccaatctatgatataatcacaccattatatttgttataattaaatctcatattcttacattctgatgaaagaaaagatatgtttcaatcctttaaattaaatgtttcagacgtgatatatagaaatatatttcaaacatgtgtttttattatgtttcataaaataatttaaatgtttcactaactggtgtttcagcatgtataacttaatgtttcaccaatgaccgaagaagtacaggatggtcaggctcctactctctctcctgtcattctattgactccctcaccatgcatgcatgcatacatgtattagtgatcttaaaaatatttttttcttctaaactatttatctgatgaacgattcgatcacaccgttgaattcgtcataattaaatctttaaagatatcccatgattatattctgataaaagaaaaacatatgtttcaaacaataaaaacttattgtttcatacgtaatagcaatatgtttcaccacgtgttctcattttgtttcacaaaatttctatatgtttcataggctgatttttctgtttcatcgtgtataacttaatgttgcatcaacggtcaactgaaacatttgattaggcggtagccgttaattaatcacactcatatcataagttggtcatgatgtggtgcatgcgtacattatattggtgaagttttccggctgaacaggtccatatgcatatgcatgaatattcaactaactcagtcactgccgttatccacccacatttcacgtcccccatcaatcgagcgcctttgatttctcctctctataaatagacatcttatcatcatatctcttcatgatagaacagtttgattcccatatcataggaattagttatcgattctgaagctagctacaagtctcgggtaataattaagcccgatcagagctaatcagccatggttgggagaaaagctgccatttgtttcgtcttgatgcttctgttatcacttgggaattctataccaacacctataggttattctctctcacacacactgttatactcatttttttatcaaagaatctcatgtatattctcattgtgttgaaggatatacatatttaatttgtcgataagaaccaattcatttttcagtacttttaaatgtttctcgatttttaaaccgaaaacttgatttttaaatgtttcttgtgattaattatggcaaatgaaatgagattattaatggtataagttactgatgggttaaattaatttatggcagatacttgtacgcaatctgtttccatattgccgatctgcgtgggtttcacatgcaagtaccactgttgggttttctcgaaattcaccaaaggcaaagccattgatcacaagtgcttgggaaaaggttacaagacaaaatgttactgcttgatttgcaggaaatagtagcactgaagatgagatgttgccggggtcaatgatttgctagagtctttagttaggttattagctagtctggtcgaataattgatttgtgctaatttttttggtaatagggtgattgattatttcaatttcaaataataatatattatcttgctatgggaactctctataaagtgttgtgatactggaatagtcttggtgattttgagaaggagcaacttacatatggtgagtgataggcagggttaaaaaaatatttggtgacccattgccgcttgggagtggtttcatcacttatcacaggttgagctcaataaatgacaaaaaactagtgaaatttagacaaatcttgccaaaacattgattttatttttgaacttgttggccagttttccaagcagtttattgatcttgaatttatttcatcagatcttaaattttcatattggattattctatacttaattggagataaaaaaaatgctcaaatgctatggccatgggaacaatcttattatttgagtacatgactggctacatcaaaataaatagaaaagatcatcatatcttcacaattatggaaatgttaataactttacaaaataacaataaaattctcatatccgaagcaaccatttattttaattttttaattttaagctgccattggatgatcatcgcaatgtacaaatttcactagaaaaatacccttttatcctaaccaaataatctagcttgcacccaccattttgtagcaattcatcatacacaagttctgcagccacgtgcaggggatctcactagtaactctttggagttgtgttttcaagtgttcattaatttgtttggtacccctccatcccaaattataaggccattcccaatccattgactggtatgatatccatagcattaaataagctgcaatctaagatgaaaaaataatgtggcaagtgaataaacgagtaaagagaaggaaaccaggtcttacatgagacatggtttctacacaacatattagtattgacgaaataaaagccgtgtacagtggtggcaaaaaatcgatggatcctatccgactcagagcgattttttaatagacggtatttttttagcaccgttttttaaaatggcgcgttttttcttatagttttttcctcccatgttttttttaaaaaaattaccgacgttggaaataatttttctcacgtgttttttatttttttatggaagatggaaagccttttttagcattttttgcgctttttcctgacttttttctcacgcgtttttttgaatcattgttattttctcgtgcattttctctttttaaatcgtttttattttctcgtgcattttgaatcgtttatattttctttttacgcacctttcagcttttgttctctctcttttattattattttttaaaaaaacaacctcaagtaccttattgcaagattatagggactcaaatataaatataaaaattacagggactcaaatgtaaaagtacaaacctaaaaaataaaatcatataaaaatggaatgctctcgacctataggttccgtcttttatacagatctttaatccggcacatcattttgtttcaccaagatgtgtgagatatcacggtatagattaaaactgaaaggagtggtggctaatatctcggactcagaaggagtggctccttttatttttcgtttttaagggggaatcggatctatagtcggacctttttgtcgtttatgagaggaatcggataggagtcggactattttttttcgcttttttttctttcgccccgttttttttatcggacaattatttttggggaatcagacaaattcttttttcccccggtttttattttaccacgtcagatttgtttttttttcgcacgttttcttacccccggtttttttatcggacaattttggtttttttttttcgcccggtcttttttcgcccttttttctggttcggacagatttgcagatttgttttttcttttcttttttccgcacattttctttcacccggtttttttattagataatttacgtttttctttcgcctgtttttttagattggacaattttggttttttttcgcctcttttttctggatatttgtataaaatatataatttaaaaatgtattatgatcctatgataccatgatactgcagatctatcctatagctagtatctatactgattaccttggtgaaggggtgcctccacgccgccaaaggaatcgtggcagcagaaacgggggattgcctccttgcaatgtgtgtagggcagttggatttcgataatgatgatgacgaaagatattcggacgttataggatcgatccgatcgatactatggtactcccactatttactataagtcatttgactttttattagtcagattttgttaagcttaatcaaatttataaaaaatatataaatattgtcaatacaaaacaaacatattataaaaatatattcaatgtaaaatgtaatgaaactaattttatgttatagatgttgctaacttttttcataaacttggtcaaaataaaaaactttaactatgaaaaaaaaagtcaaataacttataatttgaaacagagtgaatactacaaatcagaaaacggcattagctaagtatctactccctccgtactcgaattagatgtcgttttggcatcgctcgcgttttcgcaaaggatgtcgctgtacgctcggaggaaaggaggtggacgtgtttgcccctgcgcatgcgtgctcgtcgtccgcagtaatcacgcgcattaatcgtgcctgttcgttaagctcgctgctcggactctgttcagcgaatcagcgctcgcatcgcctcgctgcgcacgcttgagttaatttcttcgtaggcgcatgctcgaagaaattattcgctgcgcggcttccttcctcgtcgcaggtcctcctcgcctcgcctcgcctcacagctcgccgctcgccgcacgtcctccttccttcctcgcgctcgcgttcctctcccgcagcacgctcgccatggagctcggcgccatgaagctcgctctagacatggaggagacgctggactcagaggtcgcactcgactcagagatgacgctgtgggactcagtcgagatggcgctggactccgtcaaggtggatctggactcagtcgaggtcgcactggactagagtgacgcctaagcaaaccttttttcaaatacctttgtatcctagctttgtttataccaagtttactagacacatcttctatggtcattctttacttgagaggaatgttgcgcaattgtttcaaatcaagagggattgccttatggccacatctacccttctttctacttgcaaccacaattggactgaccgaatgtgcaatccaaattgattagcaacaattcttgtatctgtattgcctagtgtcccattcttgcttttagccagcaatacttgatacacttgttttctgacttcttctgtcatttctttctttcgatggtttggttctagtaagaggaaaaaaaacaagcacattcaaaataatatccacggcttacctaaaaaacaatcatacatggaaagtacaaactgagaaaggaaataataaccacggcttaccagcgatgttttgtacgaaatcaaaatcaaatgcaccatattcatcttagtggtaagttcaaatcaaatcctgtcgaaaatgaaagaacacactgataatggaaactaatttgcatgagactgctgtgaatatcaaaaaacaaaactaatttcctcatactccaacggaaacaatgaaacaatgaaatgatgcattaccgttgccgtgctctgccgcaggttcgttgagatcgaacccaggaaataaatcggccatgtgcggatggctcagtacatgaacaagtgaggaagaggtggcgttaagaagtggcgtgtcttaaatagatcaagcaggagatgggagacccaagcgtcggtccagacagcgtgccgtgagcgcgccagtgaaaaccaaggcaaaaaaaaaaacgagcagcaacgcgccaaaaccgaatgccatgcaaatgagccaaactcgcccgctagcgaagggatttgaaccatatgcccacaggccttaaggcgcggctgcctaaccaatctagctacgaacaattcttgcacaaggaaacccacctgatcatttagagcaggtacaatagggctgacccatcagctccaataattgccacgtcacattatttctacgtggaagggtaatgattgaggggaaagagaagagctggcgactaaattgtcgccaagctataacgcattttttgggggcatagcgcccgcttgcagcgcatttagattggatgacatggggtaggtatgtcacaaggtgacatagtgtagatctcagtccttctaaataaatccagcggctgagattcgtccacgtcattacaagttaaaatttaactccaataaaattttaactcctgaaattttaactaccagtaaaatttttactcatacgagttaaattttaactcatgatgatgtgaacgaatctcagccgttggatttattttggagagctgagatctacgctatgtcaccttatgacatgtctatcctatctcacccaatctgaatccgcttgcagccgaggcaggcgcctaaaaacgcgggttgtggggcccacgaccggaaaaactgatatgtgcccgcaccgttcttaggccgcgatccactgatccgatcccctttccc

SEQ ID NO: 63260 - DNA, 18074 bp, Oryza sativa
aatgggccgacggcccatttgacaaaaaggaggaaaaagaaaggaaaaaagaaaaagaaaaggaaaaaggatttttccctggaattaacaatattgcttgctcaattttaattggttaaaattatttctagagctctgaaaattccactaaaaatcctgttaatgcatttcgacatgtagaattcaagaaaaattccacatgtcaaatccgattattgtttgcattgttttcttagggttttatcctgatttcctctgcattttcttggggtcatttgtaatttacaatttggcttgggaggaaaacttcggggtgtgacacgcgccgcacgcacgctgaccgcgcgaccgcgtgggtcccactcccggtcgtcgtcctcctcccgcctggctcctccctctcccgtgaaaccctatccgttccctccctcaaatccgcgcgaatcaattaacttctttccaaattgattagggggaattaattccctttccttcctcttcaattccccctaattttcccattgaatggcaccctcaatcgcccggaacggccgcgccatccccggccaccttccatggccgccggccgccatacccacaaccgttctgacttcctccttggccggctccctcccctcatctataaaatggaaccccctcggtccgtcctccagttttagcccccttccgcgcttttccgggggcttaacaacttttcccggctttctccttctctctctccggcgccggccacctccagccgcacctcccaccacgaccgtgcgccgtccggttgctccatcgccaccctcggcctcgcaggtgcatcctcttccccggcgtcgcctccgtttcgtggggaaaccaccggagacgcgtcctcgccgatgaccagtggtgtcgccaccactccaccgcgtcctttgcaccggccgacgtcgccaccacttccctcggctccgcgacgccgtcctcatctccggcctcacctcctcctcgcccgaagctcgccggagtggtctcctcgtcggcgtccagtacctcacctcctccgggcggctactcttcctcgccggtgagccagcctacgctgccgtctcctccctcggcacggtgacgtcgcccttcaccccgccctgccctcggttttgccggaacgccgccgccgcaccggcctctccttcctcctcatcgacgtctcctccggcagccccttccgccgtgcctgtgcgccggccgacgtcgtcgtctcctccttcagcatcgcagtggcaaggtcgtccttggcctcgcctcccctccacccgaaccccactggcgttcatcgtcaccaccccgccggtcttcgtcgtcgtcctcttgtcgttcccggttgcgctcgtcgtcggccctcccttcgtcaagccgatcgcgttcgccgcccgcgtttcgtcaagtgtgcagcagccccgtcgtcgtcttcatcctcggctccgcgtcgtcaagccttatgctggccgcgtctcgtcttcatccaaggatcgccgccgaagtcgtccccttgccgtcatctccgtcattcccgttcgtctccgctgcccgttcaccgtagtcgttcccacgcctcgtcgcgtggtggtaaggatctctccttcgctgccccgtcctcgttctttttgtgtcgccctgtgcccgttgtgcggttgtcgaccctggtacccgtgtaccggtgtcggtagtcgttcgtgtgtgcgtgtggtgaccgtgtttgtgtgcccgctcggtagccgcgtggtttccacgtgtgcagcccgcgtggtgtcaagtggagtccgtttgtcggccactcgcctcggttgacacacggggtccgcttccgccgacccgtggaccgtctttgtgtactcggtctaccgtagtcctttaggttgacatgtggggtccgcatgtcaacagcgtagccttcctgtcttttccaggctagcacttacacatgttttatagttgtaaaacctaattacaataatccgtaaatctccatgtaacagcattaaacttcggatgaccatatcttggtcatacgaactccgaatcgacccgttcaagtcttttaatgtttgttataacctaaagaaccttgtgcttttctttttatgtattgttattgcttctttatagggtttagctttgcttatgtgcttcgcatagcttctgtcattctggaggttcccgaagcgtggttcgcgatcgtcaccaaaggttcggaaggccgttctctctgagcaaggcaagtcgcattatccttgagcatattgaatcccagtttataaaattattttgatttaaattaatgcattatcgctttatttaaattcccgcgttatcactattttatttagccatgactatttacctttgttatgaccttattactattgctattgttattattaccttgttcaccctagaataaataaaacccaactagtgggtactctatacatggttccactagtatgaacttaggtagatgcttcgttggttaattaggcaacattaggtggttttataactttagactttgggaattctcatatcacttggacactatggaatggttggcttatggtggaattggacatacccctctcttcctctttcaaaacccctaaaacctattttccggtggggtttgggtgcatgccagttgtgggaagtagcaccccggccaatataaggattaagctcggcctctgttgcaaagcactaccgtactaaccacatgtctaatggataaggcttaactcggtgctcagtctagtcctgaacaaaaggacacggatagagatggatgaagtcgttgcgacgatggatatttctgaggcaaatgaaggctacgcgagctgcgtctcggtaatcgagatgtctaggcaaatgaaggctacacgggtcggtgcccgttagtcgagatgccatggcactggactagtacgcgggtggtctcacccctatatgtgcggcgcacccggtctagatcctgttgctaggggctcaatcctagcctgcctgtccgggataccggccgtaggcagggttgggtcggtacttttgttcacggctaggatgggtgaagggttatgtcacatgtttacgacggattccaaggccatggaatgcggagtaaagatgtgtcttgtgggtaaagatgtacacctctgatcagagtaaatctattagaatagccgcgccctcggttatgggcaagcctagcaatgtacccaagttagtggtttaattcttaaaacttgcttaacaactaaaatgtgtaatggttggcctgggttggcttgggacgagctgggacccaggtcaggttgccagttcggtctgaatcatcgtaggccttgggttaaggcaggttcgtgagggttcacagccttgattaataatattgtgtagctctaggatcgtttttacaaaatagctttgagcaactaagtgacttttaaatgctgtttactgcaaaacctagcccctatattattaccccttgtacccccttgcattaatcatgcatcttccggtgtgacttgctgagtactgtggttgtactcattcttgctctatctttccccccttcagtaagagaagctttggagaagaaatcctaggtggagtcctggcttataccccagttgagtgcctgtgaagatggagccgtaggcctgctagtccgctgctgtttatttttgtttgtcaggcctgaagtgcttttgtaataatgtaaatattatcgatataataaagatgtgtcttttatatcatgtttgtgtggtgtaccccggcttttcctgggatggggactaatacactagcgttctggaaaaggtatttttccgggcgcggcaaccaggtatcgcaaacccagccgatgcattcattgagccttgctgctgaatcggctgaaccacctgttgccttaatggcgtctgttgaaccggctgcaaaacctgccgtctttgtggtgtctgctgaattggttgcacaacctgttggactggggatgtttgttgaatcggctgcacaacctgctgccttggcggtgtttgctgaatcggctgttgctgggttggatcaatggcatgttgaggaggtaagaacatagatgcaacctggtcttgggttagccgattcacattctgtccactgtgctgtggttgttctctcaccaacaatcggggattaactaattggcctagagccgaaagtggtgcggcaggtgtaggagctggtgatggtgccgtcggctgagccgatggtgcattaagagggatcgactggacaactggttgattattgatgactaatggccgataattcgagaagactcctcctggtaagtagactggtcctgtagcttgatactcggccattgaaccatcaaccattgacttcaccatatttgccaaagtattgattaatatcctagattgattgatcagagcatggtgtacagcatagtcaacctgatcttggaaattgttaaactgcaactgtgctgcattgccatcttgattaggtccttcacctttaactccctgagcaccatcaccttgaactccctgtgctccctgagagttatcaccttgatttccttgagaatcatctgtagcacctttgttgctcggttgagccgagccatctggggcttgtttcacctctccatccttagaagaaccggtcccaggaacatcagcaactacttttaccttgtacttttgcaccactgtccccttgcgggtctgcatgaatgagctcaagaactgattccctgcctgctgcatcattgcttcgaaatccttcttctgatcaggtgtcaacttgtctggagtaatggtcacgatgttgccctcattaacatcagataagcccagctgctgaatcttctctttaacagaacctggactaaccgaagacggcgacgctggcggcttctcgtccatgaggaaagctgctgacttctaatctgtcccactgggcgtgccaaaagcgtgttgatggaaaacacgaggcctaggatatctgcttaactccagtgcaggtccaaaactcgccttcgggtatacaagcgtgccagttgatttgatcatgcaatcaacaagaaataaaggcaaagaaactgtggttaaatctataaacgatagccgatcggctaagtgctgatgacatatcatttatctttgagccgatgtcatatatgcatcgatcggcagttatagataaataataaagaactaaatctgttcgatcggctgtagatattaacaatatataatccttatgtcgatatatacttaaatcaagtgattgggatagatcggtcaccatgccgggacagtataaatcacttagattgaaatatatactaacaacgagactatatatgttcatggcataaccgatcaaatagatctagcacgtatcggctaatactccgatactactctatactaagatattaaaagcaagtaggatatatcaaacaaaagcttaatatacttaaatgctacaagatcttaatataaagggcagattcaacatatcaatgaagcatataaagcaaatatagttaaatcaggtaagattggctgaaaccccgatgctaccctaatcggcaaccagaaggcaggctaaagattcatattctaagcacgacttaatagatcaaactcaactgatgcagcattaagtatgaaaagaagaacaatatctagacaatcaagccgctggaagttttatagagtggtagatatcctatataatctaagtcaacatcgatgtctaacctaatcggctaccctctaccgacagatgttagccaattgtaggttagatagcgatactgtcagagattacgtaagatatatgataactcgacgaattacataaacaagattagagtatcataaagatggaagcattaatcccgagaacgcaagctgccataacaagttttacctcttgttgaatatcgaaaccgatgcagctcaacccgaaagcaagaactcgtcgaaacaaaacgaaagtaaaatggtggcgatgcgccgagattgtattgaacgtgtgtgttcattaattacatagggttcggggtcaatttatacccgcaaattacaaactatgcccatatcggacatgactcttatctctaacaaactctaagataccataagtctttacggcagacttttgcccaaacatatctctaaggaaattacataaaatatcctaattaatagatacaattgccttcccaggactctatccatgcgtggcaatcatcttgaagcatatcaactcaacccgacgttgtacaccaagtcgtattgtcggaatcgactgcatcaccaaaccaagtctgactcgaatttagccgatccaatcatagccgatccggactccagccaattcttactctgttcccgtgataatccttatctttgattccgcttcgatctaatcttcctttccgatgctgatattaccaaatttggtcattaacagtcgggtccgcccctcctgtcaccgtcaccgcgcgggagggggagcaagatctaccgtccccatgcctcccaactgctggatctgccactgccgcacctccctaccgcctgatccgccgcaccgcacatccccaccaccagatccgccgccgccgccgtacgggggaggtcgaatgtcatcggatctgcttgggcgacgaccgccgtgcctccccaccaccagatctgccactaccggcgcatccctaccaccggatccgccgccgccatgcaggggagggcggccaccatctgagccacgcgggcgacgaacgtcgccaccatcacgcgcttcctacgccctccctagctacccaagccctccaccgccgtcaggagggaggagaggggtgagcaggagtggggagaggaggaagccgtcatcgtcgcccttaccctctgttgccaccgccgccacaggagcccgccgcgaggagatgtggtagggagaggaggaggccgggaaaggaggagtgggagagagagagaggaggggagagaaaaaaaagagtgggaactaggggggatttttgcatgcgagtaagttaagagtcccacatacaaaaatacccttatttttgcgtgcagacatttcaagtgggccattggaaaaattaattgttacatatgtgtctgttaaggagccatatgggaaaataagggaaaatgagggtatgcagacacttatggcatgtcttcaacctattaaggtgctagccagaaaaatcatttttgtcatccatcccatctttctttctcatttataggagaagaaaattaaaaagacctgctcatactaagtcttacttagatgcaatgtggacgttctaatctgcttaaagaaagagatggagctgttcgctaattggtaacccatctcatctttcgccattgtagaataagaaaagaagaatagaaaaacttgtattacatagcgcgtgcatttcgttatgctgtacatcgtgatcaggtatatcgactgcaacttcaactttcacagttgcatgatctaccacgtgcaaaatgaattaaacggccaatcttaacgaagccttcattaccacacccaaatttgatacctagagtcgaaatagggaaatatagccaaaatcacgaagcctatggaccggtctagctaaccggtggtgtgtgcctggtcagacctgcagaatccaattcagaaacgttttcatcggttcaaaggtcttcttactcgggaaggcatgtttcaggttttcattagtttatattccgagttggacgtggacgaggacttataggaggctaagaccaaccttttagaaaagccaaggttcggttctagacccccatccccaattcaaaaacagtatggtcgtacacgataattgaattaaaggaattcagcgtctgcttggttcaatttcacataaatttcatttgaaacagccacatccactacacattgacacattgatggttttcagaagcagccacatgcgccgggaagctttcccgtcacccgaatcctctctgccttctccctcaccttcctctctgcgctcctccgcttctcctccgccgtcagccttgatgctgcggccaccttgttgatccttgtaatctcgtcgttgtactcctccagcgccttctctcgcttccgctctgaattatcgccctgacacagcagatttatcaatttaagcagcatacatagagagctcacgatttttttacatgtgaattttgtgcggcgaattatagatactatagtcgtgtgcagaaattaacctctttcaactccatctggcgtttggccttggccttcttctcggcctcccattcgacgatggtatccattgtcatgttgtacctgcagatcaaattgacagctcaatgtagaatgaactgcagcaattttgatgagaaaattcagtgttttttgttgacaggtttacttactgcttcttgatttttgccatcttttccttctcccacgtatctgccattgcttcagcctcactagaatatgaactcgtcggcgcggaagccaaagatggcatttgatttgccttgtcttgctcaaacttcttgctctctttcttctctcgggaaaatgaagctgttggcctaacatctggtggcacccttgggattgcctggtcttgatcaaatttcttgctctctttcttctctcggggaaataaagctgtcggcctaacattcggtggcaccgttgggattgcctgctcttgctcaaatttcatgctccccttcttttctggtaaaggcttggcgaagctcggagcctttcttatgcttgggacagaatcaagaaccttccctaccatattttgacctgaaattccaccttctggtatcttttgtgccgttctcaccggcctcctcaccgatacattagctaaaattcaacaaaagttttttagtacataatggtatagctggttgcaggttgtgctacagtaatatatcattgttgcccaagtaagttgttttgaatcttgtaccttctagtccgtcgtcttcttcatcgggtacaatctccttaccactaaaccgccttgtgattctgctcccctcggtttgcctaggccttttcaagattccttgtctgttgggtggtagtttgagagttggtgtggtcgaaggctcatcgttcgcgacaggcttcttttcagatgttaacttctttttcacacgggtctcttctgttgcctgtttctcctcctcttttgctgcaatagcatacgctaccgcagccactgtggctgcatatgcagcatcgtattctactccattgctcatttcctctgaaatgtcaattcagtcagtggttaattcagttcttcaaacttagaaaagcgcattgatgtagggttcaccaaaccgttttgggtggggttaccaaaccgttttgggtggggttaccgtcaccccatggtttgacggttaccacgaggtatactgtggtttcaaaaactgagaaggttactgtgccataactgcacggtttgtaaaccctgatttgatgacttacctcttccaaaaaatctaccttgttgaggttgcattcttatagtctggttaccaccttgatcttcctgttcctgtaccaggaaatcggaccctgccaagagatatcaattgaaaaataataccatcctatttagagaatttggcattgtttggaaagtaaataactattgtgcaatgctaataaactccttgggtcagatcatctgttctaaaactccggaacatttgagaagaacaatggaaaaaaatgacgatgagatatggaggaattagtaagaacataagttgtaacaatctggatggcaaaacgaacagaacagatttatgaagtccaaaagagccaaaggccctttatttccttactttcaatcttattcctgggcctgtggcactcaacgttcaagattaacttgtaagttaagcattgctccatgaattggatgcaactatatatagagatgggtttagatggacatggagagggatgtagaagggggcaagaaagcagtttgcatgtcttggaggcaagcaattagcaagggaagggaagaggaatcgctttgccctattgaagtctctgagaatcctagccttttgcttgcagtgtggttgctaccaacctgaattttctgagcagtttatcctctgaactagccttggcttgccattcagattacaagtccaacaccattgctttaccttataatattcaagctaatatctgtcggcaacctgatatctagcttgctgcattagaattattcatgctggtgtttgtgagagatgtagaacaaaccgtatccattgtacaaatatatgctgtagattgtattctagcgacatatgtatatatttgtgcctctgaaatcatggactcatgtactactttcatttggatgtatatatacatgacaatgcattgatatcatgtcatttttttctaattcaaaattttgtaattaccagtgtgagatcagtatttcatactcctactactccctccgtcccataaaaaacgaatctaaaactggatgtgacacattctagtacagcgaatatccagtattatgttggttttttatgggacggaggaagtatttcctagaaactactctctctgtacacttttatatggcgtattttgattttaaaaagtcaaacttcctgtaatcaatccagtctgtagaaaggccttggatcttccggctagccagaagaagtgggctagctgacctcacccctcttaataaatttcgatacaagagtctcttctctcatatcctgcgttttttaaacatccaaactggaatatggagagggcacgtagcttggaatgtggaggttattatttctttttttttatgtaatttgtctgtaatgggaacatctgggctgcaggtgtgaacttgttgagaacgatgcaatcttaaataagttgaacgaggacagcaaaactgttttatatttgtcttttttaaatgcaatttaaactcactgcatcaagagatttagaatcaaggtctggctttttttccgtgtaaaatggaagcatgttaaatcagggtcatcaggaggtgctcttctcatgtctctgaatatagtatcatcaggttagttcgggaggcccgtcaggggtttgttcatgcggccaaaataaaatggttctaataagagaaaaaggaaggaataagttcatctaaggtcccttaacttatcaacgaatccgattttcgtccttcaatcaaagaaaaccagatatcatggatccctcaactatcaaaaccggtgaagatgaggaccctcgacggtttagatggtggttttggctgacgtggcgcctactggctaatttgactcagtcttcatctgacgtggcattaacgtggcgcttacatggcaatttgattcagaaagataataaaaccagtgggacccacgtgtcagtttcacacacaaaattttaaaaatggtgggacccacgtgggccccacctgtcattctcacccctcctttcttgctctcttcccatctcctcctcatttctatcccctttcctctctcatctctctccagcgtcaccaccaccgactccgccgccgctcccgcctcccgccaccgccacatccctcgcgccgctgccgctaccaactccgcctccaccaccaccctcgccacctccgccgccgccgcctgcgcctccaccatcaactcctagctcctctcttgccttcagtggcgtctccgtcatggaagccgtggcgggcggcagcgggaggccgtctccgccgcggccgcctcgacgccgaggagctccgggcggcacgccagcgctgcacggcctgcctatggagatgacgacgggggagatggaggccgccatcgtcgccctccctacgaagaaggaggccccttcctcttcccctcgccagtcgccgctgcagccgcgtgccgccgtcgagccgactcgatccacacgcagaactggagggaggaggacgccgctgcctccgcgcaactgattgcgccgtgtgcctcggcatgttcgtcgccgccgctgccgcgagatcaagaccgattggaccaccgttgagattgtgttgccgttccttctcaaccgccgccgccgcctcggccggcgacacctccacccgcgcgtgcctcggccgcttccgcatgaatgacgcgccgccgcccaacgaagtgcgccgccccccgcatctcctctcctcccgccggccggcgcccgcgcgttctgcggcttgtcgttgatgacgaactcaccgcggccggtgtactcgacgtggtcgagtggccccttgacgtcgatgtaggcgcccacggggagcaagtccaggtactgcgtcatgagcccgccattggggaacttggggtgctcgttcttgaagtacaccttgatgaagaggtcgaagtggccgacctcgtcgaccatgctcgtcggcgtgtacgctcgcatgcacagcttcccttcgatgctggcgcagatcaagatgtgcttgccgacggggaggccgagcacctggtcaaaggacggcagcgcgaagcggaagaggcggacgtcgcgggagagctccttcttgtcgatgagttggcaggggaccttgtcgcccgggctggagagcgcgatgggcgccggggccttgatggcctcgcggatgggggcgagctgggagaggttggacgcgccgtggacggagttgtcggagctgtacccggagccggtggtgatgagctcgccgatgcggtaggtgtcgaggagcgccttggccttgtcggagtggatggcgtcgaactcctcgtgccgccgtcgagcactcgagccaactcgatccgcgcgcggaagtgcagaactagaggacgaagaggatagagataagaggggagaaagaggatgacaggtggggtccatgtgggtcccaccattgttttttattattttgtatgtgaaactgacatgtgggtcccacgagttttattattttttcggatcaagttaccaggtaagcgtcatgtcaatgccacgtcagacgaagattgagtcaaattagccacgcaggcgtcacgtcagccaaaaccaccatctaaaccaccgagggacctcatctacaccggttttaatagttgaggaccagggtatcttttcgattgaaggacgaaaatcggattcgttgataagggacctagatgaacttattccaaaaaggaatcaccacatgacatagctatgggccaaatggcccaaatcatctgttttttttcgttgtatttatgagttatgactcgggtaaggccttcagaaatcacaaagataaatcgtaacatgacaacaagcacattttaaaaagtacaagacaagttgcaaatgttgaagcgtgtcaattgaacaagacaagtatcaagcggaagaaatgagaagggactctgaagaaaaccagttaaacagtctgaaatagtctccagtatagacctcaagcttgacccgccaacatcacagatccacagagaacgaacattacgcagtttattcagttctactggatatgcattcatcacacgaaattcacgagcttctcagtcattaccgtctatgatgcatgcaggtcacgacgatcccaaataactaaacatagagaaaagatgcatgcaggtcacgacgatcccaaataactaaacatagagaaaagaaacataagatccctaagcatagattacacatatctccccactgttcaaaatgttacacataagatggcgcgaataagcaatcagtggggagaccaagcaatacatttcttgcatttagcaacctactgcaagaccagactaaattatcaagcccatagagctacaagcttctaaacacacaaatgctaattaaatacacaggcagctaaacccagttccttcagttcatctctcacgaagtcggattataacgaaggcactgctcgtagtagctaataagctggaaaaaaaacatgagagcattttggcgttagatgtttccctcatcatcaagtaataggagaagacaatgggatgtaccagcaagggattatttgctttcaattctttgtcgtccaccatgacttcctgcccatcagacctgtcgaaacacttggttagaaaaacagttcaaacatatcaaactaacaatatgaataactacataaaaatggtcataaaaaaatgcagaatatattatttgattagtgaagagaccagaggattctttttgcgacatctctaaatgagtgaaacataaagcactcaatttgtagccaaataataattcattgctagatatagtcactttcctttttgtaataaaagtagtcagaaagggagcaatatcagctagcaaaaaaaacatgtctgagatttagaaattttaggcctataactacgaaaagaaattacagaaaatacctgagtgctttgaatgtaattgaaacttgctgcacatcgttgttcacagctgctgcaaatcgcactggcttgatgatcttggtgatatgaactcggttaggacagccctctgtctttttcttatcgccagtttctccttcagtggaaccaacatcctcagccaccactaatgctccacattctccttgtccttgtgttggtttattctgctcaaacctcctcacatttccagatttacgcttcttggcaccagttacctggccaccctgagatggaggtaccttcactaagttctcagaattagacgaaccattcacaaggtgatgctcgttttgttggtccgtcaacctaattgagagcggtagctcctgacatggtgtccttgaaatcacactggaactaccctcctgtacaatgttctgtgcaagctggttcctcaccacactccctgacgcatcaagccctgcaactgtcttactactacaattagtcgctctcctacaacttgtccgacagggcagttgcttaggttctggtgcaggagctcgagtgtgggacttagcatccaagcgagggcggccccgtttaccatgagatgggtttgagcctgctactggagtagttgttatcttccgcttacgcttccgaccgggccttggagattgtaacctgaattgcatacaaccacaaggacaaatcaatcttatttacttattatcttctgaaaatgtgaatagaactacagacggaagtgtgacaagtacataccgcatctcgaaagcatcaataatgtcagagcaggcactcaggttttctaggggctcccatgtgttagcactttccggccatccacgcctagcaaatcatataaaattgttaggaacacaagaattatcaccaaatctaaacgagtaaaacaagaagcttccacgtgagccaaaaacgtttaaactgcaatagacaagccagcgaataaaaatcatataagaaacaataaaatacaagcatcagctgcgttcagaatatatctaagctctaaggtagtgtttggttcatcaatttgagggtgtaatcaaattgcagtacgatctggtctcacagatgtttttttacagggtaccctgtaaacagaacacagctcagaacatgacacattaccaagttgaccagtacctgccgtactgctgcttcttctgaacgcaatcctgttcttggtcttcatagctctaaaggcagttaatacatccatcatctccagtgaggtaagttggttgcagtattggcagctaggatgaagaaaacacaacagttgcaatgtgcagtgtgcactagggagcatgtgtaaaacggaaatgccagtttcttgctcctgctgccaaataaccaatggagaggtgggtagtggatctagattgatttctagccactactgcctctaaatctggaagcttacgaactcgtagaggtgtattgtcccaaatatggcaatatgagtgtccacagccattctcaacctgggcacttttaccacatggtccacatcaacacgcacttgctaccgacaaacaccatcatactattaacgcatcaacaaattaaaagctgttcctgctactcagccttgccttgagcattatacaagggcatgctataaaagtcacccaagatgttatgtggaggtggctgtcctacacagctacaaccaagcgcgggaagcagccaaagatttgtttgttataacttagcttgagattcattaggagtttgttaagtgagactcctataaaaggaacaatggaaagattaattactttaggcaaacaataagttatttcctcttggtctttccagtcctctgttcttatccttcctgacagctccggggctgcgaggtcccatgccccaccctcccattgagaacccctatgctgttcaccaccttgggacgccactagcacataacactaacatttagcttgtaaggtggtccttggtgattcagatggattccacattctccaaaccactaagctcagagtgtaagctagtgatgctttcaactacaggagtccatcagcagcactcaaccgcttcacctagaagcacaatgtgctctctcacaaccctgtttgcacagtttatgctgctccaatttggttcattgctattacaagaatcacttttggcagtataggaatattaaaaggaaagggatggagttttcttgttttggtgtagtaggggaggctggtgttacaggctatcagctcagcagccatgcccctgaaattgcatctatgccttggctgtgggatggaagtatattggatatatccaatccgcctccaaatctgtttggaaaaggatatggtgaaaggttttttatatatataatcggatgatacggattcagacaatagttgtaggtgcagatatgctattccaaaatccagcagatacggattaacagacattttttagcagataacccgacaaggatctatttagataatccgataaactagggtactagaccaacttcccacggcttcaaagttaatctagtctactgtctgctgcttggcttctgggatagtgggtactacctgcagctcctgcacgatgctttcattgtgctgtttagcacctgctgctggctgatgctactttgttgcacagtagcactactagctgatgctcttattgtgctgcttgggctgatagttgcttctcaattggtacattcctagccactaatgtagtaatgttcttctttactttttcttgtatatcaccatgtacacactaccagagagctttggtctatttgcaacctaactacgttccatatccgtgccatttatagcatcccaaacaatccgttcaatatcagcatccatagatcatcagagccgaatctgaatccaacaaaaaaagtatggtaatacgataaagtacaactattatctgtctaaatctgacccgttttcgtccctagctgtgaaggctctctaactacatggttggctacttagcgcaatctggtcatcagagcctaaaccaaaatgtggatcatccaaggcacattagcaaatcaaacagtacctaaaccccaaaagctacggatgctgagcacacaaacccaatccatgaatccagcattacgaccttcaccttctaccgagtgctagagcccgtgcagggactacgagaatcccaatccaagaatccagcattacaccttcacactgttgcaagaaccgtgcagggattacgagtggggatcggaaaacccaatcctagaatccagcattacgcctttcaacttcgaccgtgctagaaagcgcgcatggattcgcgagaaaacggaagggcgtgagagagaggaagcgaaagcgatctcaccatttgacaaggtactggagcttccccttgcggaggcggcggcggcggatgtcctcgatctcgtagtacccctccgccagcttcggcggggagccatccaccaca

SEQ ID NO: 63261 - DNA, 683 bp, Oryza sativa
ttgagcttccatgagctaattgcgtcaacagtctgttgagttctttgctctcaagaagagttactatacctctgtttcttgcacggaatgttaatggaagcgattttttactgtatgttgtgccaactccctcctcctactataaaaagacataccttagaattcgtggggctctcaacgactgtccgcttcatctataaaaaataccataaatagaaagaccacaaggcacatataaaatattaatcatgtttaattatctaacagcaatgaatatacgaattataaaaaaatttcatataagacggacagtcaaagttagagacgcataccaagggtttgcctttttataggacggagggagtatgtgtctgctgtttagttcctgtacactggcttccactgatcatggttatttatttttattggttccccattactgttgacagttgagctatctgaaaaagaaattgtttatactcctcccatctcaaaataaatatatttaatttaagatagaaggagtaattgtcaacataatcaatctaaaccgtttaatagatatattttatagtaccacctcaaatacttcaactaatgctaagagaaattttttctactaatatttaacctataaataaatggtgagataaattctatttctctactagggattatattgg

SEQ ID NO: 63262 - DNA, 2444 bp, Oryza sativa
ccttgggcggcctggagcggcggcgcgccgtgcagccggcggcggccgaacagagcggcgatgccgggaggcgacgccggcgacactccggcgtcggattggattgggaaagaaagaggaaagggagtactcagcatggagaatccatttttacattcaatttcataggatttgcgatgtatgcgacgaatttgggagctctatcaatggcccaaatttagggttttggggatttttcctccggtaatggcgatttgattcagcgggggtaggggcgaatttgaggaggtgaaagaggtttaaattgtgcttcttttgcctccggtattgtgccttctagttaaggaacgaaggagatacggaggcgggaagctggaggtgtcgcggcggcattcgttcgtcgttcgtcctcgtgcgagcgtgtgcgtgcgtgtggcgcgcgcggggcggcacgagctcagcgcgagcgtgcacgggattggcgcgaggcagcaggagcttgctcggcttggctcagcctggcttggcctagccgtgtagaggaagaagaaagaaaagaaaaacagagaaagggaaggagagggagaagaacagagaagaaagaaaagaaaaaaaaacagaaaaggaaaacatggggaaaattaaaatagataggattggaattgatgtggaattagatgatccgatattcggaatagatttaaatcggattcaagggaattatttgagggatgatatgcactttgcgacaaaattaaacgagaaaagaacatcgaaaataaacatggaaaataatattttaaatgaactattaactcgacggttatatttttagagaatcaaagcaaactaaatcgattttaaatagttgtcaaattttagggcttttacatgtacccgcaccaaagcatctcccagataagctagccgtatattcagtataacaagaacataatgtaaagtaggtaatcatatacttagaaaatatttcaataccataaatgtatttagaagagtattctaataaaagtacaaagcttacaaaatagaagagaaaagttgctagagccatacccaaactcttccgaaggctttcggactccgatttctactctactcctattccaccagctagatactactaaactaagcttgagagaaatgagagagctattgcttgaggtggtgtgaagtgaagagagtgagctccttatatagaggtagttatgatggttgtggaaggggaattgtccaaagtgccctccaaccgtcattgggatgcaatcctggacgtccacgccaaaacctggatccaacggcgccaggattggtttggcacgaaacctggtgagttacggccgaatcctggagctggcaccaatgccagcaccaatttcggctggtggccctcctctattgctctactccacggaattgtgaattttggcccaattcatcatgctagttctgagttcttggcccatctattcataagtctggttctcgacatcgtccgattgatttatcatctaagttgatgccgattctcctccactttattgtcattctctgcaaaagtttagtaaacctaataatagtagaaaattattactctaacatacttatgcattgcaagcataattattactctaacatacttatgcattgcaagcatcactagttctctcctattttggtaatattgatgttcgaaactgatcgataacgaccgtcaacagcgtcccagcagtcgaactaccccggtttttccccggttcttcattaaaccgtccggttcaactagtttactgccggtttgattgctcgccgatcttttagctgaaccggaccagccggcgccctggttccgatttttcccggtcgaaccgccggtctggtccggttctaataactatggttctattagcctaacacacaacaacagttcaactaaacagaaggttagatgttttccaattgttcttactttaatttgcatttcccaattctgaacctatatgcttattcacactgtctacataatttttcaggggctacatgatcatattgttaggatgaatgctaaggcggttgcaacacagtcaggtggttccgcaacagtcaacctgtaggcaattgtgccatattcccagggttctacatcagcttcaattcagatcatatctgggaaggcatctgtttcagtctcagctcaagaaccagcaaagaagaaaacatctactgggcctgctccatccaagaaggccaagactccaggatcaattctcatgctgccaccatgggaatctgacaaactttgaatcaatctgtgtgtattgctaagtattgacatgccttagctatttatcctatctgtgatgtaatgccattcatgccatatgtcatgtaatggttagaatgctgctatgccagacttgtaaggc

SEQ ID NO: 63263 - DNA, 1767 bp, Oryza sativa
  unsure (1)..(1767): unsure at all n locations
ttagtttatattgcgttagttagccaatgattagtttgtcgacctggtatggcgtgaaatttcaaccaatcgtacataatttttgttcggtttatcctggctcttctacaataattgttgacgacacagcatattttgtataaatgtgttatatcttgtatacatgcatccgccaataaatcccatttgaagctagatggatacaaaaacatacaattaatctgatacgtgacagatttgtagacatgattaattgttgacatgtgaactctaggactggacgtttccaaaggaatctgaaaaaacaagcagttgctagcggtgggccgcgggtggtattttaatttaccgtattagcataccccagctggtgccgtcgtacactacctgcatactcctaaatgcagatacgtacagatcaagtgcacgcaaaaataaactaaaggataatttgcccatgtaatttttttcagataaaagtctcgcgcggtcggcatgtgtctgtatatactccgatgcatgggcgatttactcggatgaacaccgtgggcctacaggtaccggcccaccaccaaccacgttgtaccgcggtgttcacctcaatcagaacagtccactttcgcaagggacccgtgcattagggagaggtctcccgtttcaagccgttagcctctcccactcccgtacgtttctgtgcgttttcaatttcttgtgatccattggtttatcgtgttgggagatatttatacgctccgtgcgtccaggcaccgatattacagcgtatgaggatcgagatgcatggttaataatgatcatccatgcaaaggtaaaaggttcgtgcatgcaaggtattgcaactgccaccatgccaaacctgacgaaccaatgcttcttgtgcatattcctagatgtgtcggtctgatatagcctgatagagtaaaaaaaatgaggtcctggagagatgattaaattcgtgcagttactagccaacacagtcggcccgggtagcccgagaccacccaccgtggcacnacgcgggcgcgcgcgcgcggcgagtaaatatataggcggcgccgccgtctggttctccccggaacggaggcctctcgcgcgcaccgaacgtcgtcgtggctcttcaacgttgggatatatatgtccatgcacacgcggctccggtcattctatttccaccgcccgcgcgcacgggctgcacgcgcgcgcgacggccgcgcaccccgtgcatgccgcgcgcgtgaggagggtagggtagcgtggccgcgcgccgtgttccgacttccgacgcgcggcgcgcgcgatgtcagcgcggcccagttgtccccgggcgcgggcgccacgtcggccgggcgccgcatacgtgtccggtgaaccgagcgagagactctcctcatctcattccgtttcaccgctgcggctgcatctgcatgcatgcgcagcccacaccgtacccgcgctgttttgtccccatgccccccgctctcataaatctcagcatgcctatcgccatggacccccacaggggaggctataaaaacacggcacggtccctgtaacaaacagtgagtacccttcctccctgcagccgcatacacgcggtacatgagttgcggtcagtaattcgatcggctgtcgttgggagatcgggaagagtcgtcgccgtagcagggtagtgagggtgtatacgcgcatacacatacacatccaccagcccttccttttgtaggcgctccctgattactttctctctct

SEQ ID NO: 63264 - DNA, 689 bp, Oryza sativa
tttaaatcgcgacgaaattgctataacgtcacaggttttgggccggtttatgacgaaatcgataaattgtcatggtattatgggccttgtatccatagttgcatatccgtgacgatctctgaaaacatcacgaaaatttcatcaaatttcgtcacatattaaatagattcttgtagtgccctttgcctcacgatatcgattaagctcaaggctagatatgtgccatcctctaatagctcaatcattcacttgaacttgtgatagattatataacttgtgattgactcctcaatcacctttggcatggccatgcactttcataatctataacatcgaggggcccagagatatctctccataagaggggtaaatctcatcttgattattcgtatcgcactacggagtagcgtttagtagtccctaagtaagctactacacatgttgggaaccatgataatctcaggtctaagaattcaataccaacacatatggctcttgcagtgtctcatgttgggtctatccaacaacatgttctcccaacatgtgtccacattattaatttggtatctctataccatgatccatgagacatgatcatcaattaatacatgtgctgatcatttaaacatatttgttgcacatatgatatttgatcagggatcctttagaaatagcaacatacaacataa

SEQ ID NO: 63265 - DNA, 571 bp, Oryza sativa
ataaactacactcttaagattttgtgcttagatagtcatccggggtacaaagtaccagcaataccccctcgtaaatagaactgacaaaacagtagataatcaagcaataagaagtctaacacaacagcaatactacatgaaaatgctctccccttagccatgcccctcctcatccaaaatccatgtaatcaacttcacctcccacagaattctgttgatctccacctttccaagagggaggagacatatgcatcatatgggtctgcttcttgtgtgagggtgcggtcaacaaaccccttgtcgctttaggctaccctctatacctgcagccagcaaaataaaaaatcctggctcaatgacaactaaatagtagctctcatttctatcatttccctctaatagaattccatagcgaaacaatcaacctaggtgatgtgctatttccatgaaagcacaagccatgatgcagtttttgtttccaccatctgtttgttaggtaatgtattgtagccaattaggacgtaatgttgaggcttatgtcgatgacttggttgtaaagacgcgcaaccag

SEQ ID NO: 63266 - DNA, 1804 bp, Oryza sativa
tattgctcttgtgttgtttctagttgttgtgagtgaaaaaagggaaaggcttgatgctgttggttagggttttgcattgtctgatcatgtgatgcttgcatgtaaggtatattggcttggcgtgtttgtacttgaggaatttgaatatgtggaatttgcatttgtggaatgttggtttgggtttgggggatttggttttgaggaaaatgggtctggttgtaaaactgtggttgtatgagctgttgggtttgaatggaaggtagattttgagtagtttgcaaggtttgagtggattgcggaatttgggtggaaagttggttttgaacggattgtgggatttgagtgggaagttggttttgaggaacttcttgtgttgacttatcaactggagcattccctacttggggattctctttttccacatttccaacatttctttggatctctttcccgacttgattcggttgaccttcatcagtgtttaatgtctctgcctctctgccagatcctcctgctcctatggtttgatcatgcaaagcttgaagcctttgcaattctctttgcagttcttcatattgttctttgttcaccataacagccccttgtgcttgcaccatctcggcgagctctacttcacttggcgggttttctcttgtttcctctcttgttggactgacagtatttccgcctggcattgctttctccactctggtttgtgctgattgtccagttatctcttcccactctttcaagtgttgctgctgcgcttgcaaaagtgtcagtgtagcggattggcactgacttttgcctttgggaacgtttcatttactattcaagcccactccaaggagactacacgtccccacggacggcaccactgtcgtgacccaaggtcatggacaagattggggatagacgggaaaacacccttttatcacctatcttgagaaatgagctcgaataccaaatgaacacacacactaagtgacaagacttttagtattccgagatatcttgcctgctacaggctttttgtctgctttatatagttcacagctttacatgtgagattacaattgcgccctttgttgggcccacatgaaattacaatcatgcccttgctatatcagctaactctaagggcattttggtacattatggaggtcattatagtcttttggtgccagctggatgaagtggttgagtggtccttgggaatattctcttggcatctttgttgtccaaattgccttcttcatgatcaagagtcttttccaccaccataggtcttctcctcgaccgagggtcttttccaccaccatgggtctttttcatggcaaatagtcttttccagctcgaccaccctttccgacttatccggtagctgacctgttattaactcaggaaatacttaaaacggataatgagatttagtgacaagaatgtactcgaacggtattttccaactcgaatagtgttttccaattcgaacagcgttttaccgtttccctgttcgaatgaccatttgccactcggatactattctaactcaatctctttctctacagtgttttgggccgaatatagaggagcggtggtaaccccttgctacaacaaaatattatgacatttttataaatctaattaaatttaaaaaattttatagaaaagtcaaaacgattcagaataaaacggaggaagtactatagttgaaaggattactatatcatttgcgctcttccaagctgacaagcaattgcgtctcaacactcaacaggcccttgtttttgcgctgccccgagaa

SEQ ID NO: 63267 - DNA, 2592 bp, Oryza sativa
tgtaaagcttctgatacgaagtaaactggcatctgcttgttttctttctcttgcactaagactgcgcttactgtcactggtgttgccgctacatacattagcaaaggttgacctttctgtggacttgctaaagttggcatattctgtaggtatgtcttcaaatcatcaaaagctttctgacactcggctgtccactcaaatgagtttgcccctcttagggttttgaaaaatggcaagcctttctctgcagatttagaaagaaatctgctcaaagaagccattctccctgttagcctttgcatttcccttgtgttttttggtggctgcatttggtgaatcgctgcgatcttgtcaggatttgcttctatgcctctcttggacactaagaaaccaagcaactttcctgctcctaccccgaaaacacacttttccgggttaagcttgactgaatattttcttaagttctcgaatgtttcttgtaggtctttgccatgactaaacgcctgtttgcttttcaccacaatgtcatccacataagcttctacattgcggcctaactgctttgccaataccttgcctattaaccttgcaaaagttgctcctgcattctttaagccaaatggcattcgaatgaaacagtaagttccaaacggagtgatgaacgatgttttctcttcatcttccttcatcataaagacttgatgataaccggagtatgcatctaagaaactcatcaactcgcagctagctgtagcatctactaactggtctattcttggcaatgggaagtcatcttttgggcatgctttgttgagatctgtaaagtcaatgcacattctccactttccatttgccttcttcaccaagacaggattagccaaccattcaggatgcatcacttctcttatcacttttgctttgagcaatttctcaagctccacttttgttgcttgctgcctgtctgttgacattcttcttaacttttgcttttttggcttgtacccttacttgattgccaagttatgttcgatcaggcttctatctaccccttttagttcttctggtgaccaagcaaagacatccatgttgcttttccctactttcaagatttcctcctcaacatgcttttccagattttctcctaacaaaatgtattttccaggatcatcatcatctaactgtacattcctagttttcccttcaggaactggtttctgcaacttagagtattctccatgcttttgatcaacgacatggactcctttgacatttggcgttccctaaagctcaaactttcttgccgccaactggccaccttagactgttatcacccctcttggtccaggaagtttcatgcatatataattgtgatgtattattgcctcgaagatattgattgttgatcttccgagtatcgcattatactgatacggcatgtctaccacatcaaacactatttcctctttccttgcattgttgcctttcccaaaaaccacttgcaaaggtattttcccaattgcatgtacttgttgtccaccaaaaccttgcagaggcactcctgcacttgtcaatctgtcttcgggtatttgtatctttttgaaaacatcatagaataacacatccgctgagcttcctccatcaaccaaaactctttgaacttcgcattgtgctatttccactgagatcaccaaagggtcttggtgggggaaaagtattccttccgcatcttcaggcccaaaggaaattattgtcttcgaatgaactggtggatttgactgatagcttgtccctacatgatttacttgtctcacatatgcttttctttgtctttttgactcaattcacaaggaagagcatcctgttatggcatttatcaccctttttggagcttcttcgattgcttctattttcatgacttgtggtgcttctatagcattttgccctcgctgatctcgggccccctcatacttgttctcatattgactgacatgcttttccactaattaagccatatgcctacattcctcagtggaatggcctcctagaccatgaatttcgcaaaacttgctatagcattcttccgtagaatgaccacctagaccatgtgctttacaaaacttgccatgatcaagctgatattattttcctccgcttctgtcattattccaccattgtcctctacctctgccagaattccaccattgtcctcgacctcttgcagactgcccccaattgtttcttcctccacgagtgttttcccattgtctcttcccttttccttctccattatttgagtcatctccaatgaagtttacttgttttttctgatcttgcttgtaatcgttcttgaattttttttccatggttttgcagtgttttctgctttttgttcttcccctaaagaaacttgcttgttcttcgtctgcttctttcccaacaatgcagcctcttctgcttgcactcttagctcatcttcttctcctcttgcaaaactttccattctttcaaataggtcctttgctgctttggcctattccttgcaagatcgaaacggagagggccaggcaacaaagctctttttgctgatgctat

SEQ ID NO: 63268 - DNA, 6017 bp, Oryza sativa
cattgccatgctttggctcctacggtcaggatcattacctttcaatgtgagaatgtcagagaaaatttagaggtttgtttgttggtagtatttcaatgatcggtattcctttgaggtgaaattgctcttactattgtctcttttcagatactgttctacagataatgtcatgggcaccccacggcataagtctccgatgcgagagagtgcgtcagcaaaacgggaagcgttctcactcttcatttggttatcatcatcaggccaatctacagtacatctttaatcttcagtcttgcagcttcctggaacatgcatctattttcacagtgaacattttgagtatgtatgcaaatctcacctccattgacactcttaaattcatcgtcggagtcgtcctcgagaatactgacggagtcaaaccaggcatcttctttgcagcaacctacataggtacgtatgatcgatcaaattaggtcgattcatctactcctacagatcagcttcagttagtagagtagtaccattggaatccctctggctgtggtgccactgcatctgtgtgaggtggaatgttttggaatgctctgattttccatggtttgatgatgtctcaaaatggacaacctcactcattgagaagtcagtcatgtgtcctcttgaatcgttcaaccgtgacttgggcgcctctggcatgatggatcgggaattagtacgagctcttcttcctttcctggtatagtgccttgctggtggtctctgctcaatgacagacttggaagcacaggaacccatggtagtgacaactcgtgtttgtatctacatttgggaagtatgatatacttcaagataattatccttcactaagacttgatacagtattgaagtaaccacaaagattaatctgcaaggaaaaaaacacatacacatgcatatgttttcggagggagtacctaaaaatattgggtgcagtaacattatttatgtgacaccaaagaagcaaactgagggaaatgtaccaagagactggaatgcagaataacggaaactcggtgaaatacatccaagaaagcaaacagcgccaagaatggcatgaaactgcaagagggggaggggagggtgatggagaagaaggcagctatatatgctgatatgtaatgatgtgggttcatgatcaagggacaagtttggagagcatgtgcttgttggtagtaaggcattctgcattataagcattatcatgaactgtagcatataaaaatatatattctttcacgtagagttatattttgcagccttagagacccctttgaacttcagagaaggttcttgcttggtttgcctaatgaagatcttccagttgaagaaaaatattgttaatcaggtatgtcttggactgtgggtaggggaatgatgttttgtactgcatatagctgcatcatatgctggaggctgcacatatggatgccgtgctcctgctccccagggggaggttatggcatatagctgcatcatatgctggaggttgcagtgtcaatgagaagcaaatctcagagaagcatccgtggcacaaccagggatgagctgggaaggatcgttaggtgaacaaacaatgtgcaaacgattaaggggtcaatcatggggttttgagtttttgaataagcctagccggcctatattttttcaacaggttcccacttctgtacttaacagatagtgataattttactactatgttacacacattcctgaattgcatatgtagtttatatgctgctggaaattaaacgaaagctggaattagaaaaactatagaaatggtttggattttccatctttaatgccttgttattagagtaagcagactgtaagtaaaaaaattgatgtaggaagagaaatctgatttttgatatatcaaaagaacgcttttaatttagagcatgctacgtggttcatatatacatgaacgtatgcagtagtctgaaatggacgtgatcgagtaaatgtttttctcttcgtcttttggcgtttgttattcgtagcaatgatcgtgccatatattagtatgtatattcttttaaattatctcaatggtgatggtgagtggtgaattagctaccacccacaatcagtgtcaagtgagtcctccaaacaatgaggtaaatggacttttgttccttcccaacatcaaaccatcaaacagggatttttttaaaagtatggtgaaaataacgacaaataatatgaccctaagattttacaatgagaatatatttattttaatttttgaggctttagagtgtgcggtgtggttctcttatttaatttccgttgtaacacacgagcatttagctagtgcattataatgtggtgtcttacatcgtcaagctagactgagaagtggagacaatagaagaattgaaatgaattgttgcaacagaccatgttcggcttgtgaaagatcggttttgtcaacttgggcaaaactacgtgcatgttatgacatgtaaggatcaatgtgaaacagattatttcctgtctcaaatatagcaacttctagtttttaatatttatcataaaacataggaatttctccacctatatttttttatcaaccaatcataacattcaccattcaccaatttcattttgtcaaccaattataattttccgtgtttgattttatccactccatatgtctaacccccaagacgaagctaccgggggtcccagaatgaacaacccccccccttttccccctacccacgccggcggtatcccctcacacggatagatcgtaattattaacacaggtgaatcgacaagatgcacaaaacattctgcgttgagatggctttttgatattgcatgcatcctataggtctgaagatccatacctagcaatcaccttcttattctttttctttaactgcaatggatttcaatttttttttctttagcccaattgggttttcttaactttgttggactccattgtatttggaggtgtttggatataagattttttggaagctaattagatttctagtatttctaattctataaatccgtggatctagatctataattatattgataatattttgataaatcattttatttttattttagataaaatatcaaatatcaaaccacaaatagtttaacatatgaactctaagatctggatacatgtcaaacaaggtctaagtatcccatgtaataatttctcttttgaccattgcactccattgtatcgtcaatttaatgacatattaactgtcacatgtaatattttttctgataaaattgctctcgtaaactgaaaaccttctctattagatcttcaaatggatactgaagtaacatgtaatattttttatgatgaaataagtttcacaaaatgaaggtctctagctgcggcgtctccaaactctgaacacgccgtgtgactaataatctatacagaaatctcggcaaccccaatatttaaatcatggcttcgtccgtgttaaccctaaacttttttagggatggtggttgtgtcgttaagctcttattggagttattaaacataatcagcggccttggttttgccgcaagtaacgaacgcagatcatcatatgttactatttaatttgttgtttgcacatgtattgcatataagttctccctctttcaaaaaatgtaagtcctatttctttttcaccaagaccaaacaagcaattaattcattcaccatgtgacaaaatcaatgcacatgcaaccaataagcattaaaatagcttcttgggttcctatcaataatttaatttagcatataataactacaaataggacttagatttttgaaaaaactaaagaatgaaataggtctcacacttttggaaggagggagtatgacttactacgagttatgacatcacgagttatgacttcagatacgtcagtataggtgggctcacaccgacaaatttcgatcccattagcttttcatttcaacccattttgacttaagagtatgttgtttatcacctcttttcaactcctactcatttgttttccgtgcgcacacttcctaaactattaaacggtgtatttttttgaaaaaaaaatataagagagttgatttaaaaaatcatattaactcattcttcaaatttatgttagataatgattaattaaccatcactaatgaatcgctatgttttacgtgtagggaggtgaagttcccaaacaccacctccgaactcgaaataaagatgataactggtttatcattttcttccttgtctttttggatgcttttggtttggggagtttatcagctgaagtgatttggagtttaggaattaggctatttgctttgtttagttagaagacaatggagatttttaattaggatggagaatggatgaaagaacttactgctttttctaggctctaggctaataaatcaacggctaagatcgtttctactggtagtatcatactgttagtagaaaggaccggagaatcactctagcctctaggtagggcttcagagttgaaaagatttcctacattatggcttggacaaatcttagctatctatttttatttaaaatctagtctctgtctatatttactactaattcgaaccatctttacccaacaagatattaggactaaaaatccaattcacatactaattttacaataaattccctcgtgtaaactcctaatgctcttcccaaacaccccagaatttatcgaaagttatagatgcttaaaatctattgaagcaaaagatagtaattcagattacagcaaatcatttttctaacttcaagacgaaataccccacggtgtttcccacaatgaaagaaaaaaaacactatatgtaatatattcaagtttcatataggcataacataacagttatatactatctcccttgacgtgtgatacagaccttattgaacacagcaatggagcatgcatgaaatccagaatatagtgtctcaaagatgttaatgaattggaagaagttaatcagagaagctaggggaaagaacctctgcaactacgagcaatgaaagtcgatatgcgtgcttgcatgcatatgtatccccctcccacggatgaacgacgacggcggcggagggcggcggtgtgggggtttaccgtcgcctctgccgtacgccgttcgacgtcaaaccgccggcgacgttgttaggagaggttgagtggtaaagagagaccgtagacaccaacgagaaatgttccgttatttagcactggtattgcccatatatagtagttttctttgtttgcatcaatgcttgcatgttggaggagagaaacaaggcggggaagatggcggcaagaataaaccaacagctagatatacacctcatttacgtggttgccatttattaacaacaaaatttggtaagatatgcttggagtcgaagataaacacctaggcagatttggagcagatacaatctttccagaaacagggtgcgtgtcagctggatattatatcggctgagtctgattcggacacagttggccagtacaagaataattggtttcagattataatttcgatattttgctatacatggatagagtccattacagacagttgtatctattaattaggaatattagtatcgatttattagagaattggcaagagtccgccttaaggacttgttcatatgtgtttgtaacttaggaaagtttgactcgtatctgatatggacaagtttgtactatgggtataaatatatgcccagaaccgtgtaagaaaaataacaaccgtttaatacactcttggtgcatcgccgcctttttctcttagttcttttcgacgagttcttgctaaaagttaaggcatcggtttcgacctcctgacaagaggtaatgcttgtcacggtggtttgcattatcgagattactatatcgctttagatatgttaatcttgctaatataatcactgttcatcagatatgttattctatttatatca

SEQ ID NO: 63269 - DNA, 1633 bp, Oryza sativa
aataaaagctcaaagttagtgaatgacctgcccctttaagctcaccgtgttcattccagtcgtcttttttatacaagtccggtggttcaaagagagtactttaattccttctagacgatgattagagataacggattccagctctccaaggtcgcaactgagggagctatatatcaaaataggatattattctttgtttgtagttgagatttcttagatttgagtaaatatttaatgagtaagaagtcgttcccaagcggagttcttgaaaagagttgatttccgaaatttatatatttggaaattcgaaacttgtttggtcatttgaatgtcttttaagccaggggaaggtgaggaagtggattaaacaaggaccaaggcggtcttcttagaattcaatggttcgtcagaccaagcacactacctggtcattacatagcttcaaacatggcaatgaccaaatttaaaatgaagaatgagtacgtcgccaaaacattactagggttagccaaagttaattttcagtgcagtatattagctttaattctaaacacaactataaaaatatgaagaggacatataactaatgcatattacaagccaaaacttaatgtctagggccatgtacccctccgtcccaaaaataataataatcctagcaacaaaactggacacatgcgtgtctaggattagtctttttttttggacggagtagtagatctttaccaaattcgatatagatttataaatagacttgaataaatgttgttttctcaagtggtggtgtttatttagtgtttttatcctcacttttttatctttttttttgcggggctcacttttttatcttagctgctactgttgagcaaattgtgtaataagtgattataacttccttcaaacaaaagccaaaattaatattccattattaaaagagctatacttctttttctttcattacagtgaggaaataggggcattttttgagtccctgacccccggacaatctgggccataaaacaaaaatatgagtcaaagtttcaggctccctaaatggaaataagttcacttgatgtccctcgattttacattgagtttgtttgacatcattatttccaataccagaaatcattacccctaaactatacaaaaccgtgcaatttagatcctatagcagaaatgcaatatagatgactggtttagcttatgtggcatcctagtcaggaaaaatttcaaaaaaaaaatgtggacccaacatgtctgtgcccttttctttattctcattccttcccaagcctggagagagagaggtggctggcatgagaaaggagagagaggcggccggcgagcctgcttgggacttgggtcaagctccacgcccggcatcgacccgactaggctcttcaccgcgactggtcttggtgctcttcgaccagcagcatggtggaggatagtagtgaccacgttgctgaggaccagcttgcggaggaggaggagcactacatcgatgacgccaaccacctcgttcccaacagcgtccaagaggagggatccagtggtcgcgacatcgtcgtccccggcaaccacgatggtgaggaggactaccctgacaaccttgaccttgacatactcg

SEQ ID NO: 63270 - DNA, 25421 bp, Oryza sativa
  unsure (1)..(25421): unsure at all n locations
tctctagggttttgccggtatcgactaaattatttatgttggttagattaataatggtatctaccaccctgaaaatcagtcaagagcttgattgtcaatatatattgtttcttttcatacttaatgttgcatcagttatgtctgatctattaagtcgtgatttgaatctctagctctagcttgttttttgattgccaataatggtagaatcggggtttcaggcgatcttacctgatatagatgttttattatgtttagttaatctaatcaagcttttcatgctatatctgccctttatgtatataagataaatatatttgatttatattgagtatatttatctagattacatatataaagttttattagagtattagctaatacattatcttttgacctaggcattgtccatttagctatgatataaacacatctaatccctgagtttgtcaatctgatttatatacaatccatactgtcgcagttaggtccaatctataccatttgtctataatttagagaagattgacttagagattatatgattgtttgcctctacaactattagagattatatgactgttggtatttcttaacggcattactagaaatattcattcctagcaatggcgcaaaaatagtcatggtatatttatggttacaaaagtaatccgcaagcgcatggatataccattgtagcatttcacccggaagtattccaaggtatcgtatttaatcctaagggaagatgtgaaagagagaaccatgctaataattatatacatatataatactttctttcatcaaagtctaagcaggggttaattcagtataagggtagaatgacaaagcaaagcttttagatttatcctaataaataattctaaactaagtggaagaagagatagaaagtaatcaattcctatacttctaatatacactcaacctttagtttacatttgctagtatacaatcatgtatccaataccccctaacagtgccctcctagtgtttcgagagaccacccctggttgccaagttcttacgacaacctgtcgtgcctatccaaccggggctaaatacggaggagtaccctaccaaggaatttgtcttaggaatatatactagcgtagaggaatacctgtactaagctgtcaccatcagcggcccacctctattgtcctgcagcatatatgcccagatagtgatatttagtaaactaagcaccatgcttacattaataaatactactctacacctctgcagatgatatagagcaaccgataactcggatactaaacccacaccattgcacctctctggtaggctaccctgtcacacccagaaattcgctacccgaatttcaagcagaatgtgtattaaaatatttgtccaggaccatctagaatacacaaacaacaattgataaacagatccacatcttacaaaaataataaataattcttacaaactcagcggaaaagcaaataaactagacttttatcttcatgaccaaaagcatagcttcctccataaaccacgtgcatcctcaacgtccggaacaagctcaatcctcatagaactcaccatctgaaccaatctctacctctggggtggggaaaaataaagcaagactgagtaccaaccaccgtactcaacaagtcataccaacgggaaggcatgatgcatgatattcacaaaggaatggttcattagatatttgtaataaaagcagcatttataaatcatattttgaataagtaaaccagtatatatagttaagcagtattaaatcatcattgtccaacgctaaaaccacgttgcaacaggcccaatcaaaccacctgaactacactagttcaataagtcgtattgttaaaagtgagactaatcacggtgagctggttgaccgcccaataaccgcaggcacggctattcgaatagttttaactctgatcagaagtgtacaactttacccacaagacacgattccatacatgttaccatgccccgaagttccaccacgatactacaaaaggggaaatcgcgacaaaacccttcatataactctccctaaccaaacatacccacctcaggtttcaccccctccttgtgccaagtcgggcagtcccctcttgtgcctaggtaaatccagaaacaacagagatcaatatctagattctaactgcaccatcgcctctacccttgccacggtatgtcagctaggttaaattatactctagatttagcctggagcccacgttggcctgtggtaagtacgattatatcttccaggcattcccgagaaccggtccttaattgtcatgggcacaacttccaaaaccatgcacccacaacccaccatcaaaagccacagttcgaatctttgatcatattgaaacctatagagaaccacttagttattttctgcattgagtatttataaaattattttgcgtatgaattattttttaataaacttgttagtttagttattacccattattacattgttattattggccaaatccatggattgctatatcacgccctttgataacctaggtgtagatttaaatacttcacaataatattattctagtggataagaccaccaaatatctatagtcatatatttggtttacccgtcatcacatggtgatgtgtcgggtgatataaaatgtgttatttgatatgagtcactcgcctggagtgatatggaagattaattcccgggtgaagatggatattgtggtttgtgaggccgtgcatgttgttataatttttttgtggaaagtgtatatttacacttgaagtatgcacgggcctgtgctagttttggtggcttcccccgatataaggactaccctcttatgccatgtaaaatgatgtaatttgcgcccatccataggactgagtaatcaggcttagcctagtacattgtcccactatatgaaagactgtagggtggctctatgagcaggtttggggtggacatgtggaaggggcttcgcccaggttgacatgatccacaacggtggaacccgtgaaagcagcaaccatctagccttgcttaggcccagcaagtgcccgactgctaggacggatcaatatcccgctgggcagtaactagtagtaagtgggactctcggacggctatgttgtcctcagccttgcaaactgttgacatcatctgggtaaagctgggcagtctctacagagatgagtagaccgaaaggcattctaagatggcagaaggtaccgaagggcgtgatgaaggctgtcttggggatatctgccgggttcatgtgaatttggtgatatccagagtatgcatccaagaagctcatgagttcgcatccggcagtcgaatcgactagctgatcgatccgaggcaacgggaaatcgtccttcgggcaaatcttgttgaggtccgtgaagtcgacacacattcgccacttgtcgttcgacttcttcaccagcaatgggtttgctatccactctgggtagtcgatctcttgtatcacccctgcttttagcagcttgttcacctctgctttcaccgcctcttggcgatctgccgacattttcctcaacttttgcttcttcggctttgcgtcagtcttaactgcgagatggtgcatgatgagatctggcgaaacaccccccccacttcatttggtccccaagcgaagatatcaatgttcttcttgagcacgaccaggatggtattcacttcttgctcgcttagatcttcaccgagcgatatgattttcgtggggtctaaatcatctatctgcagttggacaaccttgccgtgggggcgggtttcggtattggctttgctttttcttgcccttcgacttctaaggtatggacttccctgtcgaaaggggaccactgtggcagccgaaggctgggaacccttgacgactatcacaccagctgggccaggcatcttgagcttgaggtagttgtgatgagatactgcttcgaacttggtcaaagtgcccctagcgaatttggcgttgtagttgtacgggatgttgacgatgtcgaagagtatctcctcttctcttctattctctttcgtgccgaaggcgactttgatgagggcctgttctagaacttgcactgcttcgcctctgaaccctctaagcgaagttggtacttgggataatgccgatggggttgtacttgaaatgtagtggggttggttgagttgctgaaggaaagcttggagttgcgcctgcagagccgaagccccttccgccattgtttgtggcgcttggccaggtggttgatgttgtacttgggcagcgactggttgggcttgcagttgcacgtgaggggccggatgcgctgctgcagtcgatggctgcccggcgaagtacattggtgcttgtgcggcttgtggcggaaagggctgggtcgtcacttgcggatggacttggggtgggacataacctgccgaatactgaaggatcggggccgacgtgaccttggtccgtctcgctgcctcgtatgcttgttgttgttcttgcatttggcgaagcatgtcttggagtcatgtcatgttctgtcgcatggcttccatgtcggcttcggcttgtgtttcggggtcagggctgacttgggcctgcacagcggcgagcacggttggggccgctgccggctgcgatggaacggcttggggcaccaccagttggcttgtcgaaaggatctctgccctggtctggagtgcccttgccgccgcagccgccttcgccacgttggccgcattcggcacttgctcagaggtggcaggggccgaaggcagtagtgatggcgcagatgcggaagcagatggtcctcctccatcttcggccacgggcgctgaaggctctgctccctcctcggcggccatgtccgctccggtgtcgctttcctttcgccttgtaaccttctccttcacgaccttcttcggtggcattcgctctcggtggtatcgctcggaggtccccacggacggcgccagctgttgtcgaaacgacaaccgcatacgtcgaaagacgtggttactcaacagtggttggaaagaaacgaagtgtattaattttagaattttttacttcgggatccccttattacatggccctaggggactatttatagccccattacaggttcttactactagggtttaggttatacaggggaatttacatggttaccctaacgaaagggacatttacaggggtacataatgttatggaggctcatgggcccctgatgggccgtcgggcgaccgccggccctatagcccctaggcttgatgggccggaaaggcttcttcggccctcgcgggggcgaacttgccatggcgaagtcgtcttccttcggcaaatactcttcgccttgcacccttcgcctgggacgcctctggctcgacaaggtactcgcacgacccctcgcctcgcgctgttcttgctccatagtcttcgccacgggtttcggcagatttggtcgaagggcctcatgccatccgccaacacttaacaacccgagagaaaagtactgacgatatcagttaaatgagagttacgagatgcatataattgagttgccctttcgttacgagatgcctgttctggcagtgagggtctaagcaagacatcttctacacctcgtcgtcgtagtgtgagatccaatgttgagaacatggatggcatcgctgcgggggatgatgactcactgctcaaggcaatgaagaggaaagcattgcacaatttggatgacagcttttctggacgagaggtttcggcaacgaattctaagcagcactcggcctctcataaaacatcctctagtgaaagtactgttataaactcatccccttctttaccttctttacattatgattttgttacttccaatcttagttctttaggtgtttctttgggtaactctcatgatgaaatttatttctcgcttaacgctttgaaacatattgaggttgatagaactaaagcaacaaacaagactagtgagtgtaaccattctaagcacgttttttcggaagtggatccttttacaactagtgatgatgagggcgacgatgatgttgccctactcgctcacttagtaaaggatctcacgaagattgatatggacgatgtggaccaaagtgacaaaatttgtgacttgttggtatccactagaaaatccaaatcttcttcaaaaagaaaagagcgaaaggcttgttcccaaaatccaaaagcctctaaatctgtttcctcatgaaaggcattttttggaatagcagaggtcttgcagacttggctaaataccgttatgttgcataaacagttagagagaaaaaactagactttgttgcgttaatggagacaagaaagggtgaaatgtcaaagatgaatttagatcgcctctctgggggtgctgatttcatctggcattgtctcccacttaaaggaagatcagggggtatacttctcggaattaatgtagctgttttggatatatctttaattgttgaaggggaatttttcgttaaatttcatctcaacaatagggaggataattttaaatggatcttgatggctgtgtacggtccggcccaagatgattttaaatctagtttcttggcggagttcgttcgtacatgccaacaaaatcatctacctactcttatagggggggacttcaacatcctgagaagtagtgtggaaaaaaacaatgcccgttacaactctctttggccttttctcttcaatgctgtgatcgatagctttgacttacgagaaatcgctctttcgggtaggcaatttacatgggcaaattcgcttcccattcctacttatgagaaactagacagggtcctcacatcaacggaatgggaatccaagtaccccctggttttggttcatgctcttgacagaggggtgtcagaccacacgcctttgctccttgacacaggggaagcggccttcacgagaaacattaaacaatttaaattggaactgggttggtttctacgtgatgacttctatggtcgtgttctcaagatatggaacaaaccagtcaagggtcataatgcggtccaaagatggaataacaagatgagcgctttacgtcgccatcttagaggttgggctgctcataccagtggcgtctttaagcagaaaaaggcaaatttgcaaaacacaattgattctctagacatcgcagcagaggtacgactcctttcggatcaagaaagaattcttcttgatcaatcgagggattctttggcaagtctactccgtgaggaggagattaaatggtaccaacgctcgaaagtctcggacgtactcttaggagataacaacacaaaatatttgaacttgatagccaacggtaaacataggaagaagaggatctttttcctagactaggatgaagggaaaattgagggggttgaggccttgaaaacttatattacgagtttttataggaaacttttggaccaccagaggagaactcgttttcgcttgatgagtccataattggtgatatggctcaagtttcacaagctgaaaatgattttcttactgctcctttttcggaagaagaagtgaaagaagccatctttgcaatggagcataataaagctcctggaccagatggtttcccagctgaattttaccaaaatttttgggatgttattaagcatgacctgatgaacctttttaatgaattccatactggtagcctcccaatttcggactaaattttggggtacttactctagttccaaaagttaaagaagcaaatcaaatccaacaatacagacccatatgcttgttaaatgtcagctataaaatattcactaaggtggctacaaaccgaattagctcgattgttgaccatttagtgaacccgacccaaacagctttcatgtgtggacgaaacattttagatggagtcgtcatcatacatgaaacaattcatgaactacataggaagaagttgagtggggtgatattcaaaattgacttcgaaaaggcgtatgacaaggttaaatggccttttctgctacaaactctgcgtatgaaaggtttttcgcccaagtagaaatcttggattgaacctttcatttccgggggaagcgtggcagtcaaagtcaatgatgatgtcgggcctttttttcagactaaaaagggccttcggcaaggagaccctctctccccaatcctattcaactttatcgctgatatgctagccacattgataaacagagccaaaacacaagggcaaattgatggagtcacaccacatttgattgatgggggactctccattctacaatatgccgatgacacggtgctgtttatgaatcatgaccttgaaaaagctcagaacatgaagtcagtgcttctagctttcgagcagttgtcgggtcttaagatcaattttcataaaagtgaactgtattgttttggtgaagcacttgattatagtgatcaatacaaccagctctttggctgccaggtcggcaacttcccattccgttatctgggcattccaatccattataggaagttgagaaatgcagaatggaaagaagtggtcgagagatttgagaagaaattgagtagctggaaaggaaaacttctttcgttgggaggacggcttactttgattaactcagtacttagcagtctcccaatgtatatgatgtcatttcttgcaattcctagtggggtacttaaaaaacttgatcaccttcgatctaggttttattggcaaggggatggacataagaagaaataccgacttgctaagttggacattatttgtcgtcccaaagaacaaggggggctaggaattcatgacctcgagataaagaataaagcgttgattagtaagtggttatacaaactacttaccaccaatggaatatggcaataactgctacgcaataaatatttgagatcacaacctttatctcaagcctactggaaagcgggggattcacatttttgggctaatcttatgaaggtcaaacaggattttttccgttttggatccttcaagattagggacggctcccaagttaggttctgggaagacaaatggttgggtaatgcctcgttaagagaacagtattcttgtctctataacatagttaggcataaactgtcaactatcgtacagattttccaaaccaatcccccgtgcttttcatggcgacgggatttaattggtgcaaaactagctgcttggcataacctattgcctcgcatagctgatttggttctggtacaggagtgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagctaattattaccagttatagcatccataattatcgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttctgaacactcctgacgcactcacgaaccttcgcaacgacggaaacgacaagctaacacgcaaaacgaagaaaaagactaataaaaaccaaataaacagtacatataaagtaaacaaacatgtagatcctgattttagatgaatttagcaacttgaaccactcaaaaccgagttacaatgatttagttatgaatttccgaagatttaatctattagaaaaactggaaaaggagaagatgatgacgtcatgatgacctcatcaatggccggaccaagatggcgacctcgccggagattggatggtcggctgtgactttggaggacatgaacacgtagaggacgacgagacgaacccaacgatactcaccctcgaaccaaacgacgaacgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggtggcggtttgcttggcggcggtggcgacggagctacggagcacggaagaggacgggagagggggcaaacgaaagaggaggactagggggtcctatttatagccttgattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagagtaatatttcccctcaacaaaattggagaaaaagagcaacggggaggcgagatttggaaggaagaggcggcggcactgtgcacggcacggctggctcgggctctgcctgagttggaagatgaacaatagcgcagggagggaaagtagacttttccggcagagctgagaggagaggacgcggctcaggttgggccggcggaagagagaggaaggaaaggaaggaatgggccgaaaatggcccaagctgaggaggaggattttattactttcccaattaaaataatcacttaaatgatctttgaattgttaaaaatacttccaatgctcaaataatttcaagaaaaatcatgaaaatacttggacactcaaagtacttaacaaaattataattagaccatttaatgattaatttaatatgtgggtaattactgaaatgctctttgtatgattaaaaattaggaattgagctccgaaaaatccgagaaaactccagagagtataattaaccatggagaatttaataaaaattaaatccatccatgctttatatttaggaaattttatttcccacatttaacttcacttgtaaattaatgaacatttaatataaattctattattaatttattaaataatttataaatcctgaaacaaaaatcagggtgtgacaaggagcaagatgagtttcactggaacctcaccccgaatggggacttctcggtcaaatctcattatctagctctaacacataccggggttctgaatatcaatagacggatttggaaggtgaaagtacccctaaaagttaaaatcttcctttggtatttacgtcggggcgtaattctcaccaaggacaaccttgctaagagaaattggaaaggcagcaagacatgttgtttctgtcacaaggatgaaactatccaacatttattctttcagtgccgcttatctcgcttggtgtggtctgtaattcatttggcttctaatctgaaacctccttgcactgttggtcatatgtttgggagttggctatcatgtgtcctcaaagaaatgaggaatctgcttttgatgggtgcaacagctctgtgttggtccatttggctaagtaggaatagagtaatttttgataacaagatggtgtcttctcctttgcatgttatcactttagttacccggtggctacgtacctgggctatcctccaccaaccgggactgcgggatactattatggtggtatctcgacgtttggaccaggtggctcaggagttttttacccaggagcataggtggcggtctagtctatggattaatagccactaagatactaagatatacggtggtatctcgacagttggaccaggtggcataggagtttcttacccaggagcatgggtggcgatctagcctacggattgatagccactaagatatatgtttccgttaaacttttgtgcttgggagatgttctagttatttctttcttattttttggctgtgtgcattttatgcagaggccgggggtgactcagtttgattgtatcatcttgatgtaattaactgagtctaaataagactccattatctaaaaacgagatgcatatcatgaaccagaaattctgaaggtgtacaaaacaaaagagccatcagttaattacatacgctaggcaactgatgccatatgtacaagcaccgaatatatatgaaataatgtaaaaatatatacaataatgatccctaacaacctgtccccaggctccacatgaacacagcaattgcaagaataatacaacagattcaattcaagttacaaaaatgagtttgcacaaatcattgttttgaataaatcaaaaatgacgacaactctactctacagtatcattcagtgtacataggagtatgtacctcttgatgaataaatcacttgttacaatagttatgcttgtgcaacaaatatatcttttactgtacacgacaaatttgttctgcatcacccagcaatctaagactacgagaaattctctgcagaagcaagagtagcacatagttataacatgatctcttaggtagaaagagaacgttacgcttagaacatacctctcgagtatcactaaggcgcaatagatccaacctgtctgacggcctcaaatttattaagttgacaagctgcaataaaaagtacagtgatgaggcgacaatatgatgcactcttaaatctaagcagttgaatgagccttacccaaaaactaaatttttcaggatcctgtggtccaggcatgctctcaagatctgtctgtcttgctcgcctcgctacattcagcaaaacatattaaagtacaatgtgcatgggtatctagtgagcaccaaataacattgcatcccccctcaaatcatttgaatcaagggcagctactatgcgagtgaaatatttaaacaatgcactgtgaaattggagtctcattttcctaaaaaaagagagagagagggagcagggcaatatgtacgacattggaattatgcatcctgacagtggccgatacaacttctggagtttttggattgacattattttttctggggtcattcgcaaatatgtatttttaaagaaaatgaccctatatatatgtcttcatatattagaccccatgactgcatactggatcttaggagtcagctcttaagctgtctattcttcacatgggcgccacagaatcactaaaacttcattgagcaggatgacaatgtgtcgaaaatatccataccaggccttgagatttctctagctcgccttatatatgtcctggccaattctgaagctgcattagccctttccatcagctgaaaagagccaaaagagttacatcaatgtcacttagaacaaattaatagagacagcattaccattccattgtgatgtttttctcttccgtctataaatatcagaaggccaaacatataaaacctcaaataaacagtgaagacaaaggtaagcgtaaagcagattttaatttcatcagaacggaaaaataaccacgtgcaaaacaaatgtacaactaagaattcgagtgcaaacataggctatgtgtccattttactgggaaaagtactagcccattttcaaaatagttgtgaaaatgtttttctattttgtttaaataaaacatgcattattaggacaaaaaacttggtcctattgaaacaagtactccttttgaagtaaaagtcttctattggtaactagttaaattgttccttcatgttgcagctcatcaagaaccaatgaatcacgcagcatgtatccctatcagcctcacaacgtacatcattttcaaacttctatatcttagtgatggtatgtccaaatattttcttaattcgtactctgcaagttttacttcaataacatcatgtggtgcttaagctggtttttgtccatcacatttttgcaatacttcacagcacaactaaaagaattgcagtccgaaaagttaacaagattttacatcttttctctcctgcgatccgtctggtaatgaaatatcttggagccactcaatttcagcaaccctatacctgaaaagggaaatgactaaagtaaaatgaacatacacaagggttgatccaacatgttatattcccagattaattgacacactcacccatcttggtcccatgatcgcaagatacgaaaccgccgtgaaccttccacctataactgaaagtattattttcacatctgataataattcaaattcatatttgttgaatgacattatctatggaaataaaaaaaaaacgtttttggcaggggaaagggtttttcattaatcaacagggataaagcagtctctttgagcaccaagtgttcaacacattggttcattgtatccggtgaatggttcgccccacaaatanagattaaaaataagcatccataaggggtccttttagaaaacaaaagtgggctatgagtctgcatccagagaggtgattgctgcaaaatnnaccaggataaatcttgatattgtaaggtacgctagtatgtgtaaccacatccactcaatatgagccaaaccaacctagaacagaagttataagctcaagcataacatcttgcaaaaatattatggttttacctctagataaaaacgaccatccggaagtggctcacacctacatatatatatatatatatggagacgagactgaaagtatgaccatatgtttgggaaataaacaagtaacaactaaacttactccagaatttccacctcacaaccacagtcagctacagtacccgtagcagaatcaataccaacctgcaatattgcagcaatattcaatccaaaaagtaaagaaattaatgaatcgacacttcaaaaccaaaatcattattttagattagttactgaccattcccatgcgatgattcccttccattatcctccttacctgtttcaaattggaaaaaaaatgttgaaacttatcatgcaaacatatcgtaccaatgcttagatggaatagaaaataggctaaaagtttcatgcataacatgaaagatatacagatgggaaaaacaccgactggaaatatgcttgttggcacattgagaaactagagacaacaaaagatgatagttacagttatcttatcatgtcttcccttttattgcgctacagctaggatttagggaaaatatcaggttgtaataatttttttgacctgaaaacttccaggctttgcctggcagttttgaattatgataaaaagaaaatatttacataaaatttaaaaagaaaagtaaagaactctcaccaataagctctaagttatatcgtttgtaaccaatcaagaattaagctttttagggactctttcatcctacaggtatgtaggagaacatcttatttgaaggttccaatattttaacactagaattttatccaagattccccggaattatacgagtccttcttagttgtacgcttataccacaagttagatatcaacatgtaacaagtattagacttctcttttggggggaaaaacaaagcatcatcgttctcaacaaacggatctgacaaaaagatcaactgaatttatggcaattgtaccatgagcctgtagcgaggttcaaatatgttcagtgccatcttttgacaaggcagtacaacatccataacaaagagaggcatcaaatcaacgcctgcatatgtcatagtctcatgttctgacttcctctcagcatattcttccggaaaatttttctgaattatgttgctcagcgttacactgaagcatttaatcatattgtcatcatagatgtcaacagaaaacattgaagaaaaaaagaaacaaaatttcaaagaacttagattaccttataggatatgtttttggaccaataaaaagaactgtccgacacatgggacatttattgcctacaggaaatgcacataatgtgaagttccgatattaaaaaaaaaaggttaatcaagtctgaatattccctaagcttaccatgatccattgattgatgtaaacaagagcgacagaatgagtgcccacatggagtggtgactggttcaaacaatagcttgaaacataatgtgcactcaaaatcatctggtctatctaatgttggacgtcttgctcgagctgcaatacttgtatttctgtgcagatcactgagccagctttgcaggacatggctatacatgcggcaaacagatgttatgcaatagaggttaattttacattaaacagatacctgcaagatacatgttgtactagtaggcaatgcatcagcagttgtacctgaggggatcaacttgaagcccagaaagaatagcctcccgtgcctcatggtactgctccaactgtgtgtcaaggagttagttgctatttcgactacatgaacatgtatgcaatggaaaaaggtttccatgagtacacaatatgcatgccagctgcgatagaatctgaacagattctataaaatcttataaatctgtctgaagagatgccgtgacatttgtaaaatattaaacctaatcagctaatggtgcctcgtgcataataaagggaaaaagaaaatagaacagtacttaaacatttaatgtttgaaaattttgtaaatcctctctcccctgcatcgtccattgtctagcatttctccaagtcttctttctgtatccatctgtgatctatcatcaatctctgacgaataaatcattatcctattgaggtgcataacaacttagtatcgcagccaacctccaagggctctactgcttgtaggatcgaatcacaacaactaagccaaccagagggggggtgaatggttggtatacccaaaaaccgaaaacttttagcggaaatagcactgctgaccaatctgacatcaacgctatgataaacaagatgatgcaagcaaacatcaatgctcttattgatctggtgagttcattgctgcagtgcacccagactcacaatgcaggtggaagctctatagacccactcttgtgcaaggttaggtagagaccaaagtcgttgggcacgtgccagtactaggtggtcctcaggtacagagagatgggtggtgtgcctcacagctttggagaagctaatgctgccaccaagctggcagcataagtgccaagtaatatggcattggaaaagagaccagtcccttacgtccgtaggatttcatctacggcccactgcacaaaccgaagcattgggattgctgggtttgtcccactagcatgttagttttatccatcccgacaataatggcttttgagcaactacaagtgaggacagttgatgacaccaacgggaatgcagtatccacaaggttccgttgtcttggcttaatgctttagaggccaggagtccaggacacctcaaaggacaaggtttggttggcttcataccacctgaaggacattggcataagtacaactactagccagagagacatgagaagtcaagtcaccaatactaagcagcccattgagggagctggcaaggtacaataggcacaaacagtagataagtaataggagaaatttattggcactgttttttctcatggatgacctctccaaacaaatgaaaatgcggatttgctataaatgtgtcaccagtttcttttgttaaaaattagtcgattcgtcgactgtaggatataggggatatacgtcgagattcatgcgtccaggaataacgtacaggcgcagtggcggggagtcgaaccctggtcttctaagtcatagagagagctcctaacctaagtcacaaaagttcccggatcgacggatcgaggaactggaccgtggaacacgggacaccattttccaaaaacatggaacgagaggggtatacctcttccaaaattatggaactataagtggaacgcgttcctaggttttttaaaacgataatccggaactctacagaactatacatgttatcacagtggtcttggcgctcatgtacaaagacaatgtcacgtgctcgactccctggttctgctctattttcggttcttcatttttttttttttttgctattcatgtgacagctcatcaccagccaaaagaatttgggccatgagtgcaacccagccgatcaccagtacgtgaaagtgaaacctagcaggctagcacccatcacttcgtcctcatcattcgtccccatccccagccgccgcatccagtccatagatagctcgatgcaacgacggcggcgctgcgtgatggcttctgttagaacttcaatggttactcttattgagaagaggatggcactcgagatggggcaattttctggttttcttcattcacaaaacacaaagccataccttcccaagggaggttggatacatatataaaaccatagctggctgcaagcctattgctgcaccctcctagtctaaaaattcgaaatttgaatgggatgctgtcctagagggcatccaaactgaataaagcataaaggaggcataaaggagatgctaattgctgctgtcctactaaccgcagctgtcctagcaactgaaaatatgctaaaggagtagatgctgtcctgaaaaggtgaaactacccaaaagcaaaaagaagaaatcaggaccaaggaccacaaagacttatccatcagcttcctcgccagtgcaggagggagaaaagcggctgcaacgagcggcacccctctatttctccaaccttccctgctcggcggcggcggcatgcgctggtttatgtaccttggcatgacagtggtgagcagcgaaggagaaacagtgccactcgtcgattgaagtgatacccctcgccactcgtcgcttgaagcggtgccccgtcctccacccgtgtagatccgggtgagttccccttctcatcttttgctcaatgtacctcgttcctccattgccggaccacgtattgggtcgatgatccctccgtttttggaacgaagttcgcttcgttcccgttcctcgttccgggacgaaattcccgggcgttccctgtgacttagttcctaaccaactgagcatggtagtggtattgatttcattgccaaaacaggaattttcatttacgaagtacttacactaattacataccacttgcactatagttacaatgtaattacatagcacttacactacggttataatgtaattagataacacttacactatagttacattatatttactttgtattttttactaatgtgttgaatgttatatagtgttataatcatatggtttaagaaataaagtatgtactagttcctaattaatcatcaaagtgtgtacatagttggatgtccactgagtcgttaggtatggattagcgactgagaaaaaaaccgactgcatttggctctgttttgtggcgaatgatttttaggtagtcccatgaaaatattgaacccgcagaaatacaggtcaccatgtgctgcacattgctacctgaagtgctgcttaaggatgagttttcttatgaggggagaaaatatcatgtacaggtcatgcatagcacctagaggaggcaataacaagcagccaacagtaagcattaactagagacgagtcattggaattctcatttagcattttagttgcaacactatctttagttgacccacctgttgaaatcaacaacacaaagagtaaaccagaaatagcctcactccctcacattttcatcagtccattcctgccaacacccccccccccccttgctttcattttcttggtatgcgtgttactgccaacttttttttcagtccctacactcattcaagcgcttaacagtagtaattattaaagtgtgtgctcagttgaggctaactggcgaaagtgttgcacagagtgaagcttttgcaaatcacaatgcctaatactagtcagttaaacattgtacggtcaattgaattatcctattcgagaataaacactaaaatctttggcctacaaaatgatattggagctatctatactggctctaacaaatgatactgaagcaaggatctatctaaattctagattatacaacaatactgaatttaagaaggttttaccaggataagcgcatatgccttgagaagatatggtcttggagaattactgccgatagctaataccttctctgcatctttgagcgctacctgcagtgaatgcataagaacattgtaccgaaaacataagaaccattgcactgtactcacatatttcacaccaaatgataatatttgcataacaacttatacctccgcatgcgttgtgggatcaagaccattcaatggttggtactctgagtcagctgctgatctctccctcaacacttgacttatcctgtaatagaggtaaccagttagccccgacataggcatgaacgtagatcaaacctatccatgtagaattgagcaactgcattaacaagcatgcaattggtacatcatattgcatatgaatagtatcgaatagggtgctaaaaagacagtgacagagaactcacatacagaaagcagaacttcggttgctaaggataatgggatctcctggtctcaaagtttgtgctttagagtaaaaggaaactgcctgaaacaggaccataccaagtatcacgaacaatgaaactagcaaattgaaggaatcaagcttgtacaactgaagactaagagaaacataagtaataatgcataattataataacagctgttgttgctacatatgcaggatagatgttatcactgcataaaaaggttgcagggacatgaactaatataaaggatactgataaagccagtaacgaattcaacatttggaatattttgttagactaataaggttatgagacatacttggacaaaattattctgtatttactcaaaaaataaggatttcatctttcaaaaagttcaataggaaaaaaacatcagctctctgtcgaactattaaacacacaacattttacacaccaacggttgtcagtgtgaaaacatatatatcaataaaatgaaaataacacaaagtagctgttgggctgagtagttcaacgtaatatagagtgggtgtgtcaaggcccatgaggtccatatgcctatatacttgtatatgtaccaggaaaggaaaagagagatttgagaagcttccagaaaattcccaaccttttctctacagtagccatactagatattttcaatctgaacattccataaattaaaaagtttctgaaagaacattaattaccgagtgaataaacatcataaaagaaataataaaagagcgaaaatgattattaaaaaagtggacaataaagttcaaatttaaagaaagaagttatttggatcaaaaagaaggattcaggaaaactgaaaatcaaaccgaagaaagtagccctgaaatgtttataattggcattagaaactcaaaaggaaatccacaaaaactagtactacctcggtcccaaatataacaacttttggctatgaatctccaaattcatgaatagaatcttggaacccaaatgttcaggcatgttgagaggaatagcaaaattttctttaatggaccaagtaaaatggtaggattaactctacaaaattgcaaaatagcatacaacatgagactgataagtgtgtcctagagccagttgtttgggacacatctaactagcatgatttatgtatctcaagcagcatttaccattaggaaaagaaagagatggcttaatattggaccacatttttttaaccaatttacactacggctgataataaacaaattgagaaaagagggtcctggaaatcttgtaagatggacataaaagttgtgctacttggtaacgttattgcaggagaatttgatgttcaaaccaaaacaaaaaatttctgaagagatgactcgttacttgttattagggatcccttgttaggttgttactagactatttcactatgacatacgagtatcaaacttgatcagagaacaccaaatatggaggtaaaattctaatagctggaaggtacattttgtagaaacacagtatttccttcagtatgctagttcaggaaaattcttagcatgcccagcaacagtaagtgccggttatgtcagtcatactgtgaggggctggatggaactagtgggctacacgaacgaaattcgggaatgaagaggagcacggtcgctcagctaactgcttacctcgtcgaagtggccgtcgcggaaggcgcgagcaccgcgctgcgcgaggtcgaacacctcgcggtacttgtccgggtccatccccatctcctcctccctcttcaccttgcgcagccaaacacgagcaggttgaaaacccatcagcacaccgcgtacagtacatataggtgaaaggagcgaagttgacatacccacgggaagtcctcgacgacgagcgcggcggcgaaagaggaggcgcccggcgaggtcattggagggcagcagggcggaggacgggggagtagggtgggaatgggggtgcaggggattgtggagtttggaggaagggggaggagagggagaggtggtggtgggggaacctgcggcgttcgtgcggcgatgcccagaaatttttgcgcggctgaggccgcgaagacgtgtcgcagtacggactcgatcacgccacccgatccctcaacaacgacggtctatggctgagcacagggtgtccttttcccgttcgaccccggtttttcattttaggattctaataatttagggccgtttgttgggattcttaggagcaattctagcattaatcggttggagttgagccaaacgggtaattttccctcagcttccaaagcgaatcaactgggatcgattcccttttttacgaaggaagggagaatcggcggaaagcgagcttctgctaagaatcaaatcaaccaaatatgaaagttcccatatttttcccaaaaaattacccgcctgccactgggtatacccctctttccagccttccccatccacccgagcagatcgatcgacatcacgcgctagggttgcgggagctagacgatggcgctccgcatccagcaccgccatcgctgctggcgctccgcatcgccgccgacctctcccgtcgacgacatcgccgaccatagtcgccgtgcccgagccttttcccaccatccagccaccttcgacgccacttccggtctccatcctgccactcccctattctccctcagccctgcagatccaggccaacaacgccaccagttgccatgttgccattctccgtcgagctccctaagcaggacgaccagcactgactgggcaaggtaccatgtcctaaacttctccatttgattaactttgtatgttgtactattgtgcaaaatagtagaactgaatagctcgctgcgatgtggatttgtgtgtaaataatattgatgtggatttgcactctgatctgtgtatgtctaaatagttttgatgtgcatctgtgctttgatttgcatatgtgttatttcataactactgcagatggcagcaacagtagtagaggaaaatcaaggtgcaaataatgttgaatggacagatgaaaacactaggatagtttgtgagttgctcgctgaacaagttaggataggaaatcgctcaaatacccatttgaacaaggtggggtatgataatgtgattgcaaaatttgaagaaaagactggcttacgctatcaaaagctgcagttcaagaacaaatggagcaagctgaggaatgagtataatctatggaagaaactgatagctagagagactagattaggttgggaccaagctagggctactattgttgcatctgatgattggtgggcaagagccaagaaggtatactacatattaatgttgatgtttaagttgttaaccatgattttgcaaatatttgtgtcactcttctgattattcccttggtgttcctcaaggatttgccaggttgtgcaaagttcaagttacgggggattcaaaatgaacatttgctccaacaaatatttgaagaccttcgaaacacaggagatgaccactgtaatcctactagtggaaatttaccgcaaagttcaacccaaccttccagtactattaatgtagatacaaaagctgtgaatgaaggtgatgatgatgatagtaatgatgaggatttctcacctcctcccaagagaggtaaggcagcagctggtaaggaagccaagaaacccaagaccagtggtggacattggttctatgaacaaatgattgttttgttgataaccaagagaaatcagctgcgtctgttgagtctcttgtcaagagggaggacacttcagggtgtgccatcaaagatgtcatggctctagtg

SEQ ID NO: 63271 - DNA, 845 bp, Oryza sativa
  unsure (1)..(845): unsure at all n locations
gtgggcgggtacaacgactaccatagggcgaanncgagctcggtacccggtataggccactggccatgattgtctgtcttgctgacgagagaaacgagcagtacaatgcctagatataaaattgttccatgatcgatcgatgagagattgagagtgctagcttgctttcaattcatccccatgcatgccaggagaggtgaatgagcatcgggttcagaattcagatcatgcttgggcccaactcctccccggttatcgtctttgccggtggggttttctccccgatagccatgcccgtctgcgaaaataaaacccctacgtcaccgaaaatgctntttctagtagtggggattgaactcgagcatgagataacaccgaacatccatgcatccatatatccgatgagtgatcgataggcattttttttgccgggacggcccaaggcaggccgcccaaattgtattaaggagcgagagaaggtttcaaaaacttttacaaatcgacattaaacagtcgaggagaaccaaaaagaaaagnnnnnnnnnnnnnnnnnnnnnnnnnnnnnctttagctgacttctctaaaaatgttggcctctcttcacactacaacttcatctttgatatctctgaagagtntccgcgcctcgataggcattggacaaccgcaacattgatctatctatctccatggacatacaaatgcaaacccgctatggatgcngatataggctacgagcataaatgcatgcatatgcngaaccgggtatagcagtttttttaaatggatcaacaaataatntttaatggaaaggtatgtatctaaaccgggattctnttaagtcg

SEQ ID NO: 63272 - DNA, 842 bp, Oryza sativa
  unsure (1)..(842): unsure at all n locations
cgcgcgtcanggatttgacanttccnatgttgaccaactccgctcggtacccatgctataatgcggaatgattttctggatgatggcttgacgtaatctctgccgaagcttaaggtctggaaccttgaaaaacttgtgcttcgcgtaggtttttctggattctatctcaaaattttcaagagacaggtatcttcggaagccgaaagcaggtctgtaggttttctttcgaggagtatcagaagaatttccgatgaagatgcagcacaacagaggcgaccagaagacgtcaatgtaagtgtctatgtacctccgtgtcctgcatctgtctatcaaggcccaagatggcaggtccagggattcgatgccgtgcaacacaagctgccaattgtttagcaagaaaatgcaacgcaacgctgggtccaagatggaattggaaagggaggaggcaatttcctccaatttgtggccaacgcaagagatgatgtcggtgatcaggttcacgaccgagctgaagccctgtgtgtgagagaccaacaccgctgagttgtgatcctgcaggatgaaggtgaggacggttttctttgcgccagaaaagcgcgatgtagttcatcatcagcacggtggtctcatggactcctgatgctgatgccctccggcgagacttgcagcatccattcttggagaagaggatcgaacttttccattatgtccaaaacgcgtgcttagctctttctcttgcgcaagangatgcgtccatgccgtcaaaaacctggcttcttgccatggcgggagaagcccgaagcaagggaacggttcttctttgaccatgcaagcacggcggg

SEQ ID NO: 63273 - DNA, 11778 bp, Oryza sativa
cagccgaggcaggcgctagaaaacgcgggttgtggggcccacgaacggaaaaactgatcatgtgcgcgcaccgctcctaggccgccgatccactgatccgatcccctttcccctttctctttgccatgagatcgatccccctctccctcttggcgcgagcgcgagaaaggaggctggcgcatcgatctctccttcctggcgcatcgatcccctcccgccaaatcgatggacagatctcccacccaccgcatcgatcgatctccttcccgcgcagtattccctctcactcactcctttttcttctctcccggtcctataacttctcccgcgcgcgcgaaattcattttgctggcaggtagaacgatgccaaagccccaaaatcgcccctgaaatccatccccccggtgaatttcagggagggccactgccccccgtcctcttccatagttctaccgcaccaaaaccctagttccttttcaccatgtctcgtcggacgaagagagaggttgcaccaccgcaaactcatttgcaagctcgtctggtcctcccggtgttcatatcccgccggcaacaccgtatccatatggaggtcctttgttccccaccccactgccatcatggtttccttttccaccgtcacaagccatggcgggctcatctgcatatcgtcctcctactgatgccaagacggacgtccaagttgatttggaacaatggtacatttattatttggctttatcagttctgattttgacatgcttctgtttccctgtctaatattgagagtttcatggtcgttattgttttgatccataacagcactagtgcaatgaattgtttaggaaaaaagaggtgattttggtctgataatcaggttaccgtagtaacttggcccatgtaatttggtctgcaatgatttgtaccatgtatttatgcagcaatttggctaagtaaaaacaagagtccaatgttacatgtagggtaaccatggtagggtaattagcagtggtggtaaccatgtatttatgcagtaatttggcaaagtaaaaacaagagtccaatgttacatctattactaatttgttttagattcgagcactcatttaccactatgaactgaaataaaataattttgactgcacatatcaatataccatttatactggggtaatattgggttaggccttgcattgatcaagattggcttgttcattcctttttatatatgggacataactgatcaagattttcatgttcatgatttttatataggggactagaatctcgcccgctcggtggttttgttgattttatcaaaaacaccacgaaccttatgcaccatgtgactgaagggtgtcagttgcagccaattaatgttgagaatggcaacaatggaaatgccactaggaccgagaagcgcctaggctggtcaactgaagaagacttgaggctggtaagtgtcctacgcgagttatttatttggtagtggcattcataatacatgcaatttaacaatagtgaaatatttggaaattgtaggtcaggcttggttaaacaactcaaatgatccaatagaatcgaatttcaaaaagaatgataaatattggctgatgttgctgctgcttacaatagcactactccgtcaagccggtttagtaagatcaagaaaaaagttaggaatttttgttgcccttggaaggaggctaattcattatatgctagtggggagtgtaatgttgatctcatggacaaggcgctgaaaatgtatgagaatgacttcaaggatgggcgattcttgtttattgagtgttggaatgaactaaaaacccaacctaaatggcatgcatatttggatcagcttgacaagtcgaataaaaggaagcgagattatgctgatgctaccccccttgatgacgaggagatcccacgtccaatgggagtcaaggcagctaaggcgaagcgtataggcaaaggaaaaggcaaggttcaagattgtactgctgagctagaagatgacacccacaagtttatggaagcacatgaagcagccaaggagcagtaaagtgaattgttggagacccagcgacgtgttgctagtgataatcttgaagcgaagaaggtgggtcgccagaccgctatgattgcagcatatagagagttactgaacaaagacacaagagatatgcctgatgatgtgaggtctgagcttgttgcaatgttgaaatgcatgagagaagatatatttacaaaaaaccagtgaggtatgtgtcatgaagttctttgcagtagtaaaacatgcatatatctacgttgattttgagcagtagtcaaactattgtactgtattcatagctctagttccaaacaaccatgcaaccagtccctgttttgtgataattaatagcattcagtccaaataatcatgcatatagtctcatattttgtgctgattaactgccattagtctaaataaccatgcagtcaacccaaattttcatgattattgtagctggtctaaattaaattgcagtcaattgccaacccatattaaatttccatggttgttgcagctggtcctaattaaaatgcagtcatagtccagacatattaaatttttcatggttattgcagctggtcctaattaaaatgcagtcatagtccagccatattaaaatttgtatggttattacagctagtcctttgcagcatctatatattacctctcataacttgaaactgccaacccaatctatcctcctcctcctcctccaaccatgtcggactcatcctcctattcatcctctaactcagatgacctagacccatctaaagttctagacaagtacatttctgagcagaatgtactagactcatttgcttctcgaatcatagagaagatgaagggtaggttaggagctgggcgttcgaagcgccaaggtggaacaaggaagacaattcatagggatcatgtagatgcccacagccgtttggtggctgattattttgcagagcatccattgtacccagagtggatgtttcgcacaaggttccgcatgcacaagccactctttctacgtattgttgaagccttaggtcagtggtcaccatactttactcaaagggaagattgctctagccgcacaagtctctctccacctcaaaagtgcacagcagcacttcgtatgttagcatatggcacacctgctgatgcactagatgaatatttaaaaattggcaagagcacagccttagaatgcttagaaatgttttcacaaggggtgattgaggtatttggtgggacgtacttgagacgccccacaagggaggatgtagagcatatattacatgttaacgagtctcgtgggtttccgggtatgctaggtagtattgattgtatgcactggaggtgggaaagttgtctgagggcttggaagggtcaattcacccgtggtgattacaaagtcccaacaattatccttgaagcagttgcttcacacgacctatggatttggcatgccttctttggtgtcgctggttctaacaacgacatcaacgtgctgaatcagtcccctcttttccttgacacagtgagaggtgaggcttctcgggtccattattatgtcaacggggaagagtacaaccatgggtattacctagctgatggtatatatccagaatgggctgtattccagaagactataccacttccacaaactgagaagcataagttatatgctacacatcaagagggggcaaggaaagatgtggagcgggctttcggggtattgtaagctcgtttcaacatcgtacgtcgtccggcaaagaaatggaagagaaagagtgttggaaatatcatgctaacttgcgtgattctccacaatatgattgttgaagacgagggcgaggatgcaatatgtgacctagacctcaatagaattcctaggacatcaatagtactgcctccagaagtaaccagtggtggtaaccaatgttttcgtgatgtgctaagtaggaaagctactatttgtgctcgttcaatgcatacccagcttaaaactgatttaatttagcacatttggaaccggttcaggaatacgcagcgtacataaccatggtagggtaattagcatataatttcccccttttttgtcatatatagagccttttaatttacccttctatatgttttatttcaggaacaattaagctttgatgtctactgtgttgcacctctgcaacacacctcttacaggtatatttccatcatatggtatatttatcgtgtgagtactttcagctgtaatgaacatcgaaatttttgtgtacatgaaccgattttgttcctccatatgctatatatgttgtatacatgaactgctagcttcatcattgatcttttttacatctcagttcaaaaatatgattcatgaatccatgtaactatagtgtagggactgtgacaatctttcaagaaaatttattggaatgagacacacctaattttatagttttaggaaaagtttactgtaattggcagaaatttgaccatcactaagtagttagatttctgggattaatattgcatttgtactgtgattgttctgctgataacataatttatattctgcaacaaatcaagatggctgatgatggtccatatggagatcaagaactatctcagtttatatctatgttttcgttaactgttattttgttatccctaaaaagttgccttgtgtagcttattattgtctagtttttgtggtccttttgtttgatggcatgttgccaggagatttgtgaatcatcgtatctgtttcactgtttggattattaatcctctatttaactagctctgatgtgattgtgtatatgtggtgcaacaaaatggccacaaatatggatgtcaggactgatcccaacaactgctattggcatgcatgcattaaatagttcaatgtattaatctctgacattttacagctaatctattgtacttggtaagctataagctagctcttcctgagttggacagaaaattggagatggcagtgggctctctattgaccttgctcttacacggaagattaccccttaattaatgactccttagtaattactccctccgtttcgaaatgttcgacaccgttgactttttagcacatgtttgaccgttcgtcttattcaaaaacttttgtaaaatatgtaaaattatatgcctacataaaaatatatttaacaatgaatcaaatgatgggaaaaaattaataattacttaaattttttgaataagacgaacggtcaaacatatttaaaaaagtcaacggcgtcaaacatttcgaaacggagggagtataatcctgtccgaaatgtcatctaattcgagtacggagggagtataataattaccttggtcaggggctgcctcatgccgccaaaggaatcgtgggatcgcctcctcgcgatgtgtgttgggcagttggatttcgataacgatgatggcgaaagaaactcctacgttagagcaagtttaatagtatagccaatcgctagctccaatttatctatagccaatttaatagctcatttatacaatagttatatactacactattaatacctggtcccacctatcatacacacactgcgtcttggagtccgtgctacagctggctataaatctatagcccactgtccttctctctacttatttatcttccttaaggaaaagtacgttttacccccctgaactatttgggtcgttcgaattaccctcttagactctaaaaccagttattttacaccccaaaattttcaaaccggccaaattacccccctaagtcaatccggggtggttttggtttgacgtggcgcacacgtggcactagtttgattgatgtggcagtccaacatggaaataacaataataaaaatggtgggccctaccagtcaggcacctattctgattatacgagagagtgagagagggcagaaggggtgtgggcggcggagctcaaggctagaggccatggagagcggccgccggcgtggatctcatcgcaccggccaccgaatctctctcacctcctctctctcatcttcctctctctctaactcttcctctctctctcttgcgcgcggcagcaggcgggcggtgggcggcagcaggcgggcggcacggaggcgacggtctctcccgcgccatcgccaccgccaccgccaccgcggctatggtcgtacaccacccgcgggatggcttactccagctcggtgcagaggaggtcgccacccatgatgaggcccatgccgaacgcacggagggcggctcgtcagtcgtcgtgcagctgctcccacgccatctccctcgccgcctccggccgccgtcctcgactcctcgcccgccgcccgcagctgcctccaccccctccggccgcagctgcctccgcccccgcgccacagctgcctcctctgctcaccgagagagagagagggagagagaggcagagaagcgctacctctcggcgacgccatagcccgctgcccgccgagccgtcgtcggctccagctccccctctgccgccgccaaccgcccggccccgcgcgccgccatcccccgcacgccacacacacctgctcccgcatcgccgccgccgccgccgcccttcaccacggggtcgtcggtcgcccactccgcctccgcctcagccgctcgccacccgcagcagcgcagcccgggaagctccgcttccgctgccagccgcccgctccgcctccgcctcagcctcagtggcacgacgcccgccgcacagggacctccgcctccaccgtcgaccgcccgctctgcttccacctcagctgcccaccgcccaccgcccagggagctccgcctccgccgcccgctgctcggggagctccgtctccgtcgccggtcgcccgctctgcctcagacacccggccgcccgaggagctccatctccgccgccggtcacccgctgccttgcccgagcgcgtgcgtgagagagatggaatggttgagagattgccagattggtttgaggataggtatgacaggtgggccatgtttttttttattttttttgctggttagattgccacgttggcgccacgtgtgcaaggttaagtcaaaaccactcaaaacagtgttaaggggccttatttgtccggtttcaatagttgagggtatagaatgtctggtttttgagtttaagggtgtaattcggtcgaccgcgatagttcagggggtaaaacgtactttttcctcttcttaaattatggttgcagctggcttatagcctgctattatacctgctcttataggattcatccagttgagacaatgatactccctcttttcatttcatattataagtcgtttgactttttttaagttaaatatctttaaatttaatcaacattataaaaaaatataaaatattttccatacaaaacaaacatattatcaaaatatatttaatgtaaaatgtatggaaattaattttgtgttatggatattgctaatttttttataaacttgatcagatataacaaactttaactatgaaaaaaaatcaaatgacttataatacaaaatagagtaaatactacaaatcggaaaacgatactccctccatctacttttgatagtaatatttcatcttggcacacagaccaatgataagtgattgtacttgtcatccatttaaacatgctactagtcattcctcgtaaacaagcgattcattaatatttacatttcccgatgcccatgtagccaatcttgtgtgtaagaatggagagtcacgcattaaatccaagaaagccattaagattataagttgttggattgaaatatgcctatcaaaaataaaattttcaaatttagaaatatgactattaaaaagtagatggagggagtattagctaagtatctatactaattaccttgtcgggggccgcctccacaccgccgaaggaattgccgaagcggaatcgggggatcgcctccttagtccttactaagtgtgttgggcagttggatttcgataatgatgacgacgaaagaaattcctacattagagcaagtttaatggtatagccaactactagctccaaaatatttatagctaatctaatagtccattcatacaatagttgactataaaaatatactacccattaatactcagtcccacctctcatacacatataatatcttggagttcatgttacaactggcgacaaatctgtaatccgctttctctctcttcttttttcttcttgatatgtggttatagttggcttatagccttagctattgtacctactcttataggattgatcccgtcgatacatactccctctatttcagattagagcatgtacaataatagcaggctataaaccagctataaacacatttcgaagagataaaagagaagagagaagggcagtgggctacatatttgtagccagctgcagcacggactctaaggtacatgtgtgtataacaggtgggaccagatattaattatgtagtatatgtttatatgtaactattgtatgaattggtcattaagttaactacggatgatttgaaggcagcagatggctatactattaaacttgctcctaaggtccattcgaccgtgcatctgcgatcctcacgcgtgcaaacgtaattagcggtagcgtccaggattaattaggcaatgtatttagaaaacatccaactatctaattaattaaacttttgattttaatcccaaatatatagggcgattcgttataattcttttatcttaaaaaaatcggaaattttaatcctaaaattttgtcacctaaatacgttgccaaaatatgccacttattattttaggtatacttttttcattctagtaaaaagttggatagtaatttttttactattattgtaaaagtttctcaatataattttttatttatgtataaagtttatcaatcatttttttacatataaagtttataaatgaaaatattttatctacatagaaaatttatgaatctattttttttgtttatttataaagtatatcaacataaatgttttcttttatgtataaagtttattaatgaaaatattttatatatgtagaaattttatgaatataaatttttatttacatgcaaagtttatgatgattcatatataatttcaagtagatggagtttacaatttaagcttatttctatttgaaaatagaagtttcggaatctaacatatcaaaaatgttgataagaaggttttcgtatcaggatgcgtcttccctgtcccgataccctgttcctggcgacgtgtcatcttcttattcgctgggtcttttctggtgggccagtacgcatgcgctcctctttcacttaaacggcgtcaacgtcccgtgttatactatcacaattaatttggaaacaacgcaatttaagcgctaacaaaaatatggcgccaagcaaataaaattagtggcgggaaaaaggattagagcggtacataagtacaaatacacagttattttattttcatctacacagattgcgtctccacactaacaagaactctcccaaatcttggcaccatgctagatgaactcccgattcctagaccaatgccatcacaattgcagaatacagtaacatgcggtacgttcgcattcttggatgatacttctgccccatcatcatcatcatcaaatcctgctgagtccacatatccctctgatggcctgggaagaaatcaattagaagctgtaagatccctatatattctcctttacattttgttaaattagttgcatctaaactgtaagatccggacatgtgcacgtgcatatgaacaactatattcatcgttcctttttttttttttgcaattttttgatggaaactattaccacagataaaactaggatgaaggaacaaatgaagcttctcatacaataaaatatctggaagacttggtgccaaagattggcatgaaatttagctctgaacaaaaagcttatcgacttctacaatgattatcttaagaaaggtttcagcattagaagaagcagctatcattacatgggaaatactaaaattataaaaaacatgacattttgttgttctcgtcaaggtaaattctttgtttctttttatagttacattaactttcaattagagacattttgtttcaattagtgcactgtattaacaggaagtagaggtactgacaaaagagcagaagcttcaggctatggcgatagttatagtaggccagaaactcgatgcaagtgtcaagcatgtatgaagataagtctcatagatggattctattctatctatcactttgtgcctgaacataaccataatcttgccactagaagtcaggctcatcagttacgatcacaaaggaagattaatgaagctcaagttgcaagcgttgaagtcgcaaaatccgtagggatttctactaaagcagctattgatttgatggcaaaacaagcttgtggatttgagaatctcgggtttactcgtgttgacatgaagaataaattatactccaagaggtccctacaaaccaaacaaggtgatactggaggagtgttagaatatatggagaagaaagcatcagaagatgtcaagtttttttattctattcaggttgatgaggatgacttaattacaaacattttctgtgctgactctaaaatggttgccgactatgaaaattctggtgatgttgtatgctttgacacaacatatagaaagttggatgacggacgaccttttggtttgcttgtaggagtgaataatcataagaagactactgtttttggtgctgctcttctatatgatgagaccgctaatagttttgtttggttatttaaaacttttctaaatattatgtcaggaaagaagccaaaaacaattttgacagatgaagatggagctatggctaaagcaattaaaatagttcttccagaaactcatcatcggatatgtgtatggcacatgaatcagaatgcctgcaagcaccttgctgggtgtgttaaggactataagaaatttaatgctgactttcagaactgcatatatgatcaggaagaggaagaagaatttttacgtgcatggggccaattgcttgaaaaatatgagcaccagcaaaatacatggttgtaacggatttttaagaaaagggagcaatgggcattaatatatggccagaacatgttttctgcggatatgagtaccacccaaagaaatgaaagcccgaataatgaattaaagggttatattagtgtgaagtatggcatgctttcttttcttgagcactttgacagattggtgggagataaaagatatgaagaggtaaagtgtgactttagagcaacacaaagtacaccgaagctaaaggcagagttgagaattttgagagatgtagcagaagtttatactccagcagtttataagatatttgaggaagaggtaatgcagactttgaattgtgacatattctactgtggtgaggttgatgcagaaaaggtgtacaaaataaaggccaacggtaaatgcatcttgaacatgttcatcttgaacatgttgttagatactctccgttggaatccaatgttaaatgcagttgcaagaagtttgaatttgctggcatcttgtgctctcatgcactgaagatacttgacgtcaacaacatcaaatcagttcctcaacaatactacctccgttttttaa

SEQ ID NO: 63274 - DNA, 576 bp, Oryza sativa
tgaccctccctttctttttcacttaaacattatagtgtaccgttgaatgagaaactaagagaaactatcatgtccatccatgatcattcagaatgaaacgccaataccacaatgccatagttgaaataaggaaaacaaatgcaaactgtttgaagccagttacatgcatactgcaagtacagaaattactgtgtacacaatgaacatgagctgtaactaacataggaaatcaggttatcttgagcttcaacaaaatgaagaaaatgttgaggggaaatagggcaatttagatagagagagactcacgtagcgatggaacatctccacagccttctcagcctcctcaacggtgctcatggtgacaaatccaaatccacgactccgatctgtttctctgttgtagatgacctgaacacgcgaaaatagaggttcatttctgatcaaaagaacaaaaccatgcatatcctaatattttgtctaactgcctctatacggttcacataataaataaatgaataccctaaagacgggaaggtaaatatcaaaggcatctttcataacacaagtaggatgccc

SEQ ID NO: 63275 - DNA, 849 bp, Oryza sativa
  unsure (1)..(849): unsure at all n locations
gcgcgtctttgacggtagnntcantttgtaccaaccgagctcggtacctgttggttttacagagttttgggttatctccatcaaactttgggaaatctgtcttaggcagtctagggctggcggatctaacactaaagctggacccccctactcccttctctgatgtttctcccaactcaaaattaacaggcgaatggtggaattggggcttactcttgaccagggtttgctccttagccttgaaggcttcggatgcgtcaccctggtgagtcgattcgacgccgtgcctacgggcgcttgtgccgcctgcgatggtgtcgttggcgtcaccgcttctagctgcgtcaccctgaccgcaatctcatccaccgccttgttcagctcccggattcctgaatccacgcatgggatccatttctccagaccttgaagcgatccgaggatgttgttgatacttgttgtgagctccaccaccttctcgcccaacacctatgcttcttcttccgctgcccccatcctctcggttagggttggatttgccttcttcctcgccagtgcgcacgagaaccgaagtgctctaatactagattgtcacgaattccatgactcttccagcgtttcgcctaattgaatcaggatttcgctagagatttggattagagattgtggaaagggatgaattgaggagggaaaggttagttaatggcatttgatttctttaatttttccgatccggttacagaccagggattttccctttaatggtcacaatgccacagaacacacacccacctgacgcggtttgccgacccaacacgggacgttaggttactcacaccaccttggcct

SEQ ID NO: 63276 - DNA, 819 bp, Oryza sativa
  unsure (1)..(819): unsure at all n locations
agagagtttggatgaaccactactataggcgcaaccgagctcggtaccctgttcaacaaataaaaagggacgataggtaatgagacaaacccccaactcccttttattattaactagcgttaaacaacatagatttgtaggatcgaaacacaagaactaagccaaccagagaggggtgaatggttggtatacccaaaaaccaaaacttttatcggaattaaaagttaccctcaaattcgatggatcgcggtctgaccgaagtagacgtgccggtctgaccgcctagaacacgtctgtctgaccgaggttgtaacaccggtcgaaccgccgaggtcaatcgtcagcacctgtcgccgccgccggtctgaccaccgtgtgcccgccggtctgaccgccggtgtctcgtcggttggaccgccacacccgagaaaacacaaatcgaagaactcttaaagtggatgatgactttattgattctctctgtgtttacaaagtgcaacaacagcactccttacaaaaatcttgacttaactcgaaacccttagtaaactatcaactcaattgctcttaaaagcgataaccggaagcctcaacgctcctctctattatacatgaggtagcagctaaaggcatgaacaaactatactagaagtctaatcccctaggaaacttntcgatagaaacaacttacataccaatcatccaaatttgactctttcaaattcactcgtatccataccacacaaacctccatgtatggcatatgaatcttaacaacacttcattgactctagcttagataaccatgaatttgaccac

SEQ ID NO: 63277 - DNA, 606 bp, Oryza sativa
gctcattattttttgctttcttggaatctttattgtcaaaaaccaattgtttctgcctcgaagattttgatttgccttttttctctggaaatacagttggtgaagattgttgcccggctgacttttgagaacgccgactaccagaccgccgactggacttctgggatgagcttctggaagtaggattttctagatcagctacttccatctctttcttttaaagaggacttcagagcatcagtatagatcaggaatttggcatgacctcataggtgtatgatcatggcatcaatgccatgtcaaagttgctaacaactaaaaatagcctgcaccgaaaggaaaacagaacacctataagatccatctggctggtacatgtgcatcatttggtgaccaaaagcagccgttcagaaaaaatgagtacattcgagcttcatcttcacagataactaagaaagtagtcacaaaaggctagcacctaaacagcttgggtctaaagaaaaaagtcctcaaaagtttgtcgtactgaaagtttgaagcaattttttagcaaataaaattctgataatatttaaataattatatgggggatttcctatcatatga

SEQ ID NO: 63278 - DNA, 13816 bp, Oryza sativa
aaaaaactgagaaaaaaaataaaacatctatccatcgattttcacttaaatcggtgggtccaatattataaaccgttagattagatctcttaaaacaaacagatgacccaccaacctcctcctcccttacatatctcactattccttccttccgttcagtatgaacgtacgtacgtatttgaccttcttttttttctttttccatgtatgtatatgagacaataataattattatcagtgataataaattttaaataatagttaccttacgagcattcaatatatcagcatagaactcttcacaaacatatatagataaattagctctataatacttgaaaataaagtttagacccattatattatattatgtgcccattattttagactacatttattaataaaagtatttttccatcaattttcacttaaattggtagacatattatttagaccataaaatctatcttttgttagaaaaacaaagcctccaatcctaaaagtttgagaaaaaaaataacatcctgctaataatcactcctcctgatcaatccggcaaatcactcatccgatctctaatacgtaaatacatactccctccgtttcaaaatgtttcataccgttgactttttagcacatgtttgaccgttcatcttattaaataaatttgtaaaatatgtaaaactatatgtgtatattaaagtatatttaacaatgaatcaaatgatatgaaaagaacaaataattacataaattttttgaataagacgaatggtcaaacacgtactaaaaagttaacgatgtcaaacattttaaaacggagggagtagttcgtatgtacgtgttgtgtgtcaaaaaagattaatacgttcggccgacaaattctctcattggattattatattaaaaaggctaattcaaaagttgtattcctggcaattaaaccaacaattttaatacccgcatatgttgtgaaaaagactaacatgttaacttagattattgctcttttttacaccatccaattactcataaaagtatacaaaacaaaatttaccgtgtagattattaagtatagaacttcataaatatgcatagccaaaataacaacaatgaaaaaccatgtatattttgaaaaaaagacatgcggacctatactttgcttttgtgtaccatcaaagagcctcaattatataataaaagtctattaaacttctatgaactatgctctaataaattagggaaaatcctagaaagtctaaaaaacacaaacatctatcagatatagcaaattgtttaaatcactttacaaacaagcataactcaattagctttaccgcattttaaaacaaagtttacataattatattatttaccattaaattaataatttattatgtatatttactatatttcaacttgtaaagggaaattatattttagatagcatttttattcctttcatgtaatccaatgcaaacggatatgaaaattatggaaaatatgacaatataaattatatcactatatatcggttatcagttcacaaatcttggtactttgcatggcattggagatttgacaaatcatgaaaaaaaataatggatgtagattatatcatcgtataagtatgcttatatatagggtccatactattgatccatatataccgggataacctataatgtatcaatcatatttaccactaccattgttatacgttttagagactatattaatcctctaaataataacaaaataatagacgaagtacaagccatgttttctctctctttgctttctattaagtacgcatggtatatgggaacttcatactaagactgtgttcgggaggaggggcacgcaaatcaaagcttgtattattgcatgattaattaagtattaactattttttaaaaaaaagattaatataattttttaaaacaactttcatatagaaagtttttgcataaatcacaccgtttagcagtttgaaaaacgtgcgcacggaaaacgaaagagatgggttgggaaaacgggaggaagaacacagccttaagattggtttattagggaaatcatactaaacttatttatgagagtgcatgcagtaaaacatacttgataaaaagaattgatcgaacaaaactgcaatttagcccatggcacttaaacctttataaacgctttacacatactaattaaatttatatgattgtgctattctttcaaatcaattttatttttcaaagaaaataagaaaacatatgaaaaaaaaagagaagagagtagaagtaaattaatagaagtttttttaattagatgaaacattcctattagccatattgtttaatagaaaatatattcacttaatatatcctaacattcataaatatatatggtataaaagcaattttgttacttaaagcatagaaacataaaaaaaactctaaaaaaagataagatatgctaaatattaaaaagtaaatacacatagtacaaacgatagttttataagaacaaactccattattatgacaacatattttctcatagtttcaaaacagcgtagttccaattaattttaatttagaatttaaacttccaagggtaaatataagaaaatcataaccaaaattcaaagcaatccaaaacaaattagtgaaaaaacacgtttacaatagtgtcaaagaataattttaagaaaagtcacccacataaaacattcttaacacaatttaaaacaacatcagataagatgcccgcgcatgtgcgcgggctatcttcctagttacatcaaaagtgctctatacttggggcataaagccagtactccactgcaattctgactacgtagaacgttgcatgttacaactgaagatcgtataaacatgatttaattatctcaatctcatctcatgaagaagccacagctaaagttccaaccttacagtctagattcatagctctccacaaaagaacgactaacctatagcacatatggcaaaaaatggaggtacacacaatacatttaatgcgacaaaagttgcgctatactcgtatgaatgacaaaatactgacaacggatgcagggtaaggcggcaccatagaaatcacagtacctatctgactttcttcaagagctctaccttctcaaactctggggccgcataactcttctctacttcccacgcatgatgagacatcatgttgaatgatgatttcactcccttctcatcagagacctctctcgtgaaagggatccgggcagcaaaggtactttccccggaatgaacatgcaagtcaaaacccaacctgtctacccaaatcatcttcacctctgtcgcctgtcaccataaaagaacactgttagcacattcagtaaacataacggaactcaacacttggtgcggtatataatatctcactatctatgaattatcacatagcacataaaatattaatcagctggagtatcttttagaaaagataagatcaacaattttttaattacttttcttcaaataaagaataaaaagatgcatagtttgatatgcccctaactcatatatataacacataatcactataccactatcagactatcagtaaattacatctttctgttttggtaattctctatagctatgttcccatcaaaaaaaaaaaatctctacagctgtgtgattataaagaaactatgaaaagacaaacatgtgctttatcttaacattagctatttttcctttcaagaagtaagaagcaaagttgtaggaatgacaggaataacttcagtacctggaaatctgattcaacataaatactgtatatcctatgtacatcttcagcatgtttgctgttcatttcctcaacaatgctttccgcaaaatttcgaagagggtcaggttctgcatcactgtattctgatggaattacccacatgccatcctgaacagaaaaagtatcccatgaatatcagtctcatttgaactacaaagttctaaggtgtaattggctcaccagcacacatccatcagaaaataaaaactgcacaactcacatagaactaagtacatcaaatgcaacagatgaaacttgacaacatttaaagcacctaatatgttggttgaacaaatttcagcagctgctcaaggttcaattagcaacctatatcaattcatttccgtagtaatttggtcgtgtggaagtgattcaatgagtggggaataaactaaatataggtgtgggggaaaattgataaattgatgattttattaagtgctaaaatatcttgatgtttttttttctaaagtcaggaagctatccatgaaaggaaattgagaaagacattctactaaaagtgatctccatatatttatcctcgtaaaatacaggtcagccaaacaaaatctgaataatgtaaacaataaataggtcttcttccgaatatgaaagaaggcaaaaccagttataacaaaaaaagaaggccagacactttcaaggggtgcactacacctgaaacacagaaatgataactagaccaatacagccaaggtaatgaaatggatgttccaactgaaaatattcttaggatagaatgtaaaagttatcttgctccatgcttttaatgtacattttcacgttaagaggctattttcgtcagctagtttactgatcaccattcagcgtcatggataactatttgataccgttctgcacagcaatcttcagcgagtaaaaagaaattcaacccacatctcttgtctacatatcttgttactgtctcacactatgcaaaaaatcatgcacaaataacccatacctaactattatatccttattattagcaaaacagaatgaagtgtgaagaacactaaaagttccatctcattttctcatgaaaatgagacaccttctacttcctccgtcccaaaataagttcatttttcacccaatacggtagataaagtaaggaatgtttgtatagaagtagataaagtgaggcaatcaatgcggaacaaacactgcagtactagaataagaactcccaaaatgacaaactgcagaatatgaagaaaccaaaagtaactagaagaaaataatgtattttacctcattgaaatcttcaatgtgcaagattctgtctactgatatcaaatacaaaagatcttgatctatctcctcgccaaatttcttttgccacctagtagaaagcttctgcataattcaatttagcacattacgaatcagtaatccgacttagtatatcatgctattcttctgcagtacatagtttcccattgtaatcaacttacaattcacaagtgtaatgcaaatatgccttgaacaaaatgaaaaaccataaaaaaaagtttacctttaattcatattcatcgttaggtttagtcaaagcaccaagcaaagtacattgaggtgtcctggccccactctgacgaaactacaccacaaaaggtagcgagaatggtgagtacaagatacaaaacagttgtgctagtgctcacattgtcagcattagaatttagtcatcaatgattctacacagagttcacagtgtcggcgcatcaactaggtaattaaagtgttcacctttgttacaagcacctgtcttccacaaaaccaaaatgcatttaacatagtggagagatctgacatcttaagatgtctagactctagaactttccaatttccaaacaacacaagtacacaagaatgcaaaccacaaactaaacaactgcaaaggcaacgcacaatgcaaagcttcagcaatgaaattctcctgcgtgatgtaagagtccagcggccttctaactcaaattctacacgaacagtgcacaaaatcattacagcgcctcgaatttccgtcttaatctcacgcaaaacaaaacagtgaagtcaaaacgcgagcaatccgtaaaattctatcccccacgcaacagtaaacagcctaagaaatcaatcaatcaatccatgagcacggctgcatccccctcacctcgacgtggaagctggacggcgcatcgggcgcggcggcggcgggcccggaggcggcgaggcacagagcgggcgcgccggagccgtcggcgacgaagcgggcgccgacgccgagcggccagccgtcggggccgaccacggagagcgtccccgacggcgcaagctccaccaccgtccgcgccacctcggccgccgacggccgggacgcccgctgctgcgcctgcacgggcgtcgcgggcgcgggcgcggacgccgccgccgcagccacggcccgctcggccccgcgcctcccggcggcgagcggcgggaggcgcagggaggaggggttggtggagaggaggatgggcggagatgggagcggggaggggaggagggaggagggaggcggcgacatggtggtgatggaaatggaggtggaggttgtgattcgtttggagatttgggaggcgggtgagattagaggagataggcagggatgaaagcggatcggatacggatcggaaactagctttatcatattcgttttcatattttttttaagaatcagaatcgaaatcgaaaactcggatacggaaatgaaatcgaatattatcgaatacagatacggagcgaatacgagacggaacgaatacggtagcggatatttaccggtatataaaaaacccctcaaattgagtttcttgatcaagaaaaagatatcgcttattattttagttcaacatctccaacatttatatcgtcaattttatagacggtcccacaaccctatgtgaaaatcaatttttatggctattcctcttagagatccatatgcaaatatgattaccattttctattctcacgacctttttactagatgtataacttacttactattgtataaattagagatgttatttattttacttcacatcttcgaaacttgtaatgtttgttttatactttaaatgctttcaaatacaaatgttataaactacaaagtgttagatctcgttgagctctacaactttgattctccatcagatgtcgtttgaattgtagatctaagattttgtaaaaattaatatggtatattataatgaatatttagactccttaaatgacctcaaataataaaatagtcaataagaaagttgtagatctcatcgagctctacaatgttgatataaagtttgtcgccatctgattccgtatgaaaaagttacgtatatatacatattttttctaaactttgctcaatgtttgcggatatccgaaaaaaaatccggatagtttccgaccgttttccgattccgacggatagtacccttactgtattcgttttcgtttccgagaaaaaaaatccgaattcgtttccgaatccgagaatttctggatagttccgaccgaaactatccgaatccgaaaaatggtccggacggacggaaattatccgaaccactttcacccctagagataggtgtggcattcgtagtcaaaatgtgttcttgatgattcggatttatggttaagtggttcatgctattaaaaaatctataacctacgtctagaaaaataataacttgaatctagataaatgcttggccagattcatcctaagaagttatttttttataggacggagagagtagataagtactcatgtattagctgcgagataattgtacgatagaataatattttctctaggtgcgttcacatgggcatagtcttttaaaactaattcttaactttaaatttcttatataatctcttttctactattataaaaattgaggatgtttccgttgatattttggtatgtcgtccgtatttgagtcggattctaaattcgttcgcttttgaaaatacataagaagttatataaaaaaatattttaaaaaaaactcacatactcacctaggatgagagtcagactcctaattgctttaaaatttctaccaagctataagaaaacaatatataggttatggccatcatcccaactagggatccgaattggatataaataatatctcaaaataaaattcatatatattttttagaaaaaaatctaacaataacacaactaaaatagccttcaccctttataatgcacgggcatgttttctagtatactacattatgtagcaatagaattacaataatataaaaataaatttaaatgataatccaataatattattttacatgaaataaaatttaatttataataaaatatttattggtcagttgaattttaaaatacgtgtggtcatagtgagtgaacagaggaaataaatttttcttgcttaatgtacgattttttttcacgtgcttttctgtatcttgtaatatgggttgattttgttttatgggctttctatatattatacattgatcaattatgtaaatggtataaatgattggagtgcatggtgtggttttatggagaaagatataatccataccattgatgaattattcaaatgcaaaaaataattgagatgatgacgacatccttcatcgaatccgcatgtaacttcacaagttccaatgactaagttcaagtcagtagcattgatttcaaatggatctagcgtcttcatgccaactctaatttggatgatgttggatttgttggagatcttatctcatcacctttcaaacgtatccagtctaatatcaaaattcatctcgagtcaataggaaattgggaatcgtcaaaacacaacaatgttgttgctgaaaccgaacttagcccttgtgctttgtaatagactagggccatctcggaagtgcctctctccacctctacgaaccaacacctatctctagctttattttcctctataaatagcttcgtacaccctaaaaaacaattgggttttgttttgttgaattttaccaagtgccattcacctaatatttaatccttgctcgattagtcggcatctagagatagagattcagagtcacccaatagtttatgcattgatttgctaggtcgattagatctaccatttcaatcacaactattcttttatacttaattacctattcgaaatatttggattgcatcttatcttgttcttgaagtgttctctcgtttacattgcagggaacatcaaccgcacatcacggttggtacaatatcgtttgtggtgttgcgattgcacagcgttctgaacttgttctagttggtagccacgtcgcaaacatcacagccaatcaaaatgagagttatcccctcaccagaagatcaggccacaagagagaccacaatcacctctcctaaccctagtgactataataaaaaagataccggaaacggttaggaagctccctcaccattttcaccccagtccccctcttcctctccaattgcaggcctaaaaagcaagagaaaattcgatccatagcacatgaaaaaactggtaccaaaaaatagcaaaaaaaattcctctttcaaccataagcacacgccactattttttcttcgatttatagcacttctgtcacatttatcgtccaagtccattggttagcgatgattaggagcgtgaaaagacgaatttacccttttttctaaccaaagtatgggtggatgaggtggccggaggaggcgcaggccttggtggcggcggtggggtggttgatagcgatggccctcgcatcccgccaccacagtcccaatccctaagcttgtccggcgccgtcgtcactaccatccccaagctctgccgttgccatccccaccccgagctcgttcggcgccgtctccatgctcgcgtcctattgccgccgccatcgcattccaccactaaacagccatgcccaagctcgtgtcctattgttgccgcagtcgtcttcaagctcgtgttcctctgccgccatcgtcgcccctgggttcgtgtccaggcgccaccatggtcacccccgatctcgcgtttcgttgccaccaccgtcgcccctgggttcacgttccaccaccgaaccgccatccccacgaactcgccacgcgcagccgccatccccgtcagaggcgctcagccgtgccacaccatggctggccaccgacgtggtggcgagatcgacgggacaaagagaaggggaaagatggaatagaagaaggtgacgggagtgctacaaatcgaaggaaaatcagaggcatgtgctttgagctaaaaggggaaaatttttgtgctattattttgttccggtttttctttttgtgtgccatgaatcgaattttctctaaaagcaatggaactgagcctaccaaaggcccagaatgtagtaaatatggcctacagttgcgtgggattccggcccgttgatctgcgtagttgtagggaatttcagcccatttgtctcatcaaattcagtccataagcgcgcgtgattctagcccgtcaatctgccaaatttcagcccatctaaaagtcagcagagaagtccaattttgaggaatatcaatcaaatttgaaaatatttcaaagagaactaaattacaatatgacattatgaccacacgctgagcacctaaattctatttgctctaataggacatacttgatatggagtatgattttccctactgaatattttttcttatttaactctaattttccatgctattttttaaaaacttgctggtgaagctggtagcctgatggaccgctttcggtcgaaaagaaatagtaataagttaaaaaaatcaaattaccctgaactactccaataaggagcctcctgtctacagcaccatatatatacctcatgtatgttttttttagataatggaataaacatcccgacctttactcaagagagctacaacccattattataatctagcactccacatcgagtgtagtccaactaagacagcaaacatcacggaaagataaaaacgaaccaataaaagataaagagaatacattattgaagtctatttatgaatcttcacccataattggcaaaaagctgcataagccgtcgactcaaacttgtggcatgcaacttttaggacctcttcatcttcgtcacatctttgcaatgtgcccaacaccggagccaacatgttgcacctcatatatgtaaatagaagtactataaaaaagacacggatgaaaattgtggcatagctatccaacatataacagcacccactaccttcacgccctttgaacattttttttacttaggttttttttctggtttttcgaggatatctcggtgtgtatatgatgcagtatcggacggacaactccctctcggtgtagtataagataaactcactttcaagacttatctcaccaaagtcatttggtttagaagacccacccccaaaacaagtaaatatgagatgcaatgcagtatatattcacacaataaattgtccaggctggaaagcatcagtttaatttatttttagataatggaatataatatcccggcctttactcaaaaaagctacagccaattattacatagtagttttcatgaacatagtgtaaatctaaatgaatagaacacaccgaagagaaaaacaaagaaaccagcctaacgtaaggagatcacaattattgaagtctatttgtaaatctccaaccataattggtaaaaagttgtataaccgtggtctccaactttcggcatgcaactttcagaaactcttcatattcatcacacctttgtagttgtgcccaaaaccggagccaatgagttgccctgaaaatgacctgcatatagaaaaatgatggtgatttgtcaaaaaccatatcgttcctactcagccatattgcccaacaaatggcagaagctccaataagtatcagtttactcattttcttatcaactcccaaaagccacctattaaaaatatgagatatgctaactggaagattaaaaccaaaagagaactgaacagctctccatagaaacttcgcaaaatgacaatccattaaagagatgttgaatagactcattcttcaaacaaaaagaacaactcaagctgccattccagttacgccttgccaaattatccttagttaacacaacccctttaagcaggtaccacataaaaattttaatcttaagtggcaacttaagcttccaaatacacttgtttctctcgatatagccattattaattaaagctaggtacatagacctcaccgagaacaagccattctgatgaaaattccatctaaaactatcagacgaatcattcaactgaatatgtactatagaggcacaaaactcatgccaacaaacaagattctgaccaactaaagctctcctaaaagaaacattaagcggaacagatcccataacagtggcaatagaagatgtcttcctccgaacaattgcgtacaaagatggatatttatccttaaaagccaagttaccaatccatctatctttccaaaatctaatttgttccccattgttgacaatccaagaacccatatttaagaaagtacttttgacattcataacactagaccaaaaatgggaatcatcttgtttcttgtcaacttgggttatagatttattataaagatattttctcttcaataaatcatgccaaaccccttcctcattaattaacttaaacaatcatttacttaaaagacatttattttgtatctccaaattatgaatcccaagacccccttggtccttaggttgacaaacaacattccacctagtgagcctgtattttttcttatggtcatccccttgccaaaaaaaaccgcgatctataataatcaattttacgaagaacccctttcggcacctaaaaaaagatatcataaacatggctaaacttgaaagaacagaattaatcaacaccagcctaccaccaacagataaatgcttggctttccaactactaagctttttcttaattctctcttctataagtttccaatatttattagaaagcttcctaaaatgcatcggaattccaaggtatttaaaaggaaaggtacctaacttacaacaaaaatatcagaatattgttcataacattcctttgcctgactaaagcaaaataattcactcttgtgaaaatttatttttaggccagataacttttcaaataccgataaaatcagtttcaaattctttgcttgttgcaagtcatgctccaaaaagatgatagtatcatctgcgtattgcaagatagacaaactatcatcaacaagatgatgaataaccccactcaagagtcccgcctctttagccctcttaatcaatagagtaagcatgtcagctactatattaaaaagaataggagataaaggatccccttgcctaagacctttgtaagtttgaaaaccattaccaatttgatcgttaacttttataccaacatgaccaccttgaacaaaagaagctatccactcacaccatctaggagaaaagcctttcattctcaaagtttgttgtacaaaaggccatttaactttatcataagatttctcaaaatcaatcttaaaaattacaccacttttatctttgcgatgtaattcatgtaaaataaccaccccttccctaatatttctcccaggaatgaacgctgtttgagtaggactaattaccttttgagcgtcatccattattttatttgtagcaactttggtaaaaatcttaaagctaacattaagtaggcatataggtctatgcctacttactcatatatgtgcacgcatagtagtgatacgcgcgtgtgcatatatatacatgtgtttcatgtaatgttaaatgtccggcctgtgttatgtattaggttatgttggagtagttttgt

SEQ ID NO: 63279 - DNA, 571 bp, Oryza sativa
tgctgccgtcgccgtatacgaggaggcgacggtccccatgtggccgttctcctcgagactagaatttacagtcaggatcctcaagtttgatgaacctcccagcatgcatttccaatatgtgattcagctaccaacacagggaaggatgacgttcttatcaaaggttgcagccagtcggagatctctatcagtaaaggatgcagacaagtgaagtgctgcatctcatggataacttggccaaccagatgttcatacaaggaatatcaacagatctgcaattagcaacaaggtcaaaattacgaactcttaaataaaggtgacccagtaggcaagcacacactccattgaactatacatagaaatccttatgttctattatgagctgacagtcaccacaaacaagccattctgaacagaacttagtttggccagcaaccggtaaccggacagaataattctaaatttacatatgtaaaaattaatatattttttatttaaatccatatcattctggccagttactaccccgtaacctgtccccggctccagaccataacaagctagtaactgc

SEQ ID NO: 63280 - DNA, 10512 bp, Oryza sativa
cctgcaagtccttctttgctgcttactggtgtcatttttcttgagccataattgttaccactactgtctaggacacgagtagaccagcaactaagggcaagtgacttgggatttttattcagcattactatatgtcattggattgtgtaccactcatatacatatatttggccttcctagctccacatattacttctggacagtacgtacaggttcttgatccctacaatcgctgactacgccttctaggtatcctttgctttgctggtaagaaccttataagagcttggttaggaactccatattgctgagaatcgttgagaggcaccactacacctgcgtagtagattattagggataaccttcaccgttttgtttctgttttggtgtttcaatgtcaggtaacaaaggtgagaagagtccccaggattttgctgattgtgtcagccaagagcaactacgaacactccaacaaaatactcaaaaggacatcacggaggccgttgcaaagtctgtccaagataccttcactaaaatcggcttcctgaaccacatggagaggttggacaagcggatatccacgctaactgatcgggtcgccgcgttggagacaccttccaatgaggaagtggtgagtggtgacaacgatgctcatcctgaagacacggtgtatgattccaatggctatattgacgcaccggctacaaggcaagcacggctatgacgtcgcctacgcacaaaccacacaggtatgggtggcactcgccaccaacaaggtaataataataatcgtgtgcccgatgatccttatgctaaggttaagtttaaaataccatctttttcgggatattatgatgctgagaaataccttgattgggagatgacagtagaacaaaagtttaatgcccaccttgtacccgagcaatatagagttagacaagccagtagtgagttcaaggattttgctattatgtggtgggctaggttatctgatgagggggtactacctactacttgggaagaacttaaggtagctatgcacgataggtttgttcctccatcttatcatagagatttacgcaagaaactgatgcgtttggaacaaggggataaatctgtacaggattactatgtgagctacaaaagggtgtgagacgctgtggcatagtggagggggtcgaggattctatttgtcgtttttattctggtttgagggagaaaattcagaacattgttgattataaggaatttaactctgtcaaccagttgtttcggtttgctatgcttgcagagaaggaattacaggggcgtgagcatcaaggcaagagcaaggcgagcacatacactccgcacacgatgccatctgcgggactgcccaaggccgtctcttttcgggcgtcctcccagccagtgggcaagcaaccagctgcatccggagcttctgcggcaccaaaaccatctccaccaccacgaccagcagagtcaggtaaaggttcctcgtaggtacccgccaagagtgcctcatctgtcgcctcgacgggacgcattcagtgctaccattgccaagggtttgggcatgtgtagaaagattgccctagtcaacgggcctatgttgctacagaagatggctacatcaccacctccgacgtggaagaggaagagggggaagaagaagaagttgaggatgaggatggcgaagtttttggtcgtgatgacacaacggactacaggaccatcattgtgcagcgggtgctcagcgcgcaggtacagcagcatgacaggttgcaatgccataatttgtttgagattttcttcgtcatcaacaaccgtcgtgcacgtgtgatcattgatggaggaagctgcaacaacttggtgagttctgatttggtcaagaagcttggcttgactacacgtacgcatccacacccttaccatattcagtggttaaacgattccggaagagcaaaggtaacacaggtttgtagggtttcgttttccattggctcatatgcagattctgttgattgcgatgtggtttctatgcaagcttgttcacttttactgggccgtctttgggaacatgataatgatgctacacaccatggtaggagtaataaatacacttttgtgcataatgggaagaaaattactttgctacctttgacccctgctgaaattgtagaagctgataaagagcgagctgctagtttgaaacttgatgaatctgaaaatcaacaagtggctaaatctgtttttccacctaaaaaggataagctttcacctagttctaaggctgagggaattaagttgaagggtggtgttatgcttgcaacgaaatgtgacattgctgaaatttcagatgatgatatgtgctatttcttgatatgcaaacaagccttggtttctttagatgatattgctagttcgatacctttcggaagatcgggaaccctagtacacatcatatagttatgaatatcttttaatgtgtaaaaatatatacacatatacaaagtttatatacgatgtatacaaagcttatataggacatatatgaactttgtatatgatgtatatgaactttgtatctcatatacatacgtatttaaaaaataaaaaaaaagaaattgcatcacatatacaaagtttgcatacgcatatacaaactttgcatatgtacgaatacaaactttgtattcatatatctaaaaaaacccaaaaaaacagaagagaaaccaaaaaaaaaggaaaaccaatcttaacagaaacaaaaaaaaaggaaaaaaaacagccaaccgaacagaaacagaaaacacggaaaagcaaaataaaaaaaaagaagggaaaagtctgtctcccgcgcggcgcgtccgccgccccctctccgcgccatagtataaaaactcggaccggagcttgacccggcggacctttcggttcaccggtccgccggtctgaccgatgaaccggcggttcaaccgcgattttttacgtataggtatagtgcatgtttgctagtagtcacaagtgatatacaacctcaacccccagacctgaggtcgattcccaagtatgcacccatttttgccaaaaagttcgaggtaccaatatgatatggaccatactgggcctctcattggcccattacaaaccttcactggtccaaccgtaggcggtttaatctccggttcaacacaaaaccgcccggttcagccggttcacagcggttcgaatgcatgtcggttccggttttttggttcaaccgccggaccggtccggttttttccactatgctccgcgcgcgacacgtgtccagtcgtgcggggaggaacgtgcgctgatcacccaatagccttctcgcagcaatggatcggaggctcggagcggcggaggcaacggcgtcggttgggttgggtgttcgcagatcccgactagcagtaaaattcagcgttccatggtgtatagcgcgtttcacaggggttccccttgggaacttccactgccgctcgatcaggcctttacggcccagatctcgcactcacacatggtaatccgcttccgcaggttcggagttcacggttcacgatgatcattgggaaatgggaagtttatgagcgctcacaatcctgcttagtttatactactatgactctcgcaggcttctatttgggctatcttctgatcttgattttctcctaacttgaaagagaaacaatgtgtagtaaactaaccagtgattgctagtatatggatcatgcggcttatggaaatccgagtgttttttactccatttctctgtttcctccgaaagatattcagttagtcctacacacgcggatcggattgtgtaaagaaaagaaaaaaaaaagaaagaaataaagaactagagctaatccgagtcagatacgctgtgcaagtatacaacatgtatatgcaactgaatacttaaatgatggtgatgtggaggggagaagagaagagagagaagcagtcatcacacctcatacaagactacaagaggcaacatccacacaaactctaagaaataaaaaaaaagaaaagaagaggggttgattggtggcaagtgtattagaccctgtttagatgggactaaaacttttaagtccctatcacatcggatgtttggacactaattataaatattaaatgtagactattaataaaacccatccataatcttggactaattcgcgagacgaatccattgagcctaattaatccataattagcctatgtgatgctacagtaaacattctctaattatgaattaattaggcttaaaaattttgtctcgtaaattagccaatgtgatactacagtatattaaatgcaatgcatttatataaattagttttaattttatggatggatgatgtaggtaaaattggggttaccatcccccattaaacttgccctaactagccggcctatatatagccaatggtcggtgaagccagacgtacgtaggcgtggcacagccatgccctcatttccgaggcaggtatgcagacggcacggcagcaacagcatcatcacggcggcggctctgtattctctgccccctgtcctgtgaagtggtcagtggagtacagtaaatttcttcctccctcgcccgcccacactattcggtcaatcgctcgactcgattgccgatttccatccattgcatgcattggccgcgcgcgtatcgtcttatccactcgatcgtcgcgcgcggcgcgggagacccggcattttgcaggccggccggcagttcatttacaactatggaagcttttatttgtggccatcgttctgtcggttcatttacaactcacttcttctccacctccaaacgagaacaactcgttagcagcagatcaacacaagtgcatacaactgctgctgcactgtacgcaccacagttgtagaaaagaaagaatgaccttgcctgggagaaaacggacgagacacttgacaatatgtactcctatgtgccagtagttggctgctacctccgtttcatattaagtttatttttatcacctcccatttagcttaaataagttcttttaagtaatcattgcgtcagattttataaaaatagagaataattatattgggagtagataaagtgagtagtaattgcattagagcaagtttaacattatagcccactatcagctccaaatcatttatagccaatgtaatagctaatttatacaatagttgtttactatattattaatatatggtcccacatgtcatacacacattacgtcttggagttcgtgctgcagctggctacagatctatagcccgctgctcttctccctcttcctttatctctttaaaatatgtttatagctggcttatagcctgctattgtacctactcttaggattggataaagtagagatattctagtcttttagtgtttgtattggtatgtgtaggagtattttggaatggaggtagtagctaattgttgaggttttattacatctgcagtggtgaatgcagcgcagtagtagacgagctctactcctatctaaaaaaaattgattgtatagccaactttttttataatgtcgaagataccattatagaacatacaagattgataaagtatatccagttaagatccaaaagattatgaaaaaatgtgtttaggtcttctttatttagacttataagccgaaaagtttaagcttaaacaaacaagcggttttttgtttggcttttttaagccataaaccactcttacactattaagctattaagccaaaagctaggttagagaaactattttggcttatttaagatagatatatgactttacctttaaatttagggctttaaatccactagcttataaatcatataagtcaaaaatctgacttaaaaggcaaagcctaatcaaagaggcccttagcctcctaactttgcgtgccagttttaagatttgttttttatgcttttagggtgtatttgagagggaaggttggaacttctctcacgcgcacgcaaaataggtgactcgttagtgcatgctataaaaaaatttaaaaatagattgatatgctttttaaaatcaacttttttatagattttttttttcaaaaaacacattgtttaacagttcagaagaagctcgcacgcacgaaaaatgagggagtggaagtatttcctgaggtatttttgtgtagttcatgagagaggaatcacttaaaaaagataaaggggaaatattcaatgaaaacccatgaaaatcatacctaaaagttctctaaattcatgaaaagttactggatagaagtataggcatgaaatacatttataccaaatctcaaatccaaactcaactttatctgagagaaacaaaaaggacaaatttgaggtaatagtatcatgttactattcacatgaagctttcattttttacttcaaaataaagttgagtttgaacttgaatatattttaagtccacatctatctctggtaatttgttttcataaatttaaaaactttttggcccgattttcacgagttttcactgaatatctccctaaagataatagcacaaaaatatttggtgtatcatatgaaagattacttacataaataaaaacaataacacaatttatgtaccatataatatgtaagttttattttcaaaagttagttaataatgcagaaatatagaaacttacacaatctactatgatgtgctaggaggatagacaaaatttttcataattctcttaatcttctgacaagataaatcaattgtcagccttatatttccttaggcattttgggaattctttacaaagtatatggcccaatggcatattgtatagacaattgataaaaatagtggtatatttgttaacaacgaaaatttgcatcagattcggagaaggaagaaaatcgaagcggatttggtgttgaatcgagttggattcagaatcagactacggatcggctggataccgcatcggctggaaacagaggttgaagactgaacaagttgagaagattgatggccgatacagctgatatggcatgacttaggctcagcatgggcttagattgggataaccgtcattgccaattagagatggagctcaattaaggcaattatatctattaattaggatattgagtcggtttttattagatttggtaagagaccgccgtatatggtcttatttttatcttaactttagaaaggtttgagtcgtgtccacaacggactaatatgtacttggggtataaatatgaaccccatagcattgtaatacgggagccaatccaatacaacttcggtgcatcgccacccttttacttttctcgtttccggcgagttcttcacaagaggtaacccgtctcaatggccagcgctatcggggctaacatgtcgctttagacatgttaggctcgatattgcgagtcattgctatcatatgtctttgctaatctattcttagcttttcaatttagttttatcggttgctgctcgctttagggtttatgctggtttcggttaaattgtcttgctagattagattagctaaggcatctatcatcttgaagtgtctaattgcttgattgtctagattgcatgtttcttttcatactttgagatgcatcatccctagtcgtgcttagaaccatgcaaactagcttgcaatcgaacataataaggataatatcagggtttcaaccgatcttacctaatatgcatgtttcaatacatgtttcatgtatattcgacacttatatagatagatcgttttatgtaagcatatcaagctttagtcagtatcggctagattcccgcaccttcatacctgatttctgtttgatatgtttatatggatcaatctgtttatataggtttgtactaaagtattagctagtacgttatctttcctgctataaatactgtcacatcggctactttcataatattgtcttaaactaatctattaaactcgataaacagtattacagccgattaggcgtgtttagggtttattattctttgatatatccagtccatagccggtttggttgaagcatctaggcccccgttgataattttggtaattaatgacaagcactaattgtggactaaccattctattgagttatatattttaagttaggttcacataatgtgtgctcatggatgattatcatgagctaaaattgatggcgcaaagcaaaaggaaaagaagacggtaaactagtgttttaatgttaaattgatcgagaagatgggcgatcaaaatttgctagtttatttttagcttcgccgtactattaagaggggtaatgacctagacaaagagatgatcaaaatgccacattaggtcatttgcatttggacttgttttagattcaatttgatttgattgtctgtccagggccggtctgaccgatggcctcaagccggtatgaccggcatgccttggctagtctgaccgtcgggttaaccccggtctgactggcctcctggatgccggtggctgtgctctgggatggtgatctagagccgccagagtcgcagccggtctgaccacccacactactgcggtctgaccagccctccttgtgtcagtgcattaaatgcactgcaacaacaactagttttctagccgttgcatagtagttcggtctgactggctacacaacggcggtctgatcggcagtgcactgagttgggggattttgaccccccaacggctagttttggttggtgggagtataaatacatccccaccagcagcaagggacctctcttggtactttcttcacttgcatacaccccttgcatatctcccacacccacttgagctttgtgtttatccatttagtgtgtttgcgggattgttgagccaagagtcaagtgcattgcttcattgtagagctagtgcggcacttgatcatctccgagctgtgtcattgcttgttactcttggaggttgccgcctcatagacggcttgtggaggtgttgcccggtgacctctccgaggagattgtggaggagacccagcgctggtttgtgagtggtttggagttcaccactttcggagtgaaggaataactaccatagtgatcgaggcttgggtagtcctctccgtgggccggctcccaccttgcccaccccttgacgaagggggcgtgcggtggcttcgtggttgagcggtggagttgggctcgcctcaacggggattaggaaaccggcgagtttccggacctcagtgaaaaatttcttgtctcttgtctcatttatttgttgcatttacatttgtgtaatttacattcatagagacatatttgaccccatatcaccctaggattgcaaaacttaacttatgtgtgtgatttactttcctagagatacatttgagcccatatcaccctaggtttgcaaaacttaacttagttgcttagttaaccttgtacatctccctgcctagcaacttaggttagttttgattaagtgccatttagttttaaatagactattcaccccccatctagtcgacatctcgatcctatattggtctaactccatcggctgagaccatcaacgatacgctatcggtctatcgtccgatcggctatgggtcgactaattttgcttttattctttcttgctaattgcaggatcaaatcagctggcacgcccttgacacactcaagtctagccttggacctgcactggagttaagcagatctcccaggccaccatgttttcacatcaacaatattatagaaaggataagatcaattgcaaattgttgaatcagtataaacatagtggcatggattctcacattttaataaatctcactaggaacatgcactttacatcattttttgattcataaaattcaaattcatatggttttttttctacatgtccatttaattcatagggaagaaaggaaactatccataggattatattcctatgcttcacatttcatatgaaaaataacaagatgttgtgtgacctttttgttattttttttgtctttctcatggcactatcaaaggactcttattgtatttcttctggtttttattcttgttgtatttgagaaacatactatttcaatttgtggtttttcctatcccatgaatcaaaggaatcctagtgtgcagcccaaatccactaatcgtgggccaccaagatcacattgagtctactccaccacaggcccaattggagctacatctttagatcctgtgtctacataacctaaaagacaagtttgatagatgagaaatatctccaccttttaagtcgtactctcccatcatcaattaccgatataagaataaacctaacaacaatgttgttcaacaataacgaaggaattgaccatttaccatttgaaggcatcatatacagtgtcttccatagagttataacaaaaatgataataaaaacaaaacagaccgcttcctcaccccatttacaatggggattg

SEQ ID NO: 63281 - DNA, 641 bp, Oryza sativa
tttccacatcaacctttgaaggctatggcagagctacatttgcagcgcagcctctctgcatgatttcttactagataggattaagtttcaagagttaatttcttgtactcttgggcgatccatgctgtcaaatcagcaactaacgaggcataatctcgatcactagctctgatctgatcttcagctagcgccggcgagctgcagaggtctccatccatggcgccggcggtcagtgcatcgcagggtgtcatcatgcggtccctgacgagcaagctcgactcgctgctgctgcagccgccggagccgccgccgcctgcgcaaccgtcgtcgctgcggaagggggagaggaagaagatcctcctcctcagaggcgatctccgacacctgctagatgactactacctcctcgtggagccgccgtcagacaccgcgccaccgccagactcgacggcggcgtgctgggctaaggaggttcgcgagctctcctacgacgtcgacgacttcctcgacgagctaacgacccagctcctccaccaccgcggcggcggcgatggcagtagcactgctggtgccaagaagatgatcagcagcatgatcgcccggcttcgaggggagcttaaccggcggcggtggatcgccga

SEQ ID NO: 63282 - DNA, 733 bp, Oryza sativa
  unsure (1)..(733): unsure at all n locations
aggatgatatttcatgccnatncancannccactggaccagtaacaaaagccctttaactgaggttgcacgctatatattcaaactgacaaaaattttgttgctatctttttcgcctttatcgggggcacgcactgacgaagctgaggggccccttctctccacttaccactcccaagcgcatagtaccgtcctacggaggggaccggatccgtcacgcctagccgccttcgctcactaagccaccaccaccgcgncgggaagaaagggagaaagaagatggagctggcatgtaagtccacattttttttctaacacctactatgggactaaattgatagtttgatagctcgggtaagattatggaataaggatcgggtgacttattcaagtactatacggatggttgatggctttcatggctggagacttcgctgtttaatggcttttgcattaaaagctaggactgcttcctttgtcaaactcagggcccgcagtgagatgcacctagcctggcccgacgatcgcgatagatttggccccggccctaggggggggacttcggatcgacggtaattgccatcctagccagactgaggtaaagaagtttggattaagaaattatatgacacactacgaaccactagtcgttgtttgtttagagcgtgacaaaccattctaggttaatcccttttacctaaaagaaaacaatgggcttatctttgttaccttct

SEQ ID NO: 63283 - DNA, 720 bp, Oryza sativa
  unsure (1)..(720): unsure at all n locations
tacccatgaattcagaaccccatagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagtnggnagctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagatt

SEQ ID NO: 63284 - DNA, 849 bp, Oryza sativa
  unsure (1)..(849): unsure at all n locations
cgcgcgggttgaactagctactcatcggcgaattcgagctcggtaccctaacctcatcaggacaagtagggtctgaattaacacctaaaacgggaattgagctattcaaaaaatggctatcccgtagaagagtgccatcaccaccaacagaaatcacaagatccacatcatgtattggattagacatatcatttcgctgcactgaaatccagtcaatggatttacgctgcagtacgcttttgcagagattgattgtttccttgtgaactctgcacctatcatccagataattcaagacctgtaagaatattgcaaaatgatcatgagaggcatgagtaccgcaaaattcatatcataataactagttgtgcaagcaagaaaagcagggtagagaactcctacactcagctagatatgcaatacctcccagccacattgtctactattcagttcacaataaggaaagccacacccttgattatacttaattagaattactaaacaaccagaagtagtccctttactgactaacatctaaatagacaagaccaataagactttctggtttcacctgtatcatatcangaacactgggcagaaacaataaccatagtttagacacacgcatttcaacaaacagatggtgtgcttcatgatagccccacgaaagttcaaaagaagtgcgactaagatgaagatagccactcacagaggaaggaacagaaccagaacctccccatcttaaactatttctgtggttcataaccttaaagaacatgcaacatgttccatttgacccaaaccgttccaaaggagaagagaaaggaaattagccggcccttttgatct

SEQ ID NO: 63285 - DNA, 859 bp, Oryza sativa
  unsure (1)..(859): unsure at all n locations
gcattttccacccagctagaggcccatacggtttacaacttcgctacattgataaaaaataaacaggggcataaacaagagcacactcttaagattgtgctacaaatacaactattcatccttgctacaaaatactagcaatagccccctcatataagttactcataggacagatanaacagtagataatctagccataagttaacacaacagcaaggcatgaagatgcatcacacttatccatgcccctcatccaaaaaacatgtccaagtccaaatccatgttatcctctttatcatccatacttgttccagaattttgttgatctccacctttccaagagggattagacagcaccacacgggtctgcttcttgtgagaaggcgcggtcaacacaaccccttgtcgtttcaggttaccctttaaacctgcagccagcaaaatattaagtgaaaaccggctcaatgacaactaaacagtagctctcatatatatatatatatatatatatatatatatatatatatatatatatatatatatatatatatatttcataaataatttaaaagatgaacatttaaagacagttgatttgatactttatattaatcttgtttaaactgtgcatatacatggatatatgcggagtaataaattttattttataatatagaaaattctactttaaaaccgctgttctattagcatacagcatagtatgttttttttctggctttatagctgtagatacgtatgtttgtttggttttttgaagtgaacaatacatatgggtaatatccaattatagtgtacgttaacttttctcgtgaaaatttctcttctatatatcggacat

SEQ ID NO: 63286 - DNA, 855 bp, Oryza sativa
  unsure (1)..(855): unsure at all n locations
cgcgtaggtgaacctacatacanctgcaaaacnaccncggnaccccacaaaatagaatgcatatagtgttttagtccaataataccaagcgaccaacaaggttgaatcaattcaacaacaaaatcaagggatactttctactccaaaactatagcaattggcaagtaggaaacaagtcaatatgaaatgaagtaacatctacaattgttgatgcaaaagaagaccaactaaccataggacaagttatgaacattttaccaaaagattgcatacacatttgcgtattcaacaaatgaaaagacgcactacttttggattggaaaggacctaattaatgaagaacaagagcataagcttttacaggttcaatactttacgaaatcaagcaacaggcaggaaattagtgctacaacaaccccatgatttggaccgttggcaatgctcgagtcaacaaccaaagatgcacacagggtgttcgatgaaatgcccacacaagcaccgaaaaagaaacaggcgacccaccgaggatgacgtgggtacccctctcgcgcagcgccggcggcggcgttttgccaagcccgacgttgtctgtacacgcatacacacacacacaccctacccaacatgagctgagcacatcacaagacggtgagactcgaaagagagagagaagcgacttcatctgcaagcaagcaagcaagaaagagccggaggcgagaagccatcggttaccccagtaatcactcanaccgngcggtngctgcggcaacaaccgcgtattccttcggcttcggcataagtcggaagcaagggacgggggcgcccccgcctgagaagaataagatgatttttaat

SEQ ID NO: 63287 - DNA, 7568 bp, Oryza sativa
acaactcttacggagtatttcaaaatcaatcaagtagacccggaagcaaggaaactgctataaaaggagttccctgaacactaccgttggataaccggacagaatgtgtggcaaaaaaggaaaacaaagagaggccaagttagacgggttgtgtacgctcaccctgcagagggggagagatactacttgagagtgcttctcaaccacgtgcgaggtgcaacctcatttgaagatttgaggacagtgtcaggtacaacgtactctacctttagagaggcatgcgagaagagagggcttgtggagacggataagtcacatgacgattgtttgaacgaggcattcactttccaaatgccatctgctctgcgtcggttatttgcaaccatactggtattttgcgaagtcactgatatccgtgcactatgggacaatcacaaggctgcaatgtctgaagattacagccgagggaacactaaccctgcagcagtagagcagatggtgctacgagacatacgtgatttgcttcattccatggggaaggatatcacggagtatggtcttcccgaggtcattgatataggtattttttttcttatactatcacgtctttttcttattagtttacatttgcaccacccaccaatagtttcatgatgcatatatttgttttcactaatcaggtgaatgttgcaacgacgtaatgacaagagattatagacgaacttaacgtgccagtggaccaagaccatttagacatatacacatcccttaatgatgagcagcgtgcaggatttaatgagatcattgatcatgtaactaataagaagagccaggtattttttatcgacggcccaggtggcactggcaaaacatttctgtacaaggcgcttcttgctagagtgtggtccgagggattaatagccattgcaactgcgacgtctcgtacagcagcgtcgattttgcctggaggacgtaccgcgcactcgagattcaaaatccctattaagatttctcacaatagcatgtgcaacttcatgaagcaaagtggcaccgcggaattgcttcacatggcgtccttaattatttgggatgaagctacaatgacgaagcgtcaagccgtagagacacttgataggtctcttcaagacattatgggttgttcattgccatttggaggaaaggttattgtttttggcgatgatttcagacagttacttcccgtggttacacgtgggataagggcccagataactgatgcaacattgcagagatcatatttatgggaaaatattaggaagatcagattgtcgcgtaacatgagggctcaatctgatccatggttttcgaaatatctccttagaattggaaatggcactgaaaacactatcagagatgattacgttcacttacctgatgaaattgtgattgcttacgggaatagcgaggattcagtacacgaattgattaatcatgtgtttcactcacttgatgatgaaaagaatgcaagctctgcatcttatatgagcacacgtgctattctatccactaaaaatgattacgtggacaagctgaatgcgaatatgattaacagatttccagggcaggccaaggtttatcacagctttgactctgttgatgatgaccctcacaacagttatcctctggactaccttaactctattactccaaatggtctgccaccacacgagctaatagtaaaaatcaattatcccgtgattcttcttcgcaaccttgatccaaataatggattgtgtaatggtactagactaatggttagagcttttcaagataatgcaattgatgctgagattgttggtggacaacatgccagcaaaagggtgttcatcccacgaatccctttgtcttgctccgacgatatatctctacctttcaaattcaagaggaagcaattcccaatacgtctcagtttcgcaatgaccattaacaaatcacaaggacaaaccatcccaaatgttgggatctatcttctagagcccgtgttttcacatggtcagctatatgtcgcattgtcaaggggtgtgtcaaggctaacaacaaggattttggcaaagccaaagaaagaaattgattcaacagggaagagcactagaaatatcgtgtataaagacgttcttgactagtgagcaaaggtaggttcgcatgatctaaattaattcaaaaaaatattgaatatagtaaattgctcatcgaatgttactcaccatcgtcctcttgttttgtacagcacaccatcaccttttatatggaatgtcgtgtgattatcttctacatactatctcacactagatgtgtcagtttgcaccaggctgtcatttgagattgtaattatggtctgtattatattaagggatacatatgcttacaaaattgttctggattattttttttatcatggttcatccatacaacttaaatggataatgcaccgtagacagcccacaccaccgccatcgccatcgccatcgccatcgccatccacagcatacagcccgcaccactgcaatcaccatcaccatcgccgccgcctccgcttgctctgctgtttttgggggaaaagacagagagggagaatagggctgacgagtgggccctacgctttttagtttttctcctatgacttacatgtgggcctcatcttgtaaagttttattgtgcccacgcaatatcatagtactgcactttacataaaatatattttatgtatgatatgaattgaattaaagttcaaatgcatagatcatgtaaaaatatttttttgctaacatgaaattctaaaaattatttaagacagatagaataaaatcgtagcgtttagcacgagcatattactagtatttaaaagaatgccataattcaatcctgatggatttagtcctacccctatgacaagattacaagtggcactaacaaccagtagagaaaaaaaatacagttttctttaaggcccatttagaattcaagaaaaatatatactccctccgttttttaatagatgacgccgttgattttttctcacgtgtttgaccattcgtcttattcaaaaaatttatgcaaatgtataagatataaatcacacttaaaatactataagtgataaaacaactcataacaaaataaattataattacgtaaattttttgaataaaacgaatggtcaaacatgtaagaaaaaatcaacggcgtcatctattaaaaaatggaggtagtattttcatgcaagaatgaaaccgtgttttgtaaatccaaatggaactagcaacagtttgcacgtttgcgtccagactccagagggcctattgccctgctaaattgcaattggaaaaagtacaccgaaggtccctcaacttgtcatcgagttacaaaatcgtccttaaccacaaaaccagatacaacgtgtccctcaacttacaaaaaccagtgcaaactaagtctctcgacggttttgacttcgattttatctgccgtggcagttgactcagcgtgggacccacgtgggtcccacatgtctgcatcttcttcccctctcctcttcacctctttctctctctgtcctctctccacgggcaattggcagagagaagatgggcgcgggtggcggctggcgagggaggagctgccaccggcggcggcggcggcgtcaccgagctcgggcgtcaccggatgccgaccacgctaccgtgctcggctcatcaccagcccacggagcgccacatccatccgcatgtcgtcgtcgtcgccgtcaccacatccatcgcatccatctctctctctctagccaccattgtccttgtcactgcagcgggacaacgccactcgtcggccaccgcccgcactcgtctcgctctccggaaacgcaatctccatgtcgtcggtgagggcggcgccgcctcaccaaatacacctacacacggcaaacggacaccgcggaaactcatcaccaacaaccttccagtcaatgctgtttgaggggagattcagagaatcggaagcagttcaatcccaaaagcaatttcattgttcctaaatcctaatcccttcgcttgtcgccgatgagcgcggcgacggagaaggggcggctggacggcgaggaggattcaccgcgcgcggaggcgttcctggagatcctcgccgggtccagtcgggggatgcggaagcggaggtcgcggagcaggtgctcaggtcccgcgtctgctactcccgtcccaagtccgccgtccgcttcttcgtctggtcggggcggtcggtgaatcacaccggctacgcctggaacctcctcgtcgacatcctcggcaaggccggcatggagtagcccatgtgggacgccgtccgccgtccgcaccatgaacaaggagggcagcggcctcgtcaccgtcgccaccttcgcctccatcttctcctcctaatgcgccagcggcaaccacaggaaagccgtcgaggccttcaatgtcatggggaagtacggcgtggagctggacgccgtcgccctcaactcccttctctctgtcatgtgccgcggggacgaccgcgcgcaggcggcacaggacctgttcgagcacacctgccgctcctaccacccgtgggcctcctcctctgccgtctcgcttcgccgacctcctccccaccagccggcctgccacgcccagcccctcccctgccaaccgtcggccgcggcccgtcgcaccagcctgccgagcccgctgcgccggcctgccgcgcccagcctgccgattgccgcctgtggagagggaaggagagagagaggaagagagatggaggggtggggaagaagaggctgacgcgtggggcccatgtgggtcccacgctgagtcagctgccacgtcggacaaaaccgggttcgaaaccgccgagggatttgcactggttttataggttgagggacgcgttgtatccggttttgtggttcaaggatgattttgtacctccatgacaagttgagggaccttcggtgtactttttccattacagtttgggttgaacatgttgggccttgccgcttacggcccaattttatgtgtccaatcataacccgatttcgttgtcaatctgtgccttcacggcttctcagacttctctcctctatcgctagccacagatccgctcctggctcctgcaaggctgcaacctgcaaccccaacaccccttcgagaatcgtcgtgcgcgcaggtatgatcccctctcgcctgcgcataccaggtccctcgctcgatccaatcttcggttgattgaagcgaatctggaggctttgcctctctagtaggtttttttttcctgattatttccactcacatttgcttgcgcatctcaaacactattgtggagaagtggggaggtggtgaaaactggcaatgggatcgttgtgggccggatcagggatgaatcttgggggattattgccttctgctcgccgctatagacgtatgcttgtttagttttagtattctgactcttttcggctgatcgtatcatcataaaagctcttggtccactctgtggtttgattttgtgcaagaagaaatataatatcgcatgattatattctgtgatcgtagattgggatagagagcagatgttattttgtgcacgcacacttttaaaatcctctgatatggttaactaattccgtgacctcttcattcagcaaacctgtacatgggtaaacaagcataactgaattacaggcaagccggtagcttggaaagaaccctcttactcccagtaaaaacaataggaggcccactactgctattttctttattgtgcttctgaatgcaaagtagcacaagtagggatattaggtatgggagagaaagtccttttgttttgttgttatcctcgttattgtaactgttatccggtgccaaattagcacctgttattgtaactaaaagtcagtggcttttattagaagataacatcttccattttttatttatacctcttaaaatgtatcttgtgaatgctcgaattctggcatatgttatgcaatcacattcatttgtgttctgttcatttaggacttgttatattccactcggctttcactatgtgttattttgtctaataataaaatagttcctcacaccatgtagcagaaggaagatggatgctaacagacgccaaggtggaattcagcaattattggctgcagagcaagaagctcaacagattgttaatgctgctaggagcggtaattgttccacaaatattcattaagaataacgcggaaattgatgggggggaattgcttatgttgtacgaaatatgtgcaatgattgcttcgatatacctacaacaagattttgctcgtatatttctttgttgatgtctttatagggtaattttgaatcatcctgtttgttgaataagttccattgtaccaacattaagcaaatcaacagtgggaaaattccatgttcagcagaatgaaaacatgctttctggaatttaaaacatgttcaacagtgggaattagagatggcctcatgttttctgttagttcctcgaaaattgagtgaaaaacatgctttcttgttactattcttctgtaccttaactaaggtaaagtacctgtctgattcctttgatatctttttagcatgtaattatcatggtattttgttcatatagttggacatcgaatatatcacatatattttggaaataacacctgaatggaaatgtataaaaaaagtggtatgttaccctgaattgtgccctttgacagcttttgtagaatgcgatggccttgtatgatcgtttacagaaaccatgttctatcttttgcttctaagcacgcaatacaaacatgttactcctactcattttttattcaacatctagagatctgacttgggtttgaaactgaatacctttcctattcgtcaggcaaaagaggaggctgagagagaaatagctgagtaccgtgctcagatggaagctgagttccagaggaaggttgcggaggtatgcatctttcaatcttgtatagttcgtggaattagaagagctattgccgctaaccttcctgtttctttccagagtagcggtgattctggtgcaaacgtaaaacggcttgagcaagaaactgacacgaaaattgcgcaactgaaggagcaggctgcaaatgtctcccctgaagtgatccagatgcttcttaggcatgtaaccaccgtgaagaactgataaaagttggacgtcctgccgacaaattaagcagagattgggctcaaattgtgtgctacctttttgttaattccaagatggattacaaatttacggatgtcagctatagccacgaaccctgttcttagtcatacaataccaataagccgcagcagatttattggtgaacacgagggatgattatacaataagcattcttgttgatgtgatttggcgagcctttgttgagctgctggagagaaagtgaatgatcctgtgtgaaactgacagttctagctctacctgactaccttatcgtttcctgccattctctcgtcagagac

SEQ ID NO: 63288 - DNA, 36598 bp, Oryza sativa
actgcatcagaaaaacctccgaaggcgttaaccatagatgagaactgtaagattttgatatccttatatggtttgaatatatccaaaagctgaaaaaaaaatagcaacttcagaatatgatttttccataagataccaaaagataaagcagaccttgcaataggcaatggctgctactaggagtataggaatcctactctatgttccacagggtatgccgtttcctcttatctgaggtgtgtatatgtctcgatatacctttatgtttagtgatttttaatgacgggtgtgttcggatgtgattgctgcagcggctttcaactactgcggctgcagcagctgcagcagcaattgcagctgatcaaggcatgatacctcttgtctggtgacttgttggcttgtcgcacacatatttcttaataaaattggagtcttgtctcaaataaaatgttcatgtttgcgaacttcaaaattacagcattaattctgagtttgcatgatatgccttttgctccagttctcactttagcttgagtttcctttttctaaaaatcctataatctgggtactagtatagttccctcatgttgtgacaaataagtatcctctaatctaaatgttgtatatttgtatgcatgaccacatgagagataaattaggcatgcataatgtgcaaacaatgccatttaccgtttgttctgtgctattccttggtaagagaacaggcgcgcctttattggttctattagttgttgagcatctggtgctatgctcattgcagagctcaacctcaagaaatgattctttgacctatgcaagatgcaaaacaataattattagaaggcaaacccacctttcttactaccaaatattcatagtgaattgttaaaacaagtacaataataacattacctgtttaggcaatgatggattctcaagaaacgagtattctctaaaatcaatgtgtgggccaaactcctccttaggtaagtcctttagcataacatgtacctgtagaattaaatcatcgtagtaggaatgttagcttcatactggatccacctgtggacttctctggcctgtttattatgtagtgcaaaatacaagacaactttatttgtgttgctgaccagttggtatgaaacgccatcattaacactattctatctgcttataaatatctagcatttcaccaaagctttgttcacatatttgtccttttcaacttccctatgcaaatttcccacagtatccatgctcattttacccacaaaaaaccataagttgaccacacatcatttgttattcctgtgatggtaatccggtggtacttttgctatatttatgaaaaatattaatggcccgatatgtcaatttttatctgcacattgccacattctgagggtggttgcaaaataatgaataacgcatatcagtacagtaaccagatcagcaataatatgttgaaaagaagttttcagtacatagcactgtggtctggtctaaactccaaaccaccaaagcttggacaataaaaagcatggcaagcttcagccacctgccacctggatacatctaaaaaaaatgacatctaaaattctaaaactacagagaatttccaaaaatctaaggtatgctgacacatataacatgaaatcccagttatataatttactttaacttcactaaccatatatacttttgaaaaaaaaaatgtgatgaatttcctacaaaatatgattcatacaactaaggaaactatttctctaaccaactaatagtatgtcatataatatgaaaaatagtaaataatgttatgataacagaaatgaaaaaaattcccagtgtaatcacctcaaaaacatgatccattggacagaggaaaggttgtctggtcattgttccttccaaaactccaggatgtccaaaccacatcctatcaagcctgcaccataatggaggcattacctaaaagtacaaacagtagtcagaaattgggtgtccacaagtttgagcacaatacatcgaacagcgtaattctgctctcaaacacctccagaagttatctaagataaaaacttatcctcaaaaaagcaagcatgaagcacctaccatacattactactcaacacctcaatactcactaattagctgcagcttactcatttaaggataaatgcacttttgcaagttgtaaattttgtatcaaattaagatggtgcacacatcatcagtaaagacaaaattaacatctaaaagataagaacatattaataatcatttcaaccttttaacatatagaaagtttatggaaagagatcacattcaagaaatcgaattgcaggttaaatcaatctcaactaaatgtttacacttaatgatctgcatgtccactacctcacaatcacgaatagtaagtgtgtagtattcacactaccatcatggagttcaaatcaaactagaaaaagaatagaaattccactgaccagggtcctctttaatagggaagcaatagcgagtgcagttcttatttgcttcaactgaaaattttcaagcacatgactaatcaggaaaaagaaaaggaataaccatcaataacagaagtgcagccacaaatttgcagaaatatatgtgtagctgcagatacctggtaattgaccaatgcaaaatgagatttaacagtatgagcgccatctaacagcaagcttttaggaatgttgggtctaaatgataggaaacctcctgcatcataataccaggtaaattatggacatgatgaaaaaaagtagtaagtaaagattgtaggattcaaatccgaataatgttatatgcatgaaaataatttcatgtgaccatcttttcattcttggatcatatatggctacagcctacatggtttgtttaacagtgctccattggtaattctgagataacccatacagacgaaacattttaacactagggtacatcatggtcttcaaacataaaatcagaaggcatttgtacactagaacacatcatgatctttaaacatgaagtcatgaacctctgtcccaaagaagttccgtcatgatagggtcagagaataaacatacctggtgagtcatagtatgatggctgatcaaagaaaagcattgcttcacgcaatctatgacgctttcccacagtacctgcatactggaaagtagtatgcacagcatatggttctagccgaagctgctgatacatgccctggcaactcaagaaaaaaatacatttcaggtataaacaacccaagaaaattacagagaattttagacgaaagggacagtataaacaagatgcacaaagtgtgtgaaacaaaagaacaagaaccaaacatatgcaggacaacaaagataaaaaatgcaattgctaactaactgaaaatttactcaccaaagaaaaattttgacatgcaagatatttaatttgccaatttcaaacaaataagagcaactacctgcacaaaatatgtatgaccactacagaatatacttgctggtaggactccaagcttcagtttcccatcataagaatatacaagttcatcttctccaacaaccgggtatccaaattttttgtgtataaggtcattaaaagcattctggtcccacaacgtatcatcagataagagtaagtctttccaatcttttgccagcctcttagctggttcagtgggtcgccaatggaaaataccgatattgtatgcaccagtaactgtgcataagaaagggggggggaaggcaatatgttaggttcaaatagtaactgcaattgatggtaaacagaacaaaaaatcttattatacaggtaaacagggaaaaaaaatattatacaggcaaacagaaaatattggagcagattttttaaaacatcagaaaaatacagtaacaagaacattagttcacatcaggttctaattctctaggatttgctattgctgatacatattggaagctatattctacagcaattgtcttcaccaacagaagtccaattccagagtcattccactgtaaatatttaaaaattagttctattctcataagttgaactaaaattaattccaaactttcagaatttagtatcaaaaggtcaagaaaattcatctcagtattgtgcagttctgatttcctgatcttacagcagggcaatgattattgtagatagattagcactgggaaatatcgaaaaatagagaatgcatcacaccatctatctcgtcacaacatatgacttagataaggtgcattattgcaaagtgtagataattcaccttccctccagttctccaggctgtcatcggtgaccgtgggaatgacctggtcgctggacgtgaggagatccgcgtcagggtagcgggcgaggtagggcagcgggttcttgagccacaccatgtccgtgtcgcacatgagcagctcgtagccgaagggcaggagcgcgttgatgagcagcaccttctccctgcccatcttgtggaaggtgggcgagccccagacggcgtcctcggtggccatcctgctgcccatgtcgaagacggggacgcccctgaggtagagctcccggagcagcttggtgtccatggcgccgacgaggaggctgtcgacgccgaggtccgtgaggtggcgcacccaggtgaggatgaagtcgaggaaggcgtggttgccgaaggtgacgacaatggcgccgccgcgggcgcgggcgcccaccatctcgcgggtgaggcggaacgcgcgcggcgcgggcatccgctccctccgcggcgggggcttccagatgggccgattgtacatggtctccggctgcgccacaccggagactgcgcccgagaggttggcggcggcggcggacgcgggagggatggggagcgggggcgcggcgagcgaggagaaggaggagaggaggaagaagagcgcggagacggcgaacccgccgatgacggcgccgtagatcccgacgaagaccggcttggtcgagtcggcggggcaccacggcgccatctcgccggccggcggcggcggatcgtggtcgccggagaggcaaggtcagcggctcaccgctgccattgtcgggaaaggggactaggggaggtggggtttgagacgagacgggagtgggcggcgccggcgggtcggggggcccacctggcggtggctgcacggtaagaccttactaccgatgatcccgttacggtgaaggaatcacgatggaaaaagcacgctcccgtttcgctcgccactgtcgtgcggggcccacttgacagtgaaagcaagtagggagtggatttgtgtcttcatttccacatgttcatccgttgtagtagagtatgactgtcaactcaatcaagtacactgtacgagtggtgtgtttatgtagggcaaatggcaatgtccaagcgtacgaaaagggaaagataaatggatattcatctatgggtgtgtttggaagagatttttttggcagcagctgcggctgcagtagtttaaaacggctgtaatctgtagcagcaaaaatggctgtcaaacgaggtctatttctctgtgcagctatgcttcaaacgtcaaatagggtaattttaagcttgtctaatcatcacggtttgcgcattgaacgattgagaaattcttttctttttagaaatataatacaaacgcagacatccacaatgcgcgtacactcacccctatgagcacgcgcgtataacctacctctaagcacttctggaagattggattagcatatcttgagattaacaaagtcaccacgaaccggcgcctcattgtcgcctattactgaaagaacaattagccataaatacgagcacccgtgttaaatctaaattttaactctggtgagctagtttcaccacaagaaacctaaccagttaagatacgctcacttcgtgaaaacctagataaatttggtgcgtcgtggaatatagttttcacctaaaatattgttttctttgagcggaattttgttcatatttcagtactagtatcttctgtgggccaattattagagcttattaatatctttacgttaaaaatactcttgaaaataagttctagtttttaaagtccttttgaagtaaataactatatttataataattaaaaaaacagccctacaaaaattccccatgtcatctaaaactaatctaaattcaagccaaagttgaaaaatgcacgatattgaaacttaaaagttgaatattgtctggtttagagttaattttagtgttattacatttttttaaaacaaatatttaggattgtaaatgaacttaattttgtcatttatgtcttacctggtatacattgagatatacaccaaaatattcgtgttattagagggaggggaaatttgccaagattgatatggactcacttcattcacaaattatcatcatataaatttttcagtgttattcagaaatgatcagtatatttggtacttcctacatgtgactttttgttttcctgtgcagtataaaataatcagttgcatgtattgttcaatgtactaactaattgtaattgtggtgcatgactgcatgcatgcaagcaatatcattggcgcatattgcccttgaagcatatatataggacacaagaaatggtgttgcatgttaatcgatgtcaatttaagtgacatgtgtaagtgtgatggtatcgatacacaaaccatatatgctgatcatttgtgaatagtggaagtacaatttatcaaggatttgtccttttgccaccacattaaaaaaaaacagaaagttctaactagctaggtactacatctcttttctaactagataccaagggagctgccagagatttctgtcgggataaggtagtagcactttgtaaatgaccaccatcgagccattcagacacgcatagatgaagaagattttagcaatatcgtacaaacagattggaacagtctattccttagacagctctagttttttgtctcccatttctcattctgtttgatgtggaaaatttgcaacaagtcttgtggctttgttcatccgcagatgatgcaaaccggaattttaattaaattatctgaaaagctacaaatttttttttgaattttatttgtgcaatttaagaaattctaaacaaacatggatggaccgtgtcattgtagattactagttatcgtgcacatgtaaggcatgttttggtattatgtacaataaaaaaaatagaataataaatgtaccttttttatatagagcactccatacaaattctaaaggtaaaaaaagagtatcatagaccctagtaaaaagcatgtgttatgtgtactcctggagtgccaagctgtgcaccatgtaaattactacgggagaagcaaagcagcaaaccttgtgtccaagattgtggatctaattctagacaattcattcaacataggaataaatgttttttcaagaaggtcctcagacctaccccgtagcttatattgaaagccacaacgacaggttcgctgggattacaaggtttacatgagctcagagcaaaagggaagtctcacatggtcacacatcccgaccagctagggtcacttaaaggatagacaaactaaacaaaaaggggtaagaactcccatagcagaaattgacaactcttactttaacacggacttcaaactttttttggtaggaaaaacatcatccaactcttgatcttggtcgcagccttgctattgccccttcagacgtgccaccagagcctccatctgcttctccttggggaaggagaggtttccactacatcagttgagaaataatttgaaaaagttaaattagaagggagtaagcaatgttatctctaaacaccatatcattcctcgttagccaccaggttcacacaattgcagctaatcagcaaagacacaacaaattttgtacaaatttaagggaaagaaaattgttcaccagtttgttttattcgttattgtcccccaaaaaaattgtaatagatctctgatagaagaaatagaggcttatatcattttattttggtcttaacccaattgttaaaaaaattacagttagcatgattgaaaacgacattcttgtatgttttttcagaaatgaatcttagcaggatacccaattaaagctcactaatcccatgccttgaactgcatatggtaacatgcatgctccatgtcccatgcaacacgctgcatctggctgactatacaaaaggacaatatgaaatttgttaaaaaagtgttttttaaatagcacaaatagaagaggcacaatcatctgttgttactctgcagttgctgctaaatagcccttctgattcctgtacatagcttcagatccattaagcttcattttttattcagtacaaaaacgattttgaaagaacactttagatagaaacattggtttatcccatgcggcctctcgccaaagctgagtcgtgtagccaaaaagattgaccgtacagaaaaacatggtcacaaaggtgatgttttgcggcaaagggaaatttaaaatgtttaaagaagatagtgtcaccagagatatgttgcatcataaagtaaatcagagaaaaaaaacttacagcaattcacacaaaatgaatacaatttcctcttttagactccaaaaattcttaatgctttttctgcacttcacgtttgctcaatctttcaacacacaagctctttgaacatggctctgaagctgaagcactcacttcgctgtgcaaaacaggagaaagtgctttagcaaatcactgggcaacagtacatccacataggaggccattagagcaactttgcacataagggatcaatagatgtgtatattcctaagcattgttgttggcacccagcttgaaccaactattgtgctaatttagccaaaaaaggattgatccttgggaatcaaaaagtctatcaggcttgataggtttgtctgaattagtcgagggtgcagactgcaagttacatgatgttatgatgttgaggtgagatcgatttaaattaataatgagacacaacctgtcctgagtcaactgcttctgaaattcatcctccgtcactgcagagaagggcagtaccacctgaatagttggagttggcaaatcacctgcatatacacttatttttttattagccaaataaaatcttaattgacaacaagcacagtaccattagaatcagaaatgccataatcatgccttggctgctccttcgatgtgaataaatcaaactttgagaacaacatgaatataatatggttacctaccttttttcgaggccaagttatactggccgccgcagctgccgttctccttcttaggaaggttgaacccagtatcacactgcaaaccactcaattcccctaatcaaacaccatacgccaccaacatcagataaaaatctttagagaaggggaggaacatcacctgaactcctgaacatgacaaggtcatccatcgtgtagatgcgctagatccggcaacatcgccatatactgcaagtaccaagtagagagggcggggccatggcggtgtccaagcaatgtgccatcaccaccgaccttgcattcacacgcaagcaccacctcctctacctgacgtggcggcgtgcactgtgggagtcgaactcatgaggtgcctgaggtgttgagggatggccttggttcctcctccacctgacgtgacgtggtaccgtaggcggtgggacagctgtagcagtgcatatacactggatctcctcttctccactgcccgacgacggcagtgaggcgaagactttgatccaaggacgacggctctcgatccaaatccaacagcgcctgcgtgcagggaaggggagctggcgacggacgccgctgcgggatacgggtggtggaaggcgacaacggcgggggaagggcgagggcatgaggggctgaggggatgatatacttgccttggcagttattgcgacgatgcggggattgcgccatcaaggaggcgagattgacgatggcgatggggatgagaatggggatggggctttgggtggatgatgcagcgatggatttctggccgatgatttcaccgagccgattgacggatggagaagtggtggatcgaggcggagcgagtagaagcggcgcgtgttggcggcggcggcggcgacgccggaaggggacgaccctccgaaggcggcgaacggggaatgcgaggaggaagagggcggaggaggaggagcgccggcgggagcagcggtggggcgaggagaatcggcgcgtgatggcagcggcagcaaaagcgctggggaggagcgcgagtcccgcgtgttcagcgcacgctcatcgcgcgaggaggaggaagcggacggataggagagatggcggacggacgatctggatcaggagagacgcagatgaacggtagtgattgattcggatgatttcaccagtaggattggagggggcaactcctcttttttatattagtatagatatagaagtatagatgtgcaatactgtgatcacttagctaccgtggagagaaatggatattttgttaaaaagtaagagaagttctacacatgattaagcattaatcattataaacttgaaaaaagagattaatttgatttgttcaaacatcttctatataaaactttttttactagaaaaaacacaccatttagtagtttaaaagtgtgctaatgaaaaacaagtaagttaaagtttggattcgaaggaaaaaattcgaaattaatcttttttttaagtttataacgattaatgattaattaataatatgttaatgagttttatccttttatgcgtacgatgaatctttcttcaaactcgctagaagaaagcagtcttactacaacatactctatatatcgaacatattattttcaaaattttctaaagcacacaaaatataatctgaaaggggttgtaaaaccagctctctcattgtgagatatttgtacgcaaaaggccagatattttagcggcgaaggagatctttcccgctacagggcaaaagctaaagcgcctaacaatgtacttgagcctcgcgttctcttgtcccatagcgaagaaaacagaggcggctggcaagaaaaatgaaaaaataacaaaaaaaaagagggaaaaaaatcaaggcagaagaatactcatccaatccaaccacacgccccggccagctcgtcgtcgccacctcaccaccacacacgcgcagccaagcccctcacctcacctcacctctccatccacgataatatcatgatccatccttatatatgcctccttcgcaaactcacttcggattctcttctctttctttcatcagctatcacaattcacaagtgtagactgtaggatggccacgctctcttcctgcagccgcctgagcaccggcggcggcgccgtccagcgccgtccccggcggccggcaagcgctgcgaccatcacctgccaccggagctcctcctcctcctcgtcggccagggtagtccgcacaggcgccgccgcggcgcctgccgcggccacggcgcccgccgtgccgcagaccaacgagtgagtaactcacaaactgagctctcccctttaatttgtggctgatgaaaaagttgtgttgatttaaaaaaaaaaattggttgttgcaggtgctcgcttccgacatgggcggagttcgagctgggcaaggcgccggtctactggaagaccatgaacggtcttcctccatcggctgtaagtttaatttcttcacaaaaagaaatactttcactcatcatacatgtaacaactactccttctgatttatattataaatcattttgatttttttttcctaatcatttttttaaaaaaatttgactatgtttttttaaaataattaccaacatgtacaccgaattagtttcattaaaattaacatttgatatattttgataatatgtttgttttgggttaagaattttgttatattttcaaactttaaaaaataataagaaaaagaaagtcaaaagcaacttataatatggaacagcggtagtactagcaacctggcagattcatcatggaaatagtagctaattaagctgccgctgtgttcttaccagggagagggcctgatccttttctacaacccggcagcgaccaagatgacccccaacgctcagtttggcatcgcgtttaatggtaattgagcaccctcttaattctccttttcacccacccagtgtccgggaaaaattcaggctacaaattggtttgatctgaatctgattcaggagttgataactgagactttatttgctgcaggtggttttaaccagccgatcatgtgcggtggtgagccgaggcagatgacgctgcaagagaggggatcagctgatcctcccatatacaccatcaggatacgtgtgccgcagcatggtcagcagctgattgttttgtttcgttgaagatatgaatgattcgcctgcaatttctcattaacttaaattaagcttttgcatcatgctgacaccatatgttcaagtgatcgttactagtactgtatgtatgtaatagcatgttgtcatctgagtggccatggattcgttactagtactgtatgtatgtaatagcatgttgtcatcggagtgagattttgtctggttggttttgcactcgcagccatgaccctcgtcttctccttcacaaacggggtggattgggatggaccgtacaccctcaagttcagggtccccaagccatggctcaacaagcccttgagcttcttcaacgaggtaaaattttgctccgagttcgtgttgttttcaatcaaacaagcttgatttgtaccttgaatccaattttattgttaattaccatttcttgatagcttatgcactggaaaagttgaaactcctctttggatcagtgttaacttttagaatgcaccttttgtgctaataaagagagttattttaaaaattatctgtgacgacgatgcagggtctagcagacgaactgaacagagaaggggcatgcgacagagccatcttcccagacgaaaacgttgtcatcacaagctgcgagatgggcagctactacgaagagggggtaaaacttttaacctttatctcaaattcatgattaatcctagccagttctgaaccgttgctgcatcccctggcactggcagggagatcgctgcaagctggacattgtgtcagggtgcatggatccaaactcgcacatgtttgatccactcgccaccgtggatgacggatcatgcccaatggattccgattccgaggaatgaactgaactacagtctcagcgagttttattagcaaggagaagctgtaattagtggccactgttgttcaatgtaaaaagaaagaagcgacacggtatgatgtacaagaaagcacagatgtgtgatagaatggtattagggaatgatgtgtgctgcatttggtgaaaagaatacacaactgtaggcctcatacaaatgtggttgttaatttgtgacagaactactctgaatttaatagagatcaacctatacaaataccatcaaagaaagtgtcggcacgtgaccaaaagttccaaaaacacgggataactcctgattaaacaaggagaaaaaaaaattattttctgatttatctatatagccttcagttcagagtttgatacttatactggaaaagtggaaatggacccagaacacgaatcaaccggaatttaagttcagttccagcacaattccaggcatccgcccgtttgtctgatgtctacgtactgcaaaaatgtcgctcatgtctgctagacgactaccaaattaggccaagaaaaaaaaaaccaagcattaagccttgaacattcacaggacaaagtctgcaaatggtccaagcaaactgatgcaaccatgcaaatttcagtcacagttacactgcggaaagaaggcatacatgtcaaggcaacatggcatgccatcatcacgccagttcactgatacagcatccagtcataatggagttgcacagaccatattactacaagggcaaagtcaacttgcagcacattgctgttcgttttgagtagcctcagtcacagcttagccgcctccaacctggcgtttccaggagtcctccacaataagctcgtcaacgccccagtcctcatagctatatttgaacacacagtaaactattataatgaggttacaaaatcaggaaacacataaatgtcttttattcaaatctcaccttccgtcaggtaagtaccgcctaattgtgaatgggatcttgcgtgctctcagctctttcatggcaatctaatttgcacaaagacaatagtttagcatagcaagtaatttgaaagatagaataaaatcaactgacaatttctgacagaaagagagaagaaatctaagtagtatttataatgagttgttgataagtgcagtcaacattcatctcatcttggttttgtgggagtactctaccaaaatatttcagttaccatgcctaaaacataccaaaataattttttatccgggaaaagcaatctaagacccttgtggaattctaaaaacatgtgaaaatttttcatgacatggaggaagagggacacgtgtaaacatacaaaattttaagattgagaacaatatgggagtcaacaaaaattgtattcatattccggaagaattgatttcttctatctcttccttttctctgtccatcatgataacaaagtttggcatgaacaaagaaaacccggcacctgccttttccttttcctagaatttttaaaacctccggttaactcttccgatttagatataataaaccttctagaagttggaataaggatggaactaatgcgtatgaaagtcccacttcagggatagcagtggcatatttaccagccagcagccatataatatatcaagtgttacaacaaaaccaatctttggtattggactatcaaacactaaaacataatacagaattaatcaattgccacttgttctccacataaactagatcaatttcatgatatttgaaatgccatgaaaaacaatgtataagagccctgactaataacttctgtctgggtagaagaactaattcaaatagacaagtcagggtgcttgtcaacatttgtcctatctgtttttatattgtggaaacaaatcacagaatcacaaggctaccaaataatagtatctagagccttgatgaaagaaatatgtgtacaaatacaaccttgtgcatactagtataattgcagacgaaaacttattgtcagtcacatatttagatttcaagctgactcggcgtggcagccctccatgacgaaaaaaagacattctattgattgaattgctggcctatgtctatacacaattacatacagctatcaaacatgtgtactttgttgaattatatattcaaacgttaattttattaattagttggcagtcaggtgttgtatgcctaaacaagaaaattccattgttcattttcattcttcatgatggaaacagatgtttattgtaaaaggttatttaagttgtacaatataagcttggtatatggaactggcaaaaatcaaaataatgaatatgtagaggttatcgcttgtttgaacaaatacctattgcatgtatagtttggaaaaatagaatttacctcaagaggatcagtttctccctcaagctcaaccataactggagcattcatgctataaaacaacagcaagggttattaatactgtatggtaaactattagccatcaaattggcaatactgtgcaatatgatatatagaaacataccttatctgtaatgcacgtgtacccaggatgcgggcacgctcatactttgtcatatactttgacgttttgcgtgggcgctgagttttttcttgttccttatcttcagcctctgcccctacaacctcatcagggccatcctcgttattctcaggttcctcttcagccccttcctattattgaacagaactccatcagttcttttccattaacagataacatcactgcatgaggatagcaatgtgtgtacctcaatctcaggttctggtggctcatcctcatacctgcagaggaaaatacaatgccattccaaaatcaatatccaacaaaacaatcctttaaaatgacatataacaatcagtgcttcagcaatcatatagttgtgcaaggataatggtagatatctcactaggatgaaatgtaaaagaaattcaaaattttcacttctaccaacactaatgaacataactttggtctgtgtaatttagtaattacactaaaattgaatattcctgagaaaatggacatataactaactaattcatatgttttaaccgccaagccaccacagtaaattaagcagaaaagaatgaaaccacacattcttgttccaattagaagcaagatgttagagatcctctaagtttttagctagcgtgacaaagttaggattccatattagtacaatgaccatctatcttaatatgtaatagattttttccatttttatctttcatttttctccttgttttccttatatgcatatatatttttcccctttctttatactgctgcataaatgatttgcaccaagcctcctattacatcaattgcatagctcccctgacctatatcggtctagccaatcccttcatgtccatgtcaccatagaaaggagcaagcaggaggtacgcatgagaaccccccatccccgactgcgttcaatgttcttttctctcaaacaaagcggtatagaatcatcaatgaaaattcccataattggtgagcgggattgtcgcattaacccaattgattcatccaagcaaacctaaatttcaaagaacctgctaaacctaaccataaccaaacaagcagggaaacagaatatcactctttacagtatccccttctgttgctgacaaactaatctcagacaacttctaagagccattactcgactcaacgaacgaaacatgccctaagaataatactcgactcaacgatcaaaacatgccccaagaataaactccaaagacaccttttacccgtgaagaccagtacgcatccaacattaacacctctcgttttccaaaaaccaatcgagtgaatcgcggcaatcgccataactagcttcgactcgaatcaacgaacccaccaccccaaatgctccccatggcgatgaggagcgccaacgaatcacccagcacagactcctaccggcgcaacatgttacacagagagctggttcgaccggtctgggattagaaatttattagaacaggcgatgcctatcgaaaccctagattggattcccatgatcatacggaaaaaggactagagagagtgagatagtagagagtaaggcaaaccccatgtccatgtcgttgtagtcgtcgtccgccatggcttccgccgcctctgattccggccgctacaatcgctagggtttcgccgcacggcggccaagcggtgctcgacagggagaaagggggcaaatgggactctgggagagcgcaacggacggcccaccagcccgggaaaaagaacggggacaatccccggagaatcgtagaaggatctggaccgtatgatccgtatctgcagaaatttcaaaatatggcattcaatgcgccctgcagaatttatcagtctatccgttgttttcagactatgacattaggaatttaggatacgaatttttttcgttctacgccactttgtccgccagcgtcggttgcgtcgtcctagtccaccaaccgcgctcgcgtaagccacaagtcattgttcgtctgttcaccactcgtatcagtcgagtcaccctctgtccgctggcgtcatcgttgtcgacatccatcatctgcatcgccatccatctgtggcaccgtcatcgtctgtttgccaccatcactgtgtcgctatagtccatccatctgtggcaccgtcatcgtctgtttgccaccatcactgtgtcgctatagtcctctgcaacgccagttgtgccaggacaccatcgtcctcttcctgctacattgcgggcctacctcgaaccaaaacctacgtgcgcttttgccgtcgtttgcctatgatggattttggcatccatccggacctggattggttgattcatcaactgatgacgtcatcttacatgcttagtttgcttggattgcttctctttcttatctcgcccctttatatttccctctttaactttttccttgctaatcaaatttggacaacgccggcagcaccgacggatgaacgacggcaacaccgggcggattaacaaggatggggcaacctatgctggtagatggagtggcacataatgaagaaaattcgcagcctagtgttgtattctaaaagaaaagtaaattgggtggcaaattctaaaagaagtgtgtattggtgatgaattctaaaactttgtttgttggatttaagctcagttctagtgagcagtactcccctttctccgaaatatagatatttctagataattttggagggattaaggagtgaaggcgaaaaaatcatagcacccttcagagttgttcggagaatcaacatgctgcagcgctgcacctacaactacagccaggggcggatctatagtactaggaccggtgtcaggcgacaccgacgattttcggcaaaacctatagcaaaactgcttattcatatgttataacactgtgatctaaatataattagtatactatgacaccgatagacacgttatgacaccaatgaatcgattttctggatccgctactaactacagcggctacaggaggatgggctgttccctgctgcaacaaaatagttgggctttgcaacacagcccaaaccgctacatcatgggatactaaacaaccccttcattgatgcacgtaggacttatagtctacagaaaatagggtggttgatgggttaaaagagagctataaatagttatatatggggtaaatttgaatcctaaaaattagttatatattaagatggagggagtagcagttacctttaatttccacttgcatgtaaaatgaggtaagccattagcttatgattaattgaatattgattactacaaacttaaaaattgtgtttatttgaatttttttaaaaaaactattatatagaaaagatttatttgaaaatgtgcttaaaaaagagaaagttacaactgctaaacaagaaaacaaacaacgcgttagggtttttagttaatttgtagtgatttagaattttatattttcacaaacaaaataattcattcaaattaatattatgaatgtaaacacaaatctagatatagatttataaatctaagaatatccaacttcaataatattggctagagctgtttcaaatagggacaatgtgggtagaattttgttcgtcaattcgttccattaaaaaaataaaaaaaattctttgttaatttcctctaggtttgctaaatgattccttaccgttgtctatttaattagtgttttttactggctctgttattttagcattttaatctctattttatttcctgaacgtatttatatccgaatctaatgtgcaaacatactcgaacacattcaaatcgggctcggctttaatttttagtgtaaaacgatttacgtatgaaaacttggtatatattaacttttcctaaaaagacgattctagaccacgcttgcacaaacagcccatttcaatttggttctaacatttacatgaaaatttaaacaaatgtgggttaaaaaatacggtttgctgagatgaaaaacgcgcctagctaggttggtacatgggttgatttgagtttcaaaattattatggcacgtgacgcatgggttgattttgagtccaactccatatctatacatagttacaagcctacaacgtgttcacaggcctattcagaagtcttcctggataacagtacgtgagctggttgcgtatttgtagacagctaacgagcatgtattagacgtaccttttttttttttcttgaatacccaaaagatccgtttatcattatattaaaataagagagggtataaccccgagtacaaaacaagatacacccttattaaattataacaaccatatgtgccacaagctcgacaatgaacacaactaaaaaacggccacaaccacaaacccgactataaaactaaccacccggctctcgagcaagctataagaatagctccaaggcccagccaaacaacacagccattcttttgccttggcaacaaagaccacctgctaagttagcagcaaccccctaaatgacacattaatttcaccaaaatgactacaaattgagcccgtattgcactgggtcattagttgcctcattggtcttgtttcataactcctccctttttcaccatcaggccattagaatgactatagacgtaccacatttacacattttctcctcttttagtatgacaggcattttccttgacaataggtgctattctcaaacatcgtaaagatatggctcctagttagggtggacaatggatgaaactaaatattatttgagggcacaaataaataaattaaatattaaaaagttgaaaaatgtcccataataaacgtcgatgaaaaaattttttgtgaaaactgtaaagctaggaacttgggaagtgtggcggtatgccaaccatctgttagctcacaagaacggggcctctgttgccggatttggattttaccatagctactagtcctgcttagaatgattctaaacttgaatttaatatttgaaattcaaatttgtatttaaactcacatccttcttccccgttaactaggagtactgatttttggaaactgaatattgtaccagtataagcagtagtgcattattacagtttttggcaggatttcttatatatttatttaacaaagttcgataaaaaaaattaaatgaaagcacacctctaacaaatttgccaagagtggtacggtttgaaatgacattgatcttaacaaccccgtatttcttactaggtgattctccgtattttgctgtggaaattactaagtaatttttagagtgaagtgcatggatagtcactaaacttgagcaggtatgtcacttaggtccctatttttgagtccctcaacttgtcttaggtgccatataggtccaaacgagctctaacccacttcgtgagatgacgtggcatgccatggtgacacttacgtgtcagtgcgatccacatgtcagtcacatagaaaaaataaaatttaaaaagagaggagagagagtgagagagagagagagagaggagaaaataatgtttttaattttgaaaaataaatgaaaaaggagaggagaaaaaatatgttcttaatttttttctatatgtgattgatatatggtttctactgacacgtaggcaccaccatagcatatgccacgtcaccaccatggcatgccacgtcagtacacggagcgggttggagcccgtttggacctatatgacacatgagataagttgagggacacaaaaatgtattttgagagttctaggacctagatgacacacccacagaagtttatggacctccaatgcactttactcaataatcgagctaagagtgaaacggatattagtttgccaaactgaaagtgcatctaggacccctcatttgttttggtgttaatgacaacacaattagaggataactaatgctttttgttgagatgtatgcaaggatgaaaaaggagtggaacttaagcatagaaagctttgtggcaatttgtgtggtaatcacctctctaaaccttgtgtatcatgtgttcttgagtattgggatgccatactattaagagggataccacatgcatataattggtagaacactagtgctcaaaatcctttctttgaagtgttcctgttttattcctgtcggactatccgatcttgatcagactatccgatgctcagactatccgaaatttcacagaactttgccctctgtctttggtcttagtgttggtcataaaatatcggactatccgatataaggtcggactatccgatacatcggactatctgaaatttctcagaacttcactctcggttttgaattgctttttattcctcttgagtgaatttcaaatcagactatccgatgtgatcggagtatccgatgacccagagactccaaaactcaatggaacttgagtctatgtgagaggatgaaattcatgactcaaaaataacggaatatccgatatgacatcggactatccgatcgatcggattgtccgaaattctccagaatttcgttctctgtctttggcttgctggggggggtcaaaaacatcggattatccgatgtcacctcggactttccgaggtgggatgaaaagattcccttcccaacggccacattttgggggatctataaataccccccacctaacccttttctagggttacccaactcattcattcacattcactttagggttgagcttggtgctaaggtgctttggatctttgaactcttcctccctcactcaaatccctccttgttctttgtgtggtggatcttggtggttgtggatttggtgtttgagggcctagtgtgtgtttcactcgatcttgagcactagggtttgaccaagagttgtgtggtgtttgttattcttggaggttgaggactcctagacggctaggtgtcactcccgagccaccgatctacgtgtggttggccgggagaagtttgtgaaggttggatctcacctccacaaggaaagagataccccttagtggaagaaggagtgcttagtgcaacctcttgaggaaagggttagcaaagacccggctcttagtgagctcctcaacggagagtaatatcccctcaaagatttgaactccgggaacaactccgtgaacttcattgttggtgatatctcttcatcttctctttagctttgcttaattgtgctgctatagatctattcgctgtttgcgctatactcttgtttgtgtgctagatctgcttgttgtgactctttagtggatcagacagtctgatccaacatcagactatctgatattttcggatagtctgactgtggatcagactttccgaccctaactcagttttagcttccgtataaagttttaaattagcctattcaccccctctctaggcctaattgaccctttcacaaactatgttcaaagagaaataaatttaagaccgataggagattacagatgaaatatgatatctcgcgctttgattatatggataaatatatgttaagtattataaaaatcattcatatttatgttgaaaatattgtgaaaataatatgaaaaggtgattatttgatatgcttaaatattgatttgtagaattcgatgaattgtagatgatgttgcatgcatgagctttgtttataattattgctagtagatgatgaagtagaattattgcttgtagatgatgaagtagcatatttacatcttaaattttagacctattaagttacaactatatagaaaatagaaagtatagatttgctcgtgcaaaagaaaaatctaggaatatatcacgcttagttatctggatgtatattattccaatttttaaatttatgctagtgtgcggatgacggttcacccatataggagtatattcttttcgaaacttttcctatatatattttttacaatgtactgtacacttgcataatacagctcgtattacaatatccgtatgtggcaacagttttgagttactgataaagaagcagacagaacaaggatatgcatatatataaacaaattacataacatttattgcaaaataaacggagaaaaacaaaactagtaacctcagctatgttcctctacaatttaacctcggaattatatatacatccttgctggtgccaattggcgccaacaagtctggtaaaatgtcctacgaactactcctttctgccggttcttatgtttcctccttcctaagaaattatttcagccctatcttcctcaagtccacgaactagcaagctgttcaatgatccaatggagagataactcatatatctatttatccagttttagattatcgcagagatggccaagttcaggcctggcctccatccatgatgcaaatgttggctcacgcaaagatgaacagtagaggtaggatcggaaggtgatcaggaagaagtaccgcctgcagttaaacagttgaaatcataatattaataatttggaaacatattgggaagagattgaccatctggaactggaaacatatactcctaggacacagcctataggatactgtaaacatgtaggaccgaccgtctaggatactgctacacccaaacacaatgctatacatatagcttgtatttattcagctcagaaaaacccaacatatttcttcaaagaaaatgtctcttagattttttgttacattccacaggacaagtgctttccccttaattttgtgcagtgtcattctttttgatcaagcaactgtttagcatttaactaaaccgagcaacctcctgaagtgactatatcttgggtgcccaaaaactaacactattttgatctaaatatgaatacttgtgcaatttgttttctagtttttaaattttagaaactatgctatatttgtagacatccactgcacgcatgcagagtgcttagtgttgaagaaatacacttaaagaaagtggtggtttttgatcagccaagtcgagattcctttttcaatccctgaatatgagttctctaatgcattcaaactgcatatgaataaagtatcgtgatcaattttttatgcgtgattgttcatataactgttatgctatctacatacgaactatgaaaattgcagtaaatacagtaagtactttgcatgatgcatagaagattctcatgaaatggagtgtgcactccgaataaattgccgaagcaggacaaactctatccattaacaaatttgcatagtcaattactcaatacaaatgtaaatgcaaggggcgtgcacatttaaactactgtggcttttctaagcatgaagagaaagcagtgtaatcgagaaaatcctatatgaaaattacctcaaagctttagtgcccatatccattagatatgaccatgtctcatcatcatcaagtgaacaatcttgcagtgcctttctgtaatgcataatatcctcccgcaaatgcccagcaccaacacaccttcatgagagattggttttcagaatatgcatagcaataatcacacgagtaacatctatgactaaactaatataagttccccgttagttcataactatgattcattgattaatttacataaatgcctgaatgaagtaaaaacctgcacaatacctgtcaataacagtgtcaacctcttctttgcattttgggccatgtaccagtacccttgtaaggtttaatatgtcacggtagtcaccttgcttgagagctatatcagctgatgttttgatagacacactttttgtaagagaagttgatatgaagtgtgtttctgctgtttgttccatgatgaacttttcatctgctcccagtcccaggcatgtaatggccattgcataagcaacaccaccatatcctgtgtgtgaaataaagaggtagtacctagcattcctgtagagaagcaaatcattcttatagcctgcaactgagtaacacaatttgtcaagctatatcaagttgtggattagggcacatactcatcaaccgacgattgtattgcatctacatcagaagctaatgcttctctttccctggtgagaggtattcttttgtagtcgatacagtacccctgatttctcagtacactatatacttcagccggtgtcatcacatcctccgtacctatatgttcccaaaaacctacaacactactttggcctgttgacgagttaaattcttcttggtgcagaagtagccgaccaccttgttgtttaacttcggagagtatatcctcctttagtcttgcctctatgttttcaacctgcatagaagatcatttaaggtttgccatgaaaataatatttacattattggaggaaactcaccattggcccacttatgccaacatgcttaagagtatcaacaggctgatctagttctctcaaaacaaaaggtgttcccttgatgtaaacaaccacttcctccctaagatccgtgacaaccaccttttgaggaatgcttctcccagtatctttagagcccaaatatgacagaacttcttttgctccatcaacagttggtgtcgccatgctatacacagggtatccatcaacctgaaaggaatattaaaaaatataataaggtacatgactaagtaatcctttattataaaatcagttttctaaaagtgaaacttccatttagtacatgcactacctctgttgccagaagaaatgcaactactaattttctttacaactagtataagtagcacacagaagtgagaaatagtataggttttcacacccactgcacgtaaatgaaatgaatgtttaatccagaatttcatgatgtggctctgacatcaaacatcttgaaatgcaaacattaccaatcttttggctaacatcatcgctctttattgagataatgtaatagccatctgttcacaagtatttctttgaaactggataataaaaacaaatctcagtgggattaggttggaattggtagcatttattttattagaagtgattttcttacttcatcacaagaaccattgaaatgagccatgacagttatagcagttcaactgtggtgttgcatgatgttaactaggatcagcctcacattctagtgggagcattgcataggcactagcttgatgcaagttcatttagcaaacagtagccaatagggatggacatagaagaatgcaagcaaatcgcatgatcctggcctgacccatgctgtggctttggaattggatggtgcaaaggcaaggtggtgcaggagggacaaattacgacgagcatgatgctgtaaaaaccaccagggcaaaattcatcccgttccttttcgcaaacaaaagtttgcactttggctctagactctagagtcatctagaaatggaattgtacaactcatacatcacccatgattgggatggtaagctgacctttacagctgggaggattcggtgaaaagtaatggaacaagaacgatattgtccataaattaacacttaaacactggaagcatgaagagcgaaaattcccagaatttggactttgaagtgcaggtgctaccaaactaatcttttgtctacatcactaagacatgaaagctctactaaagtcatgtgtcatataagatataacatgagtaaattacgctggcgatatctgaatttgtgaggtgggggtaagtacacaaacttataaagtgttcattttggtgtaagaagtgtagtgcatgcaaaccaactaaccaaggccaaaacggcataccgtagctaatcttgatgaaatgggtgatgattagggcgccatgtcatggcccacgtgcacatgtaaggaccgtgtgttacatgttatatcaaataactccttgtttttggcttttttgtccttcatctattcctatccatacattcttcaattatttctatacaatgtactattttattgtacaaccatcatgcattatcatacggttgattgaacatgtatgttcctatgactcttcctcatttatacatctgcatggcatcctaatcactgtccaactccacaaaattaaccatggtgtgcagcttggctttattcgcatggactacataagttcatgtactagaatgggcattttgcaagtctgtaaactaaattgcaaatcaaatggtcgaatgatagaagatcataaagaaggccaaacaaacaaataaactattgcaatagcatgcttccaccaaagctgatgctccatcaaaacatactaaaaatatctttgccactgttagtgttaagcaggaggcacaacatcaaagctccaaaatttggaaatcctgtttgttactgaggcagaaatattgatgactcaattatgtttttgcagaaataactgcaccatggagtgtagacagaaatatttgttcgctactaccaattacctatgatgggtcagaaagttcgaatggcagagtttaattggcagaattgatcaataacatgaataactagattaaaaaatgcatatgcattgaataggcaactattaaatgcaaatttttgttacaaataaaaataccttgaaaacttgtggtgcaccacagaagttaatagtgcttgaccttttctgtccaggaaagaagtacattttgagtattgatccctttcccaaaacagaaccattacgagctttgacaatggcttccatcattacgtcaccttgtgaaggctgaaaagatgctttggattcatcctacaaatagtaaattataactaatggtgccatttcctcaaaggtgcaaaaatgatatttttggttagaagagatgaggatatttacattaacagtgaaaaaacgcccaggtcgtaaccgtatgctccatttcatgctttggatctctggcctctggtgtatccatgctttaaatgacatctttgcctctccttgcccgcagaaaccatcaaatgcttcactccaaagatatgctgagaatgcaactaatttcaagtacctctccaaatattcagcaccacgatttaatgcaaccctcttaactctttgctccacatgctgttggttaattacttttgtgtactgcaaaacagcctggcgaatattctgtaaagccgagcatttgtcaataacattatccaaagtttgtctacactcgattccgttgtcaaataatcttgtaatcttccgcaaaacaagtatgtcatcaattccaaatctaggatgttgttctgtcacagtatgaggtcttggtgaacttgaattaaggtgaccattgtgatccgttgtttcttctccacttgagtaacccaattcatttggatcttcatggttatattcacaagctggcaatctaataggtctgccatgatcaattcgcaatctcagcagacaagcaatcacagtacctgtagttgttcttcccctgcccatctacaaaaatcagtaagttaaactcaacctttgtagcctttcatataattcaagagttgcctaacatagaattctggactaataaaacaaatgaagtgcagtacctggcaattaaaaacaaatgcagtatccttgtgagcagctgccacatttaaggttattgtgtcaaaatctgaacttttgggggctttgccatcagtgattggcactcgagcatacttgattggaagaccttcagactccagaagtttgtacacctccaatggagtcaggacagcttcattatttacattttcccatgcatcaaatatctcaccattgtcagtttcatgaataaccattatggccccactatagcgttccgcttcccgtaaaatatcctccttcaaacgagcttccattcgttccaccctatcacgatcaattccctggtgttggtgcattgtgtatcatttagaccaacagaacagttttgggaataagctcaacagagcacatgcttcaagtattagtttattaagcacaacgaaacacaatagtagacaagtatacaaattccaaaaactgaacaaagaactaaagttttcataaaaccagaattagaacaagtcctttggacagttacttcagattaaaagttaagtagttaaaagaaacaaatatagttagcttagctatggatattaatattcaaaataacttatgagagttttcccattggtgcactctgatacatcaggaaggaaaaaaattacaagtctatgttagatcaggtgcaaaattaacctagggttagagcaaataatcttgagcatccactatgttacaaatctgtcaaagcaaccagacatgatgcataccgtgtactccagcatattcttgtatggtctttccacttcacgtagtacaaatggcttcccatttatataaataactggttcttctctcatattatgccacagaattggtcgccctcccttgcttgtactaatacgctgaataacagctcgaatgccatcaacagtagggtttgcaacaccataaaccggaaattcaggaatttccctaaaattaggtgcaccctccactctttcgggtaaatgaaggttgtgacaacctgggcagtggtcactttttaacacagtttggcgtccaagaacttctccatttctcatggcagcaacaatatccatctcatgagggcgtccatcagcatattcaacaatttttgcaagagagggtttcgaacttgaataaccaagagcgcccattggatctctcctcaacagcctgaaattatcaaaatgtaaaaatatgagtttactggttatgccaaaagacaaaaagttactgatgctcttactaaaatggataattttatacggtgtccttgaatatgcatcatcatacacactttccagtgttttaaaagcatgcagagtgtatggtggaaatagagtaatataacctttctgctctttaccctttgacattgtatgattataacatgaaatttgcatcaggactccacatgcaatgcatggctcatatggaatcatgaaatgcctttgtactcatgtgctgctacacgctatagtggctaaagcaggtttccgtgaagcaacaaccatatgaaacaaagctatagaagccagtacatgtagccacaccaccttgtcctctatgaaaacaatgaccttttaaactttaagtaagatttcagtttacagttaaataggtgcatatgcactatgtgcataaaatccatttcccaatatttatatggtatattcatgcctagaagatccttgtgatgaatggtaaaatgcaaaatgcctaagttggagaagggatctgttttatccttcatttcctcccttatttttgaaggacagatatgggaacacatcaaagaacgaagatgagagcacttctctagtgtcatgtatacaaaaaaccgttttaatattagggttcgcacagtaaattgactgattacatttaattaaaacaaacgcggtaattcttcaaatacacacagtaaatacgctgtaatattgagctataaatccataccacttattgatctccaatataaatttcacaaattactcctggattttgttttcttttaatgtggtaatcctgtgcatgctatagactaactcctgaaccacaaacttcaccaatgttgtgatttctcatgtggtgcaaggaatgggttgtcaaattaaggttgaggccttgtgacagctcttgctgttatgaagagctcaataaatacaaagtgtgagaagcaaagataaacatggtctctggttactgtagtgattttcatatatcaatcatatcatatcatataacttggatgagatacggcagaagttatgatgatgactcagaaagagagcatagtacactcatcaagacaactgttaaaatcgaaagtgtgcaaagtatgacctttttatccatgcttaaattatctcttcataaagttgaatttgtaatgaattaaccaattttcaaaaagttagtcatgtcaatattcatattttcaatgccatatagactcgataataaaactaccattgttgtttaagtaaaattgtttgttccaacttgcatgttgatcaagagctaaaagattagctcatcttttactatttacttccagttctccaagccataaagaggtgagttcaaattaatttggataaaaccatgatggtaatgcttatcgaagattacaaaaacacacacaatactttgagaaagatattagagaagggaaaaggaataggcaatgagcctagctccatgaaatagccaacgactactttttcaatccatggttttgacaccaggatgacctgattcaagaaatgtcagtgactaatatttcttggacacaaaggctgcctagtattaatgcctgtgtaccctagtaattagtccaaacaaaatattgaagaagcattgagatcttatctaaaacaagatctaaaatgaaagtccagaatgtgttacaaggaaagtaagtacatattggtacactgaatataagaattccaccttacttgtgaatagtatagtgatataaaacaaaatggacatgttaatttttaagagctcatctcatgtataaaaaacagaaccatgtttagcctgcatacactcttacaagctgtacatggtactatttttatagtaaggtgccacggctcacgttcgaagaatgctgtacagttcaggccttgctctcatccaatcagaaaaaactaacttcttctgaaaagtttgattgttgagcagagcacactgaatgaacatagacagcaaagcatatgaggaagtaataacgttccaagtactcaacaaagaaggaaagtgatgcctcccgtttcatctcatcaggttgtcgaagaatactattgcggtatgtagcaatagcctctcttaagttctgccatagtcacaacaagtcataacaacaaatatattaatatagctgtattaagttagtatcatgaagagcataaaatggtatacctgcatcgtgtcacatttatcaataactttgtcaacttgcctttttccttcaacaccaccctgaacaaatgaaatcaaaaaatgaccacactaagtgtctaatgtaaaagggatatgaattaacagatccaggatattacctccagaactcgtaccaagctcctaatgacagaatattctcctctgaggatagcttcttctgagctaggcatatagtcatctacatcatttccagaatggaagactttcccgattgaacttgtcctagggatacctgcagccaatagcacccggcacaactcaatataagaaaattcaaacacgaacctacaggcacaaaatgtaagaatataatgcaaaagatatctatgatgtgcatttagtagatttgtactcagtaaatacaaaatcaccacatgatggttcaaaataggcaacagtctgtatggagaattctgtttatcaatcaattgtacatataggtagaagaagcaacaatatcaccaatcaaattacagtctgtacttacctgatgatcctatccggttcagataaatcaatgttgctataaccataccagtggttgtccttcccctccccatttgacaattaaatatgatttcagtttctatatcaacttgggagattcggcgtacctgttagaaacagtggagttcaatgttatgcaactatcatatgaaccaaatttcagtataccatattaatcacaaggagtctatagatgattgaaccctggtaaatgtggatcctatcaactgtgcaaattagtttaaaccttttccaactaaacataaaagctcgcacatagggaaacaacagtaacatgcagaactaacagttcaaaaaaagcatacagaactaaccagattgtcaaaatctccttcttttggggccttttcatcagtaataggaacacgctcataatctacaaggtatccttgatgctgcaactcctcatatacctatacaaaggaaacaaattctcaaagggactaaaaataataaaacaatataaccaaaccttgaatctattcttacctcaagaggggtcttgactgtatcagttaccactgactcccactggtccaccatctgaccatttggcagctcatcagtgacgaggatcttattaccatatctgctccatcaaatattcaggtaaaacaaacaaacaaacctcttaagagtaaatacgggtagaaaacaatattggcagccgacgtaccgtgaagcttcctgaagaatatcttctttcaggcgaaactccatctgttccactctttcccggttaattccctacagtagtagtacatataccaaaaaaaaaagttaaaatggaaaaataaaatgataatagaacaatagtaacttcatgtggaatcaaagttgttttgaagggataggccttctcaatatggttcatgtttctatagccttgaaaacatatctagaattacccaaatcaaaatgagatttaacaggaaaagcattccaagtctgcaatagcactaatgcatcatcattcctttaagaaacagagctatatattttcctgggtctcaggacatctgtatcataacttctgctgtggatgtttagcaagaaaaaatatttttggtttaacaccttcatggacttctcatacaaaaacaagaaacatagagacatactgcatacacactctaggcatgactagaaaaattcaagacaaacatcaaagaataccgtatattcaaggtttgagaagggcctttcaacatctcgcagaacaaaagggcgaccattgatgtagataacctgtacaacattggtggaaattacaacttactaagttccttttttgtcaaacataaaataaaaaagatataaggtactactctatcctattatagggagaagtagtatttgttgtaacaaggaaagggtgtaacctgttcaaaggacacttactgcaagctaagcaaactggtccagaactcacttgaaatttgaaatttacatactgttaaggcatgcatgtcaagttatgtaatttccataagtacatattacttagaaaccttttcatatatttttttaagaaaaatacacaccctcttctctatgtttttttatttatttatgcctacctactgagaattggaaacggatgttctagacagttcaaaatccattgttcattccaagtttccaaccttttgtagttttgaagtggtgagcataatttaatgttcttatgctagagatgcttaattttctatcagtgaccagtgttcttaccggctcctcgcgaagactatgccatagaacctgggtttgttttcctttcttttgtgctccaatgtgatttaacacatttacaattcccttcattgtcggcattgcaacaccatgaactcgtaaagaacccgcctgaaaaacagttggcaacagtgagtaaatgacagaaaattatagatgattgagaacccaggctgttgctgaatctttactggataaaaaggacacaagaaaattacaaattggagaacacattttgtaggactattcattcaagagtttataataaacacgtcagatggattgtttagttcatacaaagttccatgcggccttcacattgtttttctttaaatgttatatcttctatcatcgaagactatgatgccttagcagaaacagcccagatagatatgcattggaagtgttaatgctcatgttcatcagtgtgatcaacaaaaatcatcaagaaatccaaatgcaatttgcatagcattaagtgttaacattcttgtactaatttattttgagatttacatttactattctgaaaacaagtaaaggcacttccggaaagaacaccaaaattatcataggatgcgcacataagaatcggtcatgctgcacaaggttaccgataaagcagacaatcagcgcacaaaacatgtaagagacataaacaggcaaggcaggtttcttccgtggtcgtgaagattggagccaaaaattgctgcagattcccgtcgcgaacgcatggaatgggggggccagggaaaccaaggaattcgcggcgcgcggcggactgatccggaaaccatccagattattactagattaggaacgaggagcaacgcacctggcgataattgggcgcgccgtcgatttgcggcgagaggcgcttgttctggcagccggggaagtggtcgctcttgaggatggtcttcttcccgagcaccgagcctcccctcgtgctgatgacctgctccggcgccacctgctcctccaccgcctccatccgccactcctctcaattccacgcgcacccctctccgtcagcccctgcgccgcggcgcatgcaaccagcacaacaagataagcgtaggcggcggcggcggcggcgagaagcgtaggcggcggcggaggaggaggcggaaggcgataacgcggcgagatgggaggatgcggggagcgggcggccaataggcgaggcgagacgaggcgaggagatgaaacgcggaggcgaaaggggacggttggggtagcgaggccttgccttataggagtactacgagttggccgcaggccgcagctgcaggagaggcatgtggcgatggggatggatagataggctaggcagcagtgcagtgcagtacaggctctctctgtccctatctctatcttcttcttctctctccctggctgcttgccatgtgttgcagtacaagtttagtactgctactgctgatgctgctactccagtttccggatttgcgatt

SEQ ID NO: 63289 - DNA, 2996 bp, Oryza sativa
aaaagaataaagttgtttctctgaaaataccttgaagtgaatgagtaacagcacacgttgcgtcggggcaacctggatggacggtcgacggcgaggtggtggtgccttggacggacggccggcgacgctgcccctggatggacggctggcaggccggcaatcccccggataagcggccggcggagccctggacggacggccggcggtgacctggacggccggccggcggtgacctggacggccggccggcggtgacctggacggccggctggcggtgacctggataggcagccgacggcgatcgggacggagctagcgcgaggagctcccataaccctagcctggcggcgtgggcgctgtttctcgcgagaaagaaaacgacgcgaggaaggagcgagaagaaaaaggaggcgggcggaaaaaaaatggcgcggacggtaaaaaaaatgggcgcgattggtgggattgggagggcgtacagcttcccaaattctgatgagattggcaccgattttaggagtgggtaaattttagaaccgtgattgacaatctgttagaggcctagttttaaccaaaatcctaaaaaataatttttaggaacctatttggccctctgttggagatgccctaagccaataggactttttttttgcaatgtttcatcgaggctgtagccaatgagttatcattattttaagatttagttatcagatgtatcggttatttaatcgatatacactcaaatctacctgcattggacttccagtcgatgtacgttttaaccattggatcgatgcagatctgtatcggttgattggttcaattctttctgtcatccttattagttgcaagattaaattaactagcacatccgaacctcatcaagatttagaacctgcactgaaattaagtagacctcccatgccttcgtgtgtcgcggcgccagatttcacatcacttactcagcatgtcacatcagctaaaactgggcataatattgtgtaggaccttgagtgatccggttttgtaaattaatagtattttaggttagggatgaatttcatacttagcaatatattaaaggacctaaagtgaacttattgcactttattcacggtgaatggcccaaacctcctggatatgcagcaacggatagggataatgagacaatgggcttgaaatctacccctcgcctatgatgggccatgccaaaaggaattgctaccgtgcatgtgccccgtgcgctaggtcacgctcacgttgcacgcgaatcgatcgctaggacggatccccctccctcccgacacctgttttttttttttcaccgtattactttcctattttagtaaatttatgcacttaaaagtttatacacctcaagtttacacatctaaagtttatacacaaagtttagagatctaaagtttacaatcaaaagtttatatatccgattcaaatttgaatttgaattcaattattttttaatatatagtatttctatacatctaaagtttatagagccaaagtttataagtcaaaagtttacatacccgattcaaatttgaatttgaattatatccgattcaaatttgaatttgaattcaaatatttttttatatagtatttctatacaactaaagtttatataccaaaagtttataagtcaaaagtttacatacccgattcaaatttgaatttgaattcaaatattagtttatagactcaaagtttataagtcaaaagtttacataccggtttaaaatttaaatttaaattcaaaaaaaattatatagtatttctatacataatcgtttttccaactttgtttttttattttttaaaaaaattatggtgtagtagaaaaagaagaaaaggaggagaaatgggggagagagcgtatagggggatgggatcgatcacccattaaccacaccctaccctttgttcctttactttttgttccatgggtaggaacagactccatccacttcgttgtttccaatatattgtcagaatcctgaatcatgtcatcaatcacaattacaattatatgatgggtctacaacataatagtcgtccttactccctccgtcccaaacgaaatgaatctagctaggactgaatgtgacatattctaatataataaatatggataaagatatgtccagattcgtagtactagaatgtgtcacatccaataggttagtttttatgggacggagagagtactctctaacacatgtgacatgattgtattatatatgagattagttccgatataatcctgtgggtcaacagcttacataacccataatgtaacaaacaatgttattccatcgtgtgttgtaccagggataaatcatgtacgtacatgtaaattcgttcaaacagtgtatctcgattaattgttgtttaataattttctactataaaacaataaataaatagtcttttctcctataaagtttagttactatcgtacaattttgtaaagttttaaaacatgagttgaaaagtttcaaaagtgtaaagttacattttgaatcctataaagttaattataaagttattcatcactgagtatagttaatgataattatcgtttctctcataaagccacacatcactttaattattttcaaccctttgatcattcatttatggtgcaaatcgttcccttcgtctctagcatgaatccacgtacaacatctcaattgtttttgttttttttatcaaactacctgtattgtttttaacatttgaatcattggtatttttccataatggcaagatgtgattgtgtaaagtacgtgaaggcaaaaagtttaactacaaagcaaatttactttgtacctcacgtttagttactatcgtataatttttccttagcaatgcccagactttcatctacatctattttaaagacaaattatacataaatctttttatttgcgtggaaaaagaaaattttccctcctgttattatagctaggagg

SEQ ID NO: 63290 - DNA, 835 bp, Oryza sativa
  unsure (1)..(835): unsure at all n locations
ggatgtgatgactttcngtcacccanaccaccaanacnagttnggtacacagcttctactagtactcgttctgcacacacttcacaccacctctatacttttttctcctccctctgtgcgtgcgcctccagatttggccacctccggcggcgccaaatcggagcgtggcctcggccttgccgttgccaggtgagcctggcgatccgatccttctaccctcatgctctcgttgttttttttcccactcagatttggccgatccgtgtgtgtgcccgatctaccgcgacggggggaatggaggcgcggcgtggtgttgcagtggcgcgatctggagtgtgtgtgtgtgtgtgtgtgtgagtgtgtgtgtgtgtgtacggtgtgcgcatgatagatgtggatttagagagaacgcgtaatttcaacagagatgtgtcggataagcctattgggcttaaacctttaaattatattttttacccctcatatttttttaattttaaaagaaaaagtgtttatttggaccggccttttataatatgccttactcattatattttgttttgtttatttctttaaatcttattggaacaatgcccttactttctataacggctacatcgggataatccctatgatttattcagtagcattgccggttaaacgtgtattattttcaaataattaaagcgcgtctaatctctcatttacgtatttgttgttataaagctaatctcgcttcaatttttaaaactcaattatctgttatatactttataacgtttcattcgtttatatccttacatcgttcatatgagtatacaggatactattggcc

SEQ ID NO: 63291 - DNA, 14097 bp, Oryza sativa
tacatgctgaccagttttttttaagatgtgtttataggtgaatgatgtgcgtgtgtacgttcagatgataagtgtacgcacgttgtgagtggttgtgtttgtactatatttttttaaaaaaatggctaatgaaatcacttgagcatcatgatcgaccgtggaaaatgttacaactcagcgagggatttggaaacatgttttgagaatcaacaaggtttgtcgttggaaacggcacggaactaacttttggaaggctgattggtcgactgtttgtcgttggaaacggcgcggggcatccagctctcaatgccgtccttgttcagtcatgtagttaggccaaggtttacagtggcacaaaggcagcgtgataattgttaggaacgtgatatactgatatacaagtggcaccctccaatatagagcgattggtgagtacggagtgagtacctagttccgtgggacgacgtccaggagatcgagctgcacacaaggaggaccgaccaggttcaatgggcagcgtatcctatacacacaggccttaacacggtcttcgaaatgctactttaaccaaaaatgactacaaaagtaaaatattttaaataaaaagacttgcatactatgatagtaacattaaatttacatgatttatctttcttaatttatcgctattaatagtcaaaattaaaacagtttgacttggcactattctagaaatgtttatattttgggacggacggagaaataaaatggcaaaatttgctacaggacaccgaaagattgcggcctttgctgtgagacacccaaagatcgtgtatttgctcgtggacactgtaaaaatgtggtaattagctggcggacaccggccgcattattttatcatttccggacggagagagaaactttgattaaagacaagtttacccatgggcccacttgtcaatctctctttctctgttcatcttcttcctctctttctttgttcatcttcttcatcttctctctttctcattgcaccgccaccgagctccgccgtggccgagccgtcgtgcgtcgtcgccgtcgacagtgaacctcggcgatgcgccgccgccgcctcaccgtggccgagccatcccatggtgaccccatcgtggccgagccgtcctagttgcgagccacgatgcgttgccgccgccgccaccccgccgcggccgagccgtcgactgagccgccccgccgccactgccatcggcgaggacgaagaagccgttgagaagtgcgcgcgcttattggggctcatctcgccggagagcttgaagatgggggacttctgtggtggggattggaacatagggttggtgggggcggcggcgcctccgcgtgctggtggccatgggtttgaggtgggacaaggcggagaggtcaacgagaagggcaaggagcgcaccgacgagggagaagaggccggagaaggggaagtcccgccagaggcgtcgcgtggcaacgacgcagtcggcggcggcggcactgccaagcgtgcgccgcgctggcggtgagacgccggtgctgatgagcggcacgaggcacgacgcgatggcgatggtgaggctgacaaaggtcaggatgctgttcgtgcggtgcggtggcagcgtgaggcactcgtcggaggagtctgtgttggacgacgacatctgggccgccgcgaggaagaaggggaaaagaaaagaagagagagagaggaagaacagtgtcaaagggtattttggtacttacacaactctttctctctccatttcaactgaaaaaataaaataatgggaggagtgtccagtagctaattaccatatttttacagtgtccatgagcaaatacacgatcttttagtgtctcacagtaaaggccacaatctttcggtgtcctgtagcaaattttgcctaataaaatagagcagggactgaatcttcaagtcaaagaagaacatagtattataaaatatatacatatatctgcaaacacaagattttcgtataacttcgattacctgcattctaattaatcgttgaacggtattatgttttctgcaacagtgggcgggctaaggtgagatcaaggctaagacgagagtgccatcaaacgtcgaattcttcgtctggctagcaatccagggaaaatgcctcacagtttataacctcctaaaaaaattgatatcatcaacgaagttgtcactcgtgtatctcagttgatgaagaatatcgcaagcatatctattagtttcatgtgcttacagtaacagtttttctttttacacctactgacctacactaacagggtttggaggctatcaaaaggcggtgtttctttctaacttcttggagagctggggcaggattatttgagtgattggtgccttctggctggtagcaaggtgggcttttcagacgagctataggaaaatcctttgccaccttcttcatgttggtatgttggctgattcggaagaaaagaaatgctagggtgctcgaaaggacgacctcgcacgccatggtaactattcagggaaatcaaaacgaggtttaattcttgaaagaagtagttcctgtagtgcgaaatgttgaggttactagtgattggttgaggttggaccacgcctctctacagcgttctattgatatcatgtaatttctaataagctcccttcctggtcttaatgaaatttgcttggccgttttctttcgtccgacccggctaaaaaggctaaagctaatggagaaacgcagaccattcagttcagtatgcttcaacgtcaaacgccaaaattactttgaggcaacggaggagaaggcgaagttttcaaaaaaagttttttaaaaaaggagaaggcgaacgagcaaatttacctgcagagaaatcacctacttttcctccttgaacagttgcactggcctggttggaggggcgcaggcttcattctcccctatgcccatatactgtaccgggaggacgaggtacatgaaaaacctggccgggcttcatcaatccacgagtcctcccgcgcgacgactcacggtgcattggcgcccgtggtcctcagcacgttgtcctgcctgcgcatcagtcggttcggccagccggccggctaggcgagcgtgcaacgctgccaaaaagccaaaggccgaaggtaaacagcaactcgtgcaacaaccacccgcgacagcgaatgtacctacgaatggtgcagagctacaaatggcgagcgtgtgcaacgctgtcaaattaacagaataactggttttggcttctcctggcagaggagtagatcaggacactcgagttacagttgtacgcggccacgcagttatacttggcagcttagccgctacgcattcctctcgatgtctgtacgtgaccttgtcctactccatggaagacaccgggcttcatttcggaggacatagtaacagtgaccggtggattaacatttgttgccttctccatatatgcaaccagacgatccgggacagatagatcataagctctaagtctccatctccgacaataattgacgccctcgtcactcacttccaactagagccactatcgtgaacgcccgtacgtgcgccgttggcccgtcccctgtcccgttaatggatttccgcgcaacaccgatccgatctctgtttcctctcatatgtcgccatgaaagttaccataaaaaaccggcccaactccacgctatatcgtacgcagcgcgcgcggtgaggctccggtcccggcacgcacgacgccgcgcgcggacagacacgccccgctcctgccgatcgatgcaccaaatcctcccgttgcgacgacgacgacgaggtccacttccccacctccgcttgtccacggcccagccgcccgggttgcttcagctggaaggcgtctcgtgcagttgtacgagccaggaagtgagaattcagtagtactaagttgcacggagcgagagccttgctgctcccgtcccgatggcgactgcgccgtgcatgggggaaaacggcgatgtgtttgcatgtattgcatgtgtggcgtgtccgctccgcgtggtcgatcgcttagctataccggagtaccggacaagctaggcgcgagcggccagagcggtggcttggaccgcgcactagctgccactcgaatcgttcgtacgttgccgcattacacatgcatttatgctcgatctcgtcgcgtgccctcgcgtctgaaggtactcgttcgcatgtgaccgtgcagtgcaaagatgctacgcgtatgtgttgattggctaccttggctgtatcattatctacctggggacgcattacgagaggttggttgcagagaatgcaagcgcgttcaagcgttcatgcctgaggtgatcgtttaattatgacgttgttaattatatgcgtaggcgcggcatgtaacagaggagaagatgcggccaaatctgagtcgtacggctgctttgtcaccctgtcgtcgattagatccgggttgtgttaagttcacgttaaaattgaaagttcggttgaaattagaacaatgtgatggaaaagttgaaagtttatgtgtgtagaaaaattttaatgtgatggaaaagttaaaagtttaaagaaatattttagaactaaacgacgctggttattccagatgtggcattggctagctggaccctctacagtgattcacaatgctatgagatctgtagcattttttctcggtttgggtgtgtttagtttcacgttaaaataggaagtttgactaaaattaaaagtttaaaaaaaaagttaaaagtttatatgtgtaggaaagtcttaatgtgatggaaaagttggaagtttgaagaaaaaattgggaactaaacaagggcttcgttccctatctagatgttctcgttttgctgatgaactacgggtgtgtttagttcacgctaaaatttaaagtttagttgaaattggaacgatgtgatgtaaaagttggaagtttacgtgtgtaaaatagttttgatgtgatgaaaaagtttgaagtttgaagaaaaaaatttggaactaagcaaggcctgcgttacaccgcttctactccacatgattgcaagcctcctacctggaaaagtcagttgacaggccagaaatgattcagttttcattgtggacagtgttaatttctagagaaaatcccctatgtacccatgaaagttcacctaatcccttctatacccctgaattttgctcaatcccttacatacccctgaattttagtttggatcccttctatgccctttccgctagttgaccgttagttgaccgttaaattcttttgaaaaagtccattttgccctttgctatgaagaaacataataaattaatgaagtatattgttggaatgtaaaaatttattggatgggactattatatttatgagtatgtgatgcaccatattatttgtgacaaatttacttttacatatgatataaaaagttgatacttatttattattagttattaaaagttcttttatgtaacatatgtgttttcatagtaatacaacagatttgtttattacttcagaacacatatgctaaaaaaaatcttttaataactaataaataagtattaattttttatgtcatatctaaaagtatatttatcgcaaataatatggtgcataactatctcataaacataatagtctcatataacaaatttctatgctccaacaatatactctattaatttatatgcttctttataccaaagggcaaaatggactttttcataagaatttaacggtcaactaacggtcaactagcggaaagggcatggaagagatccaaactaaaattcaggggtatgtaagggattgagcaaaattcaggggtacagaagggattaggtgaactttcaagggtacacaggggattttctctaatttctatcacatctctatatgattgtttaaaatccaagtcttttttgtgctttatataaagttataaactactcacaaggtggcattgatctcaaatgatataccacaatgctgcctaaatattgaatccaacgccacaacttcaatacttttactatattgaatccaatttactactagcagtataagtttgagaaaaaaattcacataaatacatatactttgatcaaactatgtgtatcgtaaaactacaggtttaatgttaaatttatcccagaactacagatttaaaaaatatcatatcgtaaaactatatatttagtgatgaagttatcaattaagaactacacattttatattttatatccataacatattgagattacaaaagttataattttgtgatatgattgatcaatgtacatgtagctctatgaaatttactctatgttttttttggtattaaccctccatgggtagtttatagctaggatggtattattacgaacctgtacatacacatgaggcttcgatcgtagtataatttgtacatttattatcaaaaccttatgggcagtttatatagagtacaagacgacttggaatctaaataatcctagagagatgtgccatgatagccggatcttcccccagtctaatcgagtactcgaaacacaattaaccgatcagtggtagtagatcattattagtactttcagctgatccgggaatggtgggatttggggtagtttggtggtaaacaatggaaaactctgatagggggaacaaagttttgcgtgcatgtttgcttgttcgagcgatatttgcaatattgtttgtctgtagcctcacttccagtactatttgcaatacctcggtgttaatcgatgcattagtttatgtatacgactatatccctccaatctccagccaggcagaaattcaggattccgatcctaaaagtgagcattactcctccgtgtgctcgccccgtagcaaaacctggacacgggtcacatgcatgcgtacacgtcggtatgcacccctggttcctcggatactcatctcgatctgtatacgtcgcatttgggagatttctgaccctcgcaaaaagctggcctgaaaaggccacgaaagtgcgtcgtgaagtgatcggccaggtgaaaagagcgaagaattaagccgggtggttcacggttcaccggttacacgttgtcacgttgcagtcgcgacgggggataatgacgatatgccccccacgctggttgttgccgatcgatccagcgtcgcggaccgcgcgcggttgcagcggaggagctttggatgccgtgtgctcctgtgcgtgcaggtgcaggcgagccgcgatgggtgtgggtgtggccgcgcgtccgcgagagacgaacgcaccaaagtcagacgcgaggaatgggatcgtgatgcacgtaaggggtacggaccgatgccaccaccacgagccgttgctgcagcggcacagtattttatccgaatccacatgcattcctcctcttcctctacttttcctgactttcctcctcactctcctctgccacttcgcttgcgttctgttcttcatctcctcctcctcggtgccgcatttattactcgacagagtcagacagttcgagcttccatttcacacacactccaccggctcccccttcttctgcccccttgcatttcaccaacgcttacctgctccatacgacctccagtgcagtgcagtgcctctgaggtctctctctctctctcacacacacacacgtcctctggtcaccgacgctcctcctactactagtacagtggtaagcacagccatttctccatccatgcatccgtctatcttggcttcgttttgctacttcgttgatcgatccctcgttttacttaccttcgccttctcttggcctcgttttgctacctcagtgatcgagcccctcctcacttaccttcgccgaagatccatggcggaggactaagctccggctgctgatttcttcgctttggacgcccgcaaaaggtacaacacttctcatcttcctctggctctactgcctcaacgagtcactgttcagtccaggcgattttcctcttcctgcaatgtcggtgagcgagctaccgaatggtctagtagacgagaagccagttttgttgccagttttgtcgctaggctggtaaacggcgtcctcgcgagggtggtgcaggtgcaggtgaagcatcagcgatgccgggaaagaaaagaaagggagaaaaaaaaagatagcatgaacaatccccaaacttttcagctccgcccactttattacgccaatctttcccttcatcaggtcatggctttccgtttgtttcatgaccatgacttcagctgcctgcctagctagctagtacctttggggaaagcggccaacaaaaagcctacgtccccgtcctgttcctttcctcaacctcccacaccgccgtccagttcaaaattcaaagttcaaacacctcatcctccctccggacgctgcgctgcacggccgcgcggccctcctcggcctcgctgccctgaccggtcagcgtcaccgggcgtccgggccagtgggcagtggcagcagccgtaaacccgtataggtgggacgctcatcccgcaccataaaaatcccgtcaggacaacacgggagcggttagcgtgatccgacccaaatctaatctaaacccgtccccgtggattacgcatcattaccccgcatctgctcgtggattttattagcttctcctctcgctacgtttggggtttggtttttgatgggctaattattagcggtggtggaacctgaaaagtcgcgtgttttgtgctttgcgttttgctcgcttgccgtgtgtagcggtggactggtggcgtcgttcgtgtcgcgcaccttttctctttttttttcttcaccgggaccaactggggaagaaagatttggggggtttttggccgtttcggcgtctcatctttcttctcgccgcgcgcgctcgtgtccagtcgccgccgtagttgtacgagcgctatccttgagctttggctgcacgggattcattgcaagggatgcggtggccagcgtcgtaacttgctcgtttcagatcgtgacgctgtggggttctctttttcagttactgctgctactgccggtaccggctgccgaggaggggaatgaggatgaagacgctggcgtgctgccggcggcggccgcaggacttcagcatcgacatggaccaggagcctgacagtaagcctgaaatctcgaatctcccccgtttttgttttcctgcctcattttttttttacatttctttttctgttcgtggtgttcttgcccggttcatgtgcgtacagctgccgcattgtctcatttcacggtgtatttgctcatttcggtcctcatttctcaagtgcatgagttggttgtaagtactactagctgtagtagttgttagttgttggatcgatggtagctgcagcatgtctacaagccccgggcaacctgctgctccaaatctggccaagatttggagctgcctaacttttcttcacaatttttttacccgcacaaccaaaatccatacagcaaagaagtaggagcactagtagtgtgatgaaacaaaaattttcagagatatattttcttctagtactagatgtgaacgtgatagggtcatggagtgtgggatagcgctggtgtcagcagcagtagatttggcactgagcagtcacgaccaacgcgactgttcatgcctcacgggccctcctctcctctcctctcctctcctctcctctcctccctgctatgtgcttggtctccgacggaggctgcagcacagtgccatcagccactgacgttaggaacgtgggagtaaatgggagtcacgaaagatgcggcaactctacgagtaaaaaaaagcaaacaagagagagcaagcgagtcatggcctctgctatcttgatctgacgcgaatccgggcggcgccggccgcattcacgcctcgccactatccaactgcttccggtctacactagtcttgacttttaccagcctagtgatatttttatactcttttgtttgcgtttttgatctctctcttgtatccgttagcttctggtgtgtttgttcatggagtggtagtgcaggagtacaagactacaagcagtagaaactagtactagtaccttttatttttggagcggcgtgtgtcggggaccagctagctactttcagctgggtcaagtgcgacatctgcggcttcattgactttggaggataaagaagtaacgtagtggtaccctgctttttagacggtgagcactgagcaatgtgagcaggcaggaagttggggaggagtagggagtatgacttaacgactaactacaatttagaactataaatcgtgtgcgccatgtgagcatctcgtgaaagtgtaacatagtttttttctgtagggtagataaagaaccttttttctttgtcttacaggggaatctgggaatctcagtggtggttagcagtaaaagggaccacttagaatgttttgaagctatcggctttcaatgggagtgtctgtttgtgggttctgtggtgtcacaagaacctagcctggtttaatgtgtgcctacctgtgcttatccgagctaggtttttagtggtagcaagcttgaactagcgtagtttgtatggaagcggaatgaattatcagcttgtacattgcggtggagtgaggcattaagcgttacagatggcacactgtactatctgtagacagaagcacatggagttggcaaaacatcagaacatttgcaatggcatactcgtactgtcatgctaaaggcattttttttctcaatatcttgagtgtattacggtgtacagtgcataattgctagacttttcttgagttatttgtgaagtgctcttcaaaagaatcattgggtcgttgggaaatatttgtgttaaaatgtatttctgaatcagcacattagagtatactgaaccaaaccctgatctccatgtctgtgcattttaaatgtaatatggcggtataactaattttattcaccgttttcattatcgcaagatcaggctccctggaaattcttaaatttatgtcgcatggtcatctgaatgatttaaaatcttgccaaaataagttgaaaataccaaatgatgtaggggtgatgacgtacaatggccttgagagctgtattatcaacagttcctcttatgacgatgatagtggccttagtgcaacaacgggagcagatgggtgtgtaaccactgattccgttgatgatgaagtctcaagttgctcctcaagtaaagatgtttctagctcttcgttctcttcacaatgccatccactgagaaagcaagaggagcattcactttacgagttggatacactcagtgctgtccatctacttcctctcaaagggaagaagccaatcacgtataccttgagtgcttcagacattgaaaccatgaaggagaagtttgggaagctactgcttggtgatgatgcttcaggaggagctagaggtgtttgtgctgctctggctttgtccaatgccattattaatctctcaggtatgcttaaccatttgtttggaaactatgatattgtccattgtagaatttttttgggtgaactatcatctttctttcctttctttttttgaagtatttgttccatactcctatcatcatgaccaaaatgatcatttcttatgccagccactatatttggagaactctggaagctggaaccactctgtgaagagaaaaaagtcaggtggcggaaggaaatggactggttgctttctcctacaacctacatggttgagctggttcctacaaaacaaaatggagcagacgggtgcacgtttgaggtaaagatccattgaataaagcctgtaatttcactaagtgctgtgtctaatgtttcttttactgcagattatgaccccgaaagcacgttcagatgttaatgtgaaccttcctgcccttcagaagcttgattccatgctaattgtatgtttttgttattattatgttacactctagtaaatgaacatgcatatctgacaaagttgccatctcttttcattttattttacaaatcaaaaaatgttcataaaccatcgttcacttaattatgcaatgtcatagtttgtatctcctaatcctgcatgccacaaatgtgcaggaagtgctggactcgatggtagacacagagtattggtatgtggagagtggtagccgagctaatggccggggcaaaaagaatggtctgaggcagacgaagaagtggtggctcccatcacctcgtgtgccagatatagggttgtctcaatttcagagaaataggcttgtttttcaggctaagctggttcatcaaatcctcaaagctgcgatgtcaatcaatgaagaagtcctgcttcagatacctattcctccagctgtcacggatgctcttcctaaggcaagtaccatttcaagttaacttgtttgtgcttcatgacaatctctgtgaatttcatgcttcttttctccctttaattgatgattgtactgaatatatggtcttaaattcttttgcagtctggcagagctggcttgggtgaagacttgtaccatgctataaccacagagtacattcccatagaggaaattttcctctctcttagtttaaaaacggagcataccgtgctcgagactatgaaccggttggagggtgcagtttttgcatggaatcaaaggatctcagaggaaaagagcaagaaatccccaggaaggcattcctggaatttcatgaaggatagttcatcagaactcgataagatgtccatgtgcatagaaagggttgaaacacttatgcagcttctgaaatccagattcccgagccttcctccaacttttatagaagttgtaaagatccaatacaatgtggtaagttcgccattacataacaaccatttgtgctcgcgcagagcatgtaacctttgtccaaaatgcattatgaaaccttatgaaatccctgaacatgttttgttctgcttgctgaattttttgccttttgaacgaacttactacatatctacgcaggacgtggggcatgccattgtggaggcctactcaagggttcttgttggggtggcattcagcatactgtccagggtagcagagattctgctggaagatgacctgatcaagaagcccaacacccctctggccacactcaagttcgacctctcctccgacgtgtacctcgccggcatcaccgagacgccgccgggccacatccggcggtcgctgatggaccagatcagcctggtcgacggcagcctcgacgcggtcgtcaggaagaagggggtgaagcagcttaggtggtgaaaaaggacatgaagctgtgaagtttttctttttggcagttgtacagggtttgtgatgatgatgcatgctgtgctgcgcgctggctggctacataaagttggttaagttcaccttgctaatacgtcctgtatggaacgggctaaatagtgtatgcatggtaaaagctactagcattggccgcatcgtacatcaacgtttgcagcgatcaaagcgtgctgttgcggtgcattggaccgtagcctgtggttgactgctggatggcacggcttgggtgtgtgtgcgacgagcagggtttatcaaactgtttgggaataagttcaccggaggtccttaacttaacagattttgagatcccttaaccacaaactagaaatgtgtatctctaaactcacacaaaccattcatttaaggtcctatgataatatatatggatggtttcgctgacgtggcatcctagttaataaaaaaaatttaaaaaagtatgtggagcccacatgtcagctgtacattctcttgggcgaccgcggatacgggcggcgggcggagcgacgatgggcgaccgcggatacgggcggcgggcggagcgacgatgggcgaggcgggatgcgggcggcgggcggagcgacgatgggcgagcgcggatgtgggcggtggcggagcgacgatgggcacagcgatgggcgagcgtggatgcgggcggcaagcgagtgcggcagtagtcggcgggtggcaagcgaagtggtttggg

SEQ ID NO: 63292 - DNA, 13848 bp, Oryza sativa
aacgaagcgcgcgccacacgtgtgcggtgcgccatggcccccatgatgtgtccctttttccctgttacgtgtctccgccacatactccgttgtaacaaatcacccatatattttgaaaatcctataaggaattcgttttatttttttttcacaaaaaatgtttcacccagtgtacacacaactatgtatagatctaatattgcagtgaactcaaacatttttttgcaacaaatcactcacatattttggaaatcctctattaagggaattcgtttcattttttgttccaccaaaaatgttttacctagtgtactcagaatgtttcactatgtatagatctaatgttgcagtgaactgaaacattatttccctatttgctgaaacatttctttttatataaggtgaaacaacgtcaaatttaaacgattgaaacattttcgatctacttagcgaaacaattccaatatacttggtggaacatcatgcaacatttaaaaataattcaataataagcttaaaaaaaatttcgtcggaatatatccatgcgtagtcttgttttgaagatttaattgcaacaaatttaatgatgtaatcggatcatgatttagataagtaatttaagagaaaaattagtttaaattggttttgcacgcatgcatgatgtcagtgtccgatttttacatgtttagatcggacgcccgattctaagtctcctccgtaaagttgagttggtatatgataagattgcgccattgcgacatgccgggcggttcaggtccaatcgttataactactatttatttgctgagggtcacccttgtcatcaatgttacattataaatggggtataaataacaaaattcggggacatagaatagaacggaccccatgaatagctgacgacccacttttaggtccaaaacacatcaaatttatcggaggtcgatttatctttatctatatcagtcagtattaattacacaatctaatagagcttttcttttttttttcttttctgcgttaaatagaaaaaaaatagccatatattagatgatcgtattattatggtcatatattatattgagaattcgttttagacaaaaacatgactttgattaaaaagattaccgtggactccttaacttttatttagatgaaacatcacttaaaaaagaattaatggtccatatcaagtatgacccagtataaatgagacaataaagaaatactccctccatctacttttgatagtcatatttcatcttggcacacagacaaaaataagtaattctacttatcatccatttaaatatgctactagtcattcctcgtaaacaagcgatttattaatatttacatttctcaatgcccatgtagccaatcatgtgtggaagaatgaagagtcatgcattaaatccaagaaagtcattaagatgataagttgttcgaattgaaatatgtctatcaaaaataaaattttcagatttggaaatatgactatcaaaagtagatggagggagtactctataaatgagactataatgttcaaaccgagcaaaacttgatatttattaattccaaattttagaattattaaatcagaaatcatactaaattcggactccaacacatattctagcagaaacttattcataaaatattaaatttaaaaattgcaatggaggatatatttattaagatggattctagtagtacatattattctgtattttgtttaataaaatggaatctatatcagtattaaaacattatcgatggccctaaccatgattctcccatcttctacttatttgaattttgagaaaacggacgatatgttgctccattcgcgtggttcaatgaaaagccattcaataggatacaccaaataaaataccactcaatatattgtcttatgattagaatgtcacggagggttttaagaccaaaacgaccctagctggttgagcggagtgagagggagagggtagcgggcgcgacaggaggggttgtctgcaacgacagcgaagttgatgaggtggagggagaggaggaggaggcgatgatacgggggtgggggttggaccgcccttggctccacgaaggaacggcgagggcgcgtcttccagcgtggcccgcccgcacgctcatcgtatgttgcacaccgcctccaacaccgcctatgctagaggactcgctaggaggcgacagtggggacgacggggtggagccatggagggaggagggggaggcgacgacgtgcgagggtattgccctcatcagctccctgaaggagcggtgaggacacagcctctagcgccgcccacctgcacgctgtttgttgccgctcaccactcccctctccccttctctccgtacacaaccagttaagggcgctttggttttaaaatcatgttctcctgaattttggcctacaaaaagaaaagtgaagactaaagataattaagataggactaggggtgcacagtcactgctccaataagtttacgcaactataccttggtacgcgtactgtgatgtgtgttattttttttttgagaggtaaaagcaggagctctgcctatttcataaaaggagaagagagggaaaccgagtttgtaccagcaaagttacaaaaggatcccaaggggaccccttccgaggtgttgacagacacctgtgatgtgtgttaaaccctgtgatgtgtgttaagtgtcatcaaacatatcacctccaagcagttgagaacagcactctgcaggtttcatgtctctttcttgatataaaacaagcaaataagagatgatggaacgtcgaaaaagatactctcgaaatggataacgtgacaagcgatcaatctccgttgtttaaaaaagaagaaaaagaaatgaaagaaaacgcaacaagctattccaattaatgcatgccattggatctatgacctagtagcaaacatgagagagatggatggttggcggctcgatcagcttgcatgaaagcaaccggaggaaaaagaaatattatcccatggctcgttgttttgtcctctcaacccagacacccagttcttgatttctagcaattaaacccggtgtaaaatagattttgtgcaaattattagaacggattgtttatttgattaaaacgctaaattaatatttgataaataaacttcaggaatagcttagatatcgatcacatgaaagcttattattcgatggtgcaaacttattgtttgaaatttccaaatcctcaactcacagattcaaagtttcacattgaaagtgtgaatattaaaattacaaaagttcactaattaattaatttaagagtaaatttcatgtaaccctagatattatggtctaaattgcataaaattactgggttttgacttttatctaccacaatttcaagttctcaaatttataagtttttatccatcatatgaatgtcgcatctatgtaagcaaagcttttttgaattttgatacaggattatataaaaatgattaatggtgtgatttataaattttaggaccataatacttaaggttatgtgtcacatgccaaagttcttgtagttttgtgtaacatataggtgggtcttatcaaatttaagaaacaaactttcactccttagcacttatgtaatttttagattttaaaatgaaacaagtcccttatttttacgtcgaatttgaatcgtatccctaaagcgcaatactaaaattgaatcaccatcttataaagccggattaaataaggtcctaaaacactatggatatctgttttagctgacatggcatcctactcagaacaaagaaaataaaagtatggggcccacatggaattgggttgcgtctcccctctccttatctctctcctctcccttcttgagctcatgctcgttggcccatgtcaccggtcagcctcatcgccgctcccaaaaaagacccgtattcagacccgatatccgtgaaaaatcttgggtacctgaattctttacccaaatttatcccaaaataatgtgttcgggtgggcgggcgggaaatatccgccccgttttcaccctagtcacagtcttctcgccccatgagccatacatagccttcccacctacctcatcatcgtcgagctcctgatttgcgtcgaggtgcacaggaagagccacacaacagcagtggccgaatgtcgaggggggctctcagggacctcaagccaccaggccgcaccgagcctttgccttctgcccctcgcggtctcgccgcccagccgatagaaaggatgggggagagagaaggggatgaggaagaatatgttgtttcacatgcggatcccacgtgggtttattattattattattgcttctatcgccatatcaacaccacaacaaccaaaaatgccccctcaatactgctgtaggacccatttgacctggttttgctagattagggacgcgttgtatctgataatgtgcttcaacgacgtttttcaaactcaccctcgacagaagggacctgaagtgaacttatttcttttaaatccaatatccagcccaagcagggccagcacggcccatctccccatcggcgtggaaagtcgtgcatctgatcgtgatgaacggctacgattagaacaacgcggcgggggagaagatttcaggctcagaagcagccgccgccgccgccgccgtctcagccgccgcgccgcccccccgtcgaccgcgatcttccagtccgcaccccgccgcgatggccgacgccggcaagcccgaccccgcgtcgccgccggaggcgccgtcggcgaagaagggggtcttcatgcgccgcatcttcccgttcctcctcgccgccaacatcttcatcggaggtgagagaccccctgtgcctggatcgatctccctccctcccatgtggtagacatgcctcttagggatgatgcggttctttcgttgtgtggatccgagcgagaaggatcgcaaaagcctagtggatggatgatgttaggcatggttaggacttaggacttaggagcggttgtgcgactgtagggttagctgtagtctcaagctaaatgcgcttagtaattgttcatctaggtcacctcagtttggtttcagtgttatgttgtagatatgatgtgcatttttactaacacatggagtggattttggaccatcagatagagattattattagagcatttgtgatactagtgttataggattgtgtaagtaggatgaactgacatagctcggttattcctgggcctcgaatttactatcagaagcaacaagcggaagtgtttatgttctcctatagtgtttggttttgtattatgcaataatgtttgtgggactaggtggttagctccttgtattctggaatgatggatggtttgtggctgggaacatcaaatttcgcttataggggaccgacaaagctacttcctccgtttcatattataagactttctggcattgctcacattcatataggagtatatgttaacgaatctagatatatatgtgtgcctagattcattaacatctatatgaatgtggacaatgctagaaagtcttataacctgaaacggaggtagtagaatttattgctgcaggagggataaaagaagcaagttgtggacaccaagtggtaccaaatataaatacctctattttacatggtaaactgatgttttgtattggagtatatttcgcactggcaggactagggtcaaaatacactgaagcctggtttgggatccacgatctgtgagctatccatggggatgggctggggattgtgggttgcaatccaaattttagctacatttcttgccgtggagtttggattgtctagataaaaaaataagcgagtgggccagtgtctgctactctgctctactatttagtagggagttaatgggtgatattgagtgaattcaatttgtcaatgagaaatttgagggctttgctgttacaaagataaattcaatatatattttacgtattttccattttagtcaagtataattacaatgaatcatactgggcaatagtagcattccttatagagtttagaatgtatagtacggtatactcatgaatcttttctattaaaggatgggctatgcctcaaactagcttgattttcttgtattctgggttctactgaatggagtaaatatacagctcgcttgacgctgtgtgcttgtgtatcgaaagttacatttatctgctggatttcttctttgcaagaaggaaagggaaatactgtggtggtcatccatgagtgtaaaatggccacagaacacaaaaccattggcactaaccgtttatttgccctttgtcccacttgcaatatgtctttgcaactactcctggcctttgcatattgaaaatattgaaagcttaggtaggtttgcctctgaattctgatagtacatattgatggtactgttcatttcttgcgtgttgactaatatttggtttactgaaagctattttcatacagtaagtttgttccttttacatgcagtttacgtatttgcaaagacctacaagagagaccaggaaaagaagaacgctcagactgctgctgctgcagctgcagttgtagcattgtcatccccagctgccccagctgctgagactgtagatcctactcctccaactcctccacccaaaagagtgcttccaccaatacccgaagacgaacagcgccaggtctacaagtggatgctggaagagaagcggaagatcaagccacgcaatgctgctgagaagaacaagatcaacgaagagaaggcgcttctcaaggagttcatcagggcagagtctcttccccgtttgtgattagcatttcactggctgccctgctggccttgtttttttttttcttttgcctgctgttccatggaaggacatgttctggattttacacttgtctcttgtttgttggcagaaacggtagcattttgtatggtgtcaagtaatcatttgttacccaaaatactgagtcaagtggctccagtttcagggaactctggcattttaacatcattggcggcttggcgctactggagattttcttttaactaattcttgcctcgaagttctttgtctattttggttttttttaaggaggctgctataccacgggattctgtccaaacggtatgatactaagcaagtatcaaattctgataccaatcggtaacaaatttggtaccccataggtgctagacagtgttgcactaataactagacgaccatcaaatttttatcttttttttaagcatatataggcttcatctaggcgtcgcatggcaggtatctgcacggggcgagcttcatatagagggagatcatgctaaggccctctttgttcaggcttagacttatttgcttagacttttaagtcagcttattggcttacatgatttataagccagtgaatttaatgtcttaagttaagtggtggagtcatacatctatctcatataagccaaaaaagcttctccaacctaactattaagtggcttatggcttcaaaaaagccaaacgaaaaagctgcttatttgtttagacttagactttttggcttataagttggcttataagcctaaacaaagagggcctaaggtcggtgatagctacttctcagacaggttatcaggttacaacgcgcaacggatgtagcttgtttcgttgaaaagatttattgcgacgctttattgcttattcaaatatggtacagtttcagaatttcagttccaaaccaataaatcagaaacaatactgaaatactgaatgcacacatcacaatggccaacatccaggattcttcagatggggataatatggcaacttcaacaagcttataaatggtctataagtgtacagaaacaacccatcacaactcaattcatcttatgccgacgagttatccccatcctgcagacaaaaatagcaactcccagggtcagtcatatgaaaacactgttgaaacagactgtaagagacagtgcctacaaagaacaacaggtgaataaattgctttctctgcattatacctcactggatgtaatgaaatccaccacggcatcagaaagctctttacggtgagcagtgtagcagtgatttgctccctcgatgacatgtagcttgtggttcggtatatgcttcgcgaattcgtatgcatcttccacaggaatgatctcatcggctgaaccgtgaactgtgaaaaacctgaacaaagacaaataaagttgcctcaaaatctggtacaactggaaacctctgtccaaaacataagagatatgcattcaatatttcagctgtgggaatgcaagagaatagcatgttcagctatgttaagcacttatactgctgtttatttgaatataggggtaaaagcggttgagttagcttcctgacctgcattctttgctgatggaaaggcatgctttatgcatatcagtggtcaatcgttccatcaaactctcttttgttaccttatataaaacctttcctacattggaaatgacggacagtcaactaatgcgcgtgaaagagaagtaagcatacacagtgtatatgatttatctataaagtatctttgcaggtaaaggtcgcaataactgataggaacttccttacctgagttggttttgacatcaatgtaaccctctttgtcaattatattcataaactctttgcctagccgttcttcaatgcctttctccaaatgaaatcgaccagagagattaaccactgtgcgcacatcgtcatagatagaggcatacagaaccaccacatctcctcctggagataagaaatgttaaattcagtgactggatttttaagattaccaagtgtagaacttgcaacaaggcatggcaaaattcattgatcaagggatgcgatgtgagacagtgagagtaaattaaaaaaatccagaaaaagtgctatgctaaccatttagaaactttatagtattttctagcagtagattgttttgatgttacagtcaatgtgatagaaaaatattcagccatgaagttctccaccattttaactcgtgcatagattgtatatgaaacaagagtataatgccacgaacctttgctgtgaccaacaattgctttcacatcatatttctcctgattaagatgtgaaataacagaatgcaagtcatcagcctcctttctgtagttcccgtactggaattccccttcactttctctgaaaattgtatggtgacaggcttataaatcatgcattgatgccttcaggggaaaaaaagtgtagatatgaaagacaagtaacatcttaaaattcaaaggaacaacagataggaacctcagctcatttagctaattagctctaacttctaaccaaacctctagaaaagggaagtggctgccacggatgctgaagaggcagcccactggcgcacagcaggagcgccaatctgatggcctaccctttggtcttccacccacacaaccaaccgcgagatgtagccttcaattgctgttattctttttcttaccctttttcactagtttagctgatgtgaaaacaaagctctacttgaaatctcaatacaaagttacggaagtcttatgcatattcccgaaaagaactccagaaaaggataaaattgaatgccaccggtgaaattaattaacagaggatagaatagcatttacaacactagcttttgtgaacttaaatcagcatcgtacatattatctctagctccatgagcaacctacccatttccactgaaatcgaagcggaagattccaacccctttcttggtaagtgcattcgctagatcaacaatgatgctatcattctgaaaacaagagaccaagagtcaagcttcattacgttggtaaaaaaaaaagctaaaaattagaaaacttgttgcttctcagacaaaaatcgagaaaaaaaattagtgacccacatattttgaatagtacaaagggaatttcttctgtaacgacatatttatgcaccttggaagctgtaaagccatggcagatcactacaatcttgttggaacccatgtgctgcagcaacccaacgagtttctctccatgtttattcgttaccactaccctttcttcctgagcagctgtttagaaaccatataatagagttagagccccattgtttcgcttatgcttatgcatataagccaaattttaaaagttaaaacaacgagaggcccttaattattatatcggagtaacataatcttcttctccttttcttccccttcttttcgttggccaaaacatcattgaattatatacacacaaaaagaacgccctcttgtccgtcagctagcaatctaaacaatccacgttcaagtaaagaggatgaatccgggaggtaaaagaaaaaaagaaaaaaaatcaagggggactcacagggaaccgatgaaccctgggaagaggaggagagcggctccgccatggctgccgtatggcagcggcggcggcggtggcgtgctccggattggatcggaggattcccgggggtgccgcagcgaagagaggggggaagagggatcgccgaatctaatcggagagttggtttgggtagctaaagaactgtgttccactagtgactgacagggaggcaactgaaccctggagagggagagccaggttctacaattctgacaggcccttccgtttcggacactagcggaattcgaaatttcgtgaaatcaagtgaaaaaccggtaaattccgaacaaatttcataaaccaaaatttgaatacaaattccctaagtttaccgacaagttcttgaaaaccggttggttttggcaaaattccgatcgaaatcatcgaaatttcgatccgtaatttgtaatagaggtagtttgctgaaattttttttcttgatgtaagttttagtaaatacacgcaatacatcatttttttcgaaaatttatatcccaataggttctatgaatatcatagtatttataagattttattttatttttttcttttttatcaatttaaatttaaatttggatgaaactcctcgaaatctcagacggtttctactttcgagcctcgtcgaaatttcgtgaaatccgaccggatttcgtcggaattgtaaaccctggggagagccgttggcttgggctgttggaaggttccctggcccgttgaaccttggggcgtacggagcatagttttgtagtatagtactatatgagcttctacaaaaatggtagaaaattgatgtcaaacgtatctgaaagctaagtttgtctttgtgccgtgtgtgctactccctttgtattataagtcatttaacttctttttttagtgattttttttatgttcgactaaatttatagaaaaaaaatagtactctctccaggctgataatacttatcgttttagacaagggtaatgtcaaactttagaatttttaattataaatcttttttgaaatatttgtcttttaaatatggtgactacgtatatagattagtcttaaaaagtactttaataaaatcatatatttgttaacacttttatatatattataatgaaaaataatggttaaattgtttttttaaagacagtgcccttatccaaaatgacaagtattatcaactcggagggagtaacatttacaacataaaattagttttattaaatttaacattgaatatatgtttgtacgatatttaacattgaaaaacatggcaaaaagattcgaaaaaaaatataaaatggataacataaatataaaaaaattattagttttatattattagtttctgttgtttctttgaattttagatgttacttgtctttcagatctaccctttttcccctgaaggcatcaatgcatgatttataagcctttcactatataattttcagagaaagtgaaggggaattccagtacgggaactatagaaaggaggctgatgacttgcattctgttatttcacatcttaatcaggagaaatatgatgtgaaagcaattgttggtcacagcaaaggttcgtggcattatacccttgtttcaaatacaatctatgcaggagttaaaatggtggagaactttgtggctgaatatttttctatcacattgactgtaacatcaaaacaatctactgctagaaaatactataaagtttctaaatggttagcatagcacttttctggatttttttttaatttactctcactgtctcacatcgcatcccttgatcattgaattttgccatgccttgttgcaagttctacacttggtaatcttagaaatccagtcactgaatttaacattccttatctccaggaggagatgtggaggttattgcgacctttacctgcaaagatactttagagtgcaggtgggcccaattattgcagccgttggattcggtttggatgaccgagatgcacggtatgtcatcgtgtgacatacataccctatgtcactgaagctgaatccgggagggtttcagtttgggggctagtgtatcacgttttgcagaaaaccccatatggttgtcttgtttacaacgctacccttagaaacggaattttctcttcttcgcgttgtattttactggacgccgaggggttatacataataaatacaatgggggtgtcaggctgccgagtacgtatgcgatattccgtgcaaacacgatgatctttttgcaaaacaatccgctagggtggaaaataacaataggcccatctcacccgcgcaagccgaggatctgaataataccacctcggggagttgtgcgggagcgggtgtgaggaggctacaaataggagcggtatgagatgggtaggaattaaaaagggtcggttggctatgtgtgccacatccatcaatccatgggtgttgtatggctatcaagacatatggccggcataatttgtggaaatagatagggttggctcgctaaggccgaccctccattccctaattgcaaattgtttcagtattccaaccataatgtgaccattcataatcataaacttcttcatattttaaaataatcatatataaatggatagccacataaaatcaaaatgaggtcaatattccctatagcaaaggaatgtgaaacacattttatagaaaatatatttttatttgttttatggaatattataatatattttcttccatcgaaagcaaagcacatgcattcaactagctatatatatatatataataccttggattttacgttatgggtgccccaaaagcggtgttgtgaaatttacactacattttcttctttttaagtagaaaattaggtagggttttttatagatttttttattttcaattcatcgttaaacgatgagcaacttgtgataatgctaacacctagtcattacaccagaagatacacatatgtatccatatgtggaatttttttatttttacattttttattaaaatattttaaaaataatttttagttttgaaaatttacaaatctagacgcctcacgccctctgggagggcgttaagggacctaaatagccttggcagttcgtcgtgagctcgtggctctctccagttgatcgagttgctgttgtataaaattgacgcgtatcagaaaattactctgccaactggaccaatcaactgccagcggttccgccagcttgagaaggattgatcagccgcgcgcgcgcgttgacgttgtgagttttaggcccataaggcccatgcataacctggcggtggcgcgtatacgtgaggcggacggcgcccacgtcctgtattttttttccggaaaagctaacatatgtgtttttt

SEQ ID NO: 63293 - DNA, 20079 bp, Oryza sativa
ctgacattttgatcacaggaccctttacatgtgtaaacaattattgttgcccaatcaagtgagtctggttcattttcaacatggaagtaatggagcagttgtggcattatctgcatacaaaaggaaatagcgatgaaaccatggaaggatgtaaccaacaacacaaactgtatgagagtatgccaatcagtgaaatctatttaaaacagtccattcggctacaaggttgcctttcctaagacttaatatggtcagtaattagctgaaacacgaccacgctagaatgtccacatggtatagaaacgatgttgtaacttgctgatataattgcattatggtagtgttcacaattatgtgattaattcatttactagtggcatgtacgatgtgcttaaatcacagtatatgttaagagctccttagcgttatcttatgtaaattgatttcaaacatacatgcatacagctaaatacctgataacatttgtaattgaaacacgcatcagtaaataacagaaatttgccagtttgcaatggagaggcctctgcaaatcagcaacttaacaataccaatgagaatatgcgataaatggtgggacaatgatatcataggtttgcaaattcaatattctcttggtggctaaaagtaaactgtaatcttaactctatgaattacatagaagataacactgttctaaccaaaagttgtgaataccatttactctggttactatagagaccagaccacacaagactaggttcgcaaggtttgctgtgacccatcaaatatgacctaaccctgcagctggatacaggttgggtggctaggagcaacaagctaacagaagtatttcagagtatgcagttttcatgacaggatggatgcaaatgctcttcctaaaatgtaggtccataaaaacatgcatctacaagtcttttctgtttttttagagagagaagtcttttatattttttcctgttggtcaactagtaaaatcaatagcctaagatatgaaacctgtccaacctgaaattcatagcaaagtggaccattacagtatatacaagatggcttagctgcattggttagagacccagaatatactacccaaagtggttttgcagttgattccctgcagtatctgcataacgaagtaatcaaaattatgcttaagataagttgtctgcgaagtacagacatgcaagagaggtggggaactgaatatgattatttcaagtttaccatatgctactgatggcacatttcactgcataaagacacaaactacaactggagttacaaatgtgctgaagtgcaaacatgctaggttccaggcttccagctaattggttattaaacacagaagtttcccacagtacaataaaacatcgctagttgattttgttttccaagttgatataccttcccgtcaactgacctcccaaaccacattaaacggtcccagtggaactgacaacttaagcctttaaaatttcaagaaacataatgctgaactcagaaacccatatagtattgaagcccatgcaaccacaaaattaaacaaagcatctattcaactttaaaaggtaaatgaagttccaataagagttgtggcaaggcactaccgcactaggactttgctgtagtttcttaattcagaattgaaaacactgacaaagtaaagacactattccaaaaagtgataacaattaacaacccaaagtaaggcatccaaaatcacctcaaaacttgatcctgttctcttgagatgcgttctagaaaagatgcccagcatctattgtcatcatcaacctgcaacacaaaaaaaaaaagtaataaataacactctagaagtgcattagcaaacatatggcaaagcataacaggaaaacaaaaacctcaaactgatccatcaatgatgccgtcatgtcatcctcttcactttggccttgttccatcaacaattctgatctattctcacaactagcaaaacaagaaaccttttcggtttcatcaaccaccatgtattcaggccatatattgccagcaaatactgcaaatagttagaacaacaaattagatggagaaatgtttattttatgaaacatggaggaacaattaagagataaatgggcaattaccttttcctgcatctggcataatagcagaagcattatgtgagccagatatttgatggcactcattcttgtgctttgcacgccaatgcaattcctgaggaaggatattaccgagtgattaatccaaaacagtgatatctgaaaactctagcagcgcaaacaaactgattaaactgaaaatacaatataattgcctggttagttgatacctgatgcttctttgaacagtaactggatttcctacaacgactacaaactttttcccctttccatgtgccacaccaacaacaaaaccaagtttgggatcctaatagaaacatttgaagacaaaaagcataagtttgtgttcatgatttatacacagcatgcataatggattatttaagcaatatatcatatcaaagcaaagtgtttcctggacgtaaagctgtccataaaattatcaaaagcatagtgttttcaagaggaaatgtgagaataaaaagtgcattttctacacaactttaaaagattgtttcaacaagcttgtgaaagtttcacaaaatagacggtgataattcctggaattcagcttatgattaacgcacaaaattcatctgaccttcctttatcgaacaaccatttatgcaataacaaatactacctccatacatatatgtatgacgttggctagtataaatttgaactagtttcctctaaaaatttgaactagccaacgtcatataaaaaaaactggagggagtaatatagaacagtgacaaggggtattcttgtgagcatgtcccaaaattgccatacagaggacaccacactgcaagcaccaaacaagcagaaagtatatcaaacaagactaccttctgcacattgtgatccgatggatccaatacaaccctcaggctctttcaatgaataatatgaattaatttggggaagttggcaccggaaaactctaacactgcaacagctcaccagaagaggttaacagaatatacccaaaaagaattgggtgagaacactgtgtagaagaacaacaaaaatattatgccagcttcaccttcttctaggattacctgccctatccttcccctgctcatgctgatctagtagtaagcatgccatggatgggcacatgaacacaaataatgtgcggtgataggctgtctccttgcactgaattggtgcataaacctgcatataaatgattgttaacaaattgatggcttatatgcataaacctgcatataaacctgcagtttgtcatataaatgaaagacaacctggagaacaaaacgtagtggttcgccacagaagtcacagcacctggacttgccagatggcaaataacaggatcaagccaggcctgaagaaagcaatagatttttcacttaagaaagttcaaaatggcgttctaagaacacatataacgcagactgtaccgttgtacgtaccggaacaccgccagctttattggggaagtgttgagggagaagaagatgccagtcctctggtccctctggctcctctatgaaccctaaggttacttgaggatccatgtcctcatcatcctcgtcatctacgtagtcattcttgaatacagcgacaaggtttgtttccttattggggttgatctgaaggctctgaagcttgtcagtgtcaggttccatatttcacagcaattgcctgcaaggaaatggatgcaggaggggatgagtgtcaccaatccagctgaatagaaaaggcaaaacatttcgctccaacaggtgcaaaagggtgcgaacacagagcatgagggtttagttcagcaaccaaaaaaaagaagggaaattaggatatgagcatttcatgttggagtgaggtataattcttcctaactatctttactatttcctccttttcacaatgtaagtcattctatctatctagattcattaacatcaatatgaatgtgggaaatgctaaaatgacttacattgtgaaacggagggagtaattattaaagtgaagtcggaagttcagatttcagcattttacatacagcatgcatccgtatcaatcaatcaaacaatatatctaatgctggccgtgatgggcagtattgattagaccacgtgtcacactgtcacctctcacttttccgcgttcaactttgaccgtccatcttatttaaacattttttgaaaaaattttaaaaatataagtcacaagtaaaaacatccttcggaaatagattagataatatttggtagatgacaaatattaaaaagaaataatatttcattgaaaaaagggaagcttatatgattttggactgatgagatggcgctgacatcagcgatgacatcatcgccggcgacgacttcgaagggcggtgctccggtgagaggcgacagcatcgggagagagagagagagagaggaggcgacggcgaactcaccaatggcggcggagacgagaaacggcgacgggaaacggccggcgcgaggtactgtccacggtggaacgactttccggcgacgagcggcgacaacggaggggtggccgggcttcgtcttgatgctgcaatgccgaaggaggaaacagtgacgaccagtgaagacgacaacggcggcgcgacggcgcacagcggctggagatcaaaacacattggcaacccactggttcacggcgaggacggcttccggcgatcttcggcgaatgaaacgtggaggccggtcttcctctctttgctgcggtcctgttggtggcgacagcgctgacagaagatggcggagccgacggctacagctggctggagcggcggccggaggtggagagagaaggcggctacggggagaggcggctagggcatgggagctcgagctacgggttggaaacgagagaggagggcttgggaagagggagagatcggctcgggaacggatggattcggtgaaggaaaattaggccgaaatccgcgggattgagcttagatttgatgggctttattgggaaacgtagaggagatcaagggaaatccgttcccggaggccggatttggtgggaaggtggcggcggcacagtgcacgggcacgggagctcgggtcctggctggaggttgaagatgaactagaggtggccaaacgggcggcacggcccggcccggcacgggcatggttccggcacggcccgtttcggcacggcccgttaggcacggctgatgaaacgggccgtgccgtgccgacccacgtgccgagccgccggcccaagcacggcccgtggatggccgggccgtgcccgtgccggcacggcacgcccgcggcccacgggccgttcgggccacgggccgtgcacagtgttttttttttttaaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttggtaatgttaaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaacttacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaataaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaaagttagagtacaatcataaaaagtttctagaaattggtaaaatttttgtacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagctctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccacgggttattttcaaatttgaacggtcaaatagccgttagtgccacgtgtcgccttcccgttggaccgccgcccgccctgtcacgcgccgccggcgctttcggcctgacgggccgcccgggccgtgccgtgccgcgggccgtgccgtgccggcctgctacaggagccatgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctctaagatgaacaggcgcgggtgaagcaaactagacctttttttctgggccaaaaagggcccaagctgaggagaggatttttattacttttccaattaaccaatgaaatgaactacttccaatgctcacataatttcatgaaaaaaatcctgaaaatacttggacacttaaagtatttaacaaattaaaatcagatcatttaatgattaatttattatttaaatattattgaaatgttcttttattattaaaattagtaattgagctctgaaaaatctgaaaaaaattccacagagtataattaatcatggagagtttaataaaaattaaatccaaccatactttatatttagaaaattttatttcccacatttaacttcacttgtaaattaataaatatttaatataaattctaagaataatttattaaataatttataaatcctgaaacgaaaatcatgatgtgacaatggtttctgccagtgctcctagctcccgcaatacccccgtgcccctggccattgcacatcactcggtggctcggtgccattgacgacatcggcaagatggagacaaatcggtttaagagtagtaaaaaaaaatactccctccgtccaataatatagtaacctagtaccggacgagacacttcatagtacaacgaatctggacagtaagcctgtccagattcgttgtactatgaagtgtcatatccggtcctaagttgctatattatgggatggagggagtactcgctaacatataggtcccatggatgtttctttagctctttctatataacagccacatatatgctatgttagtacaggtggaccaaatcagcgtgccaagccatcgaaaactgcccttaaaaccacagagggagtcattttgtgttgttttaatagttagaggggtcgatataccctagttttagggtcgagggagatgaataagattgggccactagctgagggactcagattggactttctttcccctattttcacagttggttttgtgctgggcccaaaataaggagggcctctcagtcgcccacaacctcagaccaaaaggcttgtgcactcgtctctcatctcgtcctcctcgtgctcctccgccaaaaccccaatccaatcgggctccgactccgactccgaccaccgcgccggcatggaggcggtcatcgcggagtgccgccccaagcctctcttcaccaccgggcccttcctctccgccgtcggcggcggcggcggcggcgtcgaccgcatctccgggctccccgacgacctcctctttgtcatcctctccaagctccccgtcagggatgccgtggcgacgtccgccctctccccccgctggaagagcctctggtccagcgtcccgctccgcctcgacgacgccggcctcctccaccgccgcgacggcacgcgcctcggccgggaaggcgtcgccgccaccgtctccgacgtcctcgccgcccacccaggccccgtgcccgcggcctccgttgggtgctgcctctcctccgacgaccagggctaccagctgggaggctggctccgagccctcgccgccaagggcgttcggcaactgtgcctgatgggcgcgccatggtcgacgcgcgctgctctaccctccgctgtgttctcctgctcatccctgcggcgcctcttccttggttccgtgcaatgcaactgggacctcataccagaccatgcctgcttccctgagctacgagagatccagatatgcaacgccctaatgaagagccaggatctgtcccttgttttggctgtctgcccagcgcttgagacagtggagattcttgcgagccgtaacaaaatccccaccgtgcgaatgagtagccatactatccgcaatactttgctatggaagtcggtggccaaggaagtgaacgttttggacaccccttgcctcagcagggttgttttgtggcaggatcttctgctgccccactcaagatataattctaaggtcacaatcagccgtgccaccaaaatgcgcatttccggttacctggacaccggcatcaacactttggtgatcaacgaaaccacagttaaggtatttgtccctttgttggatatatatctctaatcatatcgaatctgtgaaactgtgttaacgcgttttaatcgttgaatttgaaggtaaacacaaatataagcttcaagacacttatccccagcgtgaaggttttgggtctctctgttcatttcggagtacgaaaggaggctttgatgtccatcagcttccttaggtgttttccagaggttgagacactacatataactgtgagatttctttccttctttcattcccgacatatatatacataaatgtgagattgcgagatagctgtctttcttctttcattcctgacatatgcatcattttacacactcactgcagccattctttcattcccgacatatgcatcattttacacactcactgcagccatatgttcctttgatagctggaggtgatcaatttttcttcttgtgcagagcaaaacggacaaggcttcagaagccgaacaattcagtttctggggaaaggttgatcctgttgagtgtgtgacctctcatctcaagaagttagtgttccatgggatgccatggtgtcctggaaaccttgagtttctcaaattcatcgtggaaggggcatacttgctagagaaggtgttgattgttcttcctaaaggaacttacactagcatgcatagcgttatcaccaaactcaagttagcacctttgacctctgcaagttgggctagtcacatctgtaaaatggaggttgtccaatccagtcaaggaactttgagctaccaaagggcatctgatcattccgtcgatgatcctttagattattccctgtaggctgttctatctgtttgttgtgattataacatattgtcgatatggttatcctttaggtccttcatgtctgtatgccattttcatgtgttttggcttgttatctagagaaaaatgtatggtttgttggatatgcttagtactatacttgatggggtgcaagtaatagaatgcagagcatccgatgtgtcagtagttcctctccattacttcttgtggcaagacagcaagatactctactctcgattttgttgcctctgcttctgtttcttgtggattaattcatcatgcgtcatattgggcggcatcggtctctcatgtctgagaattgtagtaagagcaggtacaatagcaggctataagccagctgcaaatatattttaaggagataaatgaggagagagaagagcagcgggctacagatttgtagccagctgtattacagactccaagacgcagtgtgtgtatgacaggtgtgaccaggtattaatagtgtagtatgtaactattgtatgaatgagacattagattggctatagatgaattggagctagtagttggctatactattaaacttgcgagcaacagatgtggaggaagtcccaacaaaatttagagacagcataaaacagctgtaattccattcgagccaatatatcttttttccttcttcttccagatgttaactggttactatagaatttgttcaattagatggaaaagacaatctgatttagcgaacaataatgttgtggtcgtaattaagcacatcagttttgggctaccagaactggtgtcacttggtaaggcctttcgaatataagttatttttctctttttttttaatcaactattaagttgttctggcaaaaatctttgtaaattctaaacaaggcttggttacccaacattttgatatgtgcttggtccatctccaatgcagcttgtacatgttcgtgtgcgctaacataattgttagaaacatatgtacggtgtgattgtggtgttatctaccaagatttaaatagacttaaatgttggtgtccataaatgttaaggttagtgattttcggttagtcccgtctttttccaatgtgtgttaagacggcgaacctttaaatacttatttaatagagttcaaatttcatcgcagtaatagtaatactatcgtttatcacaaattatccatactatcttttgatttgattataatttcaatttagatgggacctatacccccacacatttcaaggagacgataaagtacttttatcaaatgctcgtgatgaagattaaggacctgtttagattggtgtcattttaaatcattctatttttttaatgaataaacatgtggatgtagtttgttatcaaacattagttagtttgttatcaaacattagtaatacatagagaattttggcaataacacatttagccaattctaaaaaaaaacttactttaggctgtgtttagatccaaagtttggatccaaacttcagtcattttccatcacatcaacctgtcatacacacacaactttttagtcacatcatctccaattttaaccaaaatccaaactttgcgctgaactaaacacagccttagcattgctaaattttgaaaatattcattttggcattaatatgaaaatattcacatacttaatttcgttgtaaagatggatgagggttagagctagaggttgattagtaagtactagtaatactcgtagtagttttgcgctaaacccagtccctgcccatttcgccctccccggccgtccccgtcgatatcacccgagccctaactcccgactccttcctcgccgcgccgccatggcgccccctcggcccgcttcaccacagagcttgccgcccgtggctgccacccgatcccgcggtcgcccgtacgagggctggactctcaaggagctgattggggaggtgcgccgtctacgacgagccgcctcctcggcgccgccccggccggcgggcgtcctcgacctcgaccagggggacgcgcgcgcctcggacacggtcgccccctcgccgccctcaccgtgtgaatcccaggagcaaccccaccatcttggcaaggttttgagtactcatcctctcatccacgtccttttccaagctcaaaccccccaccctttttaatttgttcgttcgtgcccgcagaggctggaggatgtgcttatttccctacgggatgtcgccttccagttcatcaagatcggtcgacaagacgaggcaagcactacaaaattttaacgcgttgtctctctctctctctctctctctctctctctctttaaaaaaaatctatatatgccattccaaacgatagcattttgggggaagaaaagaacagtggacagctaatcatgtttacagtaggaacaaacgacgagacattacaggttttcagatagaaacaaagatcctgaagtgcgtaggattcgtatcgtgactaacaaggacataatactataatagccactaggcacagaaaatgcttcaacatggtatgcagtgtgcaccctcgctgacaccagtatgttgtttggtagatgctttgcaaaattgtatgcatctcttgtcaggaatgatgccattggcaggacaatgatctgtgaaaccaccagaataaagcacatatatcttggcttagcgacacatatatagccatgcccattgtatgcatcatgaacgacttacacatggactagcttgctggacggtagctctcagccagacaaccacactttacagatgcgcacatgcttttaacaaacaatttttcagagttcaagctagttcaaaccattaaacttggatgagtctaatatatcttttggagtttgatacatgacatattcttttttttattggtgtgactatacacacaacagacattgcgaatctaaaagcacacctatgggtattgatttgagtgcctagacacagaggtgcttgaaacgctgccctaagaatgttactgagaatggcaccaacactaacattagttaggccattaagattatcccatgaacaagaccttccttgctcattgtaaaacttcaggttatttgaatgcttatgcagttatgtggttatgtctgattgcaattcttttctaggtgcgtaaaatcgtgaatgtagcacacgatattgtggttaacttctgcaatgccattagagcgcccgaagcgttcaaattagtggctgctgctgaggtatctttttttaaaatggtcgctcttttttgagcatttgtttctatttatttgcttattttctttgtcctgtctgttataatctgttgacagaatgtgaaaccacatctgttgaagatagatcatgatgacaaccttctgtttctacaatttaaggctgcactggaggtacacgctgttgatgcaatatacaagtaaagaagtaaatgtcaccttttttccctgtagaatctaatctgtataatatgcagagggaacagcaggttcacaatgttaaccatgagattgctatatctcttgacaagtacaccaattgcccactgtccgggacggagattgcagagttaactcagccattgagaaggtacatcgtcagcaaaatatacttcagttattagctcctctatcacaaaatagtgctgttttagacagaaaaaagtccagaatccagatatcggattggttgctaaaaattccaatgtgcaatattgagcatataatttctggtgtgaaatatttgtaacacctaataaaaatattatattttcaatgcaatatttgatcggacaaaatttataaaattggaccatgaataaataacatttatttgtgattagatatttggagggagcactccctagcctaataactgcagcctacttcactgattattttttttctttgattcattatgacttgtggccacatattcgagcggcagcacatcatgaactacatgggttcctctctcaaggggtgcccggtcattggttagtataagtgttcatttgtgaggataatttttcaaatgtgccatcacaagtatacaactggatttgcacaatgttacttgaaatgccattgacttcatcagggaatactattctgaaatggttaataggaaccttgcatgtaaaaacttctccatccatttgttagcacttagcataagtctacattattaggaagtatgatttcacaatgtaagtcaacaaaagaattcaagaacatcatcgatttatcattgcaatatttctatattctatctctgatttaataatgtaaaagaggtttgatatttctattatactataatgggggtatatggcccaatgctattagctttgtattggacttttaggtctttcaatgttggggggatgggagctactgtaatatttatcgtgaacaaggagggagggggtagtataatgccgccattatttatatgaaaaaaaagaagaagagagaacttggtatgtataccattccattgctttgctttatttggtatacaacaaaaacaacagctatgtgatggtgggaagtgtctagcactgtagtgggtctttttatctggtttgttcaacaatgtgctgcatggttgtggcaagtccaacaagtggcatgttgtgtgggtgagatccatgggtgatggtgtgagagtggtggcaaggttgttgcaagctatgtgctacctgattccatggtggtgacctggtggggcatatgaccgacatgtcccttatggataaggtaaacagcggtagtctgactagtatgactggcagttcctgtggttaatggctgagtatccatagggtataagacgtgtgtaattcttttcaagaagtgactagcaaagccattttggttaattttgtgagtgcaaccagtggtgctgagagggagggataaataacgctgatagtccttgacatatttttttattaaaaaaatattctagtaaggccattttgagaaatcttgtgcaaatcagttgcatagttgcatttagccgatttctgatgttattttgtagttaagaaatttaaatgatggcatttgaaaatctctctttttttaaaaaataatgttttgtgttgaggttgtatgaggttctaagtcttctttaggttgtcctggtgctgtgtcaaacgacctggtatttgaggatgcagagcttaggcacgacataaagtactgccactgacagagagtaagccaaatggtttcaatccagttacaccaggtgaatagctcggtaactggatcttatatgaaaagagactattgttttctttgtatgcaggaatgtgcaagaggtttggtttggttacaggtcgaacaggcttcaattctgcaacgcgaggcaaacgtctgctgtgttttgtttctctgggcacctgtcatttacctttggcttaaacaaggcattcagcggttgatcgctgtgccatgcccttgtacatagaaacaaatattattctgtacatggaatggaagagttccaacacctgcaaatgaatgagcactgtcagcgttgggcaagtggttccgatttcggctggtgtggattttaatccgggattgaagatgcgtgcatcggcagatatcatatgccggtcatgctgttgttgccgtaacaattttttgtttctaattgttgctacttgctactccctcggttccataaggttccataataagttcatttttttatctccccgtctaccccaaaataagttcaaagttcatttttagtaattgatacatctgagtttgtgaaattaagtaggagatagatgtattgtgataaataaagtgagaaataattgcattgggatttaatagagtagaaattttttaatccgttttatgttatattggtatacgtggaatggatgaaaaataaacttattttgagacggacgatggaggtaataattccagcgatcgagctggatgaagctgtcacaactgtatcaccaaggttcgttacgttcacacaagacaatagggagaacgccagccaccgggcgcccgatgcggcgcgcatgcatccgacgctgctgccgtcggggtccaccacgccgcctgctgagccgcccacgtctctcccacacgcgccctcgtgctactatgtttcccaccacatattccgttgcaacaaatcacccacatattttgaaaaccctctactaatctatttctttttttccactaaaaatgtttcacatagtgtactcaatgtttcactatgtatagatctaatattgcagtgaattgaaacattcttttataacaaatcacccacatattatggaaaccatctattaaggatattcgtttcatttttttccacaaaaaatatttcacctagtgtacttataatgttttattttgtagtgaattgaaacattcttttgcaacaaatcacctacatattatggaaaccctctattaagggaattcgttttattttttgttccaccaaaatattttacctagtctacttataatgttttattttgtatggatcaaatgttgcagtgatttgaaacattccttcgctatttgttaaaacattatttttaataagatgaaacaacgcccgatttaaacaattgaaacatttttgatctacttagtgaaacaattccgatatacttggtggaacaatatgcaacatttaaaaataattcaataataagctattttttcatcggaatatatccatgtgtggtcttgtttttcaaaatttaattgcaacgaatttaatggtacattcggttcatgatttggataaataatttaagagaaaaatagtttaaaatagttttgtatgcatgcatgcctgatgacgtcatgctaacgtgggcgcccgatttttctcccaaaaatcgggcatccgattcctagtcgcctctagacaatagtctagtcgtaacactttcctgtttgcctgagcctgacatgttcaggcctagtcatataaatccaattgtacgataagaacatgagttatcctacttctgtcttatgatgtgtcttaaaagacgtttttttaaataagatatatttaagtgctataaatttagatagaaaatatgtttatattcgttatactataatatattccatccaaccaaaaccccatatattttaggatggagggattatgaaattatgaatcatttttccaatttagctattgttttttgaactgctaataaaaaaattgtatatagaaatttgttttaaaaatcaaataaatcttttttagttgtaataatagattatattcaattaattaattatttattatttttctcgttttacgtgtggctgaaaaagccaaactatttacctgtatccaatgaagtctttctttctagtggtggtggcctggtgggttaaactgagttagtttcagcttatgggctcagatttttttcctcgtactctatatatatatatatatatacttcacagtgtataaaacttttatatagaagtttctttaaaaaatcagcaaatattttttactatggtctttaatagttaatatatatcgaatttgtgctaataaaatgtctccttctacatacggtgataatccttatctacaacatgaatcgaacggccgaacgggaccttagtctgaccagaagaatcagtaagagggtaatatatatgcaagttgtggttaggccgatatatggtcggattatcacaagggatccgatcgaatcgcacgtgactccgacccccctccggccggccggcagcataaataacgtacggatcggaggcgacgagttgatcgaccgtacgtacgtacgttacgtgcagaggagagggatggacctcctgtgcgacaacatggtggaggagatcctcgtccgcctaccggaggagcagcacctccgccgcgccagcgccgcctgccgccgctacggcgacatcatccgccgccccggcttcgccacccgccaccgggagctgcactcgccgctcctctccggcggcgtcgtcctccacggcgtgcggcgccgctgcccccgcgtggacggcaccgcagcccacgtccccggatcctacgccttcttcctccccgccggcgccggcgacgcctccgcgtcttcctccttggagttggacctcgccggcctcttgcctagccccaccgacagggagctggcctacctgctcacaccggcgccgccgatccggacgccgcccgcaggagcgtcttcatcgtgcactcgtcgtcgtcggccggcctgctgctgtgctgccgaggctatgtcaacccggtgcattactacgtctgcgacccggtg

SEQ ID NO: 63294 - DNA, 32735 bp, Oryza sativa
cgcggcatcggaggtcgggcgaggatggcgacggcaactgagcagaggctagcgacggcggcggcggctctcgacgaccgaggcgcagaggcggaggtcgtgcggtcggctgaattcggcgggggcggaaaggctcggcgaagctggtagcggtgaggagtacaccagccgccacgccgaccggtcgttgctgcgggccaccgtttggcaaggcgttttggttggccaactctagccagccagtgagcaagtttgaccaacgggatggcttggccatccggttggtcagtctgttggacctcctttttgtgcttgaatgacgaaaatttggcttggagaggttgatagagaggctgcattcagaagcctctgttcctatcccaggctgtgcgcacggaaaacgaagcggtccattaacgtgtgattaattaaatattttcttttttttttaaaaaaaaggacaaatataattttttaagcaacattcgtataaaaactttttttaaaaatgtacaatttagcagttttaaaagcgtgcgtgtggaaaaggagaggagagagttgggagaacctagatacgggacttgtttggatcctccgagctattaaatagccctccggaatcttgctatttagaagtattaaacgtagattaccgacaaaaccgattccataacccctaggctattttgcgagacgaatctaatgatgtatattaatccatgattagcggctgattactgtagcatcactgtggcaaatcatggattaacatacctcgttagattcgtctcgcaaaatagcctagaggctatggaataggttttatcagtaatctacctaaataataaaattccggagggcttaaaaacaggccacgaacgtagagcatctagtaactgagcggtttgctatcgacacagtacctaataactgagctagttccattttttttttcaagtaccgttgacatatggcccaccagtcatagtaaatttgagataaaaggagtcctcgactatcttctccttcctttcgcctaaaggaaaatctcgcgtctcgtctcccctccttgcgccatctcgcggctgacagggtaggggcgccgatctccatctggcgagcagagcagagcaggcgaggggaggggatcctggtgagcatccacatcctctttccgattcatctctctctctctccccccaccgggagtacttttgtctggaattttgcttgcgttgcgttaaccccagcttctcttgtagatctggaagaagctcttctcttaatttcagagccttaaccttagtagaactaacagtttgtttgttctcccaaaagtttgccggttcaactcaacccccatttcccaagttggatccgcccctgctagtagtaagatctggaagcaaaaaaaaaaaggggggggggggttggatctagttcgcaggagatctctgattatgttgcactgattgaataacctcttctttttttccacttctggcaggtgcataattcttgaatccattttaagtgcagcaattctgagtaccaaaaaatccattcaaaatggtatgcctaatggtttattattctttgtaatattaagaagggacattctgacatttgctcttttgctggtataagcaactagttgattcgtttaggagagcttattattgttttttgtgtaccgcaggtggttcttgctgcttccatcatttcaaagtccgggaaaggttagctggcttgaaatattctgttgttaatatattgtattgcattattctcagtgaaaaaaagaagtctttttaaatttatattcttatgttgtaatcaaaacaaattcttttgtgcatagaaaaagaaactgttgtatttgtataagtttttacctgtcacctgtgctcataagattgttagctcatatgcaaatttgtggaacccaaatactaatctagccgttgtcgtgttgcctcagtagattcttaactcctatgaccctaaaatcctatgtagtgagcacctcttggttaccaatttgctgatgcttccttccagaaagctaatgtgattagactgaatgctgtttcttctctgcgcttttcaactgcagcacttgtttcaagacagtttgttgacatgtctcgcataaggattgaaggattacttgcagctttccccaaactggttggaactgggaagcagcacacttatgttgagactgaaaatgttcgctatgtttatcagccaatagaaggcctgtacttgctacttatcactaacaagcagagcaatattcttgaagatctggacaccttgaggctgctctctaagcttgtatccttttttcccatatgttcattgttccagttttttgacctaactaacctatacaatcctatcctatgaaacatatgaaacatggttttttaacctacacatatattgctctgtagtgaataaatgtatatcagataatgttaccaacgtttgttttgtgggataaaatgaagattataatgtctcggtatagttgagcttgtcactatataccaccaaggggacaaaatatcagataatgctataatatgaaacatataaaatttttttcttttaacctacccatatattgcaatgtacagactaaatatcagataatgctattaatgtttgttttgtaggacaaaatgaagattataatgtctttgtttagttgagcttatcattatatgttaccaaggagacaaaagaaaagtaattattgtttatcatagttgcttgggaaatttggaaacactataatgactgtgtattcaattgagcgaatccaaacgttatgtaggcgttgcgggcagtgtcaacagaagctacgctttggtgcctggctggagctcttgtgctccaagttttcctttgtaggtcgttatcttaagggcactaggctgtcgtagggtggttttttggtcatgtgtcgccttgtgtgatgctatttgtggatgtgttttggatgaagggcttgttagcgcttggttgtatgggtggtttgtttttccttcttaatgaaatgaagtgcagctctcctttgttttctaaaaaaaacaaagaaaataaagtcactacattaacacaattcaattttgataaaaaacaacatgcaagctatacaatcatgaacctatcatatttttttaatggaatctgttatgttttggggctttatggatatccaccgttagagatgctactacactgcattggttttctttgttggcaataatcaagtactgtgatctccttaacagttccacaggtgcctgaatattctccctctcttgatgaggagggtgtttgtaaaacagcatttgagcttatatttgccttcgatgaggccatctgtcttggaaataaggaaaacgtaacagtccaacaagtcaaacaatattgtgagatggagagccatgaagagaaggcgcacaagctgatgatgcaaagcaaaatcaatgaaacaagggatgtgatgaagaagaaagccagtgagcttgataagatgaaggtctgcactgcacctttcttcagattaaaaatacatattatatcttcagagaaaataaatgacagttaatgtagttgactttgaccattaggaaaatcgatattacattattattgctagtttgaccttatgactctgtgctgttttactgccagcttgtcatttctttggttacaattgatatcagttcgcgcaaactttagtgtttaaaatacaattgcattgccgttatttcttaatgtctaagaggtgaattttgtggtcggtgttcatgcagatggaaagaggaaaacttgacaaaggaggatactcggcaatatcaggtcccagggtagttgaaaaagcatttggtgacatgagcattactggtagtggatttggaagtggttctggattaggtggactgagcatggatatggactcatttgctagcaagcctaaaggtggtaatttaaaaactctttgcatttctcttggcagatattaactctttgcattaggggaaaatttactacgtaaagctctgggttttcttcttgcagtacttgatattcagatcttcattcccatgccagtagtctcctgattatgtctatgtttgtctatataattcctactttccattttaactgctcgacaaagttcaatcaactataatatattgcttatgtttgctagcaatgtttgtacaggccgtccatctgcagctgctactgctcctggtaaaggtcttggaatgaaattagggaaaacacagaagacgaatcagttcctggaatctttgaaagctgaaggagaagtcattctggaggatgtacaacccagttcagttcagtcaagggtgtcgcctcttccaccaagtgatcctgtcacagtgacaattgaagaaaaactcaatgttacagttaaaagagatggaggtgttaataattttgatgtgcaaggaacccttgctcttcaggtccttaatgatactgatgggtttatccagttgcaggtaacattctttctgaacctctagcatcctgcttgatttttttctacagaaattttcacaagcagatcaaagaacatagcacgacagtttttgtttgaacctatacgatatttctactaagtaaatgtaatgcatgtgttatattgggtgaccttcctgctaagataatccatgtactgttttttttgtagtccatgtcatatgatatccaattttgctatcacatttgtgcttgtgactttgtttatgcttatcatgccatgtttttgttgctgaggaatattatttctttttattacgttcagttacatctatgattcttgcaccatattttgcattgcggacaagaaacattgtttggtccatgatactgtttgtcggagctgattatttgatacttgtgtcttatagattgaaaaccaggatgtacctggacttagcttcaaaacacaccccaatatcaacaaagatttgtttaacagtcaacaagttgtgggggcaaaagatccaaacaggccattcccaagtggtcaaaatgaaactcctctggttaagtggagaattcatgggatggatgagtcatcgttacctctatcaggtgcacaatcactttactttcttctatatcacattgaagatcatgccttttcttttcttggttgcctcctacttttattaacttgtgtttttttcgctcagtcaactgctggccatcggtatctggaaatgaaacttatgtcaacattgaatatgaggctgctgagatgtttgacctgcacaatgttgtcatatctataccattgcctgcacttcgggaggctccgagtgttagacagattgatggagagtggaggtaatgtttcaaattcatctctatctgtactgaacttggctgttatattatactaaaataattgtccaactaattgttagatgacaattatctccttagtattgatgctaatattagaaaaataacaagtgatagctatgctttctagctattgttcctggcactgtcatattggcattcaaactgttaagggcccctttgatttgtaggaaaagtgtaggaaatttgaaggatttcaatcctatggaaaaaattcctatggaagcctttgaaattaaggattgaatcctatactatcctttaaaattcctatggaatggctaatcctatagagattttggagaaaagttagcaagaggtccaacctcttggaaaaattcctttgagtctatctctctcatccgattcttgtgtttttcctgtggtccaatcaaacggtcattcctgtgtttttcctgtattttccaatcctctgttttacacctgcattcctgtcagaatcctacgtttttcctattcctccgtttttccattcctgcgattcaaagggggatgtgttttggatttatcgggatttagtccaattcccttggatgaactggtcctaaatgacactttgtgtagatagagctaaacttttatttccttgatgctaataaggtagaacgcacagcgaaagctgattgttataatgcctatttcactttcattttgcatacaggtatgattcgagaaactccgtgttggaatggtccattcttcttatcgatcagtcaaaccgcaggtcagtgaaatacgagttcatataaccatgttttattttgttttttttttcctgtggctctaactcttattttttcccctgtttgcagtggctccatggaatttgttgtccccccagctgatccatcaacatttttccccatatcaattggattttccgcatctagtacattcagcgatttgaaggttggttttcccttattagatgagactcgtggttctatgtttgttgttccttctcattttattgtatggtaatgttattttctgcataccttgcaggttactggaattcgtcctctaaaggatggtaacccaccaaagtattcgcagagggctcgtttggtaacagccaattatcaagtggtttaacgcccaaataagggagattacctcacttcagcacacatgtttgcgggcatttcctttcggcaatgagctgtttagaagtcatggagaagaaggattgttttgcatttataaagaatgtaattttgtctgtttcatatgtagtaacatgtttcaccaaattgctgttaatttgtactgccacctgatgagaaataaaagcatgtcttttccttagacgccggttggctgttctttattttgtacgtcttgtttctctttctgagaatgttagatcattttttgtcgatgccatatttatacagttctcttttttcatgaaatgactacagtgcattcagccaatcgctgacatgactattggcgttctcattttcagttttcagcaaattgaacgccttgtcaacctgtattccacataaatcttgaatttaccttctgattaccaaggttgatagggggacaaatccatcaagtgaaaatttagggcttagtttggtttatagccaaactcaaccatgctaaataattggcaatgctagaaaaaaattggcacctattttgtttggaacaaaaaaaatttggaattcatctatagctatacaaatttgaacttatggtaactttgcccaatattttaaacatggccaaatcttcccattgccaaaagaatttggcaagggttatggcttaaccaaactcaccttagtttgcgtgtagcctggaagtgtggaatttactaaataagaaaatgagaagaaaaacctgctaaatccgacctgccggattcgaaccagcgacctaaggattaactgcaacgactacagtcctccgctctaccaactgagctaaggtcggtttcatgttgtttttcacttgagatttataattgattggtctaatttaagaatgacataccgccagtgatcacgtctacaaattcttttaagaatattttgacaagaacacaattaaatggattctattgagctacatgcactttggagagagctggttgagcacacttgttcatcaggttatttcttaagtgcttctctgccatggtatcaggaagaaaagcgaccttttctgctgccaaattctttttctcttggtgttttacgttcaaagatgacctccatattaataaatctctatagaaaatatgacatagcaagatgcatattcatgatgtggttatttagtttcgaagtggagaagcacaattcacggagacactcggcgattttcgaaggtagtgcgaggtcgactgggggcaatggcgaatcaagggggaggtgcatggcgtgggcgtttcaatccaaggccgatgcgaaacttcggcgaggggagaaagccacaagctccgacgttttcaacgggaggtgagtcgctgcaggggattgggggaggagctttgggggatcaagccaaaaccatggctgcacgaggagcaacaaagcagcagtatcgccctattcagcataaggaaccagccaaggaaacagagaagggtgatacctctgtgctgcagccagaacaacctctgcaatccaatccccgtgctggtaacaatcctatcccacaaagatttttttgtcagagatgcaaaaatgtgggtcatctggctagggattgcaacgtttctgttttctgcattaactgtgccaagccatctcatagaactgaggattgtttgtatgacaagcaaccaaggccagttgctaagcttgttgggtatggtgcccctggtttaggttgcattcttattcaaaacactaggccggactctcctaaagagcatgcaaatcctttggcaatggtgtctattgtctttgggagggaatttactgaatctcagcttgaacaaggcttcactcagcaatttaagtggaattggcaatggaaagcaaaagctatgcccaatgggacttttcagatgaggttcccaaacaagataaaatttgaagagctatccaactttgactacttcaatgttaaggggactgatgttcaagtcaatgtgaaagaatggacacaagagtctgatgcagtggggaagatgcatactgcttgggtgaaggtgtctggcattcctgatgctatgagaggttaccaggccctatatgaagtgggatctaacttgggaacagttatggaagttgacatggccacctttagggctagcaatgtgataagatttaaagttgggatgatggagcttgagtcgctgcccttgaagttaatccttactacacctaaaggtctgctgtatcaagcccactttgagctggaagaagttgttgagcaaggatggttcaatgagagtatctttgaggaagttcaggtagggtctgaaagtttcctgaaaagtggtcagaaatctggtcaaagggatggcaagcagattatggagatgggtgataagatcagtcctggtattttgctaagaggcaatggctcaaaggatgatcctacagatatgttgtgtcctactacaatgattgaggaaagtcaaatcaagtgtgctcagatactgagagacagagcgctggcttttcagcttcaggaagcagaggctaagtcgaccacagattgtggcatagaagtaggtatgaccagtggtgagacaatcctgacggaggaaacacaagttcttctgacacaagacaaaaaatgggagcaggctggaaatagagggatggcagtgaacacaatcgactctgaggcaactgaggtgggtgatgaagggatagacagggaagatgaaagagtgcacttgggtgacagtgaggattatatggattcacaagaatctgaaggaagttttgccaaaagactggggatcaacttagtggaggacaatacaggtagtcaagaagaggagatgagaaggagtaaaagactgaaggaaaaggaagacttgaagccacaagatatggccatgcaaagaaaggaagctcagaatgcttttgtcaacaaaggtcagaatacagtaccctctattattaatgaatcaaatgtctctcttatcaacatggcgaatattctgggtgttagtttaggatgtgctattgaagatgtggaaagtaacttgaatttgattaaaaatctggaatctgctagaattaacctctttatgaaagagggtgaagcagataaaaatgctgaattaaagaaaaaagaaatggaaggcatgtctactgatcaagagtggtcagatgattcttctgacaattctactcttgatgagattgaacagatgctgaaacaagtctagtcttcaatgaaaaaaagcaatcagaggaggggaaaccttgagatttcaaggtcactcccaagagttcaaagaaaagaggtaaagtaaaaaagaaaaagaaatgaaaggcttattttggaatatcaggggaatgggtaacattgaaaaaacaggtcatttacaagacctaattagggatcacaaactggactttgtggctattctagaaacagttaaacatgatttttcaactgaattgttaaacaaactaagctcagggagaaatatgcattggtgttggatggctgctcgtggtagatctgggggaatattggtgggaatggataaggacaaagtcaatgtattaaatgagaaaactgggaagtatttcataagacttaaattgttgaatgctgacaacaaaaatgtctgggattttatggcagtatatggggcagcgcaagctgaacagaaagctgaattcctgactgaattggctaaggaattttactcccaaggttcccctttagtggtgggtggtgatttcaatattttgagaaaggaaagtgaaaaaaacaagataggtggatatacaaaatgaagcttcatttttaactccatcattgatcaggcaaatcttagagaagttcagatgagtgggagacagttcacttggtgtaattttcagaactctcccactctaaagaaactagatagagttttcattaacaatgaatgggaagacatttacccccttaccactgttaggactttggttagggccatgtctgaccataatcccatgttaatggaaacaggacagaatatggctcctcagagtatattcaggtttgagcaaagttggtttctgagggaggatcttacttcagtagtggaagagatttggaactctgactataggggggacagcatggaaagatggcagaagaagctgaagtttttaagaaaaaaactgaaaggctggaacaaaaactgggaaggagaatacagaaggaggaaaaaagaaatcatggataagattgaagagattgatatcctagctgaaactgttggggtggatattaacattatgaataatagaagagcccttgatgctcaactcagatatgtggttagagaggagaaaattaaatggttccaaaggtgcaaagaaaaggaggttttggaaggtgactgtaataccaaatactatcacactaaggcaaatggaaggaaaaggaagagcttgatccactcacttgtgcaagaggatggtgtgatttctggccaacaaaacttgctttcctatattaccagcttttataaagaattgtttggtcattctaaagaaaacaatgtctctttaaacatggagggtgtgagcaaagttaagaaggaagatatagtggaattaaccaagcctttcagtctagaggaggtgaagaaagtcgtttttgaattgagaaaaaacagagccccagggccagatggcttccctggggaattttacatgaaattctgggacattatcaaaaatgatctcttggaactgattaatgactttcataaaggtttactgagtgtcgagagattgaattatggcattgttactcttgtccctaaaacaaaagatgctgcacaaatacaaaagttcaggcctatctgcttactcaatgtgactttcaagatcatcaccaaggtgttgatgaatagactggacagggtcatgatgtatattatttccaagaaccaaacagcctttctcaagaataggtttatcatggaagggattgtcattctacacgaacttctgaactctttacattcgaaaaaacagagtggcatcctttttaaggttgattttgaaaaggcatatgacaaggttgattgggtgtttgtatatagaatgttgaaatcaaaaggctttccagatttatggtgtgattgggttatgaaagtggtgagagggggcaaggtcgctattaaggtgaatgatgagattggtccctatttcaacactcacaaaggcctgagacagggggatcctctttcacctttgctgtttaatttagaagcagaagcactcaccttgttggtgcaaagggctgagagcagttctcttttggagggtttgtcagtaagtgagaacaataaggtgacaattctgcagtatgctgatgacacgatatttatgatcaaagataatatggaacatgctagaaacctgaaattcatcctgtgcctctttgaacaattatcagggttaaagatcaattttaataaaagcgaagtgtattgtattggagaggctgtggaaagagaaaatgtttatagtaaaatttttacctgtaaggtgggttcttttcccatgaaatacctggggttgcctattcacaaaaagaggttactaaacaaaaactggaagtctgccgaaaataagatggaacataagatggggggttggcaaggcaaactccagtccattgggggtaggctgatccttaccaatgctagtcttagcaatgtacctttgtacatgttgtctttttataaaatccctcagggagtcaaagagagaatggatttctttagaaggagaattttttggcaggaagaccaaggtataagaaaatatcacttggtacaatggcctataatctgttctcctagggatcaaggtgggttgggtgttctggatttagaaactatgaatactgctctgctgggaaaatggatatggaatttggaaaacaaagaagtttggtggcaagatatacttagggataagtatctgagaaaaaaacccctctctgaggttaagaataaaatgggggactctcacttttggcaaggtttattggagattaaaaacaccttttacaaattctgtactaagaaactgggagatggcaaacgaactttattttgggaggacaattggattggaggtaggcctttaaatgagcaattctcagacctgtacaatatcactaacacaaagcacatcacagtggataaagctctgcaggggggttgggataaagtcacttttagaagaactttacatggaaataggcttgaggactggaacagaataaagcatctatgtgctaatatccatctgcagaatggccacagtgataagctttggtggaattttaataaaaacggctcttacacagtcaagtcgatgtacagagctctcaaattgcagcagttttcatgccctttgaaaaaattttggtacatcaaaactcccctgaagattagggtgttcctctggttatttctcaaaaacaaaatcctgactaaagataatctttacaaacgtggttggcgaaagggagacaaaatatgtcagttttgctgtagggaagagtccatacagcatttgttttttgaatgccccttagcaaaattgatctggaatgtggtcatttgtgccctcaatctaaaaccattttcaaataaaacccaacttttggggccttggttatttggctttgataagaacacaaaaaatttgatgatggtggggattactgctgttatctgggccatatggaaaaccagaaacagagcgtgttttgattatgttcttcctaaagatcccacagaggttatcttcttggtttgtaatttgattgaatcttggactgttttgcagaaatcggaggcaaatcgaatggagctgggggtctgggtggtaaggcaagttgcaagtgatgtttacaactcaagatatggttggcgtccccacgttagaagattggaatgaatgaaggatgctgacgtgtggaatgctgttgcttgtgaccgttttgaagcttctgtgctgcttaacagatccctttctagctttgttttctcctctggtctttgttatatcagccaggaactagcagtctccctcaaccagttgtttttgctggtctttctgtgggaaccctcttactgggctttctgttttttgtttagttttctataagacaatttgccgttccgttaatggaaaggggggccttgtgccctagttctaaaaaaaatgatgtggttatttagcatgaaatgatgcaagtgccatggaaggccaaaaatccaaaaaaaaagtgcaaagcgtctctcatgatattctatgagaatttagagacttgttagtaaaaaggaacaaacttaacaatatgagagcactaatgttggtgacaattactcaggcatgtatacatggggggttcagcagaggcagatactcagacatgaatacatggtaagatcaaggcagataacaactagaactaggtccctgttggagcaaagggagagaccctggacgatggcatctttcaggcctggttgtgatgtggaggccatatttcgctcggtaacagagtacatcataggaaatggtgaagacaccgatttctggacagcaaactggactgggaagggatgctttacatggcggtggccgatcctgcactcttatgcaggccgtgtcaagctttcggtcgccaaagctctcaccaacaatcgttgggtccgcacactgcagggggcgctgtccaacgaggcgatgggcgagttcttctagctttgggacgaaattcatgatgtgttgctgctcccctcgacggatgaaatcaggtggaaactgacgaacgatgggcaattttctgtggcgtcggcctacgacatgttcttcatggctacggaaaactgcgcattcggcgagctgctgtggcactccagagctccctcgcgagtccgcttcttcatgtggcttgcgctaaaggaccgttgcctcactgcggacaacctcgccaagcgaaactggccacatgatgatctgtgctcactttgtcagcgagatgatgagaactgccaccacctgttcgttgcgtgtgattacacggcggtgtggcgttctatcaagcgatggtgcaatgaaagctttccaattccggcagatggggatgctgccctcgctgattggtggctggcaactagatgccgttttcagaagagctacagagcagattttgactgtgctttcatgctaatatgttggctgatttggaaggagcgtaatgcacgtatatttcagcacgtgtacaagctaccggatcagctcgcggaggacatcaaggatgaaattgccgtttggagggtggcgggggttttctcccaatttcgcgagtaatccccatgggtgtttgcggggtttagcctcgcctttgcttttcgttcttggctggctagggaccttccttggccgccacgacattgtaatgtcgctgtaaacttttactctgttttcctcccaatcttaatgaaattggtcggccaacctttggccgacccggcaaaaaaaaaaaagaactaggtccctgttggctaggtttggtaacaatgttgagggcattaacaatggacatttcggaagctggatttggagtctgaaagacacttgatgaagtgtgtactatgtatgcagatttgaggagggttgggtgttgaaagttgaaaccttgaatccaatcatcagagattcagaattttgtgacacagcaccatgcaaatggctgcacatgtcagatgaaaacagtaagtatttgcatatatacatactcaaccaagcataagaattgacactgatgattgatgtaacaagtacagtaggtgggtttaggtagcactagcacacaaaatcatatggctaacaatgaaaaataaaataaaatgcgcagcatcccctttaataccagattaatgaaaacaagatacttaatttcagatggataactttatcctaagcagtaaaatacaaggagttctggttaataattagtaaaaggcatagcttcagtcataaacacgagttaatttattcatgggaaaaagagggtaaagacagttctgatgtccacgcaaattacagaaagtgctttaggtattactcacaagggaaagaccttaaggaattcaaagtaaacaaaaagaagaagaagaaagaaacagagagagaaaaaaaacttcagaactttagctatgtgggtcatttgctcattgctgccttcgatgcaccagaaagcagaagaagagggcaatatgcttgacaagttatcgagtaaatcacgaggaccctttgacccagtccttcctactgaggcttcccaaacaataaatttccaccctgtcacatcgaatgattagacacatgcatagagtattaaatatagaaaacaaataattacatagattgcgtgtaaattgcgagattaagcctaattgcgccatgatttgacaatttggtgatacagtaaacatttgctaatgacgaattaattaggcttcataaattcgtctcgcagtttatagatgaaatctataatttgttttgctattagactacgtttaatactttaaatgtgtgtttgtatatccgatgtgacatgcaaaaacatttcacccctgaactaaacagggcctaaagccaatacgctgccgcaccagtgcgcgattacacataccagcccatgatccaccatcgccgctccagcgcccgcactccctcctgccgctgcaatccttgctctccacggatggccgaagaggaagagaaagagagataagggagagacagggaggagaaaggatgggagagagagtggatgacatgtgggccccacatgtactgggtccaataatattttttttgtgtgaatgacaatgggtcccgcacatattttttaattccaacgtgacataggtgccacttcaacgccatgtgggacgaagacccggttaacaccggtcagcgaaaccgccctccaaaatcgctgagagagtcaaattacatcagtttcaattgttcggggagtcaccctacccagctttctatttaagggttacaaattagatttggcctatttttttttagggagtcaaaagtggactttttcctagtggaaaagatagaacgcaagccagagccctgagcacggacgggccgcgttcactcgtgccgtacggggccgcttttgcttgctcccggtccgcaagcggcatcgccacaagcgcatgaggcgatgtggatagaagcagaagcaaacgagatatttaactatttgccactcttataagtgataattaatgatttgtcattggacccacatgtcatatattacgagcggcaaatacttaattaccacattttaaaagtagcaaatagttaaatgtctcgaagtgagcacgtcacctggaaatcggcccgagagctgtgggagcgtgaactcgccctcatctttaattttctccgattgctgcaaaagtgtggcagtccattaattggttttcctgctagcgctggctatagattagttgccagatctatgctctctcttcatttcttctcccttccacgtgagattgtattgttgtgaataaacttatagctcagtcttactgtacctgcagctcttaattagagagcatcagcagcggtcatactcaatgacgagcttgagaccttggataataggcgacatgtgacgagtaggcaacccacaacacacgagatggagagaaacaacaacatgctagatggcacattgagcttcaacatgggtgaccggcgacaggcgaactcaagggcactggcacggtcaagcttgatggtgcaacaatagaacctgatgattcaggctgatggtattggatttaaagtttgtatgctaattataatggttgaaaaatttataattcatctaaaatgagaataaaataatttatccaaatgttaccgacgtaattgtgcatatccaaatacatagatctgtagattaggaatacccaactacatgagaacttgaatctagagctatgcctaatagggtcctagattgcacggtaacgaggtagctcgcccgggggagggtggcgttatgagagcatgagctcaagttcgagggtgttgacatcgagctatagtgcacaacagctccgaagagctttggtgaatagggttcggtagaggaagaagaaagaagtattcacattataattttagaaaaaaataataaaaatctaacgaatgattgggtggatcccagcagtggccccctccctcattgggtcttgacggcggtgggggccctctccgtcacatggtctcgatgacaacgggcggaaaactacatcggcgatgactgcagcgacagccccctcctccggcggactgcatcgatgatgatggcggtggtgaccccctcatgcggatccagtggctccctctctcacggtgcggcgggcgacaagcaggatgatggagagcacgacaacggtggtggtggcggcgatgacgacattagctcgtgtggtcggcattgggactgcatgcgaagatgagattttcgcatgcggttgggttacccgcacggaaaaatgttgatttgcacagacacgggggtgcatgtgggccgtttagatgcatgcgaaaacccattttgtccgtttgcaaaaaaaaggatttctgtacttgtgtgatcaattaagctatagaaagcttttaaaaagattaatatgattaggtgcgagccacgagcaatgcaatggagacgatgcgggaacttgagatttggtcggcccaagctcatggccgtaaaccggggtagcacactagtgcaaaacaaaattttccaaacgggccaaatatggtttttgcatgcggacctctggcccgtctgcccagaagggtatgcgaaaatccggttttttcatgcgggtgcttatgtcgtccgcacactaccactcgccgctgccacggccatgctcctcccccgaccgcacacccctcgccaccttcgccgtgctcccaccagccaccgcgcacctgccggcctctgcagccgttgcccctcgtcaccttcgcggcgcacccgctagctgctgttgcccatcgtcgccttcgtcgtgctcccactggccaccgccactggcagagagagagagagagataggagaggagtatgcatgaaatatcctgggcaaaagaaaaagaataagtatgcttcacctatatttcaaagggcatgctaggtaataagctagaaagctaaaagtatcaagtctacagtgcctccacgttcttcaagaaggaaaacctcacaagtgaacggaatactaatgcatatgtcaatgcattacgaggaggagaggagaggagataaagaatgaggtaaggagagagagggggaatgagttgaaaaaaattgaagtgctaaaagagagaatggggaggtaactcagacttctagatggatcttttagtggttcgcatgtgaaaatatattttttcgtgcggccgtttaacatgcctgtctagaaaaacagccctatttatgcccatgtagtagtggcatacaatcaccaggtcactatatatgcatgcatggatctgactctgcaaatcaaatcgggtaattttatcacgtggaaagcttggaaaggaataattgtacgcacttggagcgcgaccgagaacaaagccacgttttccggccgggtgcaaggtcaccctcggcgcctttcctccgcggcggggcggcggccgtccgcgcgcccaacaatatctcgcgcgcgccgcgcggcatggccggcagcaagcaccttttaaatgtttagctaccccacccagagctacctgcagtcggccggccatatgcatacacataaagattaaaaattaaatgtttcacgtaaaatgaagtgataataacgtgtgattaattgagttttaattattacaaacttaaaaaatatattaatctcatattttagaaaaactttcatatagaaagtttttacatgaaacgcatcgttttatagtttaaaaaacgtgctacgagtattcaaaagtttatccaactattgttggagaaaaaaataggcctgtgtgtgtgctttggactcgctttcgctgctggatggtggctttcgcaagcatgcatgcgtaggtacagtagtgtattgagctagctactacagcttttaattttggggtatctatctattatctagctagcttattagatactccatccgttgcataaaagaccaacctagtaccggatgtgacatatcatagtactacgaatctacacatatatatattcagatttatattactaggatatgccatatttggtactagattcgttttttataggacggagggagtagggtgctggctagatatgatagtgctctccaaactccaaaagaagatgtggcaactggcaagctagggagagagagagaggcaggcacaggcttctggaagatcgacgatcaaagcatcggatgcctgcttgcgccggccaagcgcaaccttcgatctcttcggtccttctcagcttctcgatatgcatggtagctcgtatgtaggagtagatctgtctcgttccattaattcttttcctctctctccttttaatctgtgttcgttgaaagactatcttttgcagcgcctttctcttgcagctattgctgtcggcaaattcgttcgtacgtgtaaccaaaggaaatgaaatcgagagagacgactgagatttcatatttgctagctaggcaaagtccaactcacgtctgcacgtgtgatttaattaatttgatgatagttgcagtataggtgcattgtccaactttttttctacttaggtttataagcttttaggtcgatatggttagtgtatacaaccgcgttaccaagctatagctgatgcacaattaaaaagaaatacagatcatttatatgacatatacttcctcttaaaaaaaatcaaacttatagatagaagactatgtttgaggcctaataataaagctttaatgtgagactatgttggagtataagtgaattgcttacccgacttctcttatgcgtcttaaaattttgtttaaactaattggactaattgatatatacaactcaataataactcatcagtttactttctgtttgaaccaactagttcactgaactcaacaataataaagggtttcttggagtaaaacaaaaacgagttaactaggcacttactactgaagtatcctcttttgcatgcagtcaaactgtactggtggctgaccgtctgcggacatgcgcattttcgtatacggatgagttagctaggcgctcgctacaatagaaaccctaggtgtctacaaacatgcgcattttcataagcggatgccctagccgcttacgaagatccattatcacaggcagaccacttaagctggttgcctatgaaaacacacaattgcaggtgaccaagttaagaggcctgcctgcaatagtgattttttcacgtggccgttaattaattggtcatttggaaagattgtgcgttctatataatttaatatttctcgtaattttttaatcaaaatctgaaatgtttttaaaattgtccattttgtagtggctcttttgtactacacataggacctaaccgagagatcgttcttagtacatagtaataagaatcttgcattgacaaataaataggtgcagcatgtaaaatctttgtcacatcccttggatttatcgtataaaagatcctttgctgacttctctaactcctttaaattgtctaaccctcttgttgtacccattagcacttctgattcagtgtgacgcaacatatcctccaagtcaaaataaaccttaaaatcattaatatcaggggagccatcttcgtccatcatatcttgggcaatgtcattaactgtaaaattttctaccacatccattgaaaaacaatcctcttcaccttagggattaccatcacctttaggaacagtgatttctccgtgataggtccaaactttgtaattttttcacaaatccgcacttcactaagtgccccttggttgaattgggatctgtccatattttctgattcttacaatcaatgcacgaacaacaaatttccctccaattctcccttaaagaatgtacctcaacctagtcaagaaatttaaaaacttctgacatgtagaatggataagttcttagcgtatcgtacatccacgctctatccagctgctgtaaatgatcacaatacaaataaattaaactacaagttttttcctccaaacatgaaaatacatgtatcttctcgtaaataaagaaataaaacaattaactagtgcttacaataacaattttgctcatcaaactaatctattttagctaaaatttgcaaaattagctcataaattccaattttataactgcaaattctccgcattgcaccgacgattttttttaaaaaaagcggaaaatggaggaggtaagcaagtatctaaccttgtatatcaatttcaaggaaagatttcaagttcaatatatctccctctatttgttgctttgttttggagagtgaaacttcaggttggaaacacagaagctcgggcaaggagtagtatataggtcgatcatcacatgtgtgcttcttaatggcttgcctatggtaccgcattacacacgcgaacctcttaactgcctgcctgcgataatgtgttaccacaggtgtgctatgaaccatccccgcggaaacaatttttcatgcagacgcaagtacggtcagcctggagcatggagggggccttgtccatgaaaatcaattacgtggtagtgactttatgttaatcctagatacaactatataactgttactgcatattccctaccaatcgttcatttagcatgcctttggttgctaaggttaagcagaattttattttgataacatttgacacaaactacggtttgaactagcaagcatgtatgatattacttgaagtgcggaacatgcctatattctcactaaaatgggttttatttggagggaaaaaaggcatgatagaccaaattaacaccatcgatgattgtcggggttgatcgtctgtactttgtaagtgttctgtattattagagtgctgcatcatcaagattatggtttgaattactttgaagcaggaaaacaaacgcccgcccagcagtttaattggaaaaaaaaacctgaaccgacatatatatgtcatggtttggattgcatcaagaattgttcacgctattgcactggagttaactgggaagaccaggtaattttcatacgaaccggcagaccagagaactacttgactaacaaaaaccatccatcactcaagaatatcgcctggcccgcaaataaatgagaaaaatggtggcgggatgcaaacgtaggtgggtgatttccccgtacatcacctcacaactattgtggactagcaaatatatcacttgtgatagacttggaatatacatgtaaatcgctagaccgtagagttggaccgatggacaggtgaaccgagggttgtgccatgtcaactaccagtccaagcttctgtgctatggtttgaaggggagttgtaacatttattgatccctgcaactactatctcaagtaaaaaatctataaaatagttatttgtccaaaaaggggccttattgtaggaaaacaaccctcaaagacataaactcacgagacatttgtcacagctgcaaattttcttgatgatggcatttataagcgatcacaaatatacatgtacaattgacaaccacataccatctttaacacgaaagattgttggctagtctttttcggctgcctcagctagaatataaccagcccttaagaaattaaatagcaattttgtttctagagaaaacaacagagaggactagctaattaatagaccttagtgtgtgaagaatctcatgccacacaagcgttcaagggtccacatgtacgtccagtcaagtcgccatctacgtacattacttgtgtgctgatttgtcattagtcagtcaagtacaagtctttcccttagttctaaatctataggacggtgcctcccgaggtccaattgtttcttgtcctttccactaatttaatttcctgtttaactaattaaattttcagaaacgttgtcgagcatcagtggtactatatatacgtggcaatatgtatatccaggttcatttttagtttggcaatatatatcagtcgtgtccatggtaggcactatgtacaaacctaattagggactggtggccataatttggtaggcacaattagacaagccacctcctcttgatgttggtaggccaccctttcttactcactgaaaaagttcatggttgttgacaaatgaattttggtgtctttgaaaagggagaagtttgatctgaggtgcaacatatgtgagattatacactgtaatatcataaaaaatttaaactaactaggaatagtcaactagcactaaaatgaagatgcattgtaggggtgttatattacataatatagagctataaatttttatgcaattagctgcctattatatacaatactcgatcttaaatcattctcaaaacttcataggtaaattgtttgtacaaatagatagacattttatatgtaattctttatttctcatagcttctctagtggcatttcttttttctagtggcattaaattacaccgcacacgttgtcatggaaaaccattgcggaaaaaggaaacaattatatggggtacactaatcattgcaacattctcgtaacttgtatatgtgccgtgttactcatatctagctatttagcatagtttaacatcctaaaagtgcatgtagagacaaaattgtttctaaataatgccttacatgtattttgggcacattatagtagtgaaacatatctacatataaatttaggaaatatatctgaaatgtgactgaatcgtctttagtgtaaaagtattattgacaatgtttgaagtgcttctgaaaattttcctgtgtgtctacaaaagtcttttattgtagcatagtcaaatatatattgggaaaattttaaacgacgggaaatttgtaggagtgcatacctttgcatattgtgactagaatttacttttcaaataatatatcgttgagcttaaatacacaaatacacaatagctttccctttaaggctaattttgtaagcttacctgttagtttttatttgatggtatgttggtgccattcatggcatgaataataaaatcttttcatggcatgaataataaaatcttaggaaaaggggttttcctagctattattcccaagcaaccgataaaacatatttttcccaataataatttgtcagacatttagcaatttttgtgtctattcctatggatatttcatagatggtttttcgccatacaagtcactatgatactcatacaaacattttgctagagattcagactaatggtggcagtgaaaatagttgtggaggcatgaccgcactgaaatcatcctataaagttgcagaaagacctatatagtatttgcaacctcttttattgcaggacaccaatggctgaaaatttggtcactccttagaaaaatatgtgcacatgtactataggcacctccaaaccattgttattgaattgtgtagccaaatagttctattttttcccccaaagactcctcaactcaactaacaagagcatgatgaaataaaactcaaatcatatccactacatggcacatgcaatccattttactctaaaagaactaatcgattgaagatgttattgtcaattaatttttatgttagcatatcgaagaaaatccagggatcaagctgagctcatatctatttcaacaaaggaatcaaaccaaggttcgttcaggttcaccgatgagcgcgtgccaacccacagattcaccttcatcccgtctcattaattaactaattaaataaactaaatgttacttctcaacaaactctcatggatcagcttgatcacactcacctcgatctagtcatgattgatggatccatattgatttcgcggccgggccatacagtccatgtgaaatcatggaaatatcgttattggtaatctgtgatgatccagacaaacacatttgccaccaccacaaattgcctggaaagagcaaggccacatgtatgtacatgatattgtccatctttttcttcctttgagccaagagaataacacatacatagctgtttttgaagtctttttcaaaggaagaaaatggtttgcatgtatatattgatgtgccatattgcatatccccaagcacaatgcaacattgcacgattgcgatgagcactacctcccagccgtggctcctccaaaaaaaataataattgtttctaattggggaaagagagaatttttttttgacaagacatggttctactgatcaaagggtgataggtgtggttttaaacattaattgtggttatctcctcaagtctaggtagggaattaattaaggatgcgctcacataaatattaattcatgtagatacatggaaaagtgcgacatatatatttacgactgatcataataatgaaaatgatcttgaatatagtcatgggttcgtacacatacttgtttgttctgtgtgttaggaattaatatgttgaacaatcacacaaatctcccacatacgtcttacacatatgtagtcactttaatttgtatctcccaaaacatggtccctaagtagctaattaatttacttgtgtactcttagtcgtagatgatattgtttttcaaccaaatgatatcgatcgatggcacacaaactaagattacatttgagaggtttggcacaccgacaatgacacgggagaatataacatatgtggtgcatgcctttttgtttcctggctcgacgcatctcgatcggccgggcacgtcgatatcgacccactctctaggtctcgaaatcattgatatgatgaacggcttctccggtacacataggtctgcatcgacgtagagcactctcatggtcgttactccttcagaaaacatgatttgtttttctctttagtgggtagggcagattgtgttatatatgttcggagttgagggggtaattcgtactttagcgatagtttgatggaggtaaatcagacaaaccttttattaaatattaattaagtttagtgtttatatatagtttatatcttctccaatcaattcagatgttctcgaaattgcatgcgtgggtctcaagaggaagtcaactcctcatgcgtatatatatatatatgtcgtccagtattataataatgttgttattattacatgaatataatattcactggtggagaaactcttggtagtcccggtttgtaacccctttagtcccggtttccaaaccgggagtaccaatccgggactaaagatcgctatctttagtcccgggttaaataaccggctacgtggctgagccatctttagtcccggttagtgttaccaaccgggactaaagatcgagctgaccttttttttttttgcatggccctgttgctgcatggtttatatatatatatataaaccatgcatatatatatttttatacatatatatatatatatatatatatatatatatatatatatatatatatatatatatatatatatatatatatatatatatatatatatatatatatattatatgtatatatggttcagtacatatgtacatacataatatatatgtatttatatatatatatatatatatatgttatgcaaatgcatatgtgtgtgtgtatatatatatatatatatatatatatatatatgaccaaaatatatttacattatagaaaatgtagtcatgtattaattacaatctattatatgtcctagctagctatgatttcgacgtagtagtagtactcgctgctagctcagaagctaaggaccggtgaattgtgtttctgtcgtagtagaattcaccttgggatcaaggatttcttcgttgatgaatcccatgagttgttcttgaaccgctgcgataaattccttgtgtgtggtcaggttatccctcatgcgaataaactatatgaatgtatgaaattgattagtaattaaacaagaaatcgttatgtaatgaaattttgaatttatttgtacatacatcgagctctcttgtggtgatgatttggtctgcaaggcagtggcaatactcgcacacgtagtagccgcacaagttagttccctgcttttgctttgcgcactacaaataaatgacaaattaacggcatgagatctaattaatatacacttgtatgtattaatttgaattggagaaatataaatgtagagcatgtgtactcacaggaaatttgaacctccgcctaagtctttctctccagttgccgcagaccaaatgacggaaccgataccaagccctacatagagtttaaagatatgattcgtagtagaaataattaacataacaagaatttcttaattaacagaggaacttatgccagtacctgtatataagttcgaaaaccttgttaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaattctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtattttattttatatagtttacttatatacaaggacctaattaattaaaggagacgtagtaattaagaaatataactgaacgatatacttacaaaatccagcaactcataatagagacgtcgagggcgtccagctggtatacttcgtagattctcttgaaattgatccagagaatatcatctccttgcaagaagtccgggtccctgatcctcgctccgatcatctctctaccggtggcgctcatctccatgtacagctgatggaacttgtacatttgtgtgggtagggactgcaccagctcgggcttgacaagcggtttaccgagttcgtacatgtatttcaattatgccttttctattggttcaactcctagcaattgatccgtagttagaccggtgtcaataataaatttttctatcatcatgtcttccctggtcaccaatggctcgatctcctggtttggttgctctccaagctgagggactggtttggactttccagaagatgctttcttcagcgttcgctcatagtccgatagcttgatggcctccttgacaggtgcagacatacccctgaagaagttcctgacactggggtctataggaatcttcttttctagacttcgaggcttgaattgtctcttgacttctgatgcaacgtaagcgtcaagctcctcttgcgtgcaatcgtaccccgggtccttgttcttggcggcatcaattttcgccttcttcgttgcccttgtgtgggcaggcggtggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggagacggtgcaggatcctgaggaggagatggcggagccggaggagatggtgcacgagacgctgcttgtcgcccagggaggatgatgtaccgcctacgccatagaataatggcatggcttgtgtctcgtagatgcgtctcaccatcttctccagggtaatccagctcgaggttctcgtacgcgccttcgaccaacttaacttcgaccttcgagtatcttgctggaatcgacctgcagtggtaagtacctgaagggtccgttgggatggccatgcccgacgccaccttcatgttgtgagagattatttattagtaatcaacatatataagcagcaactagcggaatggctaaatctagaatatataaactacgagcttacctttattgataagttcttgtaaggaatatgcagctcacatggtgttcgttgagtgatgtcatcaacgagacaggtcgattcgtcctgtatttgcatggcatccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgctgagttcgtagctcgatacccggaaatctagatctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtccggtcggaacgtgccatgagaggaggcttccactgcatctgttagtcatcgcgcagcctctcgtatctgatcgccgaagaccagtgagccatcagctgggttgagcgttccaccgtgagcatagtaccagaacttcgatcgttccggccaattggcagctgccggttcgatacccctctcaatcaagctagccttcatctcctcccacttcggcatcacgacgctatagcctcctgaccccaagtggtgatggtacttcttcttggcggcattttctttgtttctttccatcatcgcctgcccttgttcacctgtcttatatgcaacgaaatcgtcccagtgatcccttagctttgggaatgtgtcgaagtttggtgtctgccccttcaggatatacttctggtacagatctcccttgaagctctgaatctgttctgccattttcttcagaatccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgctgaccctcaagcttcttcgctgcacctcgttgcccgcgtgccctcttttgtccaacggagggttgactaccactagcctcctcctcctggttcccctccacatccctttccacgtgcccctgctggttcccctccacatctctctccacgttctcttcctcgtttaagtattggtttggatcctcgttcccttcttcttcattccagtactagctgcttccctccgtgattgtatcgtacaatatctgttcctcatcgcggtcagccatctgttgatacaagaaatatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatagtaagtctaattacaaataaaataatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataattacatactaagtctaatttgcaataaaataatcttatattaaaactcaaataatattagaacactacacaatcttatatactaagtctaattacaagtctaatattcttaattgcattacaaatataacaatcatttatattattacgtcacttgcctgcacgaattccttctagggctagctcttccactccggcttgagggacgactccgacaacacgtcttttctacaagatacaaaaaatatgtattaggataaatgccgtgtaacatatatatattgcatttcacgttcacgttcgttcacgttcgttcgatcgttcacgttccctagctcgttcacgttcgttcgctcgttctcgttcacgttctcgcggcaacgtacgttgacgtgttcgttctcgctctcgtttgttcgatcgttctcgttctcgttcacgttctcacggcaacgtacattgacgtgttcgttctcgttcacgtgttcgttaacggcggtgtggcggcatcacgccggcgcttggcgtggcggcgtggcggcggcggcgtggtgacggcggcggcggcgtggcgttgcatgcggcggcggcgttgcgcggcggcgaaggcagcggcgtggcgtggcggcggcggcgttgcgcgcgcggcggcgaatgcggcgggggggcgtgcctatggcggcgtggcgcggcgtctgcgtggcacggcgtctcatggcgggcggccgacggagagagagatcgagatcggagatcgttgaaaggagaggcggcggcggctctcaccccatagatgcggcggcagcggaggaggcggaggcggcggcgaggacgatgagctcgagacgacggcgagatacggcggcgtcggcgcggggatttgccctaggtagtggcggcgaaggagagaggccgagagagatcgatcggccgaaaacgtttaagtgttggtgaagaagacgagggcacaccgggaatatatatacccctggatctttactcc

SEQ ID NO: 63295 - DNA, 26032 bp, Oryza sativa
tggcggtcgagtcacaggggagctctccgagatggaccttcacttcgggaggcttgtcgacgaaggggaggagcatgacaaggacggggttacggtcggggtcgccgtgcaccacgcggagccggtggcctctcccctccccccgctgctcttggatatgtggtccgccaccgccgcgctcatcccccgttgccgctccactgccgcgctcgcccgtcgtccgctccgcccgccaccactctatcgtggtagtcccgcggttaggtggctactacggttatcgcgaaaaccatatggttatcatgaagtatatcattgtttcaaaaattgaaaatgttaccatatatgataaccacgataatcgcatggttttataaacctcactctcgcttccctcgttccggagcaagacccgttcggtttcctgcagggacacggcgagaggaacgcgacacggacgtatcgctgtcagctgtcaggtcaatatttggcgtcctggacgggggctagagaccggtgagctgatgacctcgtccggtcgaccccgtcgccgaatgcttcagcgtttgagaaaaaaaggggaagcgcagaggcgttcacgggtcacggcttccacggtcgcccgggtcctcgagcgtccacgggcaccgccggcgcggccggcggacgcggcaactggcagcgtgctagtcccggttggttggagggttgacatgcgccgtgtggctgacttgccgtacgttggtcggcgttttggcgtggcattggagatgggagattgggagtgggagagaagggtggcgcgctgcgacttcgcggcgtggactccacaggagctttttacggtgcaactgcacccgtgtgcccgtgactcggtttggtctcgacattctcctcgactcctcggcgagatcgtcgacggtcaaaacaacgtgtcagctgctgtcgcgtcgcgacaagcccagaaacccgtgctcggagaaacactgatcccacaaatccactggcgtccttgctttatcaaagatctaaattccatgtagtttcacgagctttttcttttcttttccacggaagtagttccacgaactgtttataaaagaactacgctagtagtttcacataaatgtatagtgaaaaccatatctaggtggtacctgcaaacaacggtataacagttcttagaaaaatatcatacatatagctaagatgatattagacagccccagagttgtaaaaataaactcatcttcgtttgtaagatacttgtcattggttagttcattttcaaactaaccatcgttaaaaaacaaaggaagtataaaattgagaagaatattgctatattttaattgtgtgattttttgtgaaattccagtcacataaaaattgtacactaaattgttgcgatgtgcaatacgccatttacttttttatgcagttttattgatatatatgggtttactttatttttatttgagtttgaaaactttttgtatgtatttttgtaaacctttatgtattgtatgtttcttttttatgtagctcggtgattcttttcatataggaatagtttattgcttgaccttttgtcgagcaatccccttacctctggtcaggctgtcgggggaaaaccctgtcttggtttccctgagatctggatggacagcggcggtggtgctcatcgtcgttcattttcctggagatgtcattttggaggtcccttgccaaaacttccttctggtagttagtgcaagcttcctctatatgcgttgttttcttgcggcggtgctctagtttatatgagtaggcgggctgtagggggagagcggatccattattctttctcaccctcccccctcaatcccaaaggcgtgatcagagttgagttaggtgcttggttgtttgggattggttttgggtggtcccgactgtagcttccttgttagcctagcggtggccgatccaatgctagccttctacttgagtatgtatatgtgttgtcggtgcgtgtggtggtgttttttttatttctttcctaactactgccttatagggtacttgtaatttttttcctactctattcaatggatcatcacgcccgtgttgtgctgatcgctaaaagaaaaaaatgagaaaagtgattgattttttttctttaaatttgaatttcctgatgctcccaaatgaggaatagtggataaggaaaaaaagaatagtgtttttctttgcgatttggttagtttttgcatcctataatcaaagttgagtttgttcttattggatggctgtttatttaaatctaaacttcttattggatgattgtttatttaaatctaaactactccctccattttacattataagtcgtttgatcttttcctagtcaaacatttttaagtttgatcaagtttgtagaaaaatatataatagtattttcaacacaaaacaagcatattatcaaaatatattcaatattagatttaatgaaactaatttgatattttagatattgctaattttttctgtaaacttgatcaaatttaagaaagtttcactagaaaaaaaagtcaaacaacttgcaatatgaaacgaaaggagtagatgtgtattttttttacttctaacaaaaatgttttcaagtttccatagtatatgttctgcggttatatattcaaatcctgtgtcatgcattaatttcaacaattcttgggatttattcatacaaagtatggaataaaattgaaagccaacaaccttttcacatctaccaactctgaatatcgaaccaattctgacaaaggctgacctaacacatatctctttttttcttttgttccttgaacgtgctgatttttacattgttttgatattggtaccaatgacgaaattgcatttatctatctttccatgtgatgggtcaatcacatcgaatatatacacacacaacccaatatatcaatttttctagcacttgcgttaacttcttgttggtttctctatgttgtagatgacatgaataatttaaaatttgagcatcatatgatgatataaacacatcctaaagctatagtgtcgatgaattttagcaactatctatcttgaacactcaatccactttatgtttcataacacatctattgtaagaaaataaatatattgatttctacttaagttgttttcgtattaatatcactgacaagattgtatctatctatctagtctatagagtgaaattacgtcggatatgtaacacagcctaacacgtcaaattttctagcacttgcgtccactttttgttggtttttttatactttagggttgatgtactctagcgactacctatgaacactcaaccactttatgtcttgtaacacatctatctcaacaaaaagtcctacgtttctatcttttgggtcaattgttcacatttatttgtaaaatagcaataaatcacacatcaattatactatttcgttgtttccatttttttttaccaataatgcatttcacatattttcccactaatggtattcacatgccattcaaaatagcaacgaaccatatacaaccggagggcgaaatatgtactactttcagaacgtggtcaacaaatttgaaattaccgtgtaacctcctaacaaaaagaaaaacacaacgaaacacgagttggtctttcatcattttccacgtacaaccgcatgacgcgaagatcagaacgtatcagacggtcaccgtgccatctggacgacaaagcagcgtgggccggagcacgtgacggcgtcgtcgataattagaggccgttgctgctgtgcttaccactgtgtgcacattgtcatttcaccccctttgattaattaaaaaaaactcgacgcgtaaaaatatatagaagtactaagctaatcgctggacggaaaagggagcgaaaaagaggcgagagggaggtgtgacggagacgagcaaggaaagggaagagagaagagacgaaacagggaggaggggattgggactcgccgcccccctctccaaattccccactcctcctcctcctcctccgcctccgcctccgcctccgccgccgccgcagcctatcccctcgccaatccggcgaggtagaggagtgggtctcttctcgtgctctccccaaaaccccgcgcgcccaattcaccggggtcccgagctcccggcggaggctcgggagcgggagcgggcaggggcggaggagatcggatcgggggaggggggagcattgggcgatgaccgccgcctaggatgcagctggactccgccggcggccgcttagctgctgctgctggtgccgcttatttggaggagcgtgttggtgtgatcctagtgggagccgggagccgggagccaggtggattgggctgaggtggtggtggtgggcatttgatctccgcgggggcggcggcgattgggtgctgggaggcggttgcgcgtgtggtgtatggaggtttcctgggaggtggacgcggcggggccgccgtggaggccgagtgagtccacggcgttccttccgttcgctgctgctgcggcggccggggaccgggcgggggcgtcgttgtccggtcgacgcaatgggcttgccgcccgctcaagcaacctcagctccgtcaggaagaggcctgtacgtttcctgcaccttccccttctcacagggctacctaagatgcttgcttgatgcggctgcggtcaggcctcgctttgctgaattgtcaattgcattgagctattcgcacatggttacttagctggaatgcgattagcatcaggtgcttgcaaggaaccaatagcttaaactctggtcgcttgaactagctgtatcatatgatcacccattgttgctgccattttttcttattgcttgcacgcatggtctagattattcgattgctcagattttctattgattcttcagctacaaacttcatttctgaaagctctcagcattgctaaccagaaatccgacccctgttttctgctaaattcgaatgcactgttaagtttaatgtacactagatttgtttgcttagcttgttcttctaatcgtatagtcactagaacaggtactttactgctacaggcggtcctaattactttgatcataattcatgagcgaatgggaggcattgcacaactcaaattgacttgaggatcctagctttttgctaagttaagatgttcctttaaattggtatttattttttggcagcataactttgctatctcatccaggggtaagcacaatactttagggacaattttcaactttgttgatattctgaatgtattatattgtaaaatgatgagggaacagtctatgtgacattttttttgttacaattgttcaactgtgtatgacacctccttcatatacttgtgatgcttcactctaaattatattttcttattcctgcagtttgttgcaagattaaccacagacattgtccaaactttcggaaaatgcaatcctgagtttaagtactcagattcactgaaccccaagcgctttctcaccaacccttcagttccagctcacaatgatggccttgataatgcaaattctgacctcatcttgtatgtcaacttggaattggttaataaaaagtcggaccggaggttagttttcttcttgacttgttaacccttttatgtgattcaatatttgtgtctgttgtccatttcttagtgagttagagcactcaaaacatttttaccagatatatctcttttcactattttgttttttatgttataagttagaaatatgtatgcacattctgactctccattatactaagaactcagatgtggaaatatgggaagatgaaatatgtccaaaggactgccatattgccacacattgtagtttctttcaaattttcaacttattgaacttaggcgataaagctatccaattgatcaattcaactttgtgttcatattttttttatcagagttcctgatggttaaagttaagagtacctttacggtgctctctagtattctactacaagtattattgccaatagaagtgatctcaactattaatttatgagttctactaccagtagaaaatattattatactaccagtagttgatgtggtagtataaatagatatgatctattggagaaaaaaaatgatctagattggttctactaccagtagagagcattgtaaaacacctctaaagttaaactatgaacagcatcagattggactgcactcatctttttattgttctaagtagggtacgttattaaagaaatgcttggccaaggtacgtttggacaggttgctaaatgctgggatggagaaactaacagctatgttgcagtaaaggttataaaaaatcagcctgccttttatcagcaagctatcatggaggtctcactgttgagcatggtacagtagtttacctagcatttactcacttgtgattgatgtatgtaacgactggcatcacaactgtgtatgctcaatcttgcagctgaatgagaaatatgatcctgatgatcaacaccacattgtccggatgctggatttttttctctaccaaaatcatttgtgtatagcatttgaaatgcttggccataacctgtaagattgtcgtacttctcttcgctaatctattatataccatgtaactaattcatgtatcacttaaactcccacatctagttatgagctgctaaaaaggaatagtctaagaggtttgcaactgaaatatgtccgaactttctctagacaggtaaggttttattttcatatggtgcttgaatttttgaattttaaatgcattgattaccatattatctatgtctaattctttattggtcagatattggatgcattggttgtcatgaaggacgctggcattattcattgtgatctaaaaccggaaaatattctcataactccaaagttagttgtctcatctcaaatcagcacttgatttgttcactgtttgcatgctattaatccatccacgctatatctttgcagtgtaaaaacagcagctggggttaaagtaattgattttggatcagcatgcttggagggtaaaaccatttactcgtatattcaggtttcattcaaactcacccatcagtgtgaactctgaattcatgttatagtaaaattgttgatttaaagaagcttctccttttttttttcttttccagagtcggtattacagatctccggaagtacttcttggttacccgtatcctgtgtgacatctatttttcactaggaaataccttaaagctgcacaaatgtcttatgcttttaatttgtttttctctgttatgtccattttaaatttgtcattatgtggtgcagcttttgtgaattctaacatctggatttgtaaacttaacaagtactagatataccacggccattgatatgtggtcatttggctgtatagtcgctgaactatatataggattgcctttatttcctggagcgtcagaatacgatgtcctatgccgtatgattgagattctcgggttagtacatctgattgaacttttccctcccttttcttcattacaaccaacaatttacagtgaaaataacttatattcaattactttgtaactgtctgagttctttcacttctgttcttaacttttcagaaatgttacaacattgcttttatggaaattcaaaagtgtttttaaacatgtttgcctttttcttatacagtggacaaccaccagatgatctgctacgggaggctaaaaatactgggagattttttaagcaagttggaagtatttatcctggtattgaaatgcagaatggccctatcagtgcgtacagaatattaactgaagaggagattgaaactgtaatatttttattttttttaaggttacatatttgtcctgtcctatacatttacttcattattacttatctataccctgtttacatcctgcaacacagagggagtccaaaaaaccaaaagtaggaagatggtatttccctcgtggaaggcttgacaaactcatatatacatacccttggaagaatttgaatggggaaaacttgccaggtatgttttgtgatacttatttttaaggatggagctaagtaggtttacagctgattttgaaactgtgtttattctagaacaatctcagctagcagtgatcaatatggcagacccagtaattagcgtttcttgcggaatacgtggttcatttggtgtgcattgccttaaggtttattgcctttggtgtacgactatactgtggcataaattataatgggtgcccaggaagttgcagtagttgttatagaactgatagtgttgcatactatagcggtaccttttgggaaatgatcaacctagttaactataccttatttccggttgcagttctttattaaacaggtgtatgaacaataggttagcaatgctggcacataccagaatcatgcaagatactaataatactggtgaacttagaattatttcttagtattagtctcttgaatgataatatcctagtccttatgatgaagttgcaggtttgacattatcttctcacctatttcaattttgattcagagacagaaaagacagatcgcttagcactggttgatttcttgagagggcttgttgagtttgatcctaataagcggtggtcaccattgcaggtattcactgatgataacatttgattcctatttggttgtactctttgattgtgaatgggaagtcttattaatcccaatatctgaatatgctggggaatccttgtttcgtagccgttaaataaatgagctttaggcaggtcagtttggtacttaggaaattattaacttgatttcctattgcgctatttttttttcttcttgaataatcaatggaagtacttcacaattatgaacctatttcaggcttcatatcatcccttcataactggtgaagcgtttactggtccatatgagcctatccaggagactccaagaattgtaagtatgatcttgtttccagacaacctgctgtataatttttctctccttagagactgttgatacggaacgaccatcatttgtaacaattgactttggttttgctctgcatttaattgaacgaggtatttagatatcttcctttcacattataacaaacatggatacatgaaacagtgtttcttcccaccaacagactatatattgctatatactactccctctgtcttcaaatacttgtcactaggtactattcatcttcaaactttgacagctcgtcttttttgaaaaaaacaaatacttaaaagtatgtcatattaacgaagtgtgttgcaccctaaatatcacaaaacttttgtgcgtcatgctccaccattcaaaatttgttgtggtcaaaattataattgcactagtcaatggtgacatatctgaaatcagagggagtagacaatgtggagaaaccttaaaatacttgtaccttaagcgctccctttttttcatacaagtagtccgtaagtcatatacttatgtcttgttgtgttgtgccattgtagcctgttggtcgtgttgcagcagttgatcataatcctggaggaggtcactggttagctgctggtctttcccctcaggttgtaagtatgttctcttatgcttttgttaagttggtgagttgtaagataattattatcataatatattgttgattatgtttgtaggttggaagcattaacagaggcctaccatttaataacgcttttgcaccaaagattcccttttcatatggaagcagctgtggcagcttcggtagccatggtagctttaatgacaatgtaggtcttgcaagcagctatggaagctatgatgtcaacagtgtgaacatgtatcattcaccactaggcccttctggattcaatttacattcacaagccggaggaacatttttgggatctagtccagatattagacgacgatcttatctctatcatggtggtggcattcgattaagccctgggtgtccagggcctatgtctcttggggcaagtccatcacaatttactccaccaaattctcagatgcaaatcccaagtactgctacaggaaagtatggttccacttctcctgcaaggagcagtcatggctcattgggaaaagctgctgctgtaggccaatacaatagaagaagaaatcttggtcacccacctatatcaatgccgcctcatgaatacacatctcagctgactcagggacaccatggggatggcaccattagtaatcactttgatggctatgctcgtggcattctggttacccacaaagtgcactccctaatcctggtcatttcagttggagaccacatacatgcgctggcagtggtttatcaacagacacttcgaaccatgggtcctttccaccatctcgatacggtggttttcctcctacgcactcatccaatgtgtcagcagatacactggcttccacctcatcaataccggatccagctgattgggatccaaactataggtaacagtgcatcatacagttttgtctttgtaatgtaacatgtgttgatctttttcactttgttttgatgtgcagcgaagagtcacttctgcaagaggacacttcactatcagatgcgttgagcgatctccacctgaaggatgcaagtggtcaaacaaaccaatccagcagattggcccatatccaaagccatgctattgcaaactcaaactctttatccatgaatcaaaggtacttaagtgttttctaatttgttcatgtaatgacatttggccgacgcataaaaagctaatataatagaggcacccctcatctgatagattgcttacaatccaactacaatgatttgctctctgtatagttcgctcatatctttaggaaaaaaaaagcatacttcacttttcccaccttgtgctgtgctgctggtttctgcttaattattcaccatttttacaaatgctaaaattgtaatgtgctaacaaatggatttgattatatacatatgtaagggtatgattgtcattttggatggcatgtgtacaaagaatcgaaagagctttcatacacgtttattagacgctgtggggtgtaaaatgtaatgcctctcagtgcaacagtttgtttcatgacaataaacatcttaagggataactggataagggaggtgcttcttttacacgaatcttgttttctatgtgttgctttattgagagtaataccactgaaaatattttgaattttcttgggtggtgctatattgtcaggggttccatattgttatatttagtattattaactgatcattgttcatgcttttcctatagaggtgaccgcctgttccatgcatcaactcttacagagagtagtgcctctacaggccatgtgacctatgatggttaccataatgcaaactattctcagctgaattttcaaagtcgccatggacaaccatttcagcggtataaccatatgactgcgagctacctacgtccaatggggaatcatcacaatggtcagcctgtatggcctaattatggcatggcagaacctccacctgctactatggctgacggaatgccttggggtaatatttccatgttgtcatttgtatgttttatttaattgggtgttgttggtatagccattgactctgcaaaagctatcgtagcactagatttactaccatctgtggtcctctttttttatgtggcatggccttctagtccaacttaactaatttttttttgaggtatccaacttaactaaatgtgctactgaaaacttgcaatcttggtattaattttcagaacaatggccttgcagtacacatagtttattggcaaattttgtttaatagtatattgaaacatgtttggtctaggcttgtaattgcacatgggactgcaatggccaaaagaaaaggtgtaaccttcatgcatgagatatgtatgtcctgttgatatagtttgctttccaattggatcttccatttttttttcacgagtgccttatctttattaacctattatagcttaaaagtcatttcaatcggtgcatgcatttggaaaccatagaaggtatgcatatttatgtctgaaacataattctgaatgttgtgcaggaggaaggcctggtcactcttttacagcaggcggactgccgtcttcctttgcaggaaaggattttggaaggattttctagtatggatctggaggaatgccattcaattggttgcattagtagtttgtatttgcaactcttggttgcattgcttacgggctgttgattttgcagtttgttgcattcctctaattgatcccttcgcaatgctccggctcatagaactgtatggtatgggtctgtaattgtagcattctctgttggtttcttcttttcgtttttggtttatttgttatacatcgagcggaggcttctgcctgctgcaaaaacccagcgggaaaaagaagttgagcagcccctactttcagaatgccatgcttttcatgtgacttctgacgatttagacagatcaaatcaaaccagaccagtacaaatgcttcaaaacgttgaagatttgttaaaagcccttgtcgctaggggaaaaaaacaaacgctacaatccgcccagtaataataccgtgtcattaaaaggatcagatcagaccactactgtgtgattgatccaaattaaagacaagatgcttcgctgacacctatttactcccagtaggtacaccgctagatatataaactggcagccttgcaaagcgagagagcgagtgatattttccctcggaggaaaaacatgtgtgtgctccatttatcatgcatctcccctcctctgattgtgcaagtgtggcactgtgttaggaggcatcgggcaagtcgacatctttgtgttcagtattctacctcctgtctccttcagtgccgcacgcctgcaccctagatagagcgaagaatctgaacgtagtctatcgagatcaactagaagaagctccttcacacactccgatcggtgcatgaatcgacgaaatatcatcccctcctcgagctcgtgctgcatccctcgctctgctcatcagcgccgcccgtacgtccgccgtcgttcgtcacgccgacgagggcagaaatggatctggcactcgttgacgtgcagacgtggtgatatgcggtggagatacgggggatctcacgccggagctcttcatcgatggccggcggggacgcgcaacggcggcggcgaggcgccgttgacaggttaacagagcgcagtttggttaggctccactttgatttcgaaaatctcactgaacgtacttgaattttgagctaatttcgagaaaatagcattatccatcccctcaccagataaacttttcgtgtttcgtgttcgtccaatgtcacttcagtaacattaatgtggactttgtcgatgattatcgaagatatggcaaaatattgccgacaaagcgaatcaaatgttggagacacctgtaactactgttggaagctgcatccagcctccaggcatcagatgagctttaagccatcatctgcagttattcctgaaaatcaatggttgcccacggattgccctattgcgagcaataagggtgcatcaaatataacaatgtgatgaatggtagtacgaggtgaggtttctgtaattgctatgcttctgaggggtcgtcgtagattcggttgtggcaggttgaatcgcaagggtaagggcaatcaatcttctgaaacggattgcggtcgtagaaccaatctccaactgcatccgctattgtctacacaagtgtgaagagctcttgtcagatcatcattagatagctggctctagcagtagccggctctagtagtaactttggtttaattttgagttaagtggtgttgaagttgaaggatgtagtattactttggtttcaagcatgggggaaccagatgcaaaccatgtctcctgcgtctcagattggcaatgcacgaagcatgagtttataaacaatcctctggtggagggagtcccttgttccttcagtgctttcagaaaatcgtctctgaatcctgtgatggcatttagaatccatgcaatttttaaactgggtcgatagctggccaactagaaaatgcagtattacataccaatacactatctagtacctaccttgcaagatttgaagttgcgatgcaggacattgatctatatcatgcttacagctatgccatttaccatgagggtctgcaaatcctggcaccaagatgttccttacctgtaacacacgagacctaaattaatgccaaaacatatttttagaaaatggattaaagtctggcctctacatccaaatcggatgtacacagccacaatgccaaaacatatgccactacaaagcatatttatctaagggcaacactaaaaggatcataatcatagaagtattgcagaacgtggatcagatgataacctgccaggaatcatacgctgcgttgagaatgaacaaaggtgtctgaatctgtttcacctcattctgaggaaaaaagcactgcattcaaagcaacatgtttttaacaagtattcaagtgtaatctgttgtctaaattcgtattgtaaaactgcctgaagcttacaccttaccatgcctggggacaatctggaggtgcaagcagaaggtaaattcttcgctgatccctagcacatttgtacaaaatgtatttaggtataggagaaaacaatgcaaatatatgtgaaatagaactttggaaaatgatggtttgcttttcactctgttaaattctgatcctaatttgtaatttacataccaggtaagtttttttttggggggggagggggggggggtgcatgtgtgtagaatccttgactatctactagtataacagagtaatgactgtatgtgcatacatgggttgtagctacgccattgaaaaaggccacaatgtactccactccagcaatatccttcctgctaacacaaagatgggataggtgttagacatgaactcaatgttcagaaatggtgtttttttgttctaagttaatatactaatggtttgtccttcatattaaaatggctagtacatccttaatgtggaaaaaaatacataatgcatttaatttttccttcaactgccttttgtactagtattgtcttactcattgatgaagaaaccagcatcagaaaggcatttaactttggtatccactgggaaaaggtcacgaaatctgtcacagtgtagtatggaagttaaaccaccagcagaacagcccgaaattagagcctgccataaattcgttagtcttgaaaaccttcttgttgtcaagaattatgctcataagaataacatacattattggcactgttcattcctttcgcaagcagatcatccataactgcttgccacaccctagcacctctgtagtgaagctttgttgcctatccatatggaacaaaatcaaagagaaacttaacactggagcagcactaatcctcatacaatttgtaactgtaaaatcaagaaagaatggactatggactcacaggatctactttttccacatcgccggtgaaagatgacccatcacagtaccgaaccttgaccttgttccaattgtagaaatctggttttgatgattgcacaggaatcgatcaagcatgtgaactatactactccctccgtttcatattataagactttctagcattgtccacattcatatatagatgttaatgaatctagaaagtcttacattgtgattcattaacatctatatgaatgtggacaattctagaaagtcttacattgtgaaacggaggaagtagtaagtagtaacattatcttaaaaaaaaagtaagtagtaacatggagcctaggcagtccaattcctgaggtggtagagaactaggacaacatagtacaaaatattatttccttcaaacaactagtgaaatacagtacccgggttgtaatcaggggtgttgctcagtattccagagaaggcaatctgctttgccatctgcttcgatgatcctaaccgagtgcgtttgcgttgcaggcaggtcgtcacattgctgcaccatcctcctccctaacatttgcaagaaagacacagaaaattgagccgggcaaacatttgtagtagagttctaggctccagtagcacaattgcactgctatcctcacaagaactaacctcgaaatgaaccagccaactattcacgccggagccaaaaccccgggcgagatggtaggccggggggctcccatccaaacagactagcacatcacaccacacaccatcgaatgcacattagcacaacgagatactaattcaggaaagagagagagagaaaaagagatactaatacagtatgaatgaacaagtaatgacagagaagcagctgcatccacacctgcgcctttggccacagcgctcgctacgtaagtaatgtccacgaaatcaccatccaccgtgagaaacaccagcgcgcagacaagtgcagagcacgagaggcagacacccccattcgccatcctaacgagagcgcgaaaacgagatacagataaaaccacacgagctgcagaagaacacacataaccaaaccaaccacccaagaactcacccttttgtgccggagatggaacagcgcttaccggatacgccgtctcgatctaatctcgcatgctctttgttcttgccgaggcgaggggacgggacgggacggggggctcaggcaagcgaacagcgcaaaagcttggagctttccatccaagctcggcctttttttttctccaccgcgcctctgccgatgcaaaacgcagagtgggcggcccccgttcggtttccacgccgggccgcgtctcttgtgtgagctcgtgtgtcctctctttttccccttgggtatcatctagtgcgtgcgtacgccaggatctcgtcatcaacgcaacgcctgccattgatgccgcacgttaagacgtgcagtggtggtgaattgaacagtgaacacggggattgaatacagtgccagtgttaggcacatctgcactctgcagaaagtggaagtccagcctccagagcaaatacgggaaaggtttctgcgaggataatggagcagagttcattccgtcaggattggaatggttaatactccgtcatcccatgaaacccaatctaacatgagatgtaacacaacataatataataaatttgaacatactactctatcttaaaaaaataaattctagctacaaatctggatacgcatgtgtccagattcgtagctagaattggactttttttcttgagacgagggtaggtgttatatccagctctagattcgtcttttataggatggaggagtaggatcgagcctaaactattttttctagattcatgatctataatgatcaatccaccacgagatcatgcattatattgataggttatcatagacatccaaatgaatcaactatatattactaatagatcaagtaattttcaatataaaactgggacaaaaattcttaaactcattttcaggctataaaaatttttcaagttcagttaattttcatagaaatgattattatacagagtaatagaccgagagaaaatttactacacgtgcataaaacttggaccaaaaattttaaatcagtgttcataatataaaaacctattaaattcagttcatttttatagaaatgatttattatatagagaagcaaatttgcacaaatttagaccatttatacatgtgaagctgttttagattgaacattttagacataaattttagagtgaacctaaaatttcattagagtaaatttatatatcagtttaatggacaagtggagtcgaaccaaaccattgccatcctcatcatttggtgtaactttcttttttatttttcgaacgaatcatttggtgtaactttctgaaaatgtaaaaatggagaatggtaatcctgtcttgactccttgactcttgaggtacagctgcatctgtgtgagagcatgtactacctcaaaagtttaaccatccgtcttatttgaaaaatttataaaaaaatttaaaaaaatagtcacacataaagtactatttatgttttattatctaataacaataaaaatataaaatagtaatcataaaaaaatttcaaataagacaaatagttaaatgttagacataaatagcgtaaaactgtacttattttaggacggagagagtactaactatcattgttgtgcggccagcaaaagccacggtacccaatggcaatgtcagcatgtgacgagtcgtttctcgagaaggaaaccgatgctacggagtagagtagtatctttttgaactgttgatgaaagcatgtacctcgagtcgaggtaaaataattcatcgctcgccgaatgtctttgccttcaaatggaatgtccgaaggatgtctgtctactagtcttcggtcaaaaggtgagttccattttccatttcccccctagtgttcgtgtgttgtccagcttgaagacggttgctactctcatctcatggcagttggcactgcagagatggaggtcggccggcgtgtgtcgactagagatctggctgtgtctttaacgggttacggcactgcggtttaagtccacattttctcgttgggccggaacggaacgggattgccacgcatgtacggcctgctatacttgggacggaacgggattaccgtctacgtgaggccctttctacttgggcaggccggaacaggattatgatgcaagggcgtcctgtattgtatacttcctccgtctcataaaaaaccaacctaatatcggatgtgatacatcctaatactacgaatctgaacatacattattccagattcatcgtactagaatattcatatctggtcatatattcattttttatgggacggagggagtagctggctagacgagataggtcccaactcgcgccctgtttttttttcccaagaatacgcaaaagagttgtgcatcattgtattaagactttgagagaagcaaattaatacaagattatagcactaggaggctatactcacgataaaagagaaaacacaccacgccacgtgcccacacaccaccacaccctgaggaatacacagccacctctaaaacgacgccttcaataagatcacaacattaaaaatgctgtcatcgctcatcccaaaaggataagattttcacctagaggatccctttgaagagggaagggaggcacctcgacaacgctctcaagaggtacctcgaccactcgcggcctgttttggttggcctggaacttaacgccacgtgtttcggaatgctaggagacgagatcctatctcaagcatccgcattgtatgttgggatcctttataaggtaggcaataagaaatgggtagggcaatctgcatctgttccccgatttcatcccctaactctagcactagcttctttgggagagaagcctccctcactcttggtcccagcgggttctctaccgcttaatttgaccttacacaagagccaataagttgtagtgtttgacggtattttgtgatcttataaatccaaggagtatttgtattatcaagacaagcaaacaaaggagctgctatgatcgtcgcattcgttaatatgtgagactgtatatagcttgctcaattgcatgggatgcatgagccatgcacgtactacatatatatgtccatctatatatggctatatccatgtgtgtgttcagccatatatatacatgcttggctaatctgtacgtatgcatgcatgcacaaggagacttgagtgacatgtgagcagctcatacacgagcgctatatatgtattcaccgtacatgcatgtatacgtatagaaataccgcgtgatttctgagttaagaagcaacagctagctacacgtacggtggaaatgtgaagctgcccgtgggccggcagcccatggccacatttcgttctcatcgtatatatgcgattgtatatcagaatacacgcgtacgcgggatatctcaaccgcaagctactgatgtgcgcggctggcgccggataaacccaagcaacaaactccgccttatccaggtgattcggatgaaagtgatctgcagcaacgtcgccggaggcttcggagcgaaccaacgcgtgtggccccggcggcgctggagtatacgcgcccatccgttaggttttcctagcgcctataaaagccaccgagagccagccagccagaggccatggacaatcaatcaactcccatcgagatcaatctatcaacacacagttctatccatcggcatccatctgtctctgcccagccatcttcaactcatatccatcgacaacacaccggccggcggcgaagcagtatcacgtacgccggtgtccctcgggaggggcagatcgccgagaggcggcatcagcgcacatcatcggcgtccggcgagctggtgtcagtccgatctactaccatagattgatcacggaggggaaaaccatcggcgcgttgctccggcagcctgtagactactcgtcaacatcggcatcaatacacatccattcgtcggcgagtacagctccatccttttgtttgttattgtctttttacagattgatcatggagcacagacaaaggagaagaagccatgatgtggagttggccggtggccggaggacgcgctggccgacgacgccacaccaacgtgtgcgccaccggtggctgccggccggcagcatctgacgctcggcgagggtacatgcagccacccaggagacggcgccaggcgatcggcatccatattcatctactccgatcccatctcatccacagcatatatcaaatagcagagaagcctccagcgcggcgggcgggcgtgcacagcctcaccggcgctcggcccggcagggaggccgaggccaaaggaggagaaagccatctacgtcgtacgcgcacgcgccgacggccagcatccatctaccggcccccacgaagcgaccttccgacggcaagcaacggcgtttgacctcggcagccggcgacctcactgctgcacctcggcgtctaagacaggaagtgtgcgctcggtggccaggttaccacggctgcagcacaccccagcgtccggcgtgaggacgcgcacgccaaggaggagacatgtgccaggaaggagcgaggcgatgtcgttccaatctgttgtcatggccagggagaagtcgggtgtattgccgtcgcccggggtcactgggccagccgatctattcacgtcacccgcaagcctccgtcgagattgacgtcacccgttcaagccactggtagtgtcactaccgtacccaacgctgtgacaccaccaacacccgtccgccagagaagaccatcgtgacgccactccgtcggggcgcgccggagatcgtcggagcagccgcggacgccgccaagtcatgttgatccagaagttcttgtcgagaacgacacagactccgctgagctgcccgcgtccgtgaacaacatatcctcatcacaccggtagccacccacgccatcctgatggagcagccccatcgtcaaccgggaggcatctcgtccaccttatcggcaacgcccagacgctcgccgtccccgtcaagctgctggtgacactgtccgccgagtgccaccccgtcaaagtttgccgttgtgccggcaccatcgcaccgacgccaggctctcaggatgtcggcgttgtgatctctactgtgtgaggacatctcaccgagactccactggccggcgacgccttcacgctcgccgcggtctcttaggtcaccattgatgtctactcaatcatcttcgacggtcctgccattttccttacactcgtcgttgagccgctcgaggagatcgcctgtcggagcgccgctacccggagcccgcacactgtcgtcgtgccgttcggctactacacctctgcttcatcgcgccggacttgtgatgccatccgtccgcgatgactattcttcgccgagtcgctgaggcgctgccaagcagcgctcatctccgtcaactaacaatcatctgccacctgccggagaaggccgttgtgacgccacccagccggagcgtgccgaagatcgcatctacctgatgctacgacgtcgccaagacgtcgagcgtccttactttgctggtcgcaacctatgagaatggcgacaccatcaacatctactcaacctatgcaatgccggagtgccactgctgggtgcccgcacgctgtcgtcaagtccgccggcccatgatcccttcacttcgtcatgccggagcatcatggtttgcagtcatcgcgccgttcgtccgcaatgtcttcacctcgtcaagccggcgtcgtcgtgacgtctcctctccacaccaacatgatatcgtgacgtccgttcgtgatgcgttctcttcattatgccgagatgagatgttgtccgtccatggtgcttttcccctctttgtcaagatctgtgtcgtccgtccgtggcgctttccccctcttgtcaagaatcgatgtcattcgttcgtgattctctccttcttcgtggagattgatgtcgctgttcgtccgtgtattggagtgttgctcatcttcatcaacataaagcaagaatggtgccgtctgtgatgctagggaaccgttcgtgctgaatctacaccaacaatgtcctcggccgttccgccgaagagacatttacttcttccaaggtcgccgtcgttaccggcgcccttatatagccccttttatgggctcgtcatcatatcaactggatcaatagtagatccatcatccgaaggtgctaaagccacgttcatccggctattgtctacattgacttcttcatcaacatcttcattgcaagtccctgttgtataagggacatgacgaaccaagaggtgcccagccatgtgtaatccagctaccgtctacaccaaccgtctttgtcaactcttcgtcactttgatctcacctagccaggaggtgcctagccaccgtatattcggctgttgtgtacaccaactgacttcaccaattcctcttccctttaacatcattccgacgctactactgtgacgtctctaccgtccaagctatgcgagtttcatgcatgttgaagatcaacctatctacaccaccacgtcgctcaagactgatgaggcggagcgacgagggtgggcgaagccgatggaaggctacgctaccaacatcggcgcacggaccgacgaggccgtggatgcgttgccggcgcccacatatatatatccaccatcttcaccaacattcatcatgcatggagaacgtgaagcgaagacgacgagacgaccacaagcaacttaatcggaggttctcctacaggtgtagatctgcggaggtaattaaatgggagtctttcgagaccccaggaaccagaagaccacaccgctgatgtcaagatctgtccaacgacaggcaatggcgcgcgtattttatattatacatggaaactgtatcttgttaattcaattaataaagatcacgtgtttctgtgtctcttttgtgtttattttacattgtgtatctaggtacactggcacgcccgcgcttattttctttctaaacatagaggattatattcgtatttttctatcctaaacatgtagcacaggcaaccatgtgagagatggtgagataaagataaagtaaatgcatgagagcaggcgtgtagcaatggaagaagcaccgttgcggcctgcgggagctcgggaggtggaggtggaggccaccgcatgggagcaaaagccctagagttgcaagtgagcatgagcggatagtgaagttgtgtcgggaggcggatgcacgaggtcgtcttgtgcgtgtgatgcggtcggagaattgagggtacccatcagcgacaattagggaaacatgaggttatggttgcattttgtttcataccgacggtgagtagaatgggggttgaattgggcctaaatgcatacacatgtttttctaatgatttgtgaattatgataagttttttttttggggggggggagggggaggttcatacttttagggcttcacaggtcaatcattgggtgaattctggctacccctaatctcgtcctcagcataggccgtcaaactttcattggcctctgctcacgatgatgtgcgactctatgagaaggatgttgcaaacaaagcgaccactgccttgggcccaacgacgaaaaaaaaccccgccacctctgaccaggcatcgccaccactatccctattgccctctttcgctaggggtaatacaactagagacatacctagattaggggttgttggcggtatggcatgaggcccttcgaccaaaacctgccgaaggctatgcgaggagtggggatccaagcccgagacgtcaaagttagtcggggcgaagccccccccaatggcgaagactatggaacaaggacggcgagaggcgaaggatcgtgcgggtactctgccaagccggaggcctcttgggggaaggatgtagggcgaagagtatatgccgaagggagacgacttcgccaaagcaagcttgcccccgcgagggccgaagaagccttttccggcccatcaagcctaggggccattgggccgacgatcgcctaacggcccatcaggagtccatgaacctctattacactatgtatctatgtaaatgtccctttcataagggtaaccatgtaaattcccctgtataaccaaaaccctagtagtaagaacctgtaataggggctataaatagtctcatagggccatgtaatagggggatctaagaaaaattctctaatcaatacactttactttcaaccactgttgagtaaccacatctttcgacgtatgcagttgtcgtttcgacaacagttggcgtcgaccgtggggacctccgagcaaaaccactgagagcaaacgccaccgaagaatgtcgtaaaggagaaggttacaaggcgaaaggaaagcgacgccggggtggatatggctgccgaagagggagcagagccttcggcgcttatcgccgaagatgggggagcgccatctgcttccgcacctgcgccatcactaccgccttcggcccctgctacctatgtgccatggcgaaggcggctgcggcggcaagggcactccagaccagggcggagatcctttcgacaagccaactgctggtgccccaagccgctccgtcgcagccggcagcggcccaaactgcgctcgccgctgtgcaagcccaagtctaccctgaccccgagacacaaaccgaagccgacatggaagccgtgcgacagaacatgacacgactccaagacatgcttcgccaaatgcaagaatagcagcaagcgtacgaggcggcaaggcggtccaaggtcgcttcggcaccaatcctccagtattcggcaggctatgtcccaccccaagtctatctacaagtgccgacccagccccttccgccacaagtcgcgcaagcgccaatgtacttcgctgggcagccatcgaccgcagcagcgcatccggcccctcacgtgcaactgcaagctcaaccgatcgctgcccaagtacatcctcaacagcctggccaagtgccacaaacaatggcagaaggggcttcggctctgtaggcgcagctccaagctttccttcagcagctcagccaaccccacaacatttcaagtacagcgccttcggcccgcccggaggggaatacaagtcaaggtgcgcctagttgcttgccttcgaatcagccaggtctaggggcttcgccgtggagtcaaggaccgcagttcgactctatcaatgttgccaggcttcggagcaaaccaagcaccaaaccaggtcaccatgacatggtccagccaactttcgacccattcatggcggctcagcaagcatcaccatcggggccgagcagccgaatgccatgg

SEQ ID NO: 63296 - DNA, 692 bp, Oryza sativa
tttttaaagtgatttcttatacgatttcttatgtatttccaaaagcgaaccgaacttaaaaaccgaaaccggatttgtattttcaaaagcgacggacttaaaaccgatttttttaaaccccccaaccccggggggggaaaaattttggggaaaaccccccgggttaacttaaaataccagtaaaatcatcttcaatttttatatcgactcttataaataagaaatgccgatgaaaataagaacagaacttgaagactgagcttcgaatctatgcttcctgatgagtctcgccacatcaaaaacctgcattcagtcagtcttaatacgcagcccaaacttctgcagtccttatttgtgtgcattcgagttttcgatgatattcgaagaggagaaccattagccctgcagctctagtctcatcgcccctacgactcccctgaaccctcgactccttcccactagctcgccgctgcctgagcacaccgctggagttccacgtgggtgcaaggatggcggcggcggggttcctttcagctctcggcaggcctctatggccgcttcttgcgggcgggcaggagcggcgctaggcttcgggcgtggcgtcggcaggtcggctgctccggtgaggacggcgtccggttgaagcggaactcgcgactcactctcctagtggcagagtggcggcaacgctg

SEQ ID NO: 63297 - DNA, 612 bp, Oryza sativa
  unsure (1)..(612): unsure at all n locations
aaggtgctnctgntattcgagctcggtaccccgaagtactaaacatagataaaaagaaaaactaattgcacagtttgtatggaaatcgcataacgaatcttttgagcctaattagtccatgattagccataagtactacagtaaccccacatgtgctaatgataaattaattaggcttaataaattcgtctcgtggtttataggcgagctatgaaattagttttttttcattcgtgtccgaaaatgtcttccgacatccggtaaaccatgcgatgtgacacccaaaaattttcttttcacgaactaaacagggccttagttttgtttttgtccaaatggctgtgtacatctggtttgaataggagagggccgtgttcttaattatttttagaaaagaaatcattttttctaagtcaattttgttaaacattgaccgatcgagtttatgacagcatgcaccaacatctacaagatcagaataattttattattaaattacccatcaaagatattttgttaatgatatatattgttataggtgttgggtatattttccataaacccggtaaacgttagataagtttaacttaagataaagctaaaataatttaa

SEQ ID NO: 63298 - DNA, 626 bp, Oryza sativa
  unsure (1)..(626): unsure at all n locations
tgtgggctannattgattgcgatcctgctcccnaccctaaaatttgagaggggtccagggcccccactgctaatacgctaaatccgtctctgcccgggcacagccgtgaccgtggccggaaaggggagatggggagatggggagaggggagaagaatatgtaggggggtgtgacatgtggagcccacgtggacccccaccattttttttattactttgtgtctaaaactgacatgggggtcccacggggtttaatatttttcatattgagttgccacgtcaccgccacgtcaatgccacgtgggatgaagacatagtcaaaagagccatgtaggcgccacatcggccaaaaccaccctccatactgtcgagggatctcgtttgtctggttttcgtaagttgagggacgggtcgtatccggttttacggttaagggatgaaaatcggactgaccgacaaatagagggacctaaagtgaacttattccaaagagaaaagcccaagtaaatcactgcgcagtccgagtccgagcccaactaaaccacgttctaatctctcctcctccgagtcttttcggtttggctcgatccgctttgccgcaacactaaaaaagaaagaaattcctta

SEQ ID NO: 63299 - DNA, 2153 bp, Oryza sativa
ttcgccgcatccccggcgacctcgtccacccctccgtttcgctcgccgaccgccggagcaccgtcgaccccgtccacccgagccgcgccgccgccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcagctgacgcgtgggacccacggcgccggccggtgtgagcccgggtgcgcccggtccaccgtggaccgtggggctgccgcgtgggccccacccccgtggaaccggtccgcgcgcccctcccctcggctgacgcaataaatccattttaaattaaaaattaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacactgcagcttcggaggatccgctcttcgtggaagttgaagccggcgtttgggaaagcgagcaaggcaagtcacatcatccttgaacatattgaatcccagtttataaaattattttaatttaaattaatgcattatcgctttatttaaattcccgcgttaccactgttttatttagccatgcctatttacctttgttatgaccttattattgttgttattgttattattaccttgttcaccctagaataaacaaaaccccaactagtgggtactctattcatggttccactagtatgaatttaggtagatgcttcgctgattaataggacaacattaggtggttttataactttagacttggggaatattcatatctcttggacactatggaatggttggcttatggtggaattggacatacacctctcttcctctttcaaaacccctaaaacctgtttttcggtggggtttgggtgcatgccagttgtgggaagtagcaccccggccactataaggactaagctcgggcctctgttgcaaagcactaccgtactaccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctgggggcttagtcctgcctacctgtcccgggggttccggccgtaggtggggttgggtcggtactcttgtttatggctaggatgggttgggaactatgacacgtcttccgtccgtataccgtggtggtatgtggcacatggttacatgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggtcgtgagggttcacggccttgattaataacactgtgtaactctaggatcgtctttataaaatggctttgggcaactaagtgacttttaaatgctgttttctgcaaaacttaacccctatattattatccccttgtactcccttgcaataattatgcatctccggtgtggcttgctgagtactgtggttgtacttattcttgctcaatctttcccctcttcagtaagagaagctttggagaagatgtcttaggtggagtcctggcttataccccagttgagcgcctgtgaagatggagccgtaggcccgctagtccgctgctgtttatttttg

SEQ ID NO: 63300 - DNA, 1416 bp, Oryza sativa
  unsure (1)..(1416): unsure at all n locations
tctagcgccantatncgagctcggtaccctgatgtttatcacagctgcaccaagtttgggtagtgtacggcgtacctatatcgatattaatcaacagtggtgtggttctataaaagcttgaataattatgttcggctatttgaacttttcacgtccctttctcgctttagattaatcatgcttcttaagtactctttacaatgtgaaataatgaatccccttttcatccaatacaggggaattgcaaggcactgcaattatcttggggatatactgctagctctttcatttagcttaccctgtggaaccaggtgatgatgatcgttcgacacaactctcttattcaatttgattctcataaaccctaaatcataaacccttttggtgcagttcggtgatcccatacttctacccaacatacctgttcattttgctgatatggagggaacgaagggacgaagcaaggtgctcagagaagtacaaggagatctgggtagaatattgcaagcttgtgccttggaggatctttccttacgtgtattaaatccaaatattttgcctagcagttgcatcgttgtagaaccaagagcgttgttgtgctatttgaacatgtaaaattcaccaagattcctgttgtttatttgtagctgacatccgtgttgaatatcaattaacatagattttgttgaaaaagaaaggaactatgtcttgctagctagtttgatctttctttttccctaccagtctagctggtgaatactgaccgcattgagggcggtgagtgaacctgcaaagagctgaggcaatggcggcgactgtaatattcacgttggtttggaaaaaagtgcttgttttttacatctccgcacccgtacgacggattcagaaatctccggttgatcattctgttattcaaaatatacttatatagttattattaattttactgagatttaatttatcattaaagttttatttaaatatattttttatatttatatatttttttaataaaataaatgatcaaacgtttatgaaaagttaatagcatcatagaattcagagcttttgtgttcttagagagtttttttattgctgggaaaagacagaggcagcagctctgccgtttgttttatcctctcttcacttatatttagagacgaagggagtactgcgtatcatatataagaacccttaattgactatagctctagtccaactttggtccgttgattatgaaaccatttattttttccccaactcttaaagtcgttaattttgatccttgatgtcaaactaagatgttttctgagatgatgtggtgccatgtagcatcttagttagcaatttaaaatgatcaatttctaggattaagcagaggcagaggaaaaaaattagtttcatgtaggttgtagg

SEQ ID NO: 63301 - DNA, 1599 bp, Oryza sativa
cacaggtgctgattcacatgattttccatataggatcgagcatatttctgagcaatcaaagatataaagatcaaaaaaataccctgttccccaaacccaacaactacgtaaatgcatgtccctctcaaaacctcaaattaaaattgactcacccctaaaagttttccagccccctcagtgggccccactacacacgatcagcatgaagtgaacacatgctttcacacaccatagtctctctatatacatctctctctatatatatacgcactaacaccaatagctaatgatgcatgtaaaatacataaccctcacttgatcatcatcaccaataattccccatttgcaacacacaccatggatttggagagctgcagctacgtgctgccattgctgacgtgctgcctcttcttgctctactccataacctgctatgccttggcggcggcggccggcggcggcggttcttgcggcggctccgacgatcacgccgctccccggagctacccgctggtcggctgcctgctcgacttctaccgcaaccgccggcggcttctggcgtggtacacgggcctcctcgcggcgtcgccgtcgcagaccatcgtcgtcgaccgcctcggcgcgcgccgcaccgtggtcacggcgaacccggtgaacgtcgagcacgtcctcagggcgaacttcgggaactaccccaaggggaaggcgttcacggacgtgctcggcgatctgctcggcggcggcatcttcaacgccgacggcgagcggtggttcgcgcagcggaagctggtgagccacgagttcagcgcccgcgtgatgagggaggcggtgggcgtcgcgctggagcgggaggcgcgcgcgaggctcctgccggcgctcgacgcggcggcggagggtggcggcggcgtggtcgtcgtcgacgtgcaggagctgctcaggcagttcgcgttcaacgtgatctgcagggtggcgctcggcggcggcggcggcgaggtggcattggcattgccgctgtcgaggctggccgcggcgttcgacgccgccgcggcgatcagcgccaggcgtggcgcggcgccggtggccgccgcgtggaaggtgaagcgcgcgctgggcgtcggctcggagcggcggctcagggaggaggtgaaggtgatacgcgacgcgatcatggagttcgtccgtgacagcagcagccgccggcggcgggagcagctgctggcggcggcgcgcggccgcgacgacctggtgtcgcggatggccgcggcggggtaccccgacgaggcgatctgcgacatggtggtgagcttcatcatggccggccgcgacacgacgtcgtcggcgctgacgtggttcttctggctcatgacgcgccaccgcgacgtggagcgggaggtcctggacgaggtcgacgcgtgcatgggcgacggcggcgatggcggtggcctcgccggcgtggacctcgagggctcgcgcagggcgcgggtgctccacgccgcgctctgcgagacgatgcggctgtacccgccggtggcgtgggactcgaagcacgcggcggaggacgacgtgctcccggacggcacgcgcgtggggcgcggcgac

SEQ ID NO: 63302 - DNA, 8644 bp, Oryza sativa
caagccgtgatttcgcccttcgccacgccgtacccgcagcaaggtgtcgtgaacagcgcagggggcgaaaaggggctaccgctgagtgggggaatcaagacccgtccaatcccaccccagttcaagttccacccgtcccacgctacttaggcgaaactgacccaaaggaattcctctccatttatgaatccgcgatcgaagcggctcatggcgacgaaaataccaaggcaaaggtaatacatctcgccctagacggcatcgcccgctcttggtatttcaatttgccagccaatagcatttacacatgggagcaattgcgcgatgtctttgtccttaactttcgaggcacctatgaggagccgaagacgcagcagcatcaactcgacattcgccagaggccgggggagtcgataagggagtacatgcgtcgcttctcgcaagcccggtgccaagttcaagacataactgaggcataagtcataaacgctgcttcggccggtttactctagggcgaactcacaagaaaaatcgccaacaaggagccgcagacgcttgaacacctacttcgcatcattgacgggttcgcaaggggcgaagaggattccaagcgacggcaagcaatacaagctgagtacgataaggcttctgtcgccactgctcaagcccaacaacaagttcaagttgccaaaccatctcctctcgttgttcgccagccccagccggagatccaagcacaaccgccaaggcaaggtcaagcccccatgacctagaggaagttcagaaccgaccgtgcgggcaaggctgtgatggctgtcgaagaagtgcaagccctccgcaaggagttcaacgatcagcaagcaagcaaccatcagcagcctgtccgcaagaaggtccgaaaagacctctactgcgccttccacggacgctcttcgcacaccacagagcaatgccgaaacattcggcaacgtggcaacgcgcaagatccaaggacgcagcagggagcagcagctgaagcaactcgtgaagtagcttaagaacaagcacccccggccgaacagcgccaatatgcgcaacacagagtgatccaagtgattacaagggccgacccgccgatccaactgtcgaagcgatagaagaagatgcagctgcgaacggtccacaatatcacttcggcaggcgaaggggctccgcagtatctgaaccagcaaatcttttttggcccagaagatgccgcaggagtaatgttcccgcatcaagaacctctggtgatctcagccgagatagctggttttgaggtccggcgaatcctggtcgacggaggaagttcggctgatgtcatctttgccgaagcatatgccaagatggggttgactacccaagcccttaccccagcaccgacatcgctccgaggattcggcggagaagcagttcatgttcttggccaagcacagttgatagtagccttcggcacgggggaaaacagacgcgaagagcaagtattgtttgacgttgtcgacatcccatacaactacaacgccatcttcggccgtgcaaccttgaacaaattcaaagccatttcccatcacaattatctcaagctcaagatgcccggcccggcaggagtgatcgtggttaaggggcttcagccttcggctgcttcaaaaggtgatttggccataatcaacagagcagtgcacaatgtagaggccgaaccgcatgaccgggcgaagcacgcgccaaagcccgcccctcacgacaagatagtcaagatgcagattgatgatgccgaccccacaaagctcgtatcactggggggcgacatgggcgaagaagaagctaagaacatcctagaggtactcaaaaagaacattgatatcttcgcctggggccctgatgaagtgggaggtgtttcggcagatctcatcatgcatcacctggcagtcaagccggatgccaagccaaggaaacagaagctacgcaagatgtccgttgatcgccaggaggcagcaaaagccgaagtccaaaaattgctcaaggcaagggtcattcaagagatcgatcatcttgaatggctggcgaatctagtgctggtgcggaagtcaaatggcaaatggcgcatttttgtcgatttcacatacttaaacaaagcatgtccgaaggatgatttccccttgccacggattaaccagctcgtggattcgacagccggctgcgaactcatgagcttcctagatgcatattccggctatcatcggattcgcatgaacccggccgacatccccaagacagccttcatcacaccgttcggcaccttttgtcacctcaggatgcctttcggtctgaggaatgccggagcaacctttgccaggctgatgtacaaggtcctttacaagcaattggggcgaaatgtggaagcttatgtcgacgacatcgtcgtaaaaagccgcaaggctttcgaccacacgtccgacctacaggagaccttcgacaacttgcgcgcaaagcaagcttggccccgcgagggccgaagaagccttttccggcccaacaagcctaggggccattggaccgacgattgcctaacggcccattaggagtccatgaacctctattacactatgtacccatgtaaatgtccctttcataagggtaaccatgtaaattctcctgtataaccaaaaccctagtagtaagaacctgtaaaaggagctataaatagtctcatagggccatgtaatagggggatccaagaaaaattctctaatcaatacactttactttcaaccactattgagtaaccacgtctttcgacatatgcagttgtcgtttcgacaacaggggtcatgccctagcctacacggcgaggaaagaaagattggatttgacatggttgaagaagacctactcagatttaatcagactcagactgagaatgccaaaaatagctttacgagttcccttggaatatgagatgactagggatatactcctccgtccaaaaatataatgaatttcggacgattgagacactttctaatactatgagtctaagtctgagtctaaaagacttagactgagaatgtcaaaaatagctttacgagttcccttggaatatgagatgactagggatatactcctccatccaaaaatataatgaatttcggacgattgagacactttctaatactatgagtctaaacatgaagcatatctagattcgtagtattagaaaatatcctatccgtttaaaatctcttatatgttagaacggatggagtaaatatctagctccaagagaaagttagatatcgagattcaacctaggacacacaatcccgagatccatcgagtctgagcgaacggctttctccgtgctcccactgttctcccaaatcgtggaatactcgacgagactagcatataggcctatactggttctggtatttttgttgatcggatgaagaacagactggcagacgaatgatgcgtatcaaccaccatgggacgcacccacggtacgcatcccagccttcccaaaagaaaaccgagatctgcacgaatgttgcttatcaaccaccacgggagatcgggaggcatgcacggcacgcattccagccttcccgaaagaaactgaaatctgtacgccgaggacgactaccgctgcacgcaagggcggtgcacaggttcaactcggagattagcacacaaagactagcacacagcaaggcccgtagcacgcgtcaccacgggaagacgcgggtgcaggggaagtacagctcgaatcaaatgcaacccgaggccctgagcccctgagcttcgccatccctgaccggcagctgcaccacggcgcgccggctaaaccaaaacaaattctaacaagcgaggagaaccggacacccgatgttttttcacggaggtatgtacgtcgtgaaacgtcaagcgtcctcgcgtgcacgcacgcgcgcgcgaacgtgatcaattcgcctcatgctggcgtgacgcggaccgaggagcagcggtcagtgtcgcggatcgcgtgcagccgaaggaccaggagatttcgatacgtcgagagtttctcagatctcgtcgagtcgacaatgtggggatgggtccagcgcaggaatcccattcgattgatgacgtggcgccgccagccgatgtgtggacatgaccgagctccagcgccattcagaccggccagccgtaacgacggtgtgtgaatgaagggatagcggagtccgcggccgcggatcgacggactggacggggagttttgagattgcgtcagaaagcgatggaaaacgcatgaaaatccagccatggctgctgcatgtagccgttccgccttgctggccgctgactcctgtcccgtgcgcgttgcacggacgcggacccttgccggtctccccttccacactcgccaacacgtaagcacgtacgacgcgccccctttattaccgccctcgcgccacacgcgagagggaataccgcgccatcgagcgacagctccccggccgtgaaccgggacgagctgctacgcctgctgctgcacacaagctcaagtggccggccgagtcgtccgttcaccgcggcctactgcatctgccggcaaggagctgaaagatgagggctgcggggaagccgacgagcggcggcagcggcacgtcgaggtcgagcaacatccgtggcctactgcaggacttcctggagcagcagcaccggctggacgtgcgacggcaggaggcgctggagaggcacgcgcaggagcgggcggccatcgagcagcaatggagacagtcgatgcaggcgctggagcgggagaggctgatgctcgagcaggcgtggatggagcgagaggagcagaggagggtcagggaagaggcaagggctgagcggagggacgagctcctgaccaccttgctgaacaggctcttgcaggatgatgatttgtagggatgatgtgagatgtctaactcaaacagagaatttaccatgtcttaggatcatagctagatgggaattctttttttctagatttgtgtatgtgaatcttatgttgttccctgttgaattctttctgctaaatattcttttacccgctagaaaccatggaacggataaatgaatgaactgaaaatactgctgacgatggaataagtagtacagttcaaggactatactggtatgggcaaaatttcatgaaggttaaatttaacagagaaaaacaaaggaaaatgaaaatagctagctgatcaaatgtataatacatcattttacatgtacaaagcaaggataacaaaaatgactttcccatctttcttacctaggactgtctagtgcactaatctatcgtggcattgcaagataggtagatcaaccagggctacatgttactaagtaattgcctatcaaagcaagaaatatgcattacaaaattctgaatctctgataagatgtgtagacttgtgcccctttagatataccttcaggttttaataactactgcctgaacattgtattcactcgtctctttctgtatcggacatttgcatatcatcgtcagaatcagtgtcggtatcttgggtaccatcagagcctatgctgctaccttcctgtgttactaaactcgcaaaattgttcaaaacatgaggctctataattctccaaaaagattcagcattgctaccctgaaaacctatccaaaagaatctcccttcctcttcactttacttgttaacgactgtgtgtgcagggagttcacaattctctcaacaccctcgctattcccaccactgagcttaagaacaatatcacctgatgggagtttggagcctccaaacatgaaccaatatgctagaacacgtggagttaaccacctatggataagctttgggagcacaggctgacctttcagaaagaactggtcaacaaagaaactgaaatgctggtgaggtattgttgaaaactgatagggtatcttgctcccatcatcgaatgatctgcttgctgaagacaaccattcaaagaaacgctcatgaatgtgcacccttaaaactgaatgagcattggaatcttcctggaactgaaagtgcacaatatggacccctcgctgtgcataagattccattcgagtgcctcccagaagcaaaccaattaaaatttcacgctgctcttgatccagcttcatgctcacagtttttggtttaataactttcttgttgagaaggagaccactttggagcttttccaaagagtctgcctgtacatcatatttctttttactcatcatatcataaaccttttcggctttctgatagtcttctgcagaaagataacctcttagcataatgttgcacgacttcgtgttagtacctatcatcccattattgtgcatttcaccaaatacctcctcagccttctcgatatttccaacctttactagtgattccagataaatggtgtacaatattctgtttggacggcacctggctatgcattttaagaatgttaattctaacttttcatgcatatccagatccatgtacatgtacatcaagtcaaggaaggctggcatcaaatgcttcatatcactctcaataaattcattcataagttgttccacgatatctacttccagagcttttgtcattatctcaattattttatgatatgatgcaacattaggaggtatatttttatccttcatttccttgaacatatcgagagatttcataggctcaccagtccgggcataagcctccattcggcagacataggcctgaacagggaggtcagaaccactctgaagaatattgtgccacgtggcctctgtttctgcaacattcccttccttggaaaaggccctcatcactgacaccagcacatcaataccctcatcaaagcctgcttgcttcatctccttcctaagagctatgatcctttctctatcaatgacatcctggtagctgtgaagccagatgagcccagcgtagacatccttgtgcacatcaagattggtggtgaccacattatggtacacaaactcagcctgcttgagattgtactttgcagttccccctgtcttactaacaagcgcacggaacaaggagttatgaaggctaaggcgaggcttgtaaccacccatctgtatcatctggttgtagatagtgcatgcctcctcaaggcaacgccctttaggtacactgaggtaagcaacaatcagtatgtggaaggtagactctgcaggcacacggccctgcttgaccatcgcctcaaacacctcccggcatttctcaaccttcccatccctcccaaggcaatctgccaccctggtggctagtgcaaagttgaagcggaaccagtgctgccgtaccatccagctatacacctgaaaacaaccagtgaagtgagcaaggaccatccaacatccatgtctcaacctattgtgtctttgtgttcagaaagtctcttttacaacttgttcccttgggggaaaaaaagtcattttagaacttaagagagaattccttcattccacaaattgaaatagttatgacatattccataatagagtaaagttaaatctttcactccaaaaaatttcaagacaaaatattggacctacaaatgagaaaacaaagaatacagacaaatttatatttttcttgcactcttcacaaacacattggtctttttttttcctcgatacatagattgagctagtagttagtacatgtgggatggtatttagcacatattaacatcaatgttctcaatattttttggaattttttcacgactattagtaacaaagagtggagagcgtgtgaaggcgtgtaaaattccgccccccttgttgcctacaacaaaggcaattcgtcgaacagtacacgagcaagaactgcatgtatgcatgtttagtggggatgctaaaaaggtttagtcgagcgaggtggaagcgcgaagtactgacccggaaggcagcgtcgttgttgcggatgcggaggcaatggacggcgacgtaggtggcgtcgtcctgggtgatccacttgcgctgggcgttgaggatgcgggtgaaggtggagtgcttgtaggcggggagctccttgcagagccaggcgatcctggagcggcgccactgctcgggcagctcctccagctcgggcaccaccagctccggcgacctcaccgcttccctctcgtcggccgccgcccacgcctctccctggaacagcccaaactcggtctcctcgtcctcatcctcctcgtcgtcgtccaaatccaggattagggactccagcgctgacgctaccgctgggattccaggaggcggggacacggcgaggcggccggggagaagcttcgggccggcgagacggagggcgggagaggaggaggagaggcgaaggggtgggagagcgcgagagggcatcgtagcgatggggatggcgcggcgcagggagaggtggtggccatggaggattcgaccgcgtagcaccggaagccttgtcgctcctctatctccagttatcgcagtcggcaggcaccgccgccgcctaatcgtttccggaggctctgcgtgtacagtgtacactgtacacggttctcctctctggtgggcttggtaggatttgggcttttg

SEQ ID NO: 63303 - DNA, 971 bp, Oryza sativa
ctgcgttttttggtgggacttcctaactcttcgtgtgcaacagtagcggcggcctgggggttctgttgctcttctcggatctcttgcctaatcttggccctcatcaactcgggcttttcgtcgaattcagatgtcagctcagctcttatcgacgcctggatcttggcttcaaggcttgtatctttctccgccttgttggaagtccgcttcttgtactgccacgcgtagtctggaaatccatacttccagggcacagaagacccaacgccctgtgtgcgtccacggtgttccttgttgcccaacgctttcgtggggaggtcgtcctctcgtctttgagagcaggcctcttgcgaggcttgttgctcggcaaccaactctttctgcattacaatttagtggggttaaatagactgcacgataggaaacaatgtgaacatctagtttgactagacacttactatagcttcgtatagtccttgatcttctgcatttggcatgaagattgtgccatcatcattcttctggtacctggccctggcccagttcctagcccgagggtgtgggatatcgccaaacacgagcggtgtgcacgattcttccgcttcttcatcctcacgctgccattcctcttccttaccggcttatccggcggtgccaagctagtgcggatgttggttcctggtctagagcaagcgatatgccttgcttctagctcttgactctagggtcgacttcttcacatggaatttctctcttggatctggattcgccgggttgtagatgaactcgcctactagcttagtcttgaagttcttctaagcattgcccataaccttgaaagcagcccgcctgagacggtcctcatgctccgcaggataatcaaaactctccttgaacgttagccaagcaatgtccttctctgcggcgggcacgaacttgatgtcatcttgtagaatactgaatttctgcct

SEQ ID NO: 63304 - DNA, 7085 bp, Oryza sativa
aactgcagactgcacaaagtcaagggatctgtttccgattacagtgatgtaccagagcaattctctcttcaaataggacaaatcattaacccgagttgttgacagcttactgtttgttgaaaagatgagagaaatctaacattgttcatatggtaccaaagtagagcagaacacgtagagaaaacgagggctcgacaaaatatggctctagtataatctcactctcacagcttatagactgccaaaatctaacaaaaagaaacatctaaaaaaatctactagcaaagaacacacatctagaaaaaaactcaacctcagacgaccccggtagtttcggatagaacagttgttgaaaagatgagagaaatctacattattcatatgatctcatagtagagcagaaaacatatgaaaaacgagcgctggacttatctgtaaagcatggtacattcagttcagctggaactaacaagttaatttattgttgcattgtaacttctacaatttctcaatggaggacttgaacacaggttcggcttatcctttcacgcatgcttcttgttcttggcataccagttctcgatggtcatgaaccaattaaattggaagcaaattgctgcaaatcgcatgactccagcaccaataatctccaggaatgctgttagcggggaactctgtggggatagaccagcagtagctacagctaacattgctccctcgaaattgcagggtacaataaactttccggatttgatgccatctaaagccttcctagcaacatcatcagctttcatgccaccagatgatcctgctatgatattggtcaactctggcctccttttattctctgcaaccagttaatgaacagactaactgtgtaaggcacttgactatgaaatagtagtactgataaagtttagttgatggaaagagtgaagagtgcctccagaactagagtgccggaaagaattagataaaaaagatactttctcctgtgtacaatgtccaatgcaacttgtaacaatggcaaacacacaagcaatcaaccgaatgagtgagtattttggccctgaattctatttgcatgtgtgacatcatgattttgacaaatatagtatattacgtacaaccaacgaagtggcatcggtttcatcaatgcctgaagtaaaactgcttgtacacgatatattcacagaatcacagtgacataagcctgagaaatttcagtgaatatgaaagtgtgtgcctgtgaaaattaaatagggcaaccaatatattcagagatgcaaatccatcaatttaacatgtatggctcactgctagttcatcaatcgcttaaaagcatcaatggtcagcacataccttcagcgaaacccggtgtctctgtgtcaggagggaagatcaacgagacatgaatgttgtccgcaataacctcatgctgcaaggcctcacccaatccacgaagcgcaaatttgctcgctgagtaagcggtgtacccataaactccaacctacagcaagagcaatcatgtcagcaaaacctcatctccccaccatgaggcattacatcgaacacctgggctgcgacatgagcataacagcctgaatttgcttgtacggtgtacctggccggcctgtgaggacatgatggcgatggacgccgggaggcgcgtctcctttgtgcgttccttcatggcggggagcgccgccttgacgaggtggaaggtgcccatgaggttgatgtccaccatccacttgacctcctccatctcctgcttctccagctcctgcgggacgaacacgccgtggttgcagacgaggacgtcgacggggcccgcctcggcgagcgcgcgcgccacggcgtcggcgtcccgcacgtcggcggcgtggaccccgacgtcccgccccgtggcggcccggatggcgccgcgcgcctcctccagccttgcggcgttccgggccaggatggacacccgcgccccctccctcgccgccgccgtggccatggcgagcccgatgccgctggaccccccggtgatgagcacgtgccggcccttgagcgggatccgcgccgccctaggccgcgccaggaacgctagcgccgcgaggagcccgatgggcggcaccaggatgaggagcgagaggagcgcggcggccatggcgagcgaggtcgagctttgcgagtggtggctggtgggaggaaggggagcgaggcggagggggtggtttaaagtgggcgaggccgccgtcggagtggacccaggttgtactagttgtacaagggtggagacgtgaggagcttcgtggaggccgaggctgcgcggcccggcgggaacggcagatctgaccgaggacgaggtgcgggatgacttggtggagagtccgtggccgtgaccaatgagccggtcaggtttgccacatgggacactatgttgcaaggtgtgtgtgtgtgtgttttctcgcagtacatagctgaattcaaacaagaacagctaaaaagaaatcgacggtatgacgttctttgattagtcatttaattacaactattttggaacgatgtggctcgcaagttttctttttgttggcaagttcttgtgtgttaaaaataccaatcattgatcaacggaaaaaaaaacatatgagtacacttcgagcactacaagaaaacgccacgccggccattatggaacaggagagagggataattgaactcatttttttagtacatgaaatacgcatatactaactccatatatctagatctacaattacattagagtaaagtccatcaccgtctaaacttgtaccgttgtatcatcccgattcctaaactcgcaaatcgaccgttcaagtcctcaaacttgttcgagtgtgtcatcccggcccttaaacttgcagatcactcatttaggtcatccaacttgttaagttgtgtcaccccggtctctaaacttagatttgaatatcatctgagtcaaataggacggactaaagactttatatttaaaaataattcataactttttcatgtgaactctaatggagaaaaactttatatcaaacttgtagctcttgacgcgatctacaactttgtagttgaattttttttattgcaagtcattttttgtcccaaaatgtaattttaaaattaaaatttcaaaatctataaacatgcaacaatattttgggaccctaaacagttttaattcaaaaacttttcaactacaaagtcgtaggtcgcgtcgagggctacaattttaatataaagtttgtcttcattagagttcacatgaaatttttgatataaagtttttagaccgtcctgtttagggaccggggtgacacaactgaacaagttggaagacctaaacgagtgatctgcatgtttagggatcgggatgacacagtcgaacaagtttgaggacctgaacggtcgatttgcgagtttagggaccgggatgacacagcggtacaagtttagggaccggtgatgaactttactcattacattaacgacacttgaatgtaattgtgttcctattttagatgaaatataaaattctaaatcactataattgaacttaagaacttcatattcagtttgaatctagatgtggagctatgtcaaatgggacctacgaatgtgccctttaaaacacgtcaaaaaaataaagaaaataataaactcttttatatcattgtattaaaagacatctgccaataggtaatactatagtctaccctataatccaccaacaacagtcctacatactacatacttcatccttcatggaacggtcaggatctttcctcgttagatccaacgatcgatacccaccgtgctcccactctccggacaaccgcccacccgcgcccacccctatcgcgatctcctccccatcccccgtcgctcctctccctcccctgatcgcgcccctcgctctcacggtctcacttctccgccgccgccgccgccaaaatcaacgccaccaaatccagcgacgcctgcctcgctgatctcctccgcagtcgctgccgatctgcactactgctcttctcccgatctccatgccgccacaaacctgcgcccccgaaggcctcgccgatctcatccgcggtcgaccggcgccgccacccgcatcgccgatcaactccgcgcctccacttcgaggaccacatcaccgccatcatccttgacttctccgcccgatctcctctggattgccaccgactgtcaagcctcgacctccgttcatcgtccacatccacaccgcaactcgcattcctagaggctatccaccagcagccagacacttcgacttcaggttgggatcactgtattatctattgcattttgaatcatcgagggtgaaacttggtacatttatgttgaacacatgatagatagcggttcccatgctcaccatcatttttaatgaaactaaaaataaaccgaagtagcctcttgttatgtggttctcagtacataattgctattgggagatatatattttataaagactgagatgagaggtagatttcttgaaatgttctgtatgtataaagatgtcaatgaggtaatttttttcaaaataggaaaataaaagtgaatttgggtgaaagtatggactgaaaaatagaaaaatggaagctttactaaaaatggcagattcgttccatatgtaaacttttttatttaactacaactagccaacactatactgattgaacattatttcctaacattgcacgcttatatgtggttaaactagccagcactataatgatccgtgtctcttcgcccttccgcgcgcccgcacgtctttcaccgcccttccaccagatccctcccccactaccgccgccatcgatcctccccgttgcccacgccgtcctccaccagctccctccccaccgccgtcgccaccgaccttgccgtccctggctgccagatccctcccttccctcccccatttttttgatcaacatcatttttttaaagaacaatatttagaattttggaattttgtggactggatagtgaagagtcgatggtatgcattctaatgtattgaaactatctgtcagacaaatactaaaaaataggatgacatgtcagcttataaattccataagaacaatttgtgctgctttactcgtgataataaatcatataatctatagaaacttgtaatcttataaaataacttatatgacttgctggaccatttgtatgattgggcatgctgatcctttcccaagcatattattatcgtcagacatccaaattttgccatgcacatgattgatagctctacctggtgcttgacgttcatatgtacttttggtaaaggaaatttgtgtgctgatttttagctttggttgtttaacccttgacaaaccactgcatgatcaggtctttcattaagcttgactcgaatcagagtagaattgtgtttcccaacttggttctgtcactttcagaaaaagaaaaagacagttctgtctatttgcctgaatggtttatttttactgattctccccttttggattaaatacaagtcaacctgttcctatacatcatttttagccatgtgagaaaatgctctcctttgtgaatcattcaaagttaatgcaggtaacagtttctacacctccaaaattagagcaatattggcagatattagatcaatgaacactataggcgagttgcaaagtgcatagtacacttgtttgttttaaattcaaatagaactggttggatgaagctactaatgaaccctttcatgtttttatagggttccatatcatatactccggacttggcatccaatcgtcaccgcccacgatctcatgcacctcaccgctgccgccgcccgcgataaggttgagtttttacctctaacagattctttcctgattttgtgttatgatataataattttaaatgtgacatggtgtgtgtatgcgatggatttcatatgagaattaaatagattctttcacaaaagaatatcattttcttactctgttaagcaacctcaaatagaaacattactgaaataaattgacagattcgatccatagctaaaatttccttctctacttttagtgatcgggtgtaaactgttgggatttagttctacaaatgctattcttttccctttatctgatcagcaatgtaagccaaacttatccattgaggttatggagtatgggatttggctaatcacacaatacaaagacgtgccatctgaatatgtgttaattctcaagccaacaactgatgaaactcgtgcaaccaagttgtaaatccttccatggatctgaatctaggactctaaaagctcccaagctttaagatttgagcttccgtgcagaggcagtggaggccgagggtgccgccatccacagccgacaacgcgacgccgctgccgcctcaagagctaccactgctgaaaggtacaagaccccttccccacccctaccccatccctaatatgtctcctctttcccgtaagtatccctgccgtcgatcttttgtaaaaacatcatttatgctcaatatattcaatgtaaattgtgctagaaattgggaatcctcgatgagaatttctgtatatctacacccatggcccatcagtccttatgtttacaacattaatatatcacagtttttacctttcatgataaaatataagttattcagattaactccttttgcaaataagattgttaacattttgattatcctgttcaggtgagccactttttttcatactgtatcggtattgctctaccgctaatcattgacttgataactgatttgtatactgtataacttcttctttttatttgcaaccgagtcccaactttaaagttgacagtgaaatggatctggttgggcttgtattgttataagtataaaggttatattatgctttgttatttgtagtgatacattcaattgatgtataacatttctatatacagtatgaaaccacaattatgaattggatgaatctcaggtttgtttatattttatcagctaggtatggatccaaatgcttcagccaatggggggcg

SEQ ID NO: 63305 - DNA, 2351 bp, Oryza sativa
ctactccagctaggaatagagtactggatagctactgcgtgaatatgtacgcgtcgatcgtcttgtgatgactaccaggtcgtctgttgactgatcgatctatagatagatagatacagtttgtttttgacggtcaatgtatacgtgcaaaacgccgaagaagctagtggactggtggttaaacttgaacaagcacgttgcttaattaattactccgtccgttcacatatggtatcctcatcatcccgtaatgtatgaaactactgcagaaaggatcttcacaaacggccaaagctagttttcatatcagggagctccactcagaatgtttttttttacttttttagacttttttatgttttagttttattattagaccactcccaaaagtattttcgaaaactgaatcttttgattaggcgtgccagcgatgtcctgccacgtcatcagtggtggcgtgacaagaggctggcgtggctggtatgatagagttatttggccacaccaaggggctggcgtggccaaattaatacttttggaaatggtctattaataaaattaaaatataaaagtctaaaaaataaaaaaaaattcctccactctcaagtaataggtgtgagttgtctacgaaaatcggtattttaacgtgcgagcatcacatccggatgtaacaaataattttcacagatggacatcctaaggaggtcattataaagacccgatttttccaagtagccaaataaggaagcaattatttttttcaaaaaataaaaaaaataaaagaattccaaaaccctagccaggtcatcgtgaggccaccgccgcagtccacacgcctcagctcctccgcctccattttaactacgctgcccttccgcctcctctccgtcgcgctagagccgcgagcaatggatccgccctccccccctccccccgggttgggggggaggggagatcagccgctcttaagcctaccgacggtgctgtggtcgtggactcgtggtcactgctcttggtgccacggtcaccactaccgccccaagcccgaagtccgccatcgccattcagagaggcaaggaggctagtcgacccattgggagagagagaagagtagagaggaaaagtagcagtgagtgaggggagtgagagtgggagtgggagtgcgaaggaggaaataaaagagaggaagagagggaatgcaaaggggagaggaaaagaacaaagatattaggatgggggagcgtgcaacaggtaggaggagaagagaaacccccttgtgaaaatcaatttcgtagacatatctcttaatcaagagatctgtctatcaaaatagctattttctcaaaggagcctagtaagaaactcgtctgcgaaaatcggttttgacaaacaggccttgatcgaacatcatcaatgaatttttcatatggatcacctttcaaaataaagagaggtgtccgaaaaaatacctttatagttgttgcaacgtgtcaaacagaaagaaacaaggaacagagggagtatgaagaatcattctaagttaatacgaaagtataacaacatctccaccatcaaattagttttatattaaataaaatattaagtatatttttatgatatatttattttacgtcgaaaatatttctatattttcttcaaacctgattaaatttgaaaataaaaaattgaaaatgtcttataatatataaaacagatagagtatgagttacggagacgtctaaataacaaattctagagttctaacaaactcgatcggtggaacgtgacatgttctagagctcagactattcgtcgcgacatatattttaatcttttttaccgcattgctatttgccagcgagatcgatcggactatacatcttccgagccatagctagaggtgctggttcggcaagtatgtttacatgcatgcttatgatgaatgcgtcgtattatatataaacacgagcctatacgtacgtatgtatacacgttagtattcacactgcaagtgtggacatattttagtatttcactactagagaaaccatcgtccaaaatccataatagtcccgatttgaataggaaccgggactaaagatgatttttaatcccgattaaaaactttttgatctttcatcccggttggtaacactaatcgagattaaagatcatttttagtcctggtttaaaaagttgttgggatgagtcagggctccgaatatctttaatcccggttggtataaacaactgggactaaaatatcttttgtcccggtagcttatacaaaccaataagttcaccccgatatgcgcgcatcgttcttgatcagtcgctgtcaatcttatccc

SEQ ID NO: 63306 - DNA, 19345 bp, Oryza sativa
ccgcttctcccgttcatcagcaaattcagagcaagaagagttaaagaggagattaaatccactcaaagctcgtgcatgtctgcttattgactatgggcacttaattaaacgcacatgagctagctacacgacgagacatgatctgtttagttggtcgtgctgaaattaaacatcacctgaacctagcctgacagtgcttggattccgtccatgatttatgcagaagtttttcccttgaccgttgctgcagccaaagattcgtgctacgttcattcttggctcgagtagagttcattactactagtacgacattaccaacagcacacggacttaatttgtcccaggatggcgccggtggttttgagtacgtgagatcagttcttttcttcctttgtttttttttctagtttttgggtgtcaatgcatccactataactgtgtttgagaggagacaatagaagattgagaagatacgtaaaataagactagtctttaacacatgatcaattgagtattaattatttttaacttaaaaatatattaatataattttttaaacaacttttctgtagaatatttttgtgaaaaatgtaccgtttagcagtttaagaagcgtgtgcgcagatttctttttcacaataaatctttttctatctttgaacgcagccaacatctccaaagcgcttttccaaagttgtagggtagagacaagaggaagctacggctatatgtgcgtcttttgtggccgtattcatgtgacctttttttcctcctccccggcccaagtaggaacggaatacatggccttcttttcctcgtcgatggccaccgccaacgtgaggggcacgtgacacacggccgttgttgcctagatgcccatgatttgatatgattttgtgtgtgcctgccatactgcaatgctatagcatatgatgcgtggcactgaaagctacgaaaagcacgagcggtatacgagcaagtttaatagtatagcctattatcagctccaattcatttatagccaatccaataaacaattcatataatagttgcttactatactattaatatatgctcccacctgttatacacatatcgtgtcttggagtccgcgctgcagctggctacatatctgtaacccgcttctcttctctctcatattttatcttattaaaatatgtttatagctggctaatagtacctgctctacgtgttcttcgataggagaaaaaaaaaagagaggaaaagatgtaaaaaggctatgaatatgattacgatggcagcccgaattgtggctccagattttaaaacggaagattttcttgactttaaaatcgatttggaaaaaggaaaagagaagatgcgtgtgaccatctccatttgggcccctttaaagtttaccccaaacagggcagagatttgatcgtttttatattgggccgagaattagctttgcaaaggaagagcctaatttgctcggatgcctcgatgctagagaaagttttagacccatcaaaagtatagtggggctccaacatcacatgtcacactggctggcccagggtggatctgtgcttagaacatctgggccttcggacctatgcattggtttattaacccttataaattttcattttttttacttaaaagcaatgtgacaaaattgaagaggaataagttcattttagatcccttgggtacgagttcgattgttgtacttgaaccgcaataatagatagaatggatccctcaactatcaaagccggtgcaatattagttccatggcaatatagcgggtggttttgtatattgtggcaatttgacccgagtcaacagtgttgaatcagcatgggccccacatgtaagggcctcttcactcttcaccactctctcttcacttggacagggagggcgtccatgtcggtaaggagggcgataaaggggggggggcgggggcaaaccagaaccgacgtcgatgtgcgaactgtgaggttgagccgcttggcctcacatgcaagcaacacatccctcttctctcttctccctcttcgcctcgaagccgacgcggtggttatttgcctcgacgctgccgatgcggcagtgatgtgtgtacgcgctcgcttgagcgcggcggcgagcgcgttggagagcggcgcccgtggtaatgctggtgctccgtgcatgtcaggaggcgatcgagggccacgatgaagcagaggttgagcatgcggcactagagcgggtgcggctactcaagccctgccactcaggcgtccctgaggagcgacggctagttggatagcagcacggtcaccgcgtgcagcggcacaacgtgcggcgtgctcgatggcggtggtggaggaggctagtgagcagcttgatggaagggcgaggaagaggaatgccaccgccacctcaaagctccttgccaactcagacaactctcctgcgaagcgcgattccaacaccttgccctcctcctcccctttgcctccacctttgtatcgcacggccatggcggtgatgacaacaacagcaaggacacacattgctcctcccctctcccagctcagggttcacggtgcgccgaggcacctcatgcacggactagaagcaagcagataggcacgctgcctgcgggcttatcggtggcggcaagtgcagcgcgcgaagaggccaggccggtgaccaggggcagagctatagtatgtaggagggggggtgcccaagggccgatcaataaaagtttttagctatacgtcacctatttttatcatgtgtgcactcccgtaatacaaacataggcattggcattggcttaaactggatctaaagtagagtaaattaagtaagtggcaccgctctctatttcgttctatctccgcccttgccggtgacgctccgattcagccttcgttgtgcttcccttctccttcgtgagctccgcctagcctcctcctcttcagctactccctcgttgacgttggagcctccttctcgccggtcgcccacagcagccaccgccggccaccaccagagtcatgcgcagccaagggagagggaggggttgttctcgagggagacggtgacgacactcgagcttgaaatccgctgctagccgcatctggaaaggaagtgccaccggccacatctggggaaggtgaatgggaggagatagagaagagtgaggattcatcttggagccaattatgcttagcaagctactcctcgcaacatatctttagacattacatggaagacttatttccgcgtacacacaattgattttctgattggattgcgttaacatccatgatgcactccttaacatacgcttttaaaaaagatcagtgatactactggagaaatatctttgatgggtcacgtaaaaatcacattagtcccggtttgagtaaaaaccgggagtaaaaatatttttagtcccggtttaaaaacccgcagatactttattgatctttagtcccggtactaaatataatttttagtcctggttcaaaaatatgtcagacccttattatgggactaaagattcatttttagtcccggttatttataccaaccaggaaaaaaaataaaaaaaatcgcgaaaatcccttcaccgacgcgcgcgctgcctcgtgctccccgcgcctcgtccttatcacggcctcctcctctcctcctccactctcttgttctctcctccccttcccctctcctctccctcccccctcctggcctcctccgatgacggcgatggagacagcgggtggcggcccgacagaagctgccgacgaggctgcgggcggcggcctcccctgcggcggttgggaggggaggcagcgcacggtcaggcggccttccctccgccagatccggcgggaggggaggccgggcggcggtggcgacttgcgatttttttttaatttttggaatgagttgtaaattttattatacattgttttagatttgggggatgattttgtggatgattctatgaatgactttgtggattggcatgtgaattgtggatgatttgttgcgcatgatttgtagatttgttgtgcatgatttgtggatgctttgtggggatttgagggtgacgataaatgcaagcaaaaaaaaaacaaagaaagaaaagaaaaaaaaaagcctaaccggactaaagttagtcctggttggtaccaaccgggactaaagatccatctttactctcggttattttaattgggtatctttagtcccggaatagttgtcccggttcgtaattaacctagggctaaatggggctatgaaccgggacttaaaaaaactgttctccagtagtcgactatctaaaatacttaagggatggagtcatgtatcactgaccccagcaccatactttttgtgcttcctctacctgtgacattattttaatcaagttatacgtgcaactcgccgcaagtctgcagaaagttccaaaaattacagatttgtataacatgtcctcttgtcatcggagctttttatttttcatctgagggttttatgttacatatgtaaacttaactgtaccagttaataaattcatttcatccccttagcataaaaaactgtatattgtgacctgaatgaactatataacttataaaatttggtcaattctatactaatcaatactgtggatgccatatatgataaaaatctctcaatatatatatatatatgataaaaagatcggggtgccacgaaaatgattcagtccgtgcgccggatcaaacgaaaaaaaaaaaatcggacactggcttcgctctttcctaaccagtatattatcagtgagtcagcttctctctcactatttttctccttttctcattcacggtgcatgtggcaaatgcatgtcatgtcatgtcttgctggctcatttgcaacttttctctcttcttcaaatgttttttttcttccaaagtaattatccgttctatgacccgtttacaccatcgtactatttacaatttctttgtaacaagatatcacatgattacattctgataaaaaaaattgaacgttgtttcaccccttaaagaaaattgtttttgttcactatataaaatatttcacataaatacaacattagaaaatatcaactgcaacacctaaccacctatatgaaacattgagtctcaaagagtgaaacaagaaaagtcatatgagagatataatatattttaaaaacttgatattgttgaaatatttttatatcacatatgaatatcaaattgtaactattgaaatattataaaatacttgctgaaacattccaagaaaaccatgtacaacattacattccaagaaaaccatgtacaacatttataaattaactagtaaaacatcatgtgtactagctgaaacattaaatagaacatgtgcaacatttgaaataaatctatttaaaaagctaaatattcttttcatcaaaatataaccatgtgtggtcttttttaaaaagatttaattgcaacgaattaaatggtgtaattgcatcataaattggagaaacaatttaagagaaatttaaaaattacttaaaaagacttatacataccatactaatattgtactagacgcatgcatatgcatgtagacttagctatgtggctaactagttgcttcacgtttctgtgtctgctgcgcctgtcacaccctgaaaattcaaaatatataaattgttgtttaattggaatttttagaaataattttaaaagtcttgaaaagaaaatctaattttaattaataaattccaatataaaatggggccagataaaatttcattaaatactttgcttaattctataattcctagatttttctgggatttatttgagctaaggaagtatttttaataaatggaattgcatttaaggaataattttaattgaaaaaggttttaaaaagtctcttttggctttgggccgaaagtcggcccaaaacctctcttctctctcctcggcccaagccggcccagtccgccgcgcgcgcgccctcgctgtcgctgacaggtgggtcccgcctgtcggagtcgtcgtcctcctcgggccgaaaccctagtttcgcgccgccgagctgccgtcgccgccgctttccaaatccggccgttcctttccttctccggccgatttgttagaggggaaacaatctccgggatctcctctaccttttctcctttggaatctttggctcaatcggtttggaatgagtttgattcgagttcgaatcggatcggctttcctctctccaagccgcgagtttccttcgccgttgccgtcgccgtgggcctccgtcgtcgcctccgagcccctttaaaaggatccccgtgctcttctcttctcgccgccaccctcgccttcgcctctcgtcgccggagtagccctagcgccgtgtgccctagctttgccttcgccgccgccgctccagccgtgcgccgccgtcgttccagccatcgccgtcgctcgggaaggccgccgtcgttgtcgccaagtcgtcgccgtcctcgtccgctctttcgctgccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtccgctacccgttggtgtcctccgttcgtgccgtagcgccgccgttcgccggtgagcgtgcgccgcccgagccgttcgctccgccgagctgccgccgccgtcggtgacgtcattgccgacgccatcggggccgtttgccgtgaaccgccgtggacccgatcgatctcggccgtccgtttggattggatcgaatctcggccgtccgttcgcgtgaaccgccgcccgtgcgcccggtccacccaaaccctagccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattgttatagcccttttgtacttgattaccttattccttgataccttgggttattacaatttgactagttgagctttatttatattggttcaactagatattagatataattgcttagccctgcttagaaacattagtacatttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacacctctcattataataaaagatgcttaaactgataataatttgattagctcctggtttggaatggtacattcctggtttggagatagaactgtgcagccggggtggttgttcagaatggttgggcctatacaacagggtatgttgtatagcgttggattaatattgtttaattacttaactattttattaaattctcaaatgtttgttaaatgctgcttttgcaaatgcaaccctattatgccatcctttgttatcctgtgcacttgcatatttgctgcgtggcttgctgagtatgtcatatactcaccttgcaatcattcatcagaggaagaattctacaatgaggctgatggtgtggaggattaggtgtagccttggtcaagctgcctgtggagtggagccgtctgcgccgtttattttatttttccgctgcttagatctttattggttgagaggaactatctacctctgtaatgacattttattcgcttattaattagagtaatatttgtactctattatcaatttgttattgtgtgcctcggctgattcctggacaagggttcacacacatgtaagcgtttggaattttggatagaaattccgggcgtgacaagttggtatcagagcctctttgaccctaggttatgccaaatggttatccatagaagccctctaaaaatattggaaaagtagaactgttcttctccctttctcttttaattaaaccaaactaatggcacatgcacttcataatctcttttaatggttctcattcaaaatttattccagtgttattagtactgtacatctattactgtactaatggctcattataccagcaaaagttttacaatactgttttatttaatcttgctgcaataaaataaatttagcatgttgattttataattttcttttatttcttttgaaacctattgttcaaaagtactaaaattgtaaccttgtttccaactatttcaacttattttgcaagcttggtttaccttatttacttccctttttactttgattttctaactttattcaaattaatccaaaaacttgtgctattaattggataaaggacttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatcgtcatgaagagaagtgccgagtcaaagtcactttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgttcccatcctcgtcaaccccagggaagtgaccgtggtagttaccttgagactgaaggaattgagaatgatgctaccacgaagcatttggttgagatgttgtgggctatggatgaaagtcgtgcggagattgtgttagcagctcaagatcgtgaagaccggaatcgtggtaagatttgcaagttagaagacaaggtggatcgtttggaaaaggaattagccgcattgaagggagaagcaccgccgcagaaggccaggattcgtctcaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaaccattccaagattgagtgggtagcaacccaagatgatgaagacgagccgaacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtaataataaaactcagtcaagatcaataaaagttaaagtaattctctgttctaagtagtttcccccgttttctcttcttgtgccctgtccatgccagatggtgaatactcgcagcaacgggattggtcccaacaaccccaataacaacaacaatggagagaatcccactctagctcaagttcttgctcaacagacacaacttatgaacatgatgatgcaacaacttcagaatcagcaaaaccaaggaaataatcatgcacctccccagaacaagttagcagaatttcttcgtgtgaggccgcctgttttctctagtaccactaatcctgttgaagctagtgattggctgcatgccatagagaagaagttggatttacttcagtgcactgatcaggagaaggtatcatttgcatcacatcagttgcatggccctgcctctgaatggtgggatcatttccgccttaacaggactactgctgaacctatcacttggcttgaattcaccgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctatacgtcaggaggacaagtacaattgcatggagcagaggaaacgtcggattgctcacttcaaggcacaacagggaaataatcagaagccgcgtcttactttaggaccccagtccatgccacatggaggttcttcgtctgttgttcgtccgcagcgtcagttcttcaacaacaatgctggcaacaacatccgtaatcaagctccacgtcctgttgcagctccagcacagcaacaacctgccaagagggagcaaggcaacaagcccgtggtgtgtttcaactgtggagacccaggacattatgctgacaagtgtccgaagccccgtcgcgtgaaggttgtccctgcccagaataactctgctgtaccagcatcaaaggcccgtgtcaatcatgttgcggctgcagaagctcaagatgctccagatgtgattttgggtatgttccctgttaactcagttcctgcaacagtgcttttcgattctggtgctacacattcattcctatctatgagttttgcgggaaatcatgggatggaagtagaagaccttagacgtcctttgatggttagtaccctaagtgatcaagcactttctttgcaacgtagcccctctgtcagaatagaaattcaaggagtaccatttctggccaatcttatcttgttagaatccaaagaccttgatgtcatcctagggatggactggttaaccagacataaaggtgtgatagactgtgccaacaaaaaagtaactctcaccagcaatgttggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggaaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcaacttaaaggtgccactgttttttccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttatagatgatattcttatctactctcgaaccaaagaagagcatgaggaacatcttcgccttgcattggagaagctacgagaacatcaactgtatgctaagtttagcaagtgtgaattttggttgtctgaagtgaagttccttggtcacgtcatctcagccggaggagttgccgtcgatcctagtaacgtggaatccgtaaccaattggaagcaaccaaagacagtttcagagattcgcagtttcctaggcctcgcaggatattaccggaggtttatagagaatttttccaagattgctaagcccatgacacaactgcttcagaaagatgtaaagtacaagtggtcgaaagaatgtgagcggagttttcaagagttaaaaagtcgcttaatatcagctcctattttgattttgcctgatccaaagaagggttttcaagtgtattgcgatgcgtccaaacttgggttaggttgtgttctgatgcaagatgggaaggtggttgcctatgcatctcgtcagttacgtccgcatgagaagaactaccctactcatgatattgagttagctgcagtcgttcatgcattgaagatttggcgtcattatcttttcggtactcgtacagaagtgtataccgatcacaagagtttaaagtatatctttactcagccagatctgaacatgagacaacggagatggttggaattaattaaggattatgacatgggaattcattatcatccgggaaagactaatgtagtagcagacgctcttagcagaaaaggctattgcaatgctacagaaggacgacagttgccattggatttatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaagatgagcaaggaactgtatggttgggtgagagaatctgtgtccccgacaacaaagatttaaaagatgcaattctgaaagaagctcacgatactttatactccattcaccctggtagtactaagatataccaggatctcaaggaaagattttggtgggcaagtatgaagcgtgaaatcgcagagtacgtagcagtatgtgatgtttgtcagcgagtcaaggcggaacatcagaaacccgccggtttgctgcaacctttgaagattcctggatggaaatgggaagaaatcggtatggattttatcactggtttgcctagaacgtcatcaggccatgactctatttgggtaatagtcgacagacttaccaaagtggctcattttattccggtaaagacaacctattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagctgaactttagcactgcttatcatccgcagacagacggacaaaccgaaagggtgaatcaaattttggaagacatgttgagagcttgtgctttagatttcggtggaagttgggataagaatctaccttatgcagaattttcgtacaacaacagttatcaagctagtcttcagatggctccttacgaagcactgtatggtcggaagtgtcgcactccgcttttgtgggatcaaacgggagaacgtcaggttttcgggacggatatcctaagagaagcagaagaaaaggtaaagatcattcaagaaagattgcgtgtggctcagtctcgacataagagttatgccgacaatcgccgcagagatttgagttttgaagaaggagactatgtgtatcttcgtgtcacgcctcttcgaggagttcatcgttttcacaccaagggaaaattggcaccgcgttttgtgggaccttataagattgtcagtagaagaggagaggtcgcttatcagttggagttacctcaatctttggcaggagtccataatgtgttccatgtgtcgcaattgaagaagtgtttaagagtacctaccgaagaagctaatcttgaccagataagtgagagaagaaccaggaatcgagttatccgtttttgcaaagtccagtggagtaatcactcggaagaagagtcaacttgggaacgagaagatgaattgaagtcagctcatccgcatctgttcgccagttcttccgaatctcgaggacgagattctgtttaaggggggtaggtttgtcacaccctgaaaattcaaaatatataaattgttgtttaattggaatttttagaaataattttaaaagtcttgaaaagaaaatctaattttaattaataaattccaatataaaatggggccagataaaatttcattaaatactttgcttaattctataattcctagatttttctgggatttatttgagctaaggaagtatttttaataaatggaattgcatttaaggaataattttaattgaaaaaggttttaaaaagtctcttttggctttgggccgaaagtcggcccaaaacctctcttctctctcctcggcccaagccggcccagtccgccgcgcgcgcgccctcgctgtcgctgacaggtgggtcctgcctgtcagagtcgtcgtcctcctcgggccgaaaccctagtttcgcgccgccgagctgccgtcgccgccgctttccaaatccggccgttcctttccttctccggccgatttgttagaggggaaacaatctccgggatctcctctaccttttctcctttggaatctttggctcaatcggtttggaatgagtttgattcgagttcgaatcggatcggctttcctctctccaagccgcgagtttccttcgccgttgccgtcgccgtgggcctccgtcgtcgcctccgagcccctttaaaaggatccccgtgctcttctcttctcgccgccaccctcgccttcgcctctcgtcgccggagtagccctagcgccgtgtgccctagctttgccttcgccgccgccgctccagccgtgcgccgccgtcgttccagccatcgccgtcgctcgggaaggccgccgtcgttgtcgccaagtcgtcgccgtcctcgtccgctctttcgctgccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtccgctacccgttggtgtcctccgttcgtgccgtagcgccgccgttcgccggtgagcgtgcgccgcccgagccgttcgctccgccgagccgccgccgccgtcggtgacgtcattgccgacgccatcggggccgtttgccgtgaaccgccgtggacccgatcgatctcggccgtccgtttggattggatcgaatctcggccgtccgttcgcgtgaaccgccgcccgtgcgcccggtccacccaaaccctagccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgattgttatagcccttttgtacttgattaccttattccttgataccttgggttattacaatttgactagttgagctttatttatattggttcaactagatattagatataattgcttagccctgcttagaaatattagtacatttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacacctctcattataataaaagatgcttaaactgataataatttgattagctcctggtttggaatggtacattcctggtttggagatagaactgtgcagccggggtggttgttcagaatggttgggcctatacaacagggtatgttgtatagcgttggattaatattgtttaattacttaactattttattaaattctcaaatgtttgttaaatgctgcttttgcaaatgcaaccctattatgccatcctttgttatcctgtgcacttgcatatttgctgcgtggcttgctgagtatgtcatatactcaccttgcaatcattcatcagaggaagaattctacaatgaggctgatggtgtggaggattaggtgtagccttggtcaagctgcctgtggagtggagccgtctgcgccgtttattttatttttccgctgcttagatctttattggttgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacagcgcctgcacgtatagatggccatatggctcgaggcccgatggcctggcgcaaggcccggtgatttggcccgactcgggtcgtgtccgtgccagcccggcccaacagccgtgccctgcttgggctcctacctcgacacgctgggccggcacggccctgcacgaagtttagggatgcaaaacaaacttattttcaaccatatgtaaggcacaatacaaagaatagggagaaaaaatagacgtattatatggcatggcccaaagagtagggacgtaaaatagacttatttagctttatatatgtcatagcccaaaaaggagggaggggaaatagacttatttcaaagaaggcacgatgggccgcccgtgccttcgggctggaatggcacaaccaactactggtgggtcgtgcctgggcctgaggtgcagcccgtgggctggcacggcttgacctaaagtaccgatcgtgccgtgccggcccgatcgcctcggtccgtgcctagcccgtgcctgggctaggccaggtcgtgccgggcgagccttatagccatctatacctgcgtgtgtgacaggctaagatgggcatctacgcatgtgacagcggctaaggtggtatttgattttttagcttaaaatcgggtgcccgatccataatttttttatgatcaaagttacaagaaaccacaggtattagacacatgagacttacctcaggtattaatatatatggttttaaaatttcacaaacccccacccttgtgtatttgagcgtgaatttactcaaaatttctaaatcgtagagtttatatgaaatttgtagtcattaagttcttgacttggtttgatagtttaaatcttcaccactttaaaaaattgtttaagatatgctgaaattaatcaggatttcaataaaggtggggttttgtgaaacgtttagaccataaaaacgtatggttttgtgtcacacgtcataatacactagtacagatccttctatctgtgacgggctctaatatgcttagaaatagtgggccgtcacaaggaagtcatctcaatcgggccgaaaagtgcccgattgagatatggtcgcacagacatgttagatgtgtataaaatttaagtccgtcacggatgacacctatcagtgacgggccacaactttaggcccgattgagataacattccatatcttaaatgggcctcaagttgtggcccgtcacaaatgaccatcatctgtgacgtgcaccaacttgaggcctgtttgagataacaactaggcccgtcacagatgactcatcagtgacgggctatatacttaatctctatcgggcattaactaaagcccgtcaccgatgactatttttccatttttcatatgaaatgtttatatttgtaagttgactatagcaaaataattttacgggtagtaaatgatttcaaatggaaaaaatgtcaacaacaaagttgtataacttatcaatatttagaacttttagtttggtcatttttcaatataacattttttttgaacagtttgaatttgaatttaaaaatatgacaacttcaaacaacattttcaaatactaaatgatttcaattgaaaaagtcatcaacaacaaagttgaataactcatcaagatctaaaacttttatttttgttatttcttcatctgacgaaatgttagtaatattattcataaattttacatatatgtgttatagttt

SEQ ID NO: 63307 - DNA, 26138 bp, Oryza sativa
  unsure (1)..(26138): unsure at all n locations
gggggaaggtttttgacctcaaatctttgattgggttccatataaaagtgtagagctcgttctcctccttcatttgcttccatttttttcagttttcatcggtggaatacgaagaaacttgcacttttataaatggaatagtgtaggcacctttttgtttttttattttttaagcaaatacatattgcaatcttttacatgtttataaaagtaattagcacctaaattgaaacgttgggtttgcctcttaagtttattttcatttggatgaaaaaggacgaatatttttattttttagaaatggttagacaatattctattaatgcttaaaattgatgtgcggctgtttaaatagtccgttcaactttaaattactacgtgattagttccctccaatttaaatacattcgtgtttgaatcaggcatggatgtattaatggcaagctttattgtagatcatggatcggacatggatgtacaacacgaaaagagctcatccaacgttcttgaaggaagcagccaaatttgttgagctcacaaaggcacatgctgcgagggagaatttgaggagcattttttgcccatgtaaagtttgtaagaacgagatcttgctgcaagatccgaatgaagtattgtcgcacattgtagaacgaggatttaagaagggatacgagatatggacttttcatggggaagccggtggtcgtaacgaagagttagatgatttatgttttgatgatgcagaaaattttataatcgaagacatgtcttagggaaacatcccggaatacggtggctcaggtatagagaatgaaggtattgattttgaactggaagatatgttgcggcacgttgaaccagaggtcctaactggtacaagacgcgggttggacaattgggaagctttggaaaattcagcgaaggagcttctgtacgacgaagccaaaggatacgacaaggactattcagtcctgcgctcggtgctcgaacttctcatattgaaggccagacatggatggttggacacgagcttcaatgatttgatggatcttttgagagtaatgcttcctaagccgaacctgctaccgacgaacacatatcaagcgaagaaattgatatgtccattgtctctaggtgttcagaagatccatgcatgtgaaaatcattgcatactgtaccgcaaggaattcgcggatttagactcttgcccaacatgtgggacgagtaaatacaagacgggcaacggagcctccgatggagaggtggtcgacaaagatgatgcactggtggatgagaacaaaaagatttctaggatggtgatgtggtacctgccagttaaagatcgcctgaagcggctatattccaaccgagacgacgccgagttgatgagatggcaccaagagggtaggaaaattgacggtaagatccgacaccccgccgatgctcgacagtggaaaaactttgatgcactacacccggaatttgcaaaggacccgagaaatgtcaggtttgcattgagcacggatggaaagaacctgtttggtgacctaagcagcacacacagcacctggccagttcttctaacgatgtacaacttgcctacatggatttgccagaagtgaaagtacattcttttgtctgtccttatataaggtccaagacagcctgggattaacatagatgtgtttctggaaccattgatggaggacatgcaagaactatgggaggaagggttacgaatgtgggacgagtaccgtagggaacatttcactctgcatgccatcatattcgttacgatcaacgacttacaggcaaacttttcgctctcgggccagtttaaggggaagttcggatacctcatatgtatcgacaagacgtcgtacaagtacctcacctcgtcaaccaagggtgtttacatgcgtcatcgtcggttcttacctcagaggcataggtggcgtgcgaaggccagattattcgacaatacagtagagaactttctagctcctgaaacacgtacaggtcgttctgtcttcgatttgacaaagaagaagcccgtcaagaggaagaaacgtacggatcaggacacaactgatgcacctttagaggaaagtaaccagtccttcaagaagcactcaattttttttcaggtatcttgattactggaaagacctggaggttcggcatgccatcgacgtaatgcaccttgagaagaatgtgtttgatagcaccattggcactttactggacatcccgagtaagacgaaagatgggttcaagtcccggaccgactttgtcaatttggacataaggcatgagcttcacccaaaagagctgccaaatgggaagatcgaaattcctccggcatgctactcactaacacctgacgagaaaaaatctttatgtagatgcttgcatagtgtgaaagtcccgactggtttctcagcgaacgtcagaaaacttgtatctttgaaagatttgaccatctctgggtacaatgctcatgattgtcacaagatgttaacagtcttcctacccattgccataagagtggtcaagccagttcacactcagttagtgataacaaagttgtgctaccttttcaatcgagtatcacagaaggtttttgatcctgaagagttaggcccccttcaaacttttgcaatcgagacagcatgccagcttgagatgtttttccccccagcttacttcaacatgatggagcatcttattgtccacatcgtacctcagattatcgagattggtccactatacctacaccagatgtgggcgtatgagaggtacatgtccgtgctgaaagggtatgtccgtaaccgagctcatccggaaggatcaatgatagaggggtacacaactgaggaggtggtcgaatgctgcatagattacatgaaggacgccaaacccatcggtgtgaccccccctttacacgagggccggttagctgggacggggatcgtaggcaagaaaaggttctacgatgaggacttcaaagatgtagcggaagcacatagcagtgttttgcaacagctcgccatcttagagccgtacattcaggaacacatgaacgagataagagcctgcaaccctagaagaacggacatttggatttgtaaagaacagaaatggaaatttcctgaatggttgtaggagaaagatctgccgttgggtgattcgctggaggaaaaaactttgcgcaggctagcaaatggcccaactagccttgtgacctcatggcaagggtacgacatcggcggatatagattttacacgatgttcaaggacaggaaaagcgcagctcataacagcggagttcgggtggaggcgtttgacgcatcaggtgagaagaagtcttactacaggatcatacaagacatttgggagctggactatggccttaacatacagatcccggtgctacgatgccaatgggtcagagacacaacatgcgtattcatcgatgactacggcctgacggttgtggatcgtagcaagctaggacacaaggatgatccgtgggttcttgctgagcgggttgctcaggttttctatgtcaatgacccttccgatgataagatggccattgctgtaccaggaaagcaaaacattgttagcattgatagcattgaagacgtgtcagattacaaccaatacgacgacgtccttttgtttacagattttcctaaccggatcaccggatcaaggaagttgagacaagccttgacgaagatttgtttttgtccgcgcggaaggatggtgtttccaaaattgtcaaacattagtgagatgtcgatcctgtgtactacctattttgtaaacgattactggatgaaacttatattgcgaatgagatagggtatccatgtttatccgtactatatgtcgttttgaatttattttatggtccaatattttatttatattaatcatatcgatgaataattagatgcgaataaaattcatgtctgttttaattctttgttaatctatatttgtgttttgaataattcgtggtttaattaacccaaaccaatattaatttattgtttaccgtgatattaataattataattattaattaactataacttagatgggaatataacaaataattaactatattgcattgtgctatagcaaatatatacattcccatcgaaattatgatttttttaataaaaaaattggagttattaactaataggctcctctcctcctcttctcctccccccacgccggcgcctacttttcttcttcctccaccgacgccgctgaccttcttcaccggcgcccaaaaccccacgcccccgccgcctttcctcatcgtctccggtcgccgccggccagatccaggccgccgccgcctttactgctcttgtcctccccctcaccggcggcttctcttctcctacccatcccttcgccggccctcctctactcctacccctgggatctgcgccggcgaccacctngcctctacgccggcagccccagatccgggccgagcgcctgctctccacctagacctcgccggcgccgactcttctacacctcgccccttgtagccgtctcttttaacctcgccgtcgccgacggcgtcttctcgtacgacacaccgaccgggctccgccgccgagggctcctgcccggtcttcaccgacgccggcactgtctactacaccgacggccagatccgggtcgacgccggcctcttctcacgccttcaagaccaacgccggcgttaggagcaacgtcaagccgcgggcctcgccgacctccccccctcggcgtcaagagcaccgccaagccgccggcctccccgaccaaggacgccgccgtcatcctccccaagccggcgccgtcgtcctccccaagcagccgccggccacgtcgccgccaagccgcggccggccacctccccgcaaagccgccggctgcctcctacttcctccccaagcctcctcgatccaggtacccctctcttcgccgcccctccttttttggatgatgcaatggtaatggatggaatgatgcagtggaatggatgaatgatgcagtggatgatgcatgcagtagatgcaatgttgaatgaaatttttgaatgaatgaatgatatttggttgaatggatgaatgatatgttgatttgtgatgttgagatgatgatgatatttgtgatagatagatggttgtttgtgatagatagctgatatgtgagatgatgatgatatttgtgatagatagatggttgtttgtgatagatagatttgagatgatgatgacatttgtgatagatagatggctgtttgtgatggatagatgatatttgagatgatgatgatttgtgatagatatataggacttgtgctctttgtgataaatagatgtatgtctacatgggatagatggatgttttatgtcactgtgggctgtttttttttctacacatgatgaaatatatgcccctgctgaaatattttgctaattttgcaaatgatgctgttatgcccctgctgatgttgtgcatatacatgatgaaatatattttgcttctatatgtttatatatatgtgatgtacatatatgctgtttacacttgtttgtactgtatattttgggctgttttatgcctcattgtggttgatacatgtgggtgattgttgtgggtgatatatgtgggctgatttatatgtgggtgatatgtgggctgttttatacttgtggctgatatatgtgggctgttttttgttggtgataaatggccaatgatgaatgcttaagaacagatcatattgtgaatttttttggggggcacttcacttgtttatttatcctcaagaacagaacaactacacttgtgaagttttttttggggcacttcacttgtttatttatgctcaagaacataacaactacacttgtgaaatattttggggggcacttcagttgttttttttgcttgagaacagaacactacacctgtgaatttttttttttttgggggggggggccgcacttcgcttgtttaataatgcttgataacagaacaactacacttgtgaaatattttgggggcacttcagttttttttttttttgcttgagaacagaacaactaaacttgtgaattttttgagggggcacttcacttgttttttttgggggggcacttcacttgttttttttgcacataagaacagaccatctacacttggggttcatgatgaataattgctgagcaaaactgaggccatatgctttcatagtgtgcatagtgatgaatatccttaccaatcttgaaatcgttacccatcttacgttccttaccgatcttgctttccttaccaatctcctaaaattagatataggaggtgtagttcgtacgttatcatgctgctataatacgaagtgttctggttgccaagttctactagtcggtttagttgctggacgcaaccgactagtacaaattggaaaaacagaacatttcgtcaacatatgacatgcgttggtcatccataaaatgtgctagcacgtatgttgaaagatagacctctgacttgtacatgcgtcggcctcgtggatggaccaggagctcgacgttccttaaggccgttctttccgacccatacaaggttccgtcgcctgcattgttccaagagtgtcttggacgaaagcaggaagtggaaccttgttaaggtcggaacgaactgccttaaggaagtcgatgctttaggtccgtccacgaggacgacgcagctaggagttagaggtttatatttgaacacacgagctagccatgtgatcaaaacatgtttttattttgctgttaatatgatagtttagtttagtggttatgatagtttagtggatttgaacgaatattaaattgtaagaacgcgaatcgaagatgtcgggcaagacagctccggcgggcacagaaccgacggtcaataaacctaatgggtaggacagctccgtcgggcacagaaccgatgtcactaacaatccccaacacgaagaagatgtcgggaaggtaccgacgtcgagcaaggaatcgtgatgcacaccgagcgactcgtttgagctagaactagcgcaattgcagtatgaaagacctgaggatgacccggattatattcctatcgagcaggcggtaataactgaatcctgtcgaaatatatatttggaattaaactttccccgatgtagcggtctaatgacttaaccgtgcagatggcaacccgtcgtcggtcaaaactaagtgccgtcagggttgaacctgattcagacacaacgacctcgggaccaccgcgaacggacacgacgatgagtgggggagcttgtccaaagaaaaagcgtggcgagaagggcaggaacctcatgccgaaggagacgtactacattgctgctctcgatgttgacggcaaacccgtcgagccgcaacatgtaagggtgaagtttagcaccgcatgcggcgcgctggcaaggcttcatgggcctctcaacgtggacgaatggaagcatgttagcattcacatcaagaacttaatgtgggaaggtctgcaggagcaccgtatttatccgcctgagtcggaggcacttggccggaaatttgcactgcaaacaattgcccatcggtggcgacaatggaagtcggacatgaacaccaattatgttcagaagaataagactccatttgaagaatggggcaccatttcagcagtgagtgggacaagttcgtggccaagatgacgacgcttcaagctctagaaaggaggaagaagatgtcggacctggcgaagaagaacatatatccacacaggttagggtcaagtggatgcgccggtcacgagaagaaatggcgaactacggaggaaaagtttgcggccgaaggcaaacctttgattgtgcagcccctagataagcgaactagaaattgggtgtgggcaagaacttcgagatgctgttggactgtccagacatccagaacgtgaccacgtctctccaacagatcgtccagaaggagaagaccggtgagtttgtccctcgacggcagcatgatgagctgaccgaagctttgagaactacagaacactccggtaggttagaggacagtcgtgcatgacgaattggaaggtagggtttccacaggaagcccaaagttacaagaagcgcgatgcctacaaggccaagatgcgccaggaaatcacaaatcaagtcacacaacaagtcacccaacagttctacagtcttgccgcacaacatcctcaagccttccctgacctggttcctcatggtttgcagtcgacacagatcctaagctcagtcgggtcggtagaaaatacaacctacccagtagatagtataactggtccgacaccgtgcagctttgtcgttccgatagggagagcgggaaaaacgaaggaggttgcgtctggattggcgataccggggagacagttccataacagcctaattccggcggactacgtaagtgttcaggtcgcacttgttcatggcgaccagatgtcgttggagcttgacatcccaacaccagaggggattgaacttctcagggatgcggttaaccagttcatactctggcatcgtcgtgacatcatcctcactggacagttcatgtcgatgacaccagctccatcggtgccaaatacgtctgcacctcctgcaccgccgtcccctccgatctgcactaccccacccggatctccactcccacagatatcaccacttagaggtccttctccacctccacaacaagtagcacctaactccccaactaccctacctcggtagccgtctcctgctcctcagtcctatcttgctccaccccttgacgaacatgtgccacctccacagccagatacatcaaaggagcagccaaaaacctgtgaagcccgcaagctcatacccgttatggtatccacatacaacaaggagaaaatggcagagtgtgagacgcggatggttttgcaatctttcaagggtcgagggggtccgctaaagccagttggacctgatcagtattcggacgcacagaagagcgttgtaggtcttgctgacaaaatgcaatcttggacctccaatgaagtgcctaaggagtatgaatatggcaagccgtttttgccgttcaacttgatgtgtgaactcccatggccaatgaggttgatgcatgagtggtacttgagggcaagtgagttaggtctcgggatgattactgtgcatgtcccggaaggcgctttcaaggatggacctaacgcaaacttcgcctttagtttcaaggacctccacgcactctttaagatggataaaatggatatcaatctcgtcggtgcgtggtgcctataagcattccatgtacttcgttattccaatgtgtgccaatataattgttagttattctaacttccaaatttcctcatgtcacaatgggtagacgctcaaagaacggggaccttaatcggttacgtaaatccaacgatggtttgcgagacggcccacactgtgcggatatcggaggatagtgcggtactaaagaataagacacctcaggagaaaaaagattacatcgagcgtatgcgtaagagaaagatggctgaggtgggaaattacttggccacctcatttctcgcacactccgacaaacgagtcatcatggtcccctaccactttgggtaagcaactttgacatatttccgttcacatattaataacagcgcaagaaaatgtcttatgtaatttcataatccgtgttcacagcgaacactacatactattcctcgtctatccaacggaccaaaccgttgtagttcttgatccggcggactatgacaaggacgcgtacatggagttcctatgcttgctgaacttgtaagttcgaaacaatttccgtaaagattccaactttccgtaaagatcattaaagtagatttatcataattaattaatttatttttgtagagcacacggccgttataagaaacgtggcgggtacgttaagaatccaagtagagagaaactgtacataaggggacactggccggtatgtcagcatttattcagtacgtacatcacgattgtcacttcttacttctgacgtgtccacttgtgtatgcagtgttataagcaacctagctttacgaacctatgcgattattacgtgtgcgagatgctcagggtcaatgggagatacaattgagtttacagatgtaagtcattaaactctccttagatattgcaaatagttcattaaacctgactgtaacacaaatcatttgtcttttaatttcgtagctcccgagtatcccttatagtgcaagccggttcgatcagaaaacacttatcaacttgtgcgtggacttgtgccggttcattcgccgcgacatctgcaatcatttaggagagttccatgatcctcatagcgaacttgctacggaccccaaattcaagaatctaagagagtgggagaggcaacatgctatggactaaatggatgtatttgtcgtgggggatgcttgtaataaacactatactttttatgtaatatgatttaatttgatgtttcggctaattttcggctaattttctatctattgtctcgtgaggtcaaattatacaaaccgcacgggataataggttatcccagatggctagcacgtgctagccgtggggggtaacatattatcccgtgcgggccacttaatttgaccgcacgggaaaatagattatcccatgcggttggccttattgcacaggggataatcgattatcccgtgcggtcggcccgcccgcacgcgaaaataaagattttcccagacgatgagctgcaggcgggccgggcgaccacaggggataatctatccaaccgcccggaataatgggtattgtcgtagtgtccggtgtaccatctagtatatgtaatcttttgtctaacaagactctagctggatgatttctaaaagtaaagagaaaattcgatccatagcacaggaaagaaagcggtaccaaaaaatagcacaaaaaaaattccactttcgatccatagcataggccactaatttttcttcgccccgtagcactttcatcgtatttggaagtaacggcgttagatcggagtggagaaaattttcgtcggactcatttgccctttgttcccccacgttcccaccacgtctcatcttctgctccttcgtggatggcggtgcggtggccatcagcgtgccgggcaaccgcctcgtctccctgccaccgccgagcgagctgcgacgtgcactcttcaacaacgtggacgcgtggctcgccgttgccgccgagtcgaagaccttggcattgtggtgctcgtcgaggaggatgttctccggcttgatgttgcagtggacgatgcagtcgcgacacttctcgtggaggtaggtgatgccacgggcggtgccgacagtgacggcaaaccgcgtcggctacgacatcttgcagcccggcgcgtcggtgaagaggaaggcatcgagggagccgttcttcatgaactcgtaggtgagcaggcggtggcgtccctcggagcagaagctgatgaggcggacgaggttgaggtggtgcgtgctgctgatggtggccacctccatcctgaactgcttctccccctctcgatcccctccagctgcttcaccgccaccaccgtccggttcgccatcacgccgtggtacacggcgccgtacttcgggctgtgccggcacaacacacaccacaacgctcactcgcacagcaccagcccggacaccacgccgagcatcacccacctgcggacgccagacaccctgctctacagcgagccgccgccgccgaggggcaggttgggtatccccgggaagcagaccttgatgaacgacgtgctgggcagcgccacggaccggtacccgctgacgaagttggacaccttgaggaagcagaggctcgagccgccgtagagcgccatggaggcgacgcatgagctgccggagaggcagttgaggcggcaagcggtgatgccgacgaagaactgctctgtcgtgatctccagcagtaggtgaggaactgcgtgttgtcaagctggagcatggtggagttgcctgggcagttctggagctcgatcttgcgccggcatcaccctcatcgctgcgtcgacacctcgacaccctcgtcgccgcgtcgttgtttggcgacggcgcctctatgtcttcctcctctccgttgcaaatggtgggcggcgctagcgtagttcagctcaacggggtggctggggacggggatggcggcagcgtggctggggacggggatggcggcagcatggctggggacggggaaggtggcgcggcggctggggacggggacggcggtggcgtggcttggggacggggatcgtcgccgcatcactgtttggcgacggctccggcgccgtcgttgtgggcacgacccgatagaacgagatgacggagattatggcgaggaagacgaagggcaaatgggtctaacaaaatttttctacacttcaatctaacgctggtaactccaaacctgacggaagtgctatggggcgaagaaaaaccggtgcctgtgcttctgatcgaaagcgaaaaattcttgtgctattttttggtaccgcttttttcctgtgctatggatcgaattttctcaaaagtaaatgtcgaccttgtgcataaggcttttacctagcctgcctttctagactatatatgaggattcaccttttttctcattgaacatttattgattgtaatcccatctatttgtcggacataacgtttgtaatttgaggtttcatgaaacaatcatgtgtctcaaatgtaattgtaatcattattaattattattgtgatttaggccccaattggaactgttgaatatagttcgatcgcccggcctggctgaatggcagattatttcattcatgcttctaaacataccttttttaaaaaacaaacattcaactgactcccgtagaccacattagtaaactatttgttattttttaaaaaaaaatcaatttaccgcaccaatcaaatagaccatccatttcgttttatcccggtttcatcactttgcaaccatccttaagttgtattcgttacctatggttgaaaacaaatccatacagcgcaaaaaacagaatgacctattagagcataattaattaagaattagctaaaaatactataaaaattggataatatgttctttttaaataaacttttctataggaacttttttataaggtgcactttaaaaaatatgcgcgttaaaaatgatgaagtgaagttgggaatgtgtcttaagctagggttagagtaaggctaataatacagccgatttgttggctataaagttctttgcagacttttcttaacccacacatataatagattaatagttagctatttacaattaatacagagtctacttgtctctcatataattttttggttcttatgcccaagtcgactgtaagtttacagcccgctttttctctctcctcgtatttcctccacctcagtatttagccgacttacagcctcctattatacttgctcttagggtatagagtatcatttcgagcaagctttcgctttttctcccggctgtctacaacttgacatcaattgcatggtatgagcaatgagttacagctagtgtgaacatgtttcccatattgtaacgtatggccactcggcggctagtaatcttaaaaaaaaaaggagagctgacatcaattgcatggtatgagcaatgagttacagctagtgtgaacatgtttcccatattgtaacgtatggccactcggcggctagtaatcttaaaaaaaaaaggagagctgatgataaacgtaatgataggcgtaggacgccatcctcccctgccgggggactccagtccacagtccgcgaggaattcctccaatctccaatctttttgcggcttccatcccctgccgggagcagaggcgcatcggctagctagagctttcgcttgtccatcttgccgtccgtttcctgagctgtacacgaggacgttgctgtgctgcatgcgtacgtcagtcgatcggtcagttcgtccagctctcgctctcgcatccatccgtccgccgttcgtgtcgcctgtcatctcgttccaaccgaccatgagcgaccggataaacccaacctgatcattcttcccccccgggaatgattgcaccgtgccgtgctgtcccaaaatatctcccgcagaaatgttgcaagattttgtttttcagctggtgtaatttgctcgcgtttcttatgtaacctgtaacaatggtggaataattcgatcaggagtaactgagaggaaaaaaaattgatcatttcgcctctctgttcagagcagagtaccatcccgaagcatcatacagcatgatattcgttcggtaatgacgccgctaatgatcaacgtaactcaaaacagcgacttggttgcttttggcaaatagtgccggtgcagtccccctcctttttaaatattgcccatcatgtaagattgtacttgtcaaaaaccaaatcctttctgctcaaccacagagcccaacatattgcagaggctcccacaagtacaagcttactccttttcttatccaccccaaaaaccaaccatcaaaaagaatattgtattgctctccatataaagtttgcataatggcaatccatgttgaatattctcattttacataaaaaaaacaacatcttaaactactattccaattccgtcttactaaattgtctttggttaacacaacctctttaagtaagtaccacatatatatacaggtaattttcagggcaacatattggcttcggtgttgggctcagctacaaaggtgtgatgaagatggcgagtttatgaaggttgcatgccgtaggcttgagacgacagttatgcaactttttgtcaattatggttggagatttacaaatagacttcaataacgtgttctccttatcttagatgggttattttttattttaagtgcgtgttctcaatgttttgttgaactacacttttttttagtgtaactttgtaataattggctgtagctcgttttgagtaaaggctgggatattctattccattatcttaaaaaaaattgtaagattgtactgaatttctacatttgctaagatgagttttcgagcaattggaatccttcttcttacttctctatttttcaattatgggtttgttccacttttgcgactataccatgtacgatgcacctaggacaaaacgcagatatgaaacctgctgtccgcgagtgtgtgccttggccgccagcgccactagatagcgcggtacggcccgcgcgggctaaacggccgccatgcagacagaccagcgccgccgccgccgcaacgtgtgtacgcgccgcaacgtagagtacgtacgtacgacgtacatgggcctccacttcacggtcacgaggaggcgctgcatggagcgcacgtgcgtccccacttcaccgtcatgttgccgggccggtgcatgcacgcgcgggccctataaattctgctgcccccacaggccacagcccgttcgttgtagggtcgggaatccaacaggccgcgcgccgccgccgtcgccaattcgtcatggcggcgcgcgcggtggatgcgagctgagccgacttgttgcgggtgcagcgtcatcaagattcacgtgtgccgcacggcacacgtatcggttttcaagtgtagtcatcgtgcgtgaatcttgatgatgctgcaccagcaaagagccggccgtatatatattgttctattagtattgtttcaggaagcatatgtgtgcatggttgtctacgtgcaggcaggcaggcaggcaggattagctttttggccaggtacagtatacattcaactctccagggtttctttaaaagtacgaaattctttttgacaggttttatattccttgttcttataattaatagcattgctgtcatctgttctcttatttattatatctgtctttgtttaaaaaaaagcactcctcatttaaaaatataagcatttctagctagataactgtatattcaaatttataagttattaaagttatatatttgaaaaccgaggtagtatgttcttaattttataatggcaacgttgtcatatcgttcttataatgcatatctccagtttttttatgatctaattaattattaactagtgttaccaattttcatgcatgttcatcgtggagattcgaagggaaccatttttggacgtacttgtatagggatgtcatgtgaaagcggcagtccatcccatactgatgagtgatgacaccacacactccccaaaacgaaaatgcattatctacggtccgtgctacttgtggcgacgacattcgggcaagatcagtggcagctagctaaatatttaaatagtagactatccgagacactggctttgctgtctgtccgacggccaatcggtctgggtacgagctcagttcacaatatatacagaggatggaccaaacagcaagggtgtgtttagctcacgctaaaattaaaagtttggttgaaattggagcgatgtgacagaaaaattaaaagtttatgtgagtagaaaagttttgatgtgatggaaaaattgaaagtttgaagaaaaagttgggaactaaaccaggcctaaactcggcctaattgggaggtagaatttgttaacaacggttgtgtttagttacacgctaaaattgaaagtttgactaaaattaaaagtttgaagaaaaaaattggaagtttatgtgtgtagaaaagttttgatgtgatggaaaagttggaagtttgaaaaaaaaaagttataactaaaccaggccaacgtcaagtgtaatatttggaaactggaacgtaatgaactacatcaagctgtggcagtgcaagtatacataaagttaataaaagttgtgtaaattaaagaatcaggactcgattggagcttaaacatgcacgcataaagtagtagcaaataatatagtaaatgtccttttggcttcactcgtcttagataataataacgacattgactgaaatgtgacatgaccatttttatatggtttattttctaaactatgtatactacttatacatatgcttttacaccacactatctaaaatagcgatgcttgttatatatttatactccctccatcccctaatataagggattttgatattttgcttctgatgttcgaccactcgtcttattaaaaaaattgtacaaatataaaaaacaaaaagttgtgtttaaaatactttggataataaagtaagacacaaataaaataaataataattctaaaaaattttgaataagacaaatggttaaacagtacaaataagatgtcaaaatctcttatattagaggacggagggagtacaatgttaagcgctgcagcctgcaggaactgtgaggcaagcaaaatatatatataaaaaaaagcagtgggccggctgcaggaacagtgaagaagcaaaaaaaaaaaacacagtgggctggctgcagccggctgctgcacctgcgtgccgaacaggtccatatgttgttgaatttataagcacaaaataatttaatttattccataactaacataatcgtatcatacaatctacacatgtaaaccagacattatagcatgaacagatcgaatatgcgaaacatattgaaggcgtaccaagggatttgcaaaaccggctgctcagcgggaaggactcgtggtaccgtgcgttaacgatggtgcgcaacccgtgagcgaagaggaagaggagccgttgtggatgaacaaggagcggtcgtgtaaagcacttcccaaaaacattattgctgccttctcccggtgtaggacatcgaaggcgaaggttccggagacctgctctcccgatcgcagtacagaggaggaggcaaaccctagattgatttcgcatatgttgcatggaggcggcggctcaacttgagcgggatggagtagactacaagtgacggtgcagtacagaggaggaggcaaaccctagattgatttcacgtgtgttgcgtggaggcggcggctcaacttatatagagatatcaggacgcatgcacaatctccactccacgtaaccgtactaccgcgtaacatatccggactccacgtcgtttcacgtaccggaatattcggagtgtttccgaaaaacaaatccgaatttccaggccaggcgagcgagcacgtacgtgtgttccacctattctctccacttcacatgcctcaagtggctaggaaagcatcttcccttataaggaggtctccctctcctagaataggcaaggtggcactaaattcctcatgcatgccatcccatgatgtgggcttttatgattttccaaagaattaatcttgaatgggttaaggctcatctattaattcaaataatcccccaccaaatctcaaaatcccactgagatttgccttttctcaatgtactgtttatataccagcggtttgatggagaccaattaaggctgaatatccacctagaattctaagctacacttatttacaacttgaacaatggactatgccttgaattgcaagtcttttgcaagcaagtttcacttagagtcttatgtggtactaccgtactagaccgtcagtagactatccctcgtgtggagcgtataagtcatactccttgctctcttagtaagcttcctagaaaattcatccaaaatctccatagactacgaccactccagctcacaaaggtgcgttctttcaagaatggtctgcaggatagcatcttcgctaattaaagaacttattaagacataaccaacatgccttgcagctcatgagagtacatgcaacttcagttagagatggtttagattggtactcccctcaagttaaataatagcttgttcgtcccagggtctaattcacgggatctccaatcacataattatgttaccgtcatagtagaactcacatgggtctcaaacccatctccttcgatgcattgtctatcatatttcgtcatagtcccttcgtgaagggatctgccaggtttggatgtaattcaatgttataaccccaaagtttctcaaattcctgaatgacttcaatcgtcatttcacatgtctaaacgatttcatgttatccttagaactattcactttgaaaattaccatttgattgtcacaattcataagaatagccggccccggtatttcaaccacaagcatatccatcaatagatcacgcagccattctacctcaacagcagcagtatctagtgccgtcagctctgcttcgatggttgacctcgtcaaaatagtctgcttacaagacctccatgtaatagcagcaccacctagtgtgaaaacatatccactaatagctttgatctcatccacatcagagaaccaattagaactgctatatccctccagtaccgcgggatacccagtatagtgaagctccaagtccatagtaccttttaaatggtgcatcactcgctcaagagcacgccagtgatcatctcccgggttagaggtaaaccagctcaacttgctcatagcaaagaagatgtcacagcccagaaattcataagtaatttccaaactaatttgtgcattaaatcctcgtctagaaatcagctaaggtacataaactgacaatttatacaaattcatcaaaataagcaaagcgataaatacttacataagaggcacttagttctcaccaccaagaaaactgcagcggaaaataaaatctagcgaagctccaactccactcccacaggcagctcaactgggatctaaaccaaaggtcttctccttctagatcctttttcttcaactgagatttggtgtttattgcaaggtgagtacatggaatactccgcaagccacacagcaaatatgcaagtgcatagggatcgataccaaagaatggcatgatgtaggactcatttgcaaaagcatcatttagcaaagagttcaaaatttgtaaaatagtagagtaattaattatcaatattaatccaatgctatacaacatacctgctgcataggccctgccaaacctgaacaaccaaccccggtcgtacagatcaaacctccaaatcaggaattagccattccaaaccagaagttaaactaattatcatcaattatcacattattattattaacgagtagtgtgagactaatcaaaacattattagactcactcataaccgcgagcacggctattcgaataattttactctagccagagatgtaccactgtacgcacaagacacgatttcacacatgttgtcatgccccgaagtaccaccacagcactacaaagagggaaatcgtgacattacccttcacataacacaattcataacagtgcaccgttcctggatcataatcaccccctcaagagccagaggtatggactccccagcgagcctacggacttatcgccgctttacagtctggtgtctcgcaatgaaacacactgtacaaaaggtaaagtcgttgcccatactggcttgtggttgacacggttaatgtttcacaacagtagctcgcgaaccggtccttaattgtcatgagcacaaccatcaaaatcatgtgctcacaactctccattaatcaacttttagtttataattaattatcataacacgttgaccatcgtgagctaccattaaatataaccataagtgatagtgaagtataaattatcccattaatgagctaatgtttctaagcataactaagtaattacatctaatatctagttgaaccaatatataagtctaactagtcaaattataacccaagttatctaggaaaaaagagaaagctatagataaagggagggagtgcattggacttatcaaataaaaaaaagcacctaccttatgcttattttcctttggaacaaagatgtaccaatatcatttcatacaattttacaaatcttgttacttgtcatgggctttgggccaggcgtcctaggctcattggataggattagggtttgttaggattagataaggtttcttaggattagattaagtagtcctccatctatataaggagggatcctatcccaggtcagttaggtattagattaagatttatcttagtgcccatcggcctgccttctcagtgcgacggagagcgtcgcgtcgtttaggttcaggaccattcctcgttatttcatctactataatccaatctatccctattcttcccgattcttcttcatataattcttgctcgtgacaacttggtatcagagcttcggttccgtgcccatgggtgccgagatcgcggcggttcccaacatcagcgaagatcttgccaagatctcgacgaagatgatggacttggcggcacaactccaggctttggcggctccatcagccgagcaggccatgtctctcggagctgctgaacgatccgaccggcaggccatgacgttcctgctaccacggcagcacgaattcaagcagcggttgcgaggcgccaactcgaggaggaggatgagttgcctgccacagccaaaggcggccatccctcgcggtcgtctgccaggagttatgccactcatctcggcggaaacaagacttggtggcgtggtgctggggatggcatcaacggcgccacttctgcccaagccgccgtcgaccaccacggcgaaacgacatccttcaccgtgcctacaggcaccacaaccggttgggttgtcaccggtaacagctgtcagatggagtcttcctccttcgctcttggcggcgcttcaacagtccgagccattggagaccacccgggagaagctcagggcgaccgacgacacaccgtcaagggcagcggtgcctacttttgtgacgccaacccttgaaacaagaaggcgggatcaaggtcgttggagagcatgcctagccggaactcgacctcgctgttcggcctggcaatgccgccgtggttattggcgttctcaacggaggcagaggagacgactgcgagttccacttccatggcggcgtagcacggtacgggcatccgtgcgatttccgggcgatgcgatcatgcgaatcggtttccacagtgggaggcgcaaattccggcgacggttggagcagagccatgggaagcggagcggcttcttcgggcgccaggtttggcacgatctgctggcgaaccgtgcccttcgcgcggatggccccgctcgtgcactcgattggctcccgcggaggcgtggggacggcgcagatcgctccgagtccgagcgctggctcgagaagctcgcgattcgatcgcagttggctgcatcgctgctgtcggcgtggccacgtgaagaaaaggatagggtttctgtcttcttccagttgggctggctggtctggtctggttggtttccacgttggcccatgaatcatagatggttcttcctcatgttttgggccatgaaccatgcaagtaaactgctgcttctccctttgctgttggtctgggcacgtgggttttggtgagaggcatgctgctgtgcttggccacggcttgagcctaactgtccgttcaaggcttctagacggcgttctcctgtccatgtacatgatgacagcagtactagttctttagggctctttacaagctgagatgtaaaaggcttgagagtcttcgtttaggttatggtacttcgtttgagtccagcagggtgagctgcagcttgaggacgagctgctcaaaaaggggggtgtaatgtcatgggctttggaccgggcgtcctagactcattggataggattagggtttgttaggattagataaggtttgttaggattagattaagtagtcctccatctatataaggagggattctatcacaggtcagttaggcattagatcaagatttatcttagtgcccatcgacctgccttctcagtgcgacggagagcgtcgcgccgtttaggttcaggaccgttccttgttatttcatctactataatccaatctatccccattcatcccgattcttctccacaaatccttgctcttgacattcctccaatccaaagaatcatataggaataaaatcctaaggaattcaatcccctatgaaaatcctccaatccaaaggtgcacttaacagtttattaagaaggatttggaagttaggtgttgaatattctcaccactacttcttgtttatgatcagattcagtcaaacttttcagagttgatatggagaaaaacgatattaaattctgcatatttctacactacaaattactgaagttatccgattaaaataagcggaacggatcgataactactaaacaaaacattgtgccaaaccttctagtattcaaattttgttgggcatttcctttggacatcaatccatctaaaacataaacaggcggactatgcgagtggaacatgtggttttcaaccaaatggattcacatgaacaacttcaaagaatgcagcttttctttctatagtgacaattgaaatgcaaaaacaactgatacatgagcctcagaaacagcatatgataccaatccacgggaataacaggtatatgtaattgacaagaacaaaaaaaaaatgaggaggcatcagttgtacatactcagttgtgattgatgacaaatagacatctcaaaagaaatctaaggacatcagtaacaggttggcacaaacttgactaccattcaccttcctggcctcatgtgtcagaaaaccaagcctgagatatcaaagtaaccaaagccatacatatgccaaaatattgctctttattctgtgaatgaaaaacaagactgatctggcattgtgattcatggatctaccgctcgcgtcctgctctgtggcacagtgcactcatgatcgcaatgcagcgactcaaggttctaagcttccaccttcttctttggttgccgatgcacggatcccttccatgacttctgcttcaggactatgcccttcttcttgggggcatactgctgtttcctgataaaaaatatatcagcgtgagattgaaccacaacatataagcaattcacatccatccttcatgattcaaggaacttacatattacaattcaaccaagttatgtcccatatttctatttattaaaattactttgattgcacccatttcgtagataaaacaggaaaaaaattcccacacttcatctctagcagactgaagcagagctactgatttacttctgaattgctggcttctggttttgggtctacaattaaaaaaccttatggttgcaatgaaatcaattcatgagtctattatatgttgctaaaattaaccatgatttgctatcccactcctgacttgccaggcacgcgcactcttctcccattcttcaataaacaacaccttcccctcccagaatctgcagctccgcccgatgcccactcccccctcccctaccagctctccagcaaaagcgccagtgagagccaatgttgcactcctgacctccatgcgcactggcatgggcctgatgctgcgctcccatcctccacacactccccctccccctttaggcctccatgacagaggagactgccgtgtttccatggtaaagttccttcgtctgtgagggttagatggcatctattgtcttctatgaattatgatggatatcacctccattgccctgcgtgctcaattagctgtcatctttctaacctacatgctcacatgggtatcatcacatatcctttagccgatgcacttgtgtcctctccagtcagaactgagacacatcttcagcacagtgcgttctaacaatttttggtgtgtcagcatgatgtcagtgctttaggtaaaattcagtgatggctttcttgatgcttctgagaatcatgctgcaaacattatgtggactggtattggttgctcttctattcacagatgattgtatgaagcttaagcaagacatagttgccctttctaaaaaaggaggagcaagtatgaaacaaacttcagccttggatacagaatactgatcaagatgcacctttccaatgggaattctctaaaaatctatgagaaccctaatgcattggtaggctggttaaaattgccactacaccttcctgtacattagtgtttatttcttcaatttctcatagcaatatgacatactaataagttgacaactttgcatggttctagcttttaataatttgaagcattttttggtttgaccatatgatcgaggtaggtaacaaatggtttggaaccaaaacgtacatctgttgtcgtttgatatcggaggcaatggtttacattaatctatattgagagatgatttcacctcttcatccaactcatattattgtgtccttttatagccgcaaatttgggttggtcaatagtaggcttactggatgtgatcttggaaagagcaatggcagccgatgggaaggctgggtggtggtatgtaacaaaaaggaagagaacttatacctgagctacttagcatacctctacagataaaaaagaaatacatcacagagcaacgtggttgtgtaaattatcttgtgattgtgggattgctcatatattcctttttagttgaggacttgaggtccaaattaccaggctcttgaattctgggattgctcatgttcctttgccatataggtgttttatggaattctgctcaattaatcagttctctatctgaactgcgtgcaatcaagtaaatagcaatgaagaattgttttcacccccattgtgttcttttttcttcaaactttcctatcaaaaggtgaatatattgcagatcaataaaaccactggtcatttcactgcattagggctaagcgctggtcgtcataggtgatatatgaaggaggggtcatttttgtacaatcatggcatgaagttcagaactctttcagttactgtactgcagctgcaatctaacttggtaagctaattataacatatataatactacctgaaaccgtgacatcaaaaagcaactacttcctccgtttcatattgtaagactttctagcat

SEQ ID NO: 63308 - DNA, 8087 bp, Oryza sativa
ctagaattttaaagagtatataccttggaggtgtatgatagtataaataacaccatagatcagaaagaaatatgctgtgaagaattttattttattttcatttttttaaaaggggaagaatcttattttctactcaggagtttgatcgtgattatttttatagtacaatactataatagtcctgcttaaatcaatttacactataaggttggaagaagaaaaggcatgaatacttaaatcctagatttaacatattaaggcgggtgcttggttggtggaatgatgttgaaactgtatgtgatgctggttcgcctgaataggttgctgctggatgacattgaccaacttcattgtttagttgggtatatggtggcatagatttctgcttggtttttaggttgggtatatatcagttgttctcaaggttctgaatatcggttttgccagaaatctcagcacccacaccctggattagcagtcttctagaacaaggttactgccaagattttggacgtaagttgttgcacgaatttcctgatatatgatattggcactaccgcactaatggacaaaattacatactttcaaggaagattgtgtctgctctttaagcctcatcagctccatttgtaaggcatcgtttgaccgtttctgatcatcaattgatgattgatattctcttgtcctgccaataagtaatcattacgatacattgcactcgtcagaaacttgtgcaggcaagtttagcataatgagaatagcttttaaaacatcaagttagcattccacttacaattgctgaaatgtttaaaagacacaacaatgcaaaaataaaatacatgaaataatccaacaataaactttagggattaacaaaagcagagggaaaaagcacaaagtgataaaccatatgcttaaaaaaaaggccatagcaaaaataggggaagatttaagcagcagccctataaaactccattttccctgccaaaaatctgtaggtcttgtactctcgttcttcttaatgaaataactaagatacagaacccatactttaacaagactagccatatacttcttcacacgcttgaaatacatttcagtcctttagattgctgcagtcatagctagtaatattttattaccaaaaactaatatatgcatgacaactaatatactgaaaaagaaaagaaaccaaaaaaatagtagtagttactggcgagaggtcatgatcttagagcaaaattgctacctattaatttctgcacattcttgctatcaagttactggcaggaaaacatagcaaaacttcgccatcctatcaattccatcatccagtatgaaaaccaaacctctctagatcattccaatggagaaatacaaataaatctagggtacctatcaaacaaattgaataggaaattatggtacctttcctcgaatttggcaaacttttgtaaaattgcttcttctcgctcctttgctttctcacactatcaatttcaacagaaaaaatatgcactttgtaacaaagagcaaaagtcacgtatgcagttatcaactctcctgctgcacaattagatttggcaggtaaactcaataaaaaaaaccttcattaacgaattgtctcgttcagcaaatgcttgagcaacgctgctttggaaaaaccttacttgcttctctagttccttgttctgcattattgtttccaaaaagaatgtcacctcaaagataagcatgaatacatatgaaaagaacttagaaaattggtgtatttccttaagtaacgaacaccaagaccttaaatatgtaaaaattgaccgcaggctcatgtttaattgtcgcgctgcaggttttgaagtagaactagcattggatttgaaggtatgctatatgaagaaaagagtaatcctttatattcctcgggttatgcaaggttccattcggatttctctgataattttgtcagatttaagttactatagtatgcattagttgtgccttgtgactagaagaaaattttctcagttgaagctcaagttcatgactcttcacccattaaaataaccaaactgttactcactatactgcttacttgtggataatagaggacaagcgcaaaatctcatgccactggaaatttctcattgataccaaaaagcaacacattctagagaaagcagaacagccagatgtataagtcaaagtaagatacctttgatagctcagccccatgtaattcagcaagctgactctgaaatttaaattacaaaagcataaaaagacagaacaaaagaaaagaaaaggacagtatagagagaaaggagggggggggggggtacgaaacacactttaattctataagcctcagcaagctcctcttgcaaattttggttctctcttaaacatccacctaacttcttctgaagattttcaatatcctgctccaaagcagctgtcctgaacagttagaataaacatattgctttatttatgctactgttactgtaaacagcagtggaatatgaacagaagatatggaagaacctctgagaaagcattcgagttgcaacagaaacatatccaggaccagcttgttgttgcatgcataattgctcaatatctttcctaagttcatctcgttctgtcaaaccaagtatatattatgtaaccccgtagttcagtaccacaataaaacaggatgaaacaaagaactatttaataaagaaatccacatgagcaactttctgaaaacagattttaatgttccattcactcaacaaagctgcagtatgatatatgatagaataaccagtcatttgtcatcggaaattccacaaatctcaaactttaaatataaaaatacttgtgataatcaaatttaaggtattgtgtgcataattcacgcaagaaatacagccacctgaaaatatacacaaataaacaatgcagccatttacaaatggcactaaaaatagcacataactatcatccaccgaagaatgaggacaaaacagaaccaccatcaactcctaactataaggaataaagataagcttcttgagggtcaagttatccactccctaaactctagattttgccttccacatggccggctattttagatctatccttcacctactactgtttctacttcaagtcctcaccatccaacttcatttcaacagatgtttatccacacattatgatgtaagggtgtctggttgtaaaaattgttagcttgattcctagcatgcagaatcttttctcacgcgtgcatgctgggaatgtcacattccctgtgatcaaattcccacagttaggacatcagggaatgttaagataaccattgatctcattttcctataatcaaacacacccaaaggatcatcaggcaagggcaaaagtgtgagcagactgctatgcgtatgcgtggttgaaaccaaccaaaacactggggtgactatgcattggtggattctggaagatggggtgttacaaagggtaaaatcatctgtagtgcacatgtatatatttcggcaaatgtgttaaatgcaaacaatgtagggtaatatgcttcagttggttactatcctcagacagagacatgatctaaggcagcagctcaagtagtcttttgcactttgtttactaccatttttgttgcctgccgtatgtgtcaggtacctggcaagtggcaagtcaaaacagatggtgtaactagatgcagctacagtcgtgttcagtttaactcacagggtgtgctgagaaggccaggaacagtgttggcctttatgtgcagaggagagtcgcttcactgctgcaccatggagcaaggggctcatatgggattggtgaatgggtgacacacaggaggggagagaatccatgcagttgttactttcatggttttgaaaaatgccactactatttaactatttggaaccatatcattacaatttaacgggtatttgatatgtgccactgaacaccccttcgctgcactaaaaatttctagtggaccaaaatgcccatgtcttcttccttctttcccttctctttccactcctgacatctctctctagatctggttcctggtgcttctccggttaagaagcccagcaacacgacaaggtacgcagaggcggagccgtggaggctcacacaggcccaggtgcaagcggagctggtgcccacgctgtcaagctgggccacagggagcagcaacgctggagtaggtgacaacattgtgcaccaacatctggccaggcaggactggagggatccttgctttcgtgagcattttcacaaacagttggcgtgcagcagaactgtgaacagattgattgaaagaatagagaaggtgccaagatggcgtagtgggagatgggttcctcgtcagtggtgagaggaggcttcctcatttggtgcgcggctaccacagccaccgatggtttggtacatgatggtgtggtgggagatggtttccatcggcggcggtccgcagctgcatggccacaggcccgcaaggaggcacgaggggagcgtcgagcgagtcttcggcttccgtcggtcatctttggcacggggctgcctccggcctcgctaccaatacctgggaaaccatctccgtcggtcgagcccacggtgagcgttctcctcacctctccaccttgactactgcttggggctaacgtctcctgtgccaactgccaagtcgctgccccagggaagagatagggacgaagaaaggctcctgcgtcgtccgaatctagctccatcgatgggaaaagatgaacaggggagaaggggtgcaggaggaacacatgggtaatttggtccaaaaaattttctgagtacaatgaaagggtatgtagtagcacatctcaaatacatgttaaattgtaatggcatggttctaaatagttaaatagtagtggcatttttcagaaccataaaagtaataatggcatagatccaattaacgcttttctctaagggtgcctgtagaatagtcttactcgctaaaacctaatataaattatattaatgtgaacttttttcattggaacaaaattactcatcagcttcatatgaccaatctaggtatggcacatattcttgccaaagtttaaatagtataacttcgtaattccaggataatatttattttttattctacagattaaaatctgtattcttcaaacgtttaactactgaaacctaacagaaaataagttaaaacagaatgcatataaaaaagcaaccccagcagactactatctgccagatgtccttagtttaattttttttagtggttaatagttacaccgtgctacaagttaggctctatgaatgaactacttgagcagagaaagaactttagagagtttatctgatgagaagctgagaactacatggaaaaattaattgattaatgaatgagaatcttgtatgttgtgagtacctcgctggagttcttcaactcgacgagataatacttcaactaggtctgttttctcatccaaatctgcagagggaaaaaaagagggggagggggggaataagaccaatgttcctgaaatcctgaatcaacaaatgcaatcgatatccaattgttcatagatattaataccatgtgtgttaagacctgagtgagaaaaagatcaaataagaaagcccatacttggaccattacccacttttgcaatcaggttcaacaagagaactggtcaatctggcataacaatgctcagatgcatagcattggccaacagtaccataggagaggtttttatgagtaaatacaaattgacttgtcaggacaagactccacgaagtgctagaagcgaggtagctagaaattgtaggttccgagtcatgcatgactcaaaaatcaacattggtaatacgatatttagaacaacaatcagataatcaggatggagagagaacggtcactagctgaccaggaacactagaataccatgggaaggcgatacaaaactggtacccagaagttttaactggttataaaatataaacatagcagtaaggaaatctttaaatcgttcaccactgtatcaggtaatcaagatttcaagttataccaataatcattacaatagaagcacatcggcaagtgctgaatcacctagaaatctagcagtaaaggaagcttcattttggtataacagagaattcaagtatatgaatgtcaaataggaaatcaccatattggagcccttcaacccgacggataaatacttccaaagcatgctgcttttcatctctttctgtttaagaaatataaagaagctaattatatgcaagcaattgcattagaacataacaaaacattaacagtggggcaagtcataaaacaaaatacaagcactgcgcatcaaataagtagaaaatacaattaatttgcatatttatgtttaattttcacactaactctttacatattttttgcattcactggtgtaacaggaacctggagttagatgttgggaaggaagggaaacattggaaaggaaagggtagaatatgaagtgacagaaaactgcaaaaaggtaacgatgagaaacagaatgcaagacaactattcatttacacaaatggtttgtagaaatgtagagataagaagcaattacattttctacaaatgatcccctatgtcccccgaccagctacgttttctaccctgggatttcatcactgcatgtacacatcaggcatgtttggctggtgatctcattagcatgggcacgtcccgctatgaggaatgcctcaagaattcaagatcgactcagttcaaacttcacagtagtttttttttctgaaaaagcatgcacattgaattgcctggtctgttatgaggacaagataacactttgagatgtttgcaaggctaaggaaaacaaacaggaccatcaacaaaagatgtcattcacaaatactaatacaagtgcctcttgaaaaaggaagcctcagtgttgaagcacaaatattacctagaattttcttcaaatttatgaactactatatgcaagaggcatgtccagatgatatatttaattatccctgccatgggtcatgttaggctccatagttttcattgctcactgcatagttcagtagttcacatatctaccaccaatactccatacactattaagtaatatggcacatgctctccatagttttaattgctcactgcatagttcggtagttcacatatataccaccagtactccatccactactaagtagcatatcctccttaatgaaataaaatgcagcactcctgcatttttgagaaaaaaaaaacttcctacattcagcaccaacatttgcagcagaactcctcaactataataagaagcaaggttgcaaacagcacatgcaacagaactctcgaggggtaatattgaggaaaataaacttaaccctcctctccaaattaacaatcatctaccattttccgttctgaattccaattctctccctgactgactattaatcaattacagaacggctaccaaattcctgataaagtaccagcacatcacataatagtctcaacaaaatattcccctttgaaaaaacaaaattggatccaccgcataaagtgttccgccatccataacaaccatcaagaaaaaagcatgaagatactgacactaccatataagctgaggaaagcagcttgtatagtgaatgtggcaactaatattatcaggtaaggatattaccacgttgtagatcttcaacccgacagagtagtgaggacttatccacgccacttgcctcttcagccatttgttactcctcctgaagatggtggttaattaactaagaatgatttgagaagttgcttttcggaaacttgattgttttagctcgctgtaaggttgttctgagttacgaactggccaaaataaccctaagacaaatcatagcttgtgcagagaagaagaactgcagattaaatgccacggttgcacggttctacatacaatacaaggtgtcttcacaagtcacaactcattgtaagatgaatctgtatatcgtctgttattgaa

SEQ ID NO: 63309 - DNA, 937 bp, Oryza sativa
agaagcggcagtaaggtttttgggaagcgcttcacgcgactgctccctgtttgtccgcgacggctcgccttcctcttcgttcgcgtgctgcgcgccttcgtcgacgctcgcaaccgcgagtagttcctgccgagcaaccggtctttccgccaccttggtacgtgttcgacatgttgcgcatatttgatctgtttatgttttactgcttagtttacatgtgtagatctaatgatgcgttaatgctagtatacatctgtaatgtcatgatttatttatggaatatattaaatcattatatgcctatattctcaacaatccaaaaaccttattataggcgctatgattttactatggctggttttgccgatgcactgaggccggataaatttaccggtgtgcactttaagagatggcagatcagggtcactctgtggctgacagctatgaaatgcttctgggtgagtactggcaagcctatgggcgttcttaatgctgaccaggagaaagaattcgatgaggccactactctctttgtgggatgcattcttagcgtgcttggcgatcgtctggtcgaggtgtatatgcatatgaccgacgctaaagagttgtgggatgcactgaatactaaattcggtgctactgatgctagcaatgtgtcacgtcctgataaattcatcccgaaattaaaaatcattttctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgattttataaaaagaaaaatcctaaaaagtccttttttccccctccccct

SEQ ID NO: 63310 - DNA, 35564 bp, Oryza sativa
agagtagcattgtgagagaggagagctagagaaaagatcttggtgagcttccagcagcaattgaagaaatagaggtaaattagtaatgtaaatattataaagtagaagtttagtgatggcttatgtattagatataattattagtgtattggataagtaataatttagataatgtttatatattacatataaattgttcggttatatggcattttagaaattgtaggtaccacttacgttagaagttgataaatatatagtatgaatgtagtttaaatatagaatgggtttagtattatatttgttgtatataagacgtgcataaatttttattagtgtgtgaggccgtgggagaaatgtatatattttgaaatttctttagttgtgtgtacgatatctgaacaagatagacaaatgggtaaaaaatatattaatttactatgtacgtagaatggttgtagtattatgttttcgggtacataataaggggaaagttttaactagtatttagagccgtgctgcacgaataattgaatgtggtaagaagttttttagttgagtgtaccatttgagagtgaataagacaaatggaagaacaaaatttagaggtaacttgcatgacggttgggattgatataaatagtatggattttgcaagatttattattgacatatattcattattttgaaggttataagtgtgaacgtggtgcatttaatttagaaattataagttcggagaaggacaagaaataaataggagacatacaggtaagcatatatacattttatatgtgtttaggtattcattaaatgtgcaaatcatgtaaactaatgaaatgaagaagggaataaaattttcttaagaaatcatggtgcgagttaattttctggaaatctcgatgaactaaaatactatatggaattatcgtgaaattttcgaagctatattggtaattttaaaagtgtcataataatttcagcaaaataaaaaagtttaataacggccatcaaaacgcttcacatacaaaatgaaaatgacataatccatatcttcatttgtgacataatccatatttcacagatgttcattttttgtaatgcttatatgtactgattaatttggaaaatttcaggtatggcggacgattggccctacccgttactcagtagagacatcgatgcacggcaccgtgcacgacagatgtcttccagctgtccaaggggtctgtcggtcttcataacgcggacttgcccaatgtggggggtcgacgaacgttgggtaccaaggtaactaatttttatacaggcttacatgtaatattggtaatattttttttacttcaattagtgttagttttgtctgacccaacgattgtcgttttgcaaggttgtccaccgcaggccttcttccttttgttagttgcaggctcgagggcattaggattacatggtagcaagacaacaaagtgcacgccgacggagagcaaatccaggggaaggcgatgacgaggaagaagaagatgtggtgggaagagacacacggcaccagattatagacaagggacttctaactgcattggttgacatatggcggccggagactcacactttccatctcccgtgtggagagatggcaattacactgcaagatgtatccatgcttataaggatgccacttgcaggacaggcaattgtcctccctgacccactagtggattggagggatgatatcattggaagatatgcttgcattgttccagaggatgatagcgacataaaatgttttttctctgaagatgaggcgcgcggccctacgttacactggctcagccagttcgaggtaaaactaattcgaccatacaacttcgcattgatgatattatgttttgttactgaacttttcaatgtacctttgtaggttggttacatgaaagacgacacggaaaattaccatgtggaattgcatttggaggcgtaccttctatggcattttggatgggttatgttcacaagtggacacagaaacacagtggatgcaagaatgattaacttagcaaggtttattgcgcagggcaacatacaaagctttccccagtggagttggggatcaacagttttggctgcaacttaccgaggtctttgtgaagcatgcacaaagacaagctttaagcagcctgtgtttactggttgtccattgttggtcatgctatggtcgtatgaacgctttccattgggatgaccgtacatgcctgaacctatggctgattcgaccttatttggtaacactacagatgataggcctacttatggcatgcattggtgctagggaccggtacgtatattttttttaacatttgcatttatttcgtacatatataatcttaatatttatttcataacatacagccacagtgggcgaatgttcaggttcgaagtgcgtacgaatacttcactgaagtgttcgatctacttaaggaggataacgttcagtggtgtccgtacaccaacgaggagacacaacgccgtgcccctactggcctcaatacactctgcctgtgtgactcgtcttactggctgacgaaaaagatgcttctgtacgatatagcagttgaggcgtacagtccgcagcatgtaatgaggcaatttggcctttaccaagaagtgccagtcccacttggtgaaacggtcccccccaagatacacttgtaagttatatttaaatgcattcccattaatttgcgtgtgtccgaattatattacttacctcaacacttaatgatgagtttttgcaggcaaaataggaaggcagatgctagcgtgcggcgaaatatttttgctaagatgacaccttgggtcgaacaatggtcgagggcaacactcgacattgttaacgaatccagaccgtacgaccgttgtcctatgcataatgccctctacaatagctgtcaaaggtagaggccttagttttcgtagaacagcgttgtaagcttctgcaagattagttgtcatgatcccatgtctggccccatcggtgtcgtgcagcaatgcccattgctcctctggctctgcttcaatccaatgtgtgaaacacttgatgtttcttgccaacctccgtcgtttactgttggaagtaataagactgtccattggttctaaggcctccagggctggttggtcatctttcttgcaatccttttttgacttaacatgtgttgctgttgcatcatccagctgcctccaaagatcttctaacttctgttgctggttttgcatacacagccgcttgaacatttgcattagccttttgctatggaactgtttgaaaaagtttgcacccatgtgacgcatgcaccatcggctatgcaaatccgaccagtagtatgctccgttttgatcctctttgagctccttgattgccttaagcaacccagcatttctgtcatgaataatgcatacattcgatatgctttgcaccacaccccatttgacatgctgcaagaaccacaatcaactgtcgtagttctcgctctcaacaaaagcgaatgcaaccggtattatctggttgttcgcatcggcaccaacaaccgtcagaatagaccaactatactttccggtaagaaaagtaccgtccacatatagaacgggtctagaccattgaaatgcgtgaatacatgctccgaatgaatagaatgccctttccattacacggaaattcggaggtcacacggaatccctgtcttggacaacaacataggtaccaggatttctgtcttgaacaacaacataggtaccaggatttctctgtttcaggatatctaggatctgcggtagtgtgtcatatgccacctcgaatgatccataccttttctccatcgccttttgcttcgccctccacgctttgtggtagctaatagtgtaccgttcactagtctctactgcctttattatatgcctcacgagcaggtcgtccgcttcaataatgttgctgtagtacttgttagcaacatacgccgcggtgaggttgcggtgggacgaccttgtgttccttagcatacagttgttgtgctcctccactctcgacacgagccagtacgactcgtactttggcacatgcccatgaaccctaaaattgcacccttccgtctcacacaccgcagtgtagacggtcaggcttgatttgagaactttgaactgcctctgcatcttaaacgaccacgacttaactgcatcctgaaatgcagacttcgtcgaaaacattgtgcccttgtttattgggccatcaccatagaaccataccgagtcatgcaactcgttctttccgatatatccaagatcttcacggttccatgatgctataacaggttggacttcgtactcttcatcatctgcctcctcatcctcctcctgagccaagttagcttcatcctcacgagcattcctatcaaccctctcaatctcgtccactataccatttatctcttccccttcatcggcttcactcgaaccatcttgttgcaccgtgctcggcatcgcaaccaccgtttgttcagcttgttcaatatgaaggctctgcatgtcaatgccaatattgtcttcattatgctgggagacttccacatgaaatgcaatcggttgagcacatgcctctccctgcatatcggactgaccgaatgaactgtttggtcgagccctccttggacaagcttgcaccaacatggccatctcgtatcctcgacgtctgcaaccttgcaaccaatccttccatgattgacttcgggttacttctttcagttgccattggatgtccgtggccgaacgactccataacagactgacattaacactatagacttgtgggtccaatgagaatgagcatgtcaaccagtaccacacttcgggcattctaagattgtccggatttgggtgatacagtgtgcactaactaaagttgctcaagtcaacacccatttcgttcgacataatttccccgttgccataatatactctaaagtttgccattcctaaacaaataaacaattgcattacgtacgactaaaaaaactaaaaaaaactttcagatatcatacacacaactaaaaaaactttcgaaatatatacatttctccccacggtctaacacactaaaaaaaaaattcatgcacgtcttatgtacaacaaatataatactaaacccattctatattcaaactaatttcaaactacatatttatcaacttctagcttaagcggtacctaaaatttctaaacataactgaactatttacatgtaatatatgaacactatctaaactattacttatctaatacactaataattatgtctagtacataagcattcgctaaacctgttcttaataatatatacattactattttagctgtatttcttctcttgctgcaagatcatcaaaatgtttcctcttctgtgcaatctcctgacttctgtacgagcagcatctctcctctcgtttgcgcagatcttctatcttctgcagacgcatctggtctctcactctccatctactcttatggtgggagctctaaacgaaaagaaacgacacgaactaacgttttactgtattgacggcgcggattctttatcttgtctagctttaaagcaacatttattgtggagagagggcactcatatggctatcttcgcatgccctgctttcgaacccatcttctccacacaaaaaatggagcggtccattagaacgtgattaattaatattaacaattttttttaaaaaaatagattaatttgttttttaagcaacttttgtatatcaatttttttttccaaaaaacgtaacgtttagcagtttaaaaagtgtgcgcgtggaatactagggagaggggttggaaacatggagcaaagaccatagtggacagagagaagcaacagttatcgtggagagagtgcactcatagtggacagagagaggacagagattactcgtactagcagagaggacaaaggtgcatcattgaggacagaaaggtcagaggtgcaggcacggtcccgcgcgcccagtgtgcggcagcgccacggtcccgctcaaccgttccgcgcgaccgcgcaccatgcagggtcccgcccaaaccacgcgaatctcagtgcttcatttgttttaagtgtgcctaaaatttaggagtgattggacataaaatttactactattcgcaaaagttgactagtgattggatttgtgtggagagcgatcacgcagattagaaggaccgtcccgcacagccactctgcgggaccgggccggtgccgctcgcccgttctgcgtgaccgagccggcgccggccggtcccacaatccaccgcgctgcagctttatggacctgcgggatcgtgccgatgccgcctgctcaatatgcgggaccgcttcgatcccgcatattcattctgcgcgaccgggacgtctagcgatcccgctcttctgatccgcggttacgcgtcgctcccgcatccccaacacgcggattaggtatattttcacaaatctccgccatgcatgtatataaacgcaacttatgaaaaaaaagtatattttcaaatttttttctacaagtggcgacaaaggatttactactaaacccacgtgtcacagatacatgagggcctagatatgatagacaatgcgtggcaaatttttaattgtcatatcttaaaagtggcaaaaatttaaatgtcccacaaaatttggacaacaaatttggttagaattcacttttttcctccaatggagactgtcaaacacctttattgtcgtccaaatttggttagaaaatttttttgttgcaagaaaaaaggatcagatttagatggataataaccatataatatatcctaaataatatattctgagactttctatgtggtgatttttgataaaaaaaactccaaatctagcaaattgtggaccattggatttcatgcaacataccttaaccctatcttttcgccttccctcctcggtccacccgccgccgctttcacgcgcctacgcctcctgcatcatcgctgccacccgacctcatcggctggctggaaggggtcaacgtcgccggcgaggccatcttggccaacctccttcccttttcctcaccgaccttctcttcctcaaggtaacaacaccgagtgcccctgccctgctgactttcctatctccggcatctccccaccaccggatcagccaccgccacccatcgcctcctgaccagagtcaccttgttgcacccgttgcaaaccccgcaactctggcgccgccaaaggcacctcgtcactcacctgtgtccaccacccaccactagatctgccaccaccggtcgccgcttcctaaccaatctcgccattttgcctgccgccaatgctagcccattgcccattgccatcctcgtgacttcggtgccgccgcaagcacctcgttgcccgcccgtgtccaccacccacttccggtcctccattgcccatggtcatccctctaaaccccggggaacccccctccctaccaggctaccaccaaccccaacccaaaaccctaattcgcttgtctcctgctggagttgggggtatcaacggcgctagagaagagggggagcttgccggagtcagaggagaagaagcccatgacgaatcttgctgcagaaaattcacgtcccaatggcgtattctgaaagtagtgcgaattaggtggcatatcctgaaaaccgtgcgtactccaccacacgcatatcaccccaccactcccctcgcgcaaaaatcacgctgctcgccgctccctcacgcgctctcctttcccccatcctctcctcccgcccagatcgatccccctccccttgccaccgccacctcctccatcccttgccaccgcaagcaccgccccactccccgccgcggcacccgtgatgctgtctcgttcctcactccaatcgctgaagtcgaagactgccgagcaacactaatgtcccagcacatacaacacaccgaaccagatgaaaggtattgcacttcaagctcaatgggtttaacaactgcagcatactacaggttgataaaatgtcatggcatcctatggcacccagcaacattcatctggattaaggcaataccaaacacttgcaaaattttcctctggctggcctttcatggcagactaaatacgaatgataacagggtcaggaaatgctcggcatctgatccgcattgagctgtttgcccagctattgaatcagcagatcacattgttccatgctgcaagttggcatctgaggtttggaagaaaatcaacctatttgatcaggccacccagagtgcagattgtggagattatggataccccatacctacacggcatgtatagtccgactgggtatggggtgccatgtatagataagatatctttaaagggacttgggttaaattccaaacttgtatgtcaaggaaatacccgggatcccaatcggttatgattgtatattatctgtaactacctattccgttagggatatggactgtactttgtaatacggactccttcccctatataaggaggggtccgggtgcctttgggggcacgattttctcctagatcatacgatcaataatacactcggcggatcaatccccggacaggagtagggtattacttcttgattaagaaggcctgaacctgtataaaattccttgtctctcaacccatccaattttccagcttgatagccaccccctttcagtattgccgaaatcttgtttcgacaattggcgcgccaggtaagggtagcgtcaagttcttcgccgactagtgcgatgggtttcgtctccggcatcgacgacttcgtcttccctcccgggcaggcgttccggttcggcagcctcgacttcatcaccaacaacttcggcaagatttctctcctcgactcggattcgaaccagtcgggaagaggtcaggtcaccgccccgttcggtatcccgaactcggccgagatctaccccaagatcatctcaaccgagttggccacaaaccactcgaacgagatccaatatactccaacacgacccgatcaagacgatggagcctatccgccaatcctgatgaaactccccgatgacttggctgccgtgttcaccacaagggcgtcctctccccgtaggcctaggcgggatccggccccggccccgatccagtctagctccagggaagtcggcgtcataatccagcctctcggcacggtttcgacggaacaattggacggctacctcagctcccctggtgtcgactcacgaccaaccgagatcgtagagtacgacgacttcggctaccgctacgactaccacaacctcgatgacttcgatgaaggctttgaagataactacacgcgcctctactttggcattttcatggccgacaacgagacggaagaacagcgtcaagcccgagaagcagaagagcagcgcgtgcgacaggaagccgaacgtcgccgactggaggaggagcgccaagcacaagagcgagaacggctgcagcgtgagcaacaggagcgcgagcgagctgcaaaggaggctgaggaccggcgacagcgtgccttggaggccgagcgacgagcacgagaactcatagggcagcaagacgtcgaggggagggcggtttttcgcacccccaagcagaacgcggttgcaacgatcaccctcgtcgacaccctcctcaaggaagacgcactcaatcaggccaatcacgtcatcaacatcttgaaccagaccaagaccatgatcgctgcttcggtcccagtcaactccgcaagcgtccgcacgccgactggcagccgagttccgcctcttcgatctcaagactatcaccaaccaagcttcagcgtcgtcggcgcgggatccagtcgcaggagcagggatcatggcgagcggttcgttcagtcgcctcctgaccggcgcagggagtgtcgagctgaacgtccccgctccccacatcatgggcgtcccatcgatcttcgtgaaactatcaaccagcgccgtgcggcaagaggctacatccccaccattcaccagatcgttaagacaacgacgtggatggagttgctgccttcacaagcgacctgcgtcgagtggattggccggccggcttcaagccgactggaatcgagaagtatgacagcaccactaaccctgagtcttggctcaccgtctacagtctcgcaattcatgcagcaggaggagacaacaaagctatggcaaactatctgcccgtagccctagcggattctgcccggtcctggcttcacgggttaccccgcggcacaatcggatcttgggcggaacttcgcgaccacttcattgccaatttcaagggtacctttgaacgccctggcactcagttcgatctttacaacgttgtccagaagtccggagaatcccttcgagatttcatctgatgtttttccgagcaacgcaacaagatttccgacatcaccgacgatgtcatcatcgccgccttcaccaagggcattcgccacgatctcttagtcggcaagtttggacgcaagcctcccaggactgtcaagcagatgttcaaaaaagccaatgagtatgcaaaggtctaaaatgccgtcaccgcatccaagcagtcgggcaccacttggaagccgaagaaagatacgccgactacaggaggcagtggaagtaccaatcacaaggatcgcaagcgtaagcccgaggaacttgtggcaaccactacaccatcctcccgacaacgttcgcgcatcaacagcttcgacaagatcatgaactcccaatgtccgcatcatccaaattccaatcacgcggccaaagattgcttcgtctacaaatagttcgcagagcgatacgccaagaacgcacgcaagacgactaacggagatcaaagcacgtcaaagaagaaggacgatgaagatgctgccccgactggttttcaagaccatcgcaaggaactcaaccatatctttggcggacccttggcttatgaatccaagcgaaagcaaaagctgaccgaacaggagatcaatgctgttcagcccgacacgcctcaatatcttcggtggtcagagacaacaatcaagtttgacatgtcaaggaagatgctaaacctattaagcaacgactccgccgtttcgcacaggataggaaggatgcaatcaaggaggaattaactaagctgttagcagcaggcttcatcaaggaagccctacatcccgactggctggctaacccagtactggtttggaagaagacggggcaatggcgcatatgtgtcgattacaccggcctcaacaagtctcgtcccaaagaccccttcggtttacctcgcattgaccaggtagtttactcgacggccggctgcgagctactcagttttttggactgctactcaagatatcatcagatccgactaaaggagtccgactgcttgaagacttcattcatcacgcccttcggggcctactgctacatcaccatgccttttggattaaagaacgcaggagcaacttatcaacgcatgatccagagatgtttttcgactcagattggccgcaacgttgaagcttatgtggatgacatagttgtcaaaaccaagcagaaggatgatttgattacggatctagaagagacctttgcaagcatccgcacttttaggatgaaattaaaccctaaaaagtgcatcttcggagtaccgtcagggaagctgcttggttttatggtgtcccatagaggcatacaagccaacccggagaaaatcaacgccatcctcaacatgaaaccaccgagctcccagaaagatgttcaaaagttaactggctgcatggcggcactcagccggttcgtttcacgactcagcgagcgggggatgccttttttcaagctgctaaagaaaactgataatttccagtggggtcccgaagcacaaaaagcctttgaagacttcaagaaacttcttactactccaccagtcttagcttcgccacatctgcaagagccgctattgttatacgtgtcggcaactttccaggttgtaagcacagtcctggttgttgagcgtgaagaagaaggccatgttcaaaaagtccaacgaccaatctacttcgttagcgaggttttggccgactccaagacaagatatcctcaggttcagaagctgttatatggtgttttaattaccgttaggaaattatcccactactttcaaggtcactcggtcacggtggtcacattgtttccacccggggatatacttcataatcacgaagcaaatgggcggatcgcaaagtgggccttagagttgatgtctttggatatatccttcaagccgcgaacttctatcaagtcccaagctttagctgacttcgtcgccgagtggaccgagttccaagaggacacgcctgctgagaagatggagtattggactatgcattttgacgggtcaaagaggctttcaggcaccggagcaggggttgttctaatttccccgactggagagaggctgagctacgtattgtggatacatttttctgcgtcccataacgtggcggaatatgaggcgcttcttcgtggattaaagattgcgatttctttgggaattcggcgtctgattgttcgtggagattctcagttggtggttaatcaagtcatgaaagagtggtcctgtcttgatgataatatgactgcttatcggcatgaggtacgcaagttagaagataaatttgacggccttgagctaacccatgttcttcgacataacaatgaggcagccgacagactggccaattttggttcaaaacgagaagcagctccttccgatgtgtttgtcgaacatctctacgaaccaactgtaccgaggaaagaaatagtcgaggctacggacactcaagaagtaagcatgatcgaagccgactagagagagcccctcatcaaatttttaaccaagcaagaactccctcaagataaagacgaagccgagcggatctctaggcgcagcaaactttgtcatacatgagactgagctgtacaagaaaagtcaatcagggattctgcaatgctgtgtctttggaggaaggatgacaattgctaagagatatacattcaggcatctgtggcaatcatgctgccgcacgaactgttgttggcaaggcctatcggcagggttttttctggcccacagctgtgtccgatgctgacaaaatcatgcgaacatgtgagggttgtcagttcttggcccgacagactcatctaccggctcaggagttgcaaaccatcccgctatcttggccgtttgcggtatgggggctcgacatgatcggcccgtttaaaaaggctatcagtggttatactcatctctttgtagctattgacaaattctccaagtggatcgaagccaaaccggtcgccacaatcacggcagacaaggctagagattttttcatcaacattgtgctttggtttggggtacccaatcggatcatcactaataacggtactcaattcactggcggagtatttaaagatttttgtgaagacttcggcatcaaaatttgttatgcctccgtagcccatcctatgagtaatggacaagttgaacgcgccaatggtatggtacttcaaggaataaaagcacgagtttttgaccgactgcatccctatgctgccaaatgggtagaacagctaccgtccgtactttggtccctgcgcaccacacctagtcgggccacgggccagtcatcatttttcctagtctatggtgcggaagcaatgttgccgagcgaggtagaattcgaatctttgcgattttgtaacttcagcgaggagcactatgggtaagaccgagtagatgatctcaaccgactagaggaagcccgtgaagcaaccctaattcagtcggctcggtatttgcaagggatgcgccattgtcacaatcgcaatgttcgatcacgagctttctttgtcggagacctggttctgaggaaaattcaaactacacaagatcggcacaagttatctcccttatgggaaggaccgttcataatttctgaagttactcggctaggctcttaccgactcaaacgtgaagacggtactcaagtcgacaactcttggaatatcgaacatcttcgtcgtttttatgcttaggcattacattttgtatcttcctctttgactgttaacatcaagttcctccttgagttatcagtcgggagctactataataacaatggagtgtgatttttatcaattcaatttgcttacttgatttatcattgccttgtttgattttttggcttagtcaatgaggactgaaagttttttaacaacttttgcgggttctaggctcaataaggtttgacaaaaacttttaagaaatcaggacctaagtttaaatcatcaggcacagcataaattcatcagtattgtacaaattgtgcctccatcatcattatcaaaatacaaattcaatcagtttcagttttttcatcatcagagttaccaaacccggtcggcctaaggtagttgtcctggaacctctcaactacatcaacggctatcttgtcagcagctttttgcgcatcattgatgaggtcaagggcagcttcttcacttgtcccgtctgcaaagccatcaacagcatcaatgtcgatcttcgggtacaaggacttggtcatcgccaacgccaaacttgctcccatacttccagcttccttgatgttcttaaaatatgtatccggagcaattctcaacttgtcgaagatttcggaagcgtcaaatgaactcggaccattgttattaaaaaacatggcttggacaagtggtgtagcagcattggtgacttcatctctagcttcctcaagcctcttgattttgttaaccaagacgtcgaattgtgcctaggatttgattttgcaatcttcataggagtgggcacgaagataagagtggttttttgaagttcccgctacaagtaccttcgacatctttcaaagccgagtccctctgcttcgtcagttcgcccttatgtttttctagagctttgattcgcttttccagctcggatatcttggtagcttgcactgtattgcctctcattggttagttgcatatggatagcagcacgaaacaagtcagacagggatgagagttaccttttgatgaaccgctcagctcaaagttggagtcttgaaactcggcgattcgatctctgaggtcatgctcggtcttcctggcaagttctttggcttcacgcagttggtctctggttgcttcaagggttccaaggtggggaactaatttttcgagggttgcggtcttcgcttcattcctaagatggattctctgcaccacaaatttgtctttgtttaagcaaagtggtcgacaggatgattgaagctgtgtgtagggagacttacatttacaagacgagtggcttgactaagtgtctttttcagcagacacacttcctcgtctttcttctgtttatttatcatgattccctgtggttgcatttcatcatcccaccacttgacttatatgggtgggcgagaatcttcagccgattgtatccggaggacctcttcttcgtcgccgatcattgggccttatacattcatgaataatggtgaaacaattgaagaaagtctgtcggatcaaaactgatttggaggttttgattacctgttatgatttccggtcgaggacgagcaggtccttgcaccctaacaggagagttagttccagagtcagcgccagcgtccgtcttgggagggctattggtttgagcctccacttctgggatatctttattttgctctgtacccgactggtttccagtcgggggctcctgatcagcactgactccagtgtcggccgactggtttccagtcgggggcttattgctggtcgctacattgtcggttgctggttggtcatcactcgggcgatcttcggcagtcggcccggtttcttttgaaggaccagtctccgtgccagtcggctcagggtctttatcagaaagatctatgtcagatggcttcctacaaatttaagatatgctattagtgctacttcgatagtaagtgaccagtgaaacatggaaaatgaccaaatgatttgtacctggaggacttcctgatttttggtatgggacgactggctgttttattcttcgggttggcttgttttggctgtttcccagtcatccctttgctgccagtcttttcagcattatcatcttcgtcgtggctcagaaccaatttcctcttacgagagtcaggctggttagtcggctgtgaggtgtgaggttgagcgtcggaccggatttttggccctccactagcctggccagtctgccgacggggtgagcggcgttgggcaatcggaggatctgatgtcatcaaggcaaactcctgtgcatgatgttccaagttttcaatcaaccttgcagatgataaaagcatgcttttgagagaggctgagatgtttaatacatgctagtggaggagggttgaaagcattgtacggcaccactggcagcaagtgcgaatagctgactacgattgcatttgagaagattttatacattctctccttcataattttgaattcaagagattatggatcttcacggttagggtcatgcttgccatcaaattcaaaggccgtacgagatctttccttgattggggccagccggctcttgataaaatgccgggtgatctgttccccttgcagaccctgttcctttagcttcaacatacggtcaaccagggcgagtgcttgagcagcctcatctcccattggaagcgagttccaagtatcttgatacactggaggaaggcaggagtactcgggaagagctgattcaggattttgcacataaaaccaattcgcatgccaacccttgtttgaggttttgaagggcatggaaaagtacttttggctcaaggttccccttagttggaaaccggctcccccaacaacacatggtttgctcttgtttggctggggcttgaggaagaagatgcgacagaacagggcaaaatgcggtcttacacccaggaaagcctcgcaagcgtggataaaattggtgatgtggactatggaattggggtttaggtgatgcaaactgatcccatagaaatccaaaatcccccggaagaaacttgaggttggaagagaaaatccgccataaaagaaatgggaaaacaccaccacctcgtgtgtgtcgggggtcggaaatgtttcaccgcacgctagacgccacccgatgatctcctttgccagaagaacgccgtgcgccaccatctccttcaggttttcctccgttacatcggagggcgcccactgaccctcaaagctttctctctcttccgccatggatgcgaactggatgatgtgatttggttcgaagtgtggctgggaatggatgggagattgatgtggtggttgcgtgggagattttcgtggggctttggaggctggatttgtgtgaatctgtgaaccctagcttcgccggtgtggttttgcactatagcagagaatggggaaagtggcgagagtttcggcggggaagacgaaccgacgctttgcttctagtgttattttattagggtatcgggagtactaatgggcctgggcctaaacagtacttcagcccaattttgctatcagcgtggctaagttgtgattcttagggacttaggcattttgcttcggtgacacttgctcacaacagtatagtccaatgctgttaaaatcctttttgacgcagttagataattctttggaattactacgacgcaaataaaatggtgcccaatagaaaagtgttatactaattttgtaggcctttttaggctagctgttcgggttttgttgagatgactggtttttgaatagtcattctctcggcatgttatatgcttattttgatatggtgtgagtcatagcttaggcaatttagactcacttattgtcatgatttataccacatttgatggatcttttttgagagtttttactcggattcttatcatatgtgttggtttatagaccttcagtgtgtttctccctcggagttttttatatcttcttttctggtatctcaaagctaaagcagtcggctggatgttttattaaacgtagcatatgcttagctgtgtgataccatggatgatccggttgtaaaaccactcggttggatttttgcgccttgactatatgtttagtttttaactaatcacatagtcgggggctacacctaattaggtgcatctaatcgatgcacctgattttttttctattttgagcccttcacagtctttgatcttactactcaggaggccaaggcagaagaagttggagcactcggattatcgttttgggttacgagagaaaactattttgtcgactgtaaaggtctcaggggctactatggagattatgaataccccatacctacatggtatgtatagtccgactaggtatggggtgccatgtatagataagatatctttaaagggacttgggttaaattccaaacttatatgtaaaggaaatacccgggatcctagtcggttatgattgtatattatctgtaactacctattccgttagggatatggactataatttgtaatacggactccttcccctatataaggaggggtccgggtgcctttgggggcacgattttctcccagatcatatgatcaataatacactcagcgaatcaatctccggacaggagtagggtattacttcttgattaagaaggcctgaacctgtataaaattccttgtctctcaacccattcacttttccagcttgatagccacccccttttagtattgccgaaatcttgtttcgacacagatatactccagttcgttgaggagggactgttggttacaccggtgcatctaaaacctggatggtctatttgcttcgctgcttgttcacacagtttatggaaagcacgcaattaaatcagagaatgtctgcacttgtggtagaaccgcgtcaagcgacaatgccggactctaatgcgcagttgggcttgcgcagttgggctgccttgctagcatagcagctatatctccctactctttttatgttcttcatgttgttttctgttttcttttttcttttttctctttctctctcccttctttcttcttccttcctctgtctactgttgtttcttttcagtttctttccgatctttgtacttctgctataacaccttggctaccattaataaaatggttataaggtagagcctctctacctttttcagtcaaaaaaaaaaaaagacccccgagccagcgacgatctcctccgcggccgtcactgactggctctgcccgccagctgaaacgaacgtcatgtgtgtggtgtggctaaatgtgtttgattcaatcaggtgcgacagctcgtgaagacgacgacggcggcagtggttcttcgacggtctgggctggcgttgtggcggctgacacaggcggcgccggcagcgggggcgagaaagcggctcaaagactatctttggttttagtgcccacaacaaaagcagccgcagcagcagctattgcccggactattttgctgttattttgtgagagggtgtgagattagatgagatggcgtgcagatgcaatacagggcttgtgggaaattggaaaaacttggcaggattgatgggttaggtctttgtatggttctgaacatagtgctgtctacaatcagatttgggaatcaaactgcatgtaggcagatagtcttcctgagtggtacaatgaattaagggaataaaacactcactagagttctgtttccagttaatcagaagcaataaattgagggaaatagagactcacaagagttacatttccagtcaatcaaaaggttagtttttttttggttcacactgacaatttccaactcaaattatgttgatgcatgtaaacaatctgtgagtttagagcacttgaaactaggcaataaaacatttgggaataaattactttgctcaaaccgggacccaacatcaccagcagtaaatttctgaagtaacattcatatgtgagatgttaagttcatcatttttttttgttcagtacgagttttcattgcagatggttaattgtttcaaatttttgggggtattttacaggtgtttgacggttatggtcgtacagacgaagcatcttttgttcggaagaacttagcaaggtccatagttgatgcttggttgacttccccagcagcatccccaatgcagttaggagtgcatttctacatgttttacctgccatgtctaattatgtatatctatgtattcctatattcaagtatatatttctgtgctgaaatggaaatagaaaaatggcattgttgtttttaatatacattgggctgtctgaaattcagaacactgaaatatacattgttattgtcccttgactttgcttcttatatgagtgattaagtgaatttattactaaatagttaatagtttttgaattgtacaatggaaactgggagttttctatgttttataaaaatttgaattgtataatggtaagcatttaaagtaacctgaatttgttaatatggagcatgctggcagcttgctttcaaaattcctttgagaaattcagaatatataaatgtaacaggtttgctatggcacttccaaatttgctatcggactttcaaggaaagcagcgaacctctcctgtttgctatgggacttcctgattagggctaaatttttgtacaaaatctgtgagtaatggaattgttctgatttgaaacagagacctttggtttagagcatgatcactaagttagtaccggtattgtcggagggtgaactcctccatcggggaaccatgaggccctcttttttggttcggccgggggcagcgggtgagatttgagggcttggtgagcaaagttgtgtgacattaaggggtcagccccctcaaagacgatgagacaaaaggagtttatataggttcgggccaataagaagcgtaataccctactcctgtgcttagctgatcttatgagaaattacaagatctccttgttggagtagatcgagttgatcctcaggggcagaagctcccctcccttttactaggcttggttctccttttatacctcaaggggttaccacatgggcaaaaaaatctagctccggtggagaagtattttgcattaaatgcctgtcatgtctcttgatttgggaagcaagcgcacgtcatcttgatgatggggcctgtcaaatcctgctgcctgacacggggggcgcccatgtcagctgctattaatgggtgaaaacttctgggctcctgtttgcaccagcaaatgggaaccccaattgaccagggcggatggaccgactctggccaggatgagaggctcatcatgaccgatgggacaggacgggatgtacgccccctgacacatgcgatagtgcacctaacaccctgatgtacgccccctgacacatgcgatagtgcacctaacaccccgggtcccgtcggtcattcgaccggtcacaggccaatttaggcgcgctgcatgccacattaaatacggcgtggcgcgcctgctcaggtcaccattaatacgggtaggtgagcgctcgaaggtggccacctaacccaccgcacgtggcgacccgcggaggcggtctggggagcccgacccctagtcacatgagggagtggctgccgccttgcctccggcccggcccccctcgggggagggctacgtgatattggggggcagcctcctccgtctagtcgctgggaaggagtggccgccgccccacctcgggcctgactcccctcgggggagggccacgtggcattggagggcagcctcctccgtctagtcgctgggacggagtgaccaccgccccacctcaggcctgactcccctcgggggagggccacgtggcattggggggcagcctcctccgtctggtcgctgggacggagtggccgccgtcccacctcgggcctgactcccctcggaggagggccacgtggcattggggggcagcctcctccgtctggtcgctgggaaggagtggccgccgccccacctcgggcctgactcccctcgggggagggccacgtgacattggggggcagcctcctccctctagtcttgagaccccaggcccatatcaccgatagatattgttttaaattcaagcacactcctctggttggaaactttgatcagtcaggtttgaattatgtctcctctttatgcaaataatttcttttttttaggtaatgatcatttgatttagagtttaatttggcacaattggagtattaactctaagtcagggctaaattttgtacaaaatctgtaagtagtataattgttttttgacctgagacagagtcctaacatgatatcagagatagttgcaaaattttgtaatgtctgtgagtaccagaatcattctaatttggaacaaaactcatctgattaacaactttactcagtcagtgtgaattgtgcctcctcttaagtgcagatagtttctttcatttcaggtaatgatcatttcatcagtccgccgtgctctcttaggcctacatcatgggcaatcaagtgtggacctcgggtcatattggcaacatctacatccagtcagataataccacgacaagcatgcagtccttcaaatttccagtgtaagcatccatactcatccaaacataagattttgggaagacacgtggttgggatcgcgtgctttcaaagatcaataccctacattatataatctggctcgaaagaagcagtccactgtggcaaaggtcatgagcacaacgccgctaaatatctcttttagaagagctattgttggccaaaagctaatcaagtggaacgatttgatcctcaggctaactaatatagctctgttaaatgaaaaggacttctttgtatggtcgctccataagaatggtcaattttccgtcaaatctatgtatgccacgatcatgaactgtaatgttcggataaaaagagaattctgtgggacttgaaaattccactaaagatcaaggtctttatttggtttcttcacaagaaagtaattctaatgaaagataacctggctaaatgaaaatggggggggagacaaacattgttctttctgctatacacaagagacaatccaacatcttttctttgagtgtcctgtcgctcagtttgtttggagatgtgtgttttttgcttttaatatctcccaccctgtaacgccaaaaacattttcggtaaatggcttagaggggtatctaggtccatcaataagatgattctaattggagctagtgttgtatgttggtcaatttggtgttgtcgcaatgataaagtttttaatggtaaacaattatctaaccctatgcaggttatctttatgtcttcctactggctccacttttggtctacaatgctaccacaggaggagcaggatactatgcgtaatggtgctacactcttgaaatcggtagccaagcgtctcttattccactatgggtggcgtagttccataagaattgctagctaaaaaattttatgtggtttaacgctagtcaataataaaggggagttggggatttgtcccatcaccttatttctcattttgatttatttttatcttacctttttattagtattaaacttatggctgtgtgtcttatgacagaagccgagatgtaatccatttccattatctaaaaaaatactcatccacttactttatatgcatgaataacattattttcaaaactgaaagatcaaaggtatgttctgctgtggtggatgaacaaatagcctggtgaggatagtgaaagtggagtgaagacgaagcagagtatgatgcacgtcgtggctaaaacaagaccctcctattatggaaattatgagcaatgttgtctcttgaatcctttttttcctgctgaatctataactccgccgtctcatttcttcaccatataagtatgattgctgaaagagaagtgaagagatgaatttttttaatgactcgcacgagacggtgcgaagttctattgatagagcaggaaaaaattacaagattacaaccctggaggatcgtaaccaggaaaaagaaaaaaggataccaccacccacacaccgacattgccaacgaacaagcccaggagaaggctagcaccagagcggctgccgctaagcgtgaccgaccgccactacaccaacaaagggacacaaacaagatcgccccctaggggatgccaaaacgacgtctccaagaagagaagcaacggaaaaactgccgccgccgtccgtcgggactcagccaagactgggctttcacccagcaatcacccttgaggggtgagacagcacgacaacgcccataggaggatcgttgtcggtccggccaaggccggactgggttttcacccgccgctcaccggctgcgaatccacggctgacgcaccgatgctccaccaccacacaaactctgccaacatgtgggacccctgcaccggcgtcccccgccggccagccttcgtgcgccgaagaccacgccacatccaccggcaactcctcctcacacctaggtcgcctcctccactgccggccgcgcctctcgcgtcaagccggcttcctccaccggacgcgcctctcgcgccaatccggcctccctccatcggccgcgcctctcgtgccaagccggcctccatctccgccgcccgcgcctctcacgccgaaccggcctccgctgccatcggctgcgcctctctgcgccaagccggtctccgacccctccaccgaacgatgccgcgccggctagaagcagccgtctcccacgccctcggctagccgtccgaggccgtcatgcctccggtgaccgcagtcgcggtcaccaccaccacagccgctgctgtcgaacgcccagccactcacacccgactccttccccgccgccgacgtcaccaccgcctccacagtcacggccgccgtcgccgctgccaccagcgccagtcaccacctccgcagaccgctgctgcaccgtcgctctccgccaccaaggagccagcaacgccccgacgccgccgccatgccctccgccgtcgtcaccagccgatgccgccgctgctgttgtcgccagccgaccaccaaacccggccacccctcgaccgccgtcgtagccaccgcacctccgtctccagcgtctccgcgccgtcacgcccgtcgacgccggatccggccgcctcctcagcagtcgtcgtctggctccaccgccgccagttccggccgctgtggcatcggcaccgccgtcgccgtcgccctgaggacgccgacctcctccgccggcgccagacccccaccgggcaccgtcggaaacctccccgccagattcgcgtcagatctggcggcctcttccaccgccgccagcgcctccaaacctccgccgccatccccgccaaaggccgctcccgagcacactgccccgccgccggcttaactcaacgagaactctggctggccggcgtggatctgggcggtttctgcctcccgacgccggcagacctccccctgcccttgtgcggcgagacgaagcgaagcccagccgccgccgtccttgccgccacgcggctttgccggcggccactcgggcggcggcgaggcggaggaggagggagggagggcgggcgacggcggcctgggcgcctcccgtgccgcccgagaggagacgacacgagaggaaaaggtccgctatacgccccctcaagaggtgaatagataacttatagcctagcaggcgatggatcattagattgcattctatgtttctctttatctttctggtttgagcttgagaatgtatttttcggttggtcttgaactcttgaagtcacacctggatggatgggtgtttggtattctcgtttccttttacccaactcattttatttatgaatgataatgtaattttgataatttagttatccaaaaattgtgggataaaatccttatttgactcctaaagttgacctccattctctcattggcatgtggatccatgactaacatgtcagtaaattatcatggaaaaaatttcaattagagttgcttgtagttattttgcgcatcatgagcaaatagtatttatgtacataaaagaatttcttagtgcatcaacaatcagatggttttgagtgaagatataaaagttacgatgcaattttgcgcacatggttgtctttaaaatataacaattctatcgttcaatctttacgtgaattttaaatttatctaattatattttttattgtgctaacatatgacagtctttggtttaattttaccgtagcgttagcacggacaagttactagtattaaaggttcaacaatatatttgaacatacaaaattacaagaaataaacataatattcataaaaaattacaaaaattacatgcaaaaaatatttatatacttagataaaaataaattaaaaccatatataacaataaaattgcaattaaaaatatgttaactataatattacaatcataccatctaaatgctaggctttgttatatataattttaggtggctaaaattttaggaatcactaaaaaaatatcttaaattttttttaaagaactttcaaatataatagttgtagagttacactaaagttacattatagttacatttacattgtaatatctatataacttaggtataatacatatttctttacatacatacaagttaatataactagcatggtggcccgcgcagattgcgtggctagcatcattatattttctctcatataatagcatatatgttttctcattatattattcaaatatattaaaatgaaaacataattttaaattttgcaataactttacaaaactactaatgtgtaatattcatattatattttatatacgtgttagttattaattatttttaatatcaaattttagttatttgtaaattatatatattcctatatgtactctagacttgtcttttaattttttttaattccgaattttctgtaaattgtatttctatatagactctatgctcttcttctaatattatttatttttatttctgaattttcatattatattttatatacgtgttagttattaattatttttaatgtcaaattttagttatttgtaaattatatatattcctatatgtactctagactcgtcttttaatacttcttttttttaattctgaattttctgtaaattgtatttctatatagactgtttgctcttctttcaatattatttatttttatttctgaattgttattattactaattgcatttatatgtggactctaaacttatctttcaatattctttaattttaatttcgaatttcagttacttctaaattgtatttctatatttgtattcctatattgaccttaaactcttcttcccatgttattcttaatctcgaatttcgaattttagttatttgtaaattgtatttttatacatactctaaactctacttttaattttattatatttattccaaattttagttagttttgaattcctatatggactctatactctacttctaatattccttatttttttaattctgaatttctacttttttcttaattgtatttctatatggattctatactctacttctaatattccttattttaaattgggtgaatagctaatatgctccctgaagtttcacttcgggctcagtttagtccttgatgttttaaatcgtccaaacaagtcctctaaattaatcatttgggttaatatagtccttggacccaaaaaagtgccacaaattaattatttgggttaatatagtccttggacccacaaaaagtgccacgtgagcatgtcaagtcatcctcgcatgtagcggtatgaatgaaatgaacattctacccttatataccatataaaaaagaaaacaaatatttcacacatgtatggacattttagaattgtcacttacgattgctgcagcctaatcgtataaattcctttgtcggccaccctccgcaacaatgttgggcctaggttagcttgttttttttgtcttttatttcttttctatatagtatataggggtagaatagtcatttcattcatatcgctgcatgcgaggatgacttggcatactcatgtaccattttttttggtataaggactatattaacctaaataattaatttggaggacatgtctagacgatttgaaacctgactaaactgagcctgaagcgaaactttagggaccatattagctattcaccctttttaattccaaatttctattatttcctaattgtatttctatatggactctatactctacttctaatattccttatttttaattccgaatttcagttatttcctaattgtatttctatatggactctatactctacttctattattccttatttttaattccgaatttaagttatttcctaattgtatttctatatggactctagtctcctcttctaatattccttattttttaattctgaatttcagttatttcctaattgtatttctatatggactctagtctcctcttctaatattccttatttttaattccgaatttcagttatttcctaattgtatttctatatggactctagtctcctcttctaatattccttattttttaattctaaatttcagctatttcctaattgtatttctatatggactctagtctcctcttctaatattccttatttttaatttagaatttcagctatttctaaattgtatttctatatggactctgttttttctttttctccgattaatgtgagaatttctaggccatgagagcgaacgtggaggctcatttttctattcctttaataatataatagatagatagttatataataattatagtagaggtagtatattataaccgtacaataaagtttcactcagttttttagttgtctcgaagttttctcaggtgtcttaaatttagcaataccttgcaatttgataaaagattttctacggctcgaattccttttcctgttttatcgaccacgatttttaggatcttatatgttagatttccttccatagtcaagaactttttttctgtaccattaattggagggttttgtccaaattaattgtattgtatggcagatactgaacattattaatggttaaaacacctggaggtgacttaaaacaagagaatcatgtcattaacgaccgctagcttcctaacttcaggtacggttggggaacggcgacaatcggactgcgcatgacatgtttcccagacacccaactcaagcttccctccaccacctcgccgccgccgccgccgccactcaccgtcacgctgaagcccttcttctcgccgacaccggagaacaccagcttctccggcgacacacgcatcgtcagcgacctgggtatctccagcttcatcgtgtaggtcgacctggccggcccgacgttcgtcaccgtccggttcaccgtgaacggcggcggcgccgccgacgacgacgaccgcggcagcggcaccgtgatggtcgggtagttgagctgcgcctccggtatcttgttcttgtccagcttcccgcagctcaagctctcgttgcgcacgatcgtccccagcccggcgtctccgagcagcgcgcagatgtagccggcgtagtcagcgacggcgatgtcgtacactaggcctgggtcggcggccctcgccgggttgatgtggccggcgccggtgaggaacgcggtcgccctctcgtggtgttcgtccaggatcgggttgccggcgccgtcgacggcgtcggacgtcgtcaggatggctgacttgatggcggccggcaaccagtccgggtggcggctcttgacgagcgccgccacgccgctcgcgtgcggggtcgccatggacgtcccggatatgaccttgaagagcccgccgcctccgccgccgccgccgtgctggaggtgcggcggccatgcggcgaggatgttgagccccggcgccaggacgtccggcttgagcacgcccggggcgaccttgctcggtccccgggacgagaaggaggcgacggtgggcgccgggtggacgctgagcaacgtgttgtcgaacaccacggtggcgttgggtttgcagccgccggctgatgatgacgacgacctagcgtactccgtgatgttgtggccaccggcgacggtcacctgcaccatgcccgggccgtagtcctcgaggacggtcgtgtagccttcgctctcggtgttgatcagcaccacgccgccggcgccggtggccatcatggcgctcacgacggactcgtcctcgaccggatcggactggcagaccacgaggtggccggcgacgccatctccgacgattccggcgagctcgttacatttcggttgcttctccgagaagtggagtgggtagtacgaggtcgaggagttgggctgctgggcgagcgcctggccgtcgacgagctcgccgttgccgagcagcacggtggtggagaagctccggccgaccgagcctgcggcgaccgtgagcagccacggcgcgtcgttcgagaccgtcgacggctcggggccgccattgccggccgcgcacaccacggtgatgcctcgcgccactgcgctgaaggcggcgatggcgatggggtcctcatcgaaggggggactcgaccacctcccgagcgacaccgagaggacgtcgactccgtccttcatggcctcgtcgaacccggctagcacggcgtcgtcatcgcagcctgagccgttgcacaccttgtacatggcgacgtgcgcgccgggcgcgatcccggccgccgttcccgcgcccaggccgcggtccgacgcgccgccggcgacgaagttcccggcggccgtggacgcggtgtgtgtcccgtggccgacgtcgtcgtcgccgccgccgccgccgtcaacgaaggacttgacgccgacgagcttgttgttgcaccgccgcgtggcggcgacggcgcaggagcccctccacctcgccggcggcggcgggacgccgcggtcgtcgaaggaagggtgcgcggcgtggacgccggtgtcgagcagcccgacgacgacgcccttcccgtagccggcgacgtccctccagaacccggcgcctctcgtcagcccgaggaactccggcgtgtgcgtcgtcatgaggcgcagcgtccggcgccccgggaacgcgcgcacgaacccgggcttcttggacaccacgccggcgagctcggcggcggtgagcctcgcggcgaagccctcgaacacctcggtgtaggagcggatgatccgtgcctgatcggcgccgtcgtccatgcgccggcctcccggcaagaaagactcgtgccaccggcggtgcccgtcgtcgtccgtggccgcgccgtgcggcggcgggtcgacgagcacgatgtaagtccggtaggcgtcggctggcggcggcggcgtgccattcggagtacggacgacgctgcctgcttcacctgcatggatatagcagagtgcaggtgcaggagagagcaaggaggctagagccagtaacacaagaagattgatcatgagatttgtaaaggatgacattgatgggaatgcaattaagctagcaagccaagcttcatctttatatatacatatagatatcaatcatgaaggcaaaatgaagcacactacatatctcagcaggattaattgcattctcgtttctctgaatcgttgtagatggggcttgcatttattttcgtgtgatcaaataatcaattgagcataggatggtttatgtattaaaggcttggattaattttctccctccacctttccaagacaaaaaaatatttaatatgcagggagggatgcatatctatatcagtatacaatttggtataaatgtagatttgaaaatcaaaccaaaacaaagggtatgtattgttaaagatatgaaagttatatgtcagaaaatctttgccattaagacataagtctctgtattaaatgcccaacttgatgcatatactccctccatactcataaagaaagttatttaggacagcgacacggtctccaaaacacaactttgatttcttgtttttataaaaatatttattgaaaagtgatatatgtatacttttgtgaaagtatttttcaagacaaatcgattcatataatttttacattttcaaactcaacaacttgagagttatttatgatttatattcctaagatttgacttaaacattgtcctagaccacttcctttatgagtatggagggagtaccttatgacctggctatacttatgacgtcatattatataaaaaaagttcaaatctttcaacagtatttacactataaattccatatattacattgtaaattttatatatgtatagcgtagttttcttacacagtaaaatttgctgtaattttttcttatattcaggatactgttattatctgcttaaatcatataagcaaaaggacaacgacaaaactttagtttgcatcacatgatgaaaaaattgattgaaatcaaccgaaaaggtggtgccataattttaccaaaactgtttagtttattagcattttggctctttattgatttgagaatttgttttattattaatgtgagaaattttagctttcccgattaatatgtgaattcctggcctttggcctcctgaaatttccgtggaagtgcttctatgagggccttcttcagttagtatgaatatattttatgattttctcaaattgagtagtttagcatagttcctgttagaaatatggtcatatatcggcatattttaattcaaaatattatgacaataatcatggcatgaacaatgtggggtgatctaatgataaaatgtaacataaccagagcatgcttaaagtataataagcatcatgaacataccaagaacgcaattctaacagaggtatcaaagaatgagttaacagtagcagaaagatataccccgagaatgtctctccgctggattgtgaggcagaactgcctccgttgacgttgacgttcgcagcggctccggctcccggcgcgccatctccagggacggcggtagctgcgccggctccaggtgcagacatggtggagacgacgacgaacagagcagaagtcgagagcagtcgtgcggaagcactccccaaaaacttgatcacccgcctacctggtacagatctcaggcgaaggtatggttccggaggccctgctcgttccgatctctcgtgcacgcaagcgatcagaagcggggaggcagaacagaggcagcacaagcgcgcggaggaggaagaacaccagcaagagaaagcaagcgagagagttctgatcggattagcggcctccttatatagcacgagtgattccgccagttgccgcacacgccattatggaggcaatcgtgggatcgtgggatcgtgcacgcgccgttacggaggcaatcgtgggatcgtgggatcgtggttgcaaaaagggtagaggcaggcgcaacgcacgcccgccacgccattcccacgccctcgccccggcccggccggctcggcgcgcgcgcgtgtggctttccgattcccacctcaaccggtcaacagggagcctccaataactccctatttaagttgagatactcctcgtttaattcctgaggtggtattattatccttaacatttattatgggcctttgagatttaatagaataaatcgggcctagtccaattattctaacaatccccaccaaatttcaaggctcataagaaatattctcaaggttgtgcctgtttgatataccagtgttttggtggagactgttaagttgaacttccacataggaaatgagctacatcagaccacaactgaacaatggactatgccttgaattgtcagtcttgtgtgatcaggtttcactcaaacccttgactggtactgggctcccgttcgcatcccctatgtttggagcatataagtcaaactccaggccttttcatgagtatctagagatcacccaaatctcatagactttgactagcagtcaaactcatataggtgtgttccttctgagatgttctgcaggtcaacatctctgcttagaaaagccactcggatcacattaaggcatgagccatcctaccatgcagaaaagaagagaagtacatcatgaaaatgagcccttttcaagggtctcttctctcagtcacacaatagtttgtttcgccatccaaattcacgggatctccgatcacaatagacaggtttccactattgtgcaaccttaggtgggtatcaagcccatttccctcgatgcactgtctatcacattacgtggtagccccttggtaaactgatctgccagatttctagctgtttggacatagtcgaatgctatcactccggagtttttatgctttctaacagatttcagtcttctcttgatatgcctagatgacttcatgttgtcctttgaactgttcactttaataatcattgtttgattatcatagttcattaggatagctggcactggtttttcaaccatcggcaaatccatcaggagttcacgaaggcactcggcctcaactgtcgcagtatctagtgctgtaagttctgcttccattgttgacctcgttaagatggtctgcttgcaagacttccaggaaacaacgccacctccaagtgtgaacacatattcacttgcggcttttatctcatcagcatcagatatccagtttgagtcactatacccttctagtaattttggatacctggtatagtgaattccatagctcatagtgccctttagatagcgcataactctttccagagcctgccaatgatcatctcccggatttgagacaaaccggctcagcttgcttacagcaaatgagatgtcaggcctcgttgcactagccaagtacatcaatgaaccaatgatttgagagtatctcagttgatcccttgctattcttcggtttttccttaatagcacgctgggatcataaggagtaggagctggcatgcagtcactatatccaaagcgactcaaaaccttgtccacatagtgggattgcacaagtgtaatcccaccctcatctcctcttagtagcttaatgttaataataacatcagccactcccaaatccttcatttcaaaactcttggacagaaagtccttgacctcctcaatcacattgaggctggtcccaaagatcaatatgtcatcgacatataagcacaagatcactccttctcccccaccatagcgatagtacacacatttgtcagcttcgttcacaacaaagccaacagatatagtgtggtgtcaaacttctcatgccattgcttaggtgcttgcttaaggccatacaaggatttcaacagttta

SEQ ID NO: 63311 - DNA, 19912 bp, Oryza sativa
tacaaaattgaacattgacaatgaaagcaaacaaagataagaaatatttacttgtgtaattcaactctagtgagatgtcctcaaccggccagtcttgtttcttcccgaactttcgcatgacacggtgcggaaggtggtactcaactgcccaaaaacaaatcaatgggcactggtacatgaagtagtcagagtctcgattgcacatcgagttcagggtcaggcttgaagcctcatttgtatgtatggtaaccactcaatctgcaaaagttgaagagatgtcgttggttagtatatcaattaaagaagtaaatgtctaactagaagtgatattggaagtatttacatgttgaggctgtaagcagtccatctcattgacatgatgcttgtatgccacatcccggtgagcatgtgcagtggtagtactctcaaaaaggtaggccactgtcttctccatgtctggctcattgtaggggcaaggagtaaagctttgcctccacttaggccttccaaccggtagtcttaaccacatccacagctgaatcaatagcacacaaccactcatgttggatgatcgtgcctgacgacaacaggcctcacagagctgtctatatgtccacgccaacactgctgagccccaactaaaatggcccagatcaccaaggttggcgaccaaaggaatccatatcaccgaagcaatgtcacctccagcatcaggaaacagaacccctcccaacaagtgcaagatgtatgcacgggcataacactcaacacgccatggctcagcgtcgtcgtcaagatgtgagaagttctgactcagccaagacaggggtattccattctgcttcttcttgcccccttgcccctgctcaatgttcagtggaatgccaaacagctgctccacttgtgcacgccatccaggattctctgtcctgcccgtcacggcatgcccccgtaatggacggtcatcatcagagtcttcagcaaattcaacatcatattgctcaacacttgcctcctcgtcaacctcctctctattgacttctactgagacagaatcgtgaccaccactcaattcgacatcaaagtaatcatctggattcacatattggcctgctacttccgtcgggtattcagggttgcctccgtacgacaaccaatgaacactctccgacaaatgttcacttagatcaagccccttttgtactaactcccttttcatctccctcgctgcatccatatcatcagtaccgcaatgtctctttgatgatcctgcctcccctaaatcatttccaagcaaaggtctcttcttatctccttccccctccaagtcttctcgtaccaactcagtcttacttgcacccccttcacgatgagaagaatatgtcacaaaattcttctcaacgtaatgataagaaggagatttgtttagattcaaattttctacggtacgtaccaactttgatgcaaacacctctagagatctaaactgagactcttttaccaaatcaaagtaaacttcccattccaactgacctatgacatttaatatatacttatgcccttgaccaacatcgtatctcccataaaaacgaatctccacattatcctcggtccatccaagaacttctttcactcgtgaccttagttcatctagagttgggtgggtgggaaacaaaatggtcttcaatgacatatcctaaaactcaacatgtgcaccaacataaggttccaccactctaccaccgtagtaaacacgaacaagtctatccatctacaccaaaaaatcaaatgtaactttgcaacaaaaattaaatattcatttataaacgtagtccaaaccgacatattataaccaatgcataacttaatttgtcccaaagctactactccaaaaaaaatatttaatccacctacaactatcaacaagtttactagtgcattatacatcgaaatattacaaatactccgtcatacaacccaacctagttctaattaactataatcaatttctataatgcaaccaaaattttctccccttcatataattaattgttaaaagtttaacctataggctatagcatcaagtccatcaaattaaaattactttcatgcctcaaccctaatttttcatccatccatccaaccaaacaatccaaaaattaacattaccacatatatggttaaaaaaatcgtgacaccaatgcgtacattgcaaacatgtagcactacaacaagtaaatcccaagaacaaatgctaaaaatcacaaatttgggcataaaaggggttctagggttacccttcgatctacaaattcaaccaataaaaacgaaaaaaaagaggggggaatggaggagtctacctttctcttcaatttccacaaaaaatcctgcgaaaaatgagttcaaatggagtggatttgatgtggggaggtgagggggagagagagggggagagctgctgctgctcagctcgggctggtgcttgggcgaaaatgggagtggggaggagaaaggtggtgggacccacagggtttaaggggtcggcccacagagaaggggcgcgccagccatgttggcgccgtggtatgaggggtggcgccagtgtggctggcgcccatattctgaccagtcagcacctccacgacagccctagtgccacggtggcacgggcacggcgccagtgtgggtggcaccaccatgttggggtacggcgccagccactctggcgccccaaaaaggaccatttccggtttaagttttcccaggggtttatttgtaaaataagttttcaaaaaggaccaaaatgtaaaaatttcaggtgctcccgctgtaaacttttttaagatacatttcgtttagagaaaaggtcaaactttatggatcttgtcaacgattagtcaaactacaaatacttttagtgaaatagattcatatttcaaagtattttttataaatgttactaatattttctatcaaaaaccaatggttaaagtgtgatgttgaagactttttccaaataaaatgttgcatataaatatctatgcatggaggcagtactcttatgtatggcatgcatgctttttaaaaacaaaataaatcaaaccacatagaatttcatcaacaattagttaagttacaactttgtttagtgtataaaaaaatatgctgctacattcgtactataaagtattttgccaccttattgtctttgtaccctgtttattatgtgaaaaatcaatggccaaaccgtgcccaaacagagagaggtactacaatggatgagtatatgtatatcaactaaaaccaaaccagagagagaatactgcctctacatttttattcattagctagctagtggagtagcacgcctaagataggcgctgtaatcgcttcttcttcatttacattagagataatccattgtatgccactgagtttgtcataggtctacaatttgccactgactttatcacgttctataatatgccatcgatttttgcttaacttctacgatttaccaccgccatccggttagtctccgttagtactgtacactttcatccaaatgaccaaaatacccctgagacaaaaactttcaaattttggataaaaaatctgaaatgtcagacttaagtttttggacaaattttgaatgtttacaatcttatgtttataatatggcatttcagaatttttgtccacattttggaagttttatcccaggggtattttggtcatttggacaaaattgtacagtactaacggagactaactggacggcgatggtaaatcatagaagttaagtaaaagtcgatggtatattatagaacgtgacaaagtcagtggcaaatcgtagagctatgacaaactcagtggcatataatggattgtctctttacattaccttcgggcattaacttttcttttccttttgttggtgtgcacttttctactgtgaatgtgaataacattatatacataatttaccttccgcaaagtacatctcaaagaggctgcctctatgtcacttaataaaaaggaacgaaccatatggtaggatcaataattaatgcaagatgtgtggaagtggaaaggttcacttccatcctatgacacaaacttcacgccacgtaagaaacatggttagcaactactcatgcgctgccatctataaaattactatatgtaactctcatgcgacaacaacataactaaatagcgtgttcctaaaaacacccggtgtagccatttgtcctccatttaaccaatacgttcgctgcaattttcactttcttgtcacattcttcctcccactcgttttctccggtgtgtacacccatttttttcacagtattataccagaagtactgcattaacactaagctcttacctttcagcacatgcaaccatcaaccatgggtgatactatattgcaagtgcatgcacacggttgacaacccgtaactctagtctctagtacggcactagcacatgggattaggcaaaacggggagctcgtcaagcctctcctggctgaccagtgctgacgtgtcagcccgggaatggctaggaaaggaagagattatattagccagtagcagaagagcagagaatctagcggccaatcagcagcagcgtctcctccccccctgcatgcatgacgcgcacacgaacactgaaagtccgaaacatacttgtagtaaaaggcacatttccagatggatcatcggtggacgcgcgcgcgcacgcagtgactaaaaaaatgggcaggcaaaggccaaattgcaagccgacccggccgggcgcgcgctatcgcacgcagctgcctcctgcctgtcactgattgggctcagttcactcaccaataccacatcggtgtccatccatgaattccatcgatgggcaactgaataatgccgggctcgtgaccgcttgcctgcctgcccggctggctgaataattggcacagaggatagggttccatctgtctcgccattagagggagaggagacttcggcctccgctttcctggaaacttcgctttcgctctgttcctctgcatctctctttggctctttgcacctctgtttttttaagcgtctctctgtttttttttaagtatgcttgtttccatctccaaaagtcaatcactcgactcggtcaccaaccctgtaccgctgtacgtactacggcgcttccaaagttcatcccaagaaaattgtcaacaccatgtttaatttgagattcggtgggcgaatcgatagggaaacagatcctctcacattgtcatatcagtgtcacaactgtaaactgcacaaagttaggggagtctaatccaatcgatagggatagaattatggtatcatccaaacttcatcgttgtttcactagaaaagctcagtttcaacttgattaagttagttcatataagcatgggagattggatgaaaacaggataagtattttccacatacccatccactcacccgacctgaaacgtggggatgatattagagagaaaaatagatatgtggtactattatctaaacaacaaatatgaaataggatacgagttactgagtgatagattattgactctatccatactttctaactccgaaagaaaatatgggctaagatacggaaatacgatgagctgacgtaccaaacttgatttcaccccttggcagctaacatggtaaacggataagtaggtgagtttaagtgtaaaccatttttgatacctctataaatcaactggaacttctatcaagggaaccaaattgcatgtgttcgtccgaggtgaaaaatacttatcctgttctcatccaatctcccatgcgtatatgattgtatagcaacacgaatacacgatggaagaatttcataactccattaaccacattttatttgaattctatgtgatgccaacattatatttgttgtttcaattccctagggtgttgttccacgcgaccttggcctaattcatcgacgcttgaccaatgccaccgtgcccaatgggagcaacattacccgctacaatcttagtagttgttggccattatggttgtttttaacaaaatgaaatattttgaagggttaaaccatcatagtgcatttgggttgttttggagccaacatttagaccaagagtaacaatttgatttcaatcatctcctaattccatattcattttttttataaaaagaatcaagaacatgccattggcatccaaagttagcttctagaaccttaagattggagatggatcacagacgtggtacaaagagctagcccttccagtgctagagaggcaacagatagttttagtttagttttaaaagaactcatcatccacaatatgcatcattccatcagtttgactcgggtagtatcctatcccaaagtccaaccgatatttttatggatcacgctgcagattagaattagtttattggaagcatgcatgcatgcttacacacaagaagtgatcgaaaaaatcgcttgctcaactgcaatatagggtgctgggtagcaattcctgtgtgcgcgtgtatagggacaattcaatacttttctcaagaaggtcattttctcttgagttggacgaaacggtacagaggagtcgctctcccgtggcctggcttagcccgcgggggatcacgacgttcttcccttttgactctggcgatcgatgaatcgatccatccgtccatcatcgctcgcctcgattattcgacctatagctgcatctgcatgccagcctgctttcaggcgggcaacctagcttacatcccaatcagggcctcttcatcctccctgtattttctccccaatttctcttctcttctctactcttctcctatagttgttggccaaaaaaaaaactaagcaaaaaaggataaaaaatggttggttttacaattaagggccacttctttgtggcgctccctagctcagatgtctacgtagtgtttggtttttttcatcaactcctctgctcctcctctcgattgccaaccgtggtcctagctgaagaatctgtacaaggactctgatgatccgtgctaatacggaatccaccgttcggtctcccgctcccactgcggcgccaacaggtgtccccccggacggtgaccgccgcgaaaatggactcgcgcgcgctgcgtggcgccgctgcccgccgttgatgttggttttgccagctttccccagcttagctgatgctagtattcttcttcttctttttgtctccctgttcggttttcactcctgctcggtgttcttgcgggtgaagctcatggggaggccgttgagcggcagcgcgaaggggccgaactggacgccgctctcggacttggacgtggaccacctgtacttggttgcgaggtggtggaagagcacgagcatctccagcttggcgagctcgttgcccgggcacgagtgggtcccgttcccgaacggcatgaacgtgttgggcttgggcgccacctgcaacagtgacgggacggacgcggggtcaggaaaacccataccggccactgctcgcaaaccgcggaccgacttggctaggaagtcggccgcaccgggaaaggaaagggagggaagggaacaaaaacacggaagagtgggttcgtgatgctgacctcgaaccgggacgggtcgaacttttccgggcaggggaagtggtcggggttgtggtggatgttgcggaacagaggtagcactttccagcccttggggatcaggtaccctgcacagagcagacgatcgaacgaggttagattctgggacgactgatcgagttagtctatttcagttaaggaaccagtctgccccattcggtccagttcactcgcagcggaagagaagcgcgaggctgtctcgaaagggacggacaggctgccaccggacagctctgctctgctgctcaccttggtattccacgtcctccacggcctccctgaaggtgaaggagaggatggacgccaccctcatcgtctcctggatgacccggctcgtcatcttcatccgccgcgtgtccgcccatgacagcggctcgcccgacgcctctttctccttggcaatctgcagctgctcttcctgttccatccatggcacccgcggtcagcctcaccatcaaggactttgatatactatgagatatgaggaggcgaacttacggtgacggccttgaggacggcggggtggtcgccgaggaacttgaccatccaggtgaggacgctggcggtggtgtcgcgggcggcgaagatgacgccgatgacgttgtcggcgatctgggcgtcggtgagggcctcgcggccgtccacgaacgaccctagcaggtcgttcccccgctgccgctcgcgccgggcagagatgatgtgggccacaatggcgcccagcctcttccgggccttcatggccttgtggaacagggtgcccggcaggttcaccggcatcgagttgtaccccttctccagcgtcaggtagcactgcttcagctcctcgatgtagcgcatctcctcctccccgaagatggacagcaatgccacattcagcgcgtactgttgtatatgccatcaacaacaaacacatcggatcgatcagcaaagcagagtagagcagagcaaagcagagtgggaagaggagttaggcagtaagaactcacagtcttcatctcttggaaggtgttgacgaactggccgtcccaggagtggagggagcggagcgcgatggcctcgatggccgggacggaggcgcggatggactcgggggagaaggcgcgggagacgatgcggcggaggtgggcgtggtagtcgccctgctggaagaagatggcctggggacccagcatccgctccttgctcgccgggaaggtgggcttgaagaggtgcgcctgcgtcaccagcacgaaccgcgccgcctccgggctggacaccatcacgcaggggcatcccaggatgtgcgtcttgaagatgggaccgtacttgttccgcttcttgttgaagaacacgttggggttcttggacgagtacagctggaacgtctccccgacgtacggccaccccatcgaccccggcggcagcggcaggccgcacgccgccgcttccgacgagcccgcctgccggcggcggccgcggacggcgcagacaagcaagaaaggcgcgagcacgcacacgaacagaagaaaagcacccattggcgcctgctcacttcacttatctttgtcaatcgcagaggagtaggaggagaaggaagaagaagaggaagagaaagggaaatgggcggtggtgttgttggggggggtgtggagggaaaggcgagaggggtggcagctatttatagattggccgcgagctgagtttcccggtttctcctccgtttcgctctccttttctgcggccgcttgctgcccaaaaatctactactactagtagctagcaccaccactacgcgctagaatagccgagctgggtgcctccgcgcgcgagagagacagatagacgctgccgaataattgcgcaatcaatacggaaataaagggaaaaaggcgtgcgggcgagagagccggattaatcaactgatcggttaaaccggttaaccaatacagtgatagctaaatgggcctctcttctcttctggccagcgcgcgagagaatcatccctttctccagctcacctctccctttccgccctgtttccacaccatcagctactgtacgcgctctcgtacgtactacgtactgccccggcagcagctgctgctgctcctgctcctgctcctgctcctataatgctgctctcctttggccgcttcctctgatcatccccaaccagccatcatactggcctgaacactgttctgcttaattacttggtgtccggtgcggcggtgttttttttttctttttgtcggtaaacacatctaccgattgttcctgagtccatcgtaagatactcattttatgatttattgatgcgtgaataatctattttttcgaagtaaacatcacttgggaatttttgccggtatcactgaccgcggctagctaaagcaggttgcaaagtaggaatgcgtgccgaaatgcttaacctgctcatgatgggaatgacaggtgttgaacaaaccgttagtccgtcgcgaaatggtcgtgcgcatgcagctctacccctctttttttcttctgagaaaaataaaagcatatttttttctcttttctctcttttttgattcgggcaaaaaaagatcggatggtagcagttctagtagtaggttaacatcttaatcagaaattcaaaggcatgtgcattcagatctacaggttgacctttgcatgtgatgggacagctgtgagggtgtgcttcaattcatctcttattcatcaaatccaaattcagtcgttcaactcatcccgtcaaaaaatctttcaactcgaaactgaatactactagtatatgtgtattagggaaggacgctgaggaggtgtagtagtagtctactgtggaaactattagtaacaaaatatctgccatggtttctggacacgtggaccattgaaaataccctcttgttcggttgttcctaatctcttcctgactccatgcaagcaaaaggacaagtggcacggaaccatcatttgcgttcattcttaatccaacgtatcctcatcgctatgagcaaatgtaaaagaggctctatattagtatacaatataatgtaaaaggagtggcaggcatttcgtaatatagtctaacagttgtgatgctgaatctgaatctcacacaactttcgaatgagctgcgttataaacgtatactcaacctatttcttcatcggtcatcgcagatgaggccattgccttctagacgtttgcaacgcgccatgctgccggcaggggaggatattgatcgcttgttctcgttcaattatgacggcattatcagtgtaccggcccaagctaccaacaggctacatgtatgtgtgtacaaactcatgcttcacgtaagagaacaaatgaaacttggcctttgatcagtagtagtagcattctgtgaaacgaatatgcaatgcacaatattaaaatgttatagtgcgatttgacaggatattttctcgcaggcaaaggacaattacgtacatgcatggggggctaccctttgtgaattatgcattctgttccgtcctgtagtgtggtagctaccagtccatctttgtatctaaacaagtttatctatgaggaatatgagacccggtggtcaggtcccacgggggcaggagcccaatttggatcgggaagtggctgaagcacagcatgagtgtgcgattcggatagattcttgggggaccaaactgtccgtggtggtatcctagttgcacatacatgcagtgccatttcgtctcaggatatgcacggcggcggatgccgctagaaagcctgcaaggtttgcaggttgatgggcggaactacgtgcgagagagccgcacggtgctggcacggcgccgtccagggcacgcgggcagggaatttgcacgtagcaccccaccgcggcgcgcgcgcgggcgcggcggtcacgaatcacatgcgagcgcggggcggctacgttgcgatctaactttggagtcaaggcctcaagggcgccaaaatgcgtgctttgtccgggctcttgcctgcggtgtgcagggcgcggacgagagccgttgatagtcaaatagcctcatcatagccgcccagagccaatcaaccgccgcggcgcgcgcgcgaccggtcgtctcggcgccgtccttactccacgacaaccgccgtgggatcatcaatggctcctggccgcttcgtgcggtcgcgggacacctgtgcgcgtttcgatcacctcctgatgagacgatgcggcgcgcttcggtgtttgtcctggtcgacgagaggtggaaccacgcatctgatctgataggggatgcacgatagtacgtcgtcgtagtagacgtagcgcggaagcggtcccgggccgggaggcgcgcgcgtctgtggtcgcagtgagctagcccacggcacccagcaaagcgggctctagctaaaggaaatatcgggggccggagctcgcggaggcgtcgttgtggcgccggatcgacgcgcgggccacgttacggcggccgcaggacatacgtgtcttcaatgattgcgcggatgttcatatgtgcatatccgcgcgcccggtcgcagctctaccgctccttgaccgatcgatctcttccgttccgtgccgtgcggcgccgctccgcgcgcggtcgagccgccccgcgcgcccacatgcgactgcgtagtacagttagccttccccgttttggcacgtttcgatcagcacggacgatttgctcgctgctaacttgggtaacacgcagatcgatcgtccaccgacgggatatgatggagtcgaagcgtagcagtgtgcgcgtgcaataggccaggcgttttgcgtgcgatgtcgcgcgtgtccagctgggcgagcaataaaatagcccgatcaatcaaacacgagccggcaggcgtggcagcgacaatgtcactccggcggcggagggggcccggggacggcactgatcgataaggctggtgatgctggtggacgagtcggcgcccgcgacgtggccggcaggcgggcgcgcagcggccacccgacgctagctggccggtggaatactagtatttgagatcgtcgtgctggtcaggaaatactagtatttgagatcgccgtacgtgtcttccaacagcgagcgcatgcttgaatgaatacgtcggtactactcggcattcggcaaggaaacgattgaggaactatgtgtctgtttgaagagatttgttctggtccagcaaaattattttaaggtaccggtacctcacggtaccaaatcgtttccgatcgttggattagctagacaggataagcatggttagattcaacaattgaaaataatttttttggtaccatgaggtatgatacttcgagataccttttattggaccggagcaaatctactggttaaaatgagacgatgcatacttatgggtataagatctaaagatctaatatctgttgacactaaaccgatatttgtcagtaactctcacaatatttgacgtgttgagtagttgttgatatcgacaatatttttttaacgaacaacaatagtgtgttgttttatattgatatagcataccaataatactttcatgtcacccggtgtgccgaaatccttatttccactaagttagaggaaaactcattgtccgaagcatgattttctcatgcatcttgcaaactaaaaaagtttaaaagatagagaggcagcaagggccacaattatgacatttactctaatcaaaagactaaagatttcaatcccacaaagctatcacatccaaaacttaggtttagttctggagacagtttgacttgaattttagtggcacgtaaaatcaaatactccatccgtcccattttaagtgcagttatgattttccacgtttaaattagatcgtccatcttatttaattttttttaaaaaaaaattaaaaacataagtcacgaataaagtattattcatgttttatcatctcataactacaaaaatattaattataaaaaaattcaaataaaacggactatcaaagttggacacggaaactcatgattgcacttaaaatgagacggagggagtaagtgattagcaaataatgaattgaatactaattattataggtgtcaaaatagatttacttgattcttttaaataaaattatacataaacttatgcacgaaatttagtagtttggtaaacgttcatgacagggatttttttttcagcccaacctccctcgagagcccagcatagtgtaagtagcattgttctaagtaactttaaacggcgacccatttgttgcacttgtgacaagaggccggttagttcctgcagtacattgtactcttatttgtttcaatttaaaactcgcccacacgcattagaattttcatcaaaggaaattgcagtggttaaattgcccctgcaagtcggcactagactctgaattttacgtcccccgtcacctcatttacacccggtctctgctgggaccaggtcttcgtacaggtctatgtagacaatatcacaatataccatggaaaggtacatgttgatgttggaagaagcaggtcgttacgagtgtcagttagtgccgttgcattatttgtctgcataagacgatcgaaaggtctcctggatatctagaatctttgtttcgctaaactttagttgggtgtgtacaagcactacagcgacttccattcatgtctacatcggcacatcgcactatgtacgtacgctcacaatcttattttctgcatagataaattgcagaaagtatggcacatatcatccatgtaacttttgtcccgactgttcgttgtttgctggctcaatattggaaggatatccttcgctttttatcacataggcatctatcctgtttcctcgccgtacccaatctaatgtatttttttggggtttttttttttagctatacgttccggattatcagatcatcagctaaccggccgatctagatacaccgtacagtacaaacatattgacattgtgaaactgccgcagcatgcatggctgcatgcatgtgtatgcatgaggtacgtacgcaacaaataacaggttggtccagctacaaaaatagccgctccctcgcgtgacgttccgttccgtgcagaaccgtgcatgcacgcgtacgacggactccctcccctgacacgcacagcttagccacaggacctcaaattctctgtccggtatctagtctggccgcactgtggcacacatcgtacgcagcaacacgacgaggcgcgaggcaggggagatggatcgcgcattcgatcacgctagaagtggcggatcttagccagccattcagccagaggctgagaggcgtacgtactgcctagccgggtcctacgacgcgcgagcaaacagaagaaggagagaaggagagtctggttgattggggcgcatgcggatgcgacgcgcgcgagtggttgcctggtccctcgcgtagccagcgggcaggtacccagggcacccggcacgggggggtcccgcaccccgatcggctccgccacacatatctggatatatatctcgctcccatcctcgcatgtacgcgcgcatgcacgcgctaccctacacgccccaatcagggcacgcaactcgcgcgccccaccgtgcatgattcacacgaattccagacgctgatcctatcgccaatcgatcaacacccgcggattctgcgtatcaatcgatccaaccgtgcgttgcgtatctcgaattctcgatcatgcacctgaccaggtaagtgcgtgtacggtcgatcggtacgcctcgcctgccacccgcagatcgatcgaccatccatgtgctgctgcttgtataacggtcgcgatactgctcggctattcatacgagcaccgattgttgacaggtagtggccccctggaccgctagctctggactagcgagcgaacgaacgaggtcaatctacaccgtaccgtacgtcctcgcgttgtcataggcgaaccatgattttgtcgtccctaccgaccgggcaggggcaatgccgactatacatgcacatatggcgatagctaagctgcttgcttgtttcgttgcgtacttggctcggtctcagtcctatcagtctcggcctctcctctcatccaagtcatacatacgcatttgcatgaggaaggtcgcggtagttgacttggttttccacggccaagacaagctgctgtccgagtggccgactatatataacaacaaactggttatgtttcaccgctgtcattaaaaccgtttaaagagaccttatccgtcgatatattggaaacctgtatcgaacctatcaggaaaattgacgcgcgtagtttttgaggagtcaagttcaatgccgaccgtacatgcaagagggcgattcgtagtcccggttcacgtaattgactcatagaaagaaatccatgccgacttgtactagtaaaagaactgttccaccaagcgttaaaataggtatagcttgttgtgtttgtgaacataaacgtcagcataatcaaagagggtacgtctagctctcgccaaaatttctagattacttgctccgtctcagaaaccggatgtgatttagtactaaattaacttattctggatggaatctctctttagaaattttgctttgaaaagtgtgcagctctgtttgcacagtcgattttccaatttccattattcctcaatagtgcacgtgtaacttttgccatgagatgagcaaaggatatatgaccaactggctatgtaaagcacgcagcatgggcgaaccaaaacgacgcgtggttccatccatctgtcagttttctgttgcagcgaaaagctctttccatctcatctcatcaccagaggaaacgacgccacgcccacgcacaccaccggctcggtcaaggaccccgcaacggcctatcgtagcattccggtgaggtagtttctctcgtaatctcgttgggtttttccagtttcaaccaatgacgcgcgcgtgcgcttttagtttgctgttgattccctattcccccctccacatcttccgtcgtcgatgaaacgcgagcgcgacggctgactctgacttttccgcgtcgcctctgccgttatccggcgccgcgcgcgcgttccgtggccccacgcgagcacgcgccacttgcgcttgcgcgccagagggcgaccgcggtcgcctcgcgcgccagagggcgaccgcgaccgcacgcgcgcgaggcgagaggcgaaaacccggaacgcgacgggacggcgagaggccgagacagcgacgcgcgcaggcaggattagccgaactcttaaaccgggcaggttcaaggcacgcgcatgacgagagagaatcagagggagctgatgtgattagcgccagaggaaaaccacaaaagctgagacgggaagctgaaacagctctggtattgtgccgcaacttgatagccgtgatgttggttgctgctggggctgttgcacctggtcggccgtcccgataccgttaatcttacacccccgctacatgctaatatgtgtatgcgtgtgccgtgccgtcgctttcgctttccgtccccgcccgggatcctcctccctctccttttcctctgcctttctggtcgccttttcgggccttgctcccctgtcactcgggtggacgcttcgccgtgcactgatcctacagttgtactcctttgtcctaccggttgctctctccacatcgccttcccccaagctaagctaataagctaaaacagctagctaagctacgtgctcatcactgatgctactatgcttccctgcttccttgggtgcttccttacgttgtattttactccataatgatatccaaaaggcgaaaaggagcagcgatcgcagaccgtgctagtagctttgcatcactctctattatttagtggcaatctggctagattgggatacagctgctggtcagtctcaaagcccgatcaaacgcgaacagtagtatacactagggcctttggtgacagatcatcctttgttctgatctttttgccccacgagcactctctgcctggttaagcaatcgagtctttcattattttagcggaggcaaaggtgaggatatatatatgctagctgctacactaagccagttgtcagggtggacttgattgtaaggccggacccatgcattcgccatcaacttttctttcacttgtttttaattcagaaatctcgatgcgtaccatattaaaaattttcccattcagctgtcattgttatcctttttccgatcacaggccaccacagcacagtcctcagatcgcttagtttaagatatgtgcatccatgcaattgctcgagggagatactgtcatgaagcaaagatccaagctaatgtgtcagtcctttttttttaattcgttcacttaaggagtacattgctaaatcgatcgctttggtcgatcgagctgcacttgtgctttcacttaaaaagaaacgcgatttgtagccagaaacaaaatcgcagctggatgcgcgtcgctttagagaggggggggggggggacacaaattaatgacatataaaggcttctcatgatttgagatcagagtcatcacgaactacggcctcaggctccactagcgaccaccggttgatacgtggctcgatctgctttacagcgcatttttgtgtgtccgtctgacagtcgcggattggggatatcaaaacgcaccaaaaagacggctacagatcatcagaaaacggagataaccaggatcttttttttttttggcttcagcttttgccgaggacttacgtgtgcatgcaacctcacaaaatctttacacagatagccatgggagtatttctctgatataaaaatctcgttgccgatgtgttgtgtgggggtggtcactgaatttgattcttgtgagattgtggcttagatccaggaaccgggtacgtatccgtttcaatattttatgcgaaaaaagcagccaacatctctcctttttcccgtatccttttccattcagaatttcagacatcgtgagtcactcaccagaaaaactacgatgatacgatatgctacgtttttttatcacgagagttttcgtcaggattatgggccgaaatcgcaagtttcagaaacctgggctctcctctgcatcagccggccgaacacgtcgggcacaggaattttgtggggaataagtccactttgactcccttaaaagtgaccaaatctaatccatgaccctaaaccgcaaaactggatatctcgaccatgaactattgaaatcggtgcaatttgactctcttggcggttttggaggacggtttcgctgacgtggcgctgacgtggcggtgctaacctaatttgtggggttgacatgacgcttaggtggcatttgaattaaaaaaatatatgtgggacccgtttgtcattcacacccataaaaattgtggggcccactgacatatgggctccacatgccatcctctctctcttcttcctcccctctttctcccttctctctcagtacaggaacgagtagacgaggcaacacagcaccatgggacagcgatgccgatgtacaacgccctggcgagggacgccgcgttgcgccactctgcctcgatcgtgccgaccattcccgccaccatgagcaacccaaacaccacacccctgctcgtgccgtcgaaggagtcggcgacgaaggtgtatattgtcgggatttgcagtgccagcccgagtccgttcaacgccgccgtcaccgccatctgcatcgcaccatgtacgcaaaagcatgtcaaccatggaggagcatggaaaggtgaagggaactttgccatggtcatttggttggcgttcgtcgccgctgggctgctggcctactgttgctgtcactggtggagaaagggttattactcccggttcgtaacccccctatagtaccggttttcgaaccggaagtacgaatccgggactaaagatcgctatctttagtcccgggtgaaaaaaccgggggtaaaaacccatctttagactaaagatgctaatccggttgctctttccggttcctttttattattttcttttcttcattatttttaaatatattgatttcactctatcccgtccccaaaatctcaaatcaatcattctcaaattgcctccaaatccacaaatcgatcatctcaaatactcaaatacatcacaaaatcttaaaaaaaaattacatcacaacttctacaaaattcatcacatattcacatcacacacaa

SEQ ID NO: 63312 - DNA, 745 bp, Oryza sativa
cctcctcccgaacacagcctaagagatggctgggtaatagaaacaggagtgggaaatgaagaacagaggttctggtactatggaattaaaaggaaaatatagaatagaaaactcacagtgggtatctttaggtaaccactaggagcaaggtgtgcctgcaataccaccaatttcaagttacttaaagagaaatgatgtgtgtaatgcctaacagtgatactaacaattaagacatggcaaaaaaagacaagtcataaacacctgtacatagtttgaatatatctccaatttaatcagagcatcaataagaacacaaacgatgccagactgcaaaaaaaagaagaaagggttagtagcgcaacagtacttgtttaactgttagatagcaacgtcactagcctgagaattgaagttcctagtgcagctataaatgacagaagatgagtttaccagaaactacattattcagatactagagaaaacattgcatgaagtaaaccccacggaaaacttggaggcatgctcattcatatgaatgcacaaaagtaagggagcagtctcaaggcctcatgctaatttacaaattaacatacaacctcaatctgtttgaaattacagtcaattagtgatctaggttaacaaagaaacgaacaaaaacatattcatacaggactcaaagcatgctttctccctcccttgaaatctggcaaattgaaagaagttatcactattcacttgtaatgca

SEQ ID NO: 63313 - DNA, 731 bp, Oryza sativa
tggaatcttcttttcacctgacttgaaccagggtgcaccttttagctgacgcagactaggttgcggtagtttaatgatgcttccgttccagaacttctcacgattcatatcttcggcgtcaacctcacacaagttatcaacttcatgtcatgtgtcgtaacctgcttgtcattactaggataccatgcttgtcatcatgagaataccatgcttggcgtttccttccagcttaccaccatatgctttagactatgatatcccgcttactaaggataccatgattgacaacttgccattaactgtctcatattagctttcctggtctccggtgctaggtacttctgctattcgatgcaagggtcaaccactcttactataagttatgcttcccaagagaaccaatttatcccacttgacatgctttgacgtcttcccgaatgactttgctgctggacttgttattgtctgatcgtgatcctgccagatctgaagcttcgttgttagatgtgattttgatctgacctctatagattatcttcaaacatatcacttgttccataactgggaatggctctcacgaacaagcagctcggattcactttccttacatttagtttacttcccactattctctttatgttgttatcatttagcattcaacgtattcctttacaccttcagccttgatgtgttctttctcgatggatcgattgctaggaaagtgcgttgaa

SEQ ID NO: 63314 - DNA, 671 bp, Oryza sativa
aaaagaaagccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccttgaaggtagtcagtgcagctttttgacgaaccacatcaaggtttcactgaaagacagcaagccaaaggacctcatcgtccccagaagcgtccgcaatccacattaaagaataccacctgttagagataagctgaaagatgattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagt

SEQ ID NO: 63315 - DNA, 16070 bp, Oryza sativa
ttgaggagaggagttaaaggagaggaggaggtaccggcctcgatccgatcgcacacacctctccgatctccgcgtcgatctttactcccggttggttttaccaccaggactataaatatatctttagtcccggttggtaacagcaactgagagtaaagcgtatggcgatcttttttcctggttggtgttattaaccgggactacaaatagatctttagtcccggttggtaacaccaaccggtactaaagattgaaaaagtactctgtagcttttaaaccgggactaaagatatttttagtcccggtttttaatacaatcgggactattgtaaaatctggtcgaccgaccaaagatggtttctccaccagtgtgttcatgctcatgaccggcatgcttgactccgccatcccaacgatgagcagcggaaagaagtggacggaggtgatcaaccagttcctcaacgcgctcttcaccatcatgtgcctgtactagcagtccagcacgccaagatcttccaccacctcgtgctgctcctccggtggcgccccggcaccagcgacgaccgcgaggagatccacaaggtgtactgcaaagactgcgcgccgcggccgcacgaccgcgcgcacatgctcgtcgtggcagtgctgcttcacgtcacctgctcggcgcagtacttctgctgcgctctcttctggagctacgcgtgcaaggaccggctaggctgggctccatgatgccggcgtggggagagaaggagagagaagggagagagggaggaaaaaagagggaaggggagagaggatgacacgtgggccccacatgtaaagggtcccacaatttttttttaatgtgaatgacaattgggtcccacaattttttacaaattatagtgccacatcagcgccacatggaagtaaaaccaggtcaatactgccatgtatgcgccacgtcagcgaaaccgccctccaaaaccgctgagggagtcaaattgaaccggttttaacagtttagggagtcaagatatctggttttgtggttcagggtcagggtcacggattagattcgtgtcacttttaagggagtcaaattgaacttattccattttgtggtccatgaagaggccagagcaccagcctatcgaagttaagagatgggtcctgagcgtatctggagggaggaaggaaaatgtttaattgagtccctcaaagatagtcaagacttattcctacccctcaaccgcaaactaggtatagtgatttcttcaactatttaaaccatgcaaaatgactcccttaacaatatagttggtggtttcactgacgtggcatccatgtggcagcctagtcatcacgtaattttttttttaaaaaaaatacaatggggctcacatgtcatcccctctatctccttactttcctatctatgtttatccccttctcggcagtggtacgacgacttcttccataggacggcggtgggactgtagcaaaacacgatatgctctgggtactccatgcctccatggtggtgccaccgccttcgttcgccttatccaagaactcatgcaggcattcgttgtcgaccttgctttacattatatatggttttgtggttgaaggatatgaatttatcatatccgacctatatcgaaggagtcagattgaactttttccaacgaggaatgggtccgatctgagattgcacccactttattaaggactcgattgaatgagtcggtattgaggcccattcaactgtattggccaaacattttagtataatgtcccgcttatgcattaggatggcgaaaacgctaattggcggctagttgcgcgcgcccttctttttttccgtttctctttctgtttggttttctccggttttttttggtttctctttctgtttggttttttccggttttttgtttctctgtctattttggtttttccgttattttggggttctctttctgttttggttttttttgtttccccccccctttttttttccttttttctcttttcggttttttttaacatatacgtatacaaactttttgtattcatgtatacaaactagtttatatacgtacgtatataaagtttatatacgcacgtatacaaagtttgtatacgttatgtttttttgtttttttttattttttaatacgtacgtatacaaagtttgtacatattgtatacaaagtttgtatatgtgtatattttttatacatcaacaatatatacatataaaaatatattttttatagaaataatactagtactaatagtagtagtgtaatagtaatagtaatactagtaactactagttgtatagtatagatactaagaggagtggggggtggtcgcgcgcgatggggcaggcgcgaccagtcgccaggtagccacccccttaggatggggccaggatttatgcacatccaggttttgagctaacgtgcaaggttcaggttcttgtacgctttgaaataaaattcactttaggtccctcaactataggtcgagttttattcacaccactcaaccataaaaccggagtgtccctcaacttttaaaacgggtacaaattaaattcctcgacaatattgaaagcgatttctagttaatgtgacgcctacgtggcacgatgattgcttgacttattaggcccatcccgtgtcggcatgacccaacctttgcgccatgcctgggcctctgtctcgacacgatgggccgatacggcattggcccagtccaacgatcagggagttaaatagatgagagagacaaaatagatttattcagccatacaagaaatgacccaaacagatgagggatgaaaaatagatttattccaaccatataagagacggcccaaagatatgagggaagcaaaatagtcttttatccaaggaagagtgcaatggactttcgtggctttgggctagctcgacaccatccaagtcttattgggtcgtgcataggcagatggtgcagcaagtggatagacccggggcagcccgatgtgtaggtcgagtctgccggctcgactaatctcggcccgggcccggttgtgcctaggccagacggcccatttggtcattgatctatacgttggagtaagggcgtgagacatagtggagagtggggagggggaagaagtcacatgtgaagctactagtttatttttatgctgacatcgacaccacatgctgttcacgtaaacgccgcatagaaaaaaccagtctagtttgtatgaggggtgtaaattaaacagttttatgagttcgggaaggaattatgtcggttttagagtaaaatggattcttttagataaatgtggtagttgagggggatgatatgaacttatcccagctcataatgatattaatcaatatcaacataactgaatgtatctctctgtgaaaccagtcaacagttggtgcggtaagagcaagtttaatactactaactccaaatcatttatagttaatttaatagctaataaatatactacctcccccctatcatacacataaatctgtagcccgctgcttttctctctcttcttttatcttcttgatatgtgtttataactggcttatagtatgctattgtacatgctataatagagctaccgaatagtatacattttccacgaatttttgtgtgcaagaaaacaaagaacacacgaccagatgcaagcccgtatgaatgacagcacatgcagaatcctattgccttgtttcttccaccttcggcacaccaggccaacatgtttgctgttgccaacctgaaagaaaacatcgaacttgcccgcaacggcttaaaaatccccttcaccgttgcataccctttttagctttatgacctgataaagtgtactgtgtacggatagttctaatatgacgtttgcatttttctgcgttgcattgctctcccaatagtccgtattgttggaccagcggcgcgtatcattataactctgcaatttccatgatacttctagttcaaaaactggagattgccctatgaaaagatagaaacataggataatgcgactgcttatgagccaacgtgcttgtcattctcattgcaacaatgcgactgataaactcgggggccatcacatattatccccgtgtcatttttgtcttctcaccagaagaagaagaaaaaaaaaaggaatttacagtctacagagccaaaaagaattgttcatatgcattcccatcatgctgtctgttagactgttacagactagataatgtatagaggacagagccagcctttgccagcacaagtgaacatgctaaaacatgaggacctaatcaagaaacacatgctaggtatatataaatattactacagtaatacatctcctgttatctaaaaaacaaatatataaatacaataaaaccatcacgaaaatctggcataggcgagctaaaaaaaaatagaatcctgctatacatacgactaaatcgtacgactcacattcgactctgccacatccaccaatcaccatgttcgaactcggctatgtcttaagatgctgtaattaattcatgtacaacctttactttctttgcgtggatctgtttgatctggtttcatttacattttgcacggtcttggacctcttggtcagtaattttgtcagtaatgctatgtactacctttgtccagctaaaatatcttctaacccaccggtatacccgcccccacccatcaccagccgttggcctttgccagcaagcggagattgcccccacgccgcttggcctttgcgggacgaacagcgcggagcaccgtccacccgcctctcctccggttggcccgtcccgccccgcgtgttccgccccggccaggccggcgggtcactgcttcgatcgcccgctcgcctgctcggcgtccgtggccgccgcgtcgagacggattgtcgttgtggcggatgctgccgaggtggcgcatgaggatgatttggtggtggaggtgaggccgaggatgaggagcgccgtgacgacgaccagcgcggcggccccgccgaacacgccgttcctggcgacgtagcagtcgccgtccatccagccccggccgtaccgctgcccgtggttcatgctcgccgcggtcgccagcaggacgacggccagcgcgaagctcaccctgcgtacatccggcgcgcgcgccgcgggcggcgattcagcgatccacgctcgcagaaatcacgcattaattctttgtttggcagccatggccgtactatagggcgtaccatgagaggacgaggatggcgacggacgccgcgcggcgcctggtggtggacgacttgctgcgcttggacgcggcgcacatggtggtcgccgccgccgtggtgcccaccagctgcgccacggagaggaacgcgatggccgcgacgcccaattcgaaggcggagctcttgggcagggagcagaggctaccgtccagcttcatgtccttctcctgcgcacacacacagacatgatccagatccaagggcgtgagtgagaccgacccgcccgccaccattgccggcgtcggagagcgcaagagcaagcgagcctgaccttgactttgcggaattcggcggcgagggagcaggagaacgcggtggcgcagagcaggacgacgatgccgcagatggcggcccggcaggagagccccctgctccacttctccatcgaacccaacccaacccaacccaccccgagccgaagcaaccctgtaaacgcctcgcccacggctaagtacgtaaaattcgaccaaatccctcttcctacctcgctttgcttctccagagcatgtctaactactgcatataaatgagaggaaattctccgaacacgtcaagacgccaagactaattggctgctctgaataatcgaggagggttggtggcctctggatgatgatgatgatggaaacagaggaggagagagacgggatgctaaacaaaaccaaaccacatggccccgtcgactcattggtcaatacaatagtggtaattgtttagcagttttatgcacggatactagaagaagaagaagaacgaggaagaggaaaggagaacagaagaaagatggaattggcaaagatgagaggccctcctgatcgatctgatccctgtgtcgatgacttgacgggttggtaggctggtttggtcaaccggatagcgcctgtactggtttgggagaaggtggctgattggctaggaaaggaagcctgcaaggaaagaatcacgctacatcatggctaatcgcgttcgcccctgcaccagacactacctaatggtgcggccattgtttaagcccaagtcgtgtcacccatcgtcagatcagggcatcaggccacccaaacgaacaggaaacacgcatcgaccaataataaccggtgtttgtgactgcgtatgctgctgctgcactgctgcttgtgcgggcaaaaaggagaactacgaatgagaaagaccgggaggggagtgaggattgcgacgaatcgctttctttctttcgcagagttcccccccccccccccccccccttttccttgacgttttcgtctttgcgttcgctgggtggcagcggcagacggcgaggcgacggcgatgttgtggcgggggccgtgaggaatggatctcttcccggatgtttgggccgccctctggtcggtcaccttctgttgtcgcgtgcgatgcgtggactcggcttgggtggtggcctggtgggcgcgcgcgtgtggcccagcgttggggcgtggtggaagcggcattctcctcgtcggggcagacggatccatccgaatctggccgtttcgttcggtctccggtctccgccgcccatccaccaccaactggatgcgcgcatccatcatctcgctttcttctctttggttcgttgatctaggttgccttcccaatcgccagttgatccacttgagtcgtggggacgatcgtttgcgcgctgcgcaaacgatttcgcatgggtcaccggcttacgaacaggcagaaaagctaaacaaatcgtcacgcgtcgcatgtgtcaaatggacggacaatgacattggagaaacaaggcggcgttttttttttttcctaaactactcttcgagttcgagccttcgatggaggaagaatggaaaatgttcctctcgagttctagcctgcaatcgttgactgcataacgatgcagccgtcacccgtcagccttgcaagcagaagaggcagcccgacgtggactgctcgcgccaacaagcaacggtatcacatcagcaaaaccgtggtccgccgcctcgtattttaggttcggggttgaacggagaaacggttgagagccttactaacaatggggatattggattacgctatcaaaaaaacaatattaacccggggatttcagtgtgtctgctgctgtttggggttagttgaaagaggatcgccaattgtgattggtttggtcgtagtggtaatctaatcgtggtattaagacgatgggattagaccgtgacacatcgaacgtctcggttgatcccgaataaaattgacaacttttgaaaacgaaatcatcaatgatcaccccatctttgacacacgactctgctgatcccaaaggttgacatacaggtaccatataaagtactctatccgatattctttagacgacggcaatggatcattggatcacattgttttatttggttgttgaaaaatttatatccatattaattgggtgctcagagaaaaaaaaaacacccacaactatacctatagatattcccgaggaaactcctatgttaactgaaaattttagtcgttgtatctggaatcatgattgtatatcgtatttagagttttttaaacaatacatgcaattaaaaaaatcatctcttttcaacttctaccaaacatgttcaaataaaataagagtatgtaccaattacaaacttggaaacactaaaccaaaaataaaaattaatatatctccaaaagtctaaactgagtacaactcgatatttacaaattttaaatttcagaattattaatttatgaaatatagtacattgaatctccaacacaaatacaaataaatactccctccgtactcgtaaagtaagtcgtttaggacaatgtttaagtaaacattaggaatataaatcatgagtaattctcaagttgttgagtttgaaaatataaaaattatatgaataaatttgtcttgaaaaatactttcataaaagtatacatatatcacttttcaataaatatttttatagaaataagaagtcaaaattgtgttttggtgatcgtgtcactgtcctaaacgactttcttagggagtacttattaattaaaattttaaaaatattaaataaaacatacaaacaacagaaaacatatagaataaattttgatttagtgttgtatttaattctaaaaatcgaaattaataattaatgaatagtaattgacatggattattattttaacatgatctattttaatttgaaagttaacaaacatatttgacatataattaaaatttcaatatccatgttatttaacaaaaaaaaacccttgcaattattaaaattacagtgaacgggtcggcaagtagtcatcatttgttaatttgtttctctaccgcacaaaaatccaaagagaaaagtccagtttactcacccaaacaatttcattgtattacttaaactccaaaactattttgaactcattttaccctataagctactccctccataccaaattattgggcacccttatttctaaaaaaaattaaacttggtaatttttgactaataatcatgctaactatatcgataccaagtattatgcatgttatattattatattttcacgtgatgctaattttatattcattgggaacatgacatgaaataaattaatggccaaagtatatcattggagatcatgtaaaaaaataggccttataatttggaatggagagagtattaaaaatggttctttcatttctcttatttgtttctctttatacgagtcatattttaagcttatattttgcagagccacaaatgacaccattatcagagttctaaaatagtttcattttttttcaaaactatttgcttgaaatttaaattagtatgagtgtttccaacctctacaacaattaaaaaaaatcaaaaaatgttgagatataaattataatgcgtatatcaatgtcatcaaatttaattgcaaaatatgacatacatatagagaaaagaagaagacaaatatcattagggagtaaggtgagccattttcaatagttcgtggtgcaaaatgagcgaataaatagtatagaaggttaagtgctccggcgaaaggggggaaatatggactcttttttttttcaaatccaaatagccgtctgtggcatgtactgaactttctttcagtccatccatagaccgagggcctaggcccaagcgaggtactccagacgcggaataagttcacatgaggtccctcaacttaacagcgagaatttttttaggtccctcaaccacaaaaccagaaatgttcgcacctaaactcattcaaaccgttcacaggaggtcccttcgcagtataggtgggtggtttcgcttacgtggcatcctagtcagcaaaaaaaatattaaaattatgaggcccacatgtcagctgcagtttatttttcttctcttttctctcctcttctctttcctctcctctctctttgccggcggcgagcggcgatgggcgagcgcgcggctggagtaggtggaggggcggcgtcagcacgctagagcaggcggagcggcagtgtctgggcgagcgcggctgcggcggcgacaagcagcggccaagcgcgacggcgggcaagcggcggctccgagcgtgggcggtgcatggccggagcaggcggagcagcggcgtctccgggcgcgggcggagcagaggggggggggacgcggggggcgcggcgggtgagcggcggcgaggcgtcgcctctttcccccctcccgccggcctcatctccccccgctccgtccgttcccgccgctgcggcacgccaccacgctgggctcctccaaggagtgcgacggcggcgacgggaaccagcggcaagaacgacgtgctcgttcgctctgtccactttgtgtgccgctctcgccgccaacgacgacgcgaccggcggagtaggccgccacgctcctccttcggccacctccgccgttgcggccccctcctccgcctgccatgctcgtccgctcgcttgccgtccgctctgcccacagcccgtcgcgcttgccttccgctcgcccgccgccgtccaacgccgcttcgcgtgccgccgcgccgcccgtctccgttctgcccatagcccggcgacctgccgttcttcgacctcatgagcatccccggcaagctcatgcccgaccttgggcgctcggcattcgaccgccacccccttttgattcctccgccaccggcggcgacatatccgtcaccgcgggaatcccctcccggagcaggagcccgtcctggatcccgcccccacctcccgccgcggtcgcccgcagtcgctcttgccagcttcgcctgccgcggccacactcgccctccgccgccgccgccgctctcgccggccgttgccccacccgtctcggtcgtcgaagaagacgatagaagagaagaaaggggaaaatagaagggatgtggggcccgcaccgttttctctcacttacatgtgggccccacgtactttatttatttatttttctgactagggtgccacgtacgcgaaaccacctatactgccaagggagctcctgtgaatgagtttagggcgaggttaagggacctcgagggacctccggtgaacttattcccgagagatatcatgatgggcccaactgcttacatacagtcgattaggccggcctaaaacttttccgtgtgttccaccggctgttgatggaataagtccattgtgcgtccctcatctcttgtgcttgtgtaaataacatcccccaaccggaaaaccgggtataacgtctccttcatctctcaaaccagagcaaatcacctccctcagtggttttgctggcggtttcgtccgacgtggcgttgttgacccggttgacaagctgactcagcgtagtgggacccacatgtcattctcacacagaaaataataaaaaaatggtgggacccacgttttcccttcttctcgttttcttctcctctcgattcttctctctgctcttcctgtcgatgctgagacagagccggcgctgggcggcgatgggcgtggcgacggcggcagtcggcgcggcgacggcgatggcggccggcgcggcgaccgagaagggcggcaaggcagaggcggtttcggcggaggcggaggcggcgcccgtgcgggccgactggccgcgcgcggggtggcgctcgggccgatggtggggactggggaggcgatggtggcggcgaggcagaggcggttggcgcccgaaggcggccacgacgcgataacgacggcctgatgaagacggctagtcaaaggagcgcgcgaggaggcggcgccccggaggaagaagaaaccggcggcgacggcggtttcggcggaggcggaggcagcgcctgtgcgggcctaatagccgcgcgcggggcggcgctcgggccgatggtggggactgggaggcgatggtggcggcggtgaatggtaagtgaaatggggaggatgatgtgtttggggattttttgtgggggattttattgcagtggcttcgaagagaaggaaggatgggtgcacagtggtgatggcagaggcgacgcagcggcatgggcgtggctcacgagggcacgaggtggtgcaccgggtgtagtggcgttggcaaggtggacagctgcggtggcgtcgtggagtccagatccagttggcaaagagaggaggaggaggaggaggagatggtggggcagctgcttgctgcggggagtcgtcgatcagcgtcgaggttgcctcctccgtcgccgctccgaccacggcgatggcggcctccccgaacggagcctcggtagcggcgggcacggccgcagccgcgaaggggtcgagcacgtgcagcgaccgcggccgccgcagccaggtccacctcccgcgccgattcctcttccgcccacaaccgccggagccgtgcctccgccgctgcccttgtcctctcgtcgctggcgtccgtagttgcccatctccaccatccgagccagccaccgagttccccgtccctcactcgttcttcatccgtttcccgctactcctacctcgccgccgttcgtcggctcgccgtcgtgcgtcgccggccgtcgatctccccggtggtcaactgctgtcggtccaagatgacatcgctgcacactgacatgtgagtcccaccacgctgagtcagcttgtcaaccgggtcaacaacgtcacgtcggacgaaaccgccagcaaaaccaccgagagaggtgatttgctctggttttcatagatgaaggaggcattatacccggttttccggttggggatgttatttacacaagcgcaagagatgagggaggcaaaatggacttattccgcagttgatggcttcatgccaagcaccacgcccaaactgcgaccgcggatcgagcccgcgggcggacactgttccgttcgtggctgtgcggccatctccacgactccaccacctccacctgtagcatcgctttgatccatggaacaataaagaactcttgcctgcaactgtgcgtggccggtggcgatggcgactctaccctagtgtattctccgctctgccgcctccaccaggaccaccaccaccttcgctacccggcgccgtaccctgcgcagccgcggggcacctcggcggcgtaacgaggcgagggggatcggacgcgcgcgcgcgcgcgaggagaaaggccgggggggatcagcgatgagcttcgcggatctggaggccggcgcggtgcgggcgcccaggagggcgcggggccccgacgccacgcgcgcgctcgtcttccagatcaccaccgccgtggcctcctaccgccgcctcctcaactcgctcgggacgcccaaggacacccccgcccttcgtgaccagctgtctctcctcgctcccccccactcctcactcctttaattgttgtttgcctctacacgtttcatgtcctagaatgctagatgctcgcgattattattatttttttggctcagctcaagttaattgatcgaaattgtgatggttggtagctcatgccctcgaggcatgtcgtttaccatcactctggtgttctgattggttgatttctccacaggcagaagactagtcataacattcttcaattggcaaaggatgcgaaggagaagctcaggagagctgctgaggcagacaagaacgccgatactagtgttagtagtaatttactgtttatttataccctttgttttagcccagtgaatttgtcttggacaagactgtttccaactatatgtgtgatcatgtatgcatctttctgctcttagtttacttagctaccatagtgattaggaatctgggtatcatgtgcaggcagacaagagggttgctgacatgaagcttgccaaggattttgccacgacgatggaggagtatggaaaacttcaaaatcttgcgattcaaagggagatggcatataagccagttgttccccagacatctcagccaaagtaatgcttgtacacttttcattcgattcatctcaaacttttctctgtattgtttgattgtttcattttcctgccatgatatgccattggtttttaatagtataccgacgaatggccatgtgtagaagttaatttacatgcacatgttacttatcagtggcttccacatggattctaacaaatctatctatttatctatctataaaaaggaatataaaaaggagcctccacgttcgctctcacggcctagaaattctcatattaatcggagaaaaagaaaaacagagtccatatggaaatacaatttagaaatacttgaaattcggaattaaaaaataaggaatattggaagaggagactagagtccatatagaaatacaatttagaaataactgaaattcggaataaaaaaaaaagaattttagaagaagagtatagagtccatatagaaatacaattaagaaataatagaaattcggaattaaaaaaaataaggaatattgaaagatgagtttagagtccatataggaatttaaaactaactaaaattcggaataaacataataaaactaaaagtagagtttagaatccgtataaaaatacaatttagaagtaactgaaattcgaaataaaaaattaaagaatattgaaagatgagtttagagaccacatagaaatacaattagaaacaaaaaaaaaatcagaattaaaaataaataatattggaagaagagcgtagagtctatatagaaatacaatttacagataacgaaaatttggaattaaaaataagaaatattgaaagacgagtctagagtccatataggaatataatttagaaataactaaaatttgatattaaaaataattaataactaacacgtatataaaatacaatatgaatattacacattagtagtttcgtaaagttagtacaaaatttaaaattatgttgtcattttaatatattttaataataaattgagaaaacatatatgctattatatgagataaaatatagatgctagccgcaatctgcacgggccaccatgctagttactagtatagtaataaccaattcctttgccctcattgcttgataaaagagtttggttgaataatctgattgtcggcagaggctggagatgtaaaccatttctattatcttaaaaaaagttgaataatctgatactgttgtgtatgggccattttggtttggtgccaatttttgccctaccaattctttggtagttttgaatagtgcatgttagcattttggattggagccaatttttgccaaatcaatagagtggagccaaatctatgctatcaaaaatttggtagtgccaaaatttacccaaggtttggtaccagtattttgatagggtttcaaaccaaactagccctatgtgaaccattggccaagtaatacttctcacaactttttggcatagtttgttactgtgttcatcatgatccatttcatttgcttatgctgcaaccttctaggattctgcctagcttatattggcatttttttctttgaataggtcatataactttgcctatgttattgctccattagcttctcttcctttgaagtatggagatgggtcttattattttgcattgtaaaaacatacaatttaactaatttaaagacacattgccttctctttgtcagtgtcatgaccatccgttttacttgcagtttacctgatgacctcatttagtgacatggtttatcttaaaactaaaggtattcatgtgcagagttgactgggttatcttctaatatctttgagaattttggtcactatgatgtagctatactacaggtggtatagaagccagggattctggtaaaattcctgaacagcatgcgctactcgcagaatcaaagaggtcagtgttctcatagctcttctttttctgcttattttttcaactagtgatttagtacttactggtggaaggtcagctttaatcgtatagcgcatgttttttcattctatcccatcagaaaatattcaattttagtgacttcctgtggctgagttttcatctgtggtgcatggaacttacataagtcgcgtggcacgtcatttatctcatgggcagtatatcacctcatgaattatatacctggcacactttctatgtctttttgggagagtacatgcacctaaaatctgttagatcaaatgcttctgctggaatacataggccaagtggccatgcattattttgaccgagcctagattgtgtggcagttacagtaaattgcagtgttggtactttacacag

SEQ ID NO: 63316 - DNA, 692 bp, Oryza sativa
tgcagcccatattgaagcaaataccttattgtcaatgaatccatttagttaaaagaaaatatttggtattgaaacaaaacgaaattgtgcttatggtacacactctcatccatgtttccttgtaagttatttacttatatcttattttcaccccctatggccctgtcctcaaaagttgaagcacatatactttttaaccaacagtaaattctgaacaaggaatacatcattatacgcttctttccacacccaaagccctgatgaggatgtcaatgtaatgctctcactcctcaggattcttgtctggaacacaagaaaccccttctgccgtccacagcagctaagccgccgccccccaccctctcctccacccacctccctcgtgcgctccgcctgcgcctcctccctctccccccagatcgaatcgcggtggcgacgcacccgagagccaaaggaccaagaaaaaaacaatggcgcgaggaggggagggagcgaagcagagaaaaatccaacttacgggcagccggagaagcaggtccgcgggaggggacacggattcctccgctcctcctagctcttctcccacggattggagaagaatctcctactaccaagaacgctcacccgatgaactccatgcgctcgcttctttctcctttcactgccgcgaccaaccacaccacagctgtgtc

SEQ ID NO: 63317 - DNA, 846 bp, Oryza sativa
aatactaggaagttacacatgcaacaaatcgatctattgctcaacaattgcggagaaacggaaggctaatctggatggccgagccaaggaatacaaagggcgttctcctcactcagcataaccgagggatattctctgaggacttgtggcttgtccaggggaggcccgatgtgatcacagcggagggttgacgcccacggccacactcttcatgtgtgctggaacgcatgttgcgttgccattgacccacaagtcaaaagtaactaaggcaaaaacaaaagttgttaggtgtggtgaggagaagagggaacaaagagatagggaaaatcttgactcatttgtaagggaggacgtcatcttttttatgcccgaagaagatctcgaggtggaaatgattgctaagagctttatctcccagcgggaatggctagaacgcaaccagggatgatggagacacggtgtggagtgatggtctgaggatgttctcgaagtcatcgggtcaaggtggaggtggccaagcccagggtgtgctagcgcgttctaacgccagcacgtgtcgagggcggtggtgtgactgccatatgggtctagggggtgctgggtggatgccaaatgagccatggggcctgtgaggtccaattggaagtgagggatgaggggaaaccaatgcttttgctaaatcagagaatacttgcaatgagatgttttccagcataggttttatacatataattttagacttgcaggtggtagggctcattgtttttaatctttactctctcataatcatctttcaaatatcagcagggctcattggtagcaactctaactcgttaccattatatg

SEQ ID NO: 63318 - DNA, 526 bp, Oryza sativa
agtcaacggtattatctattaaaaaacaaaggttatatatatatatatatatatacactctatatgcaagatgaagattcctggaaacgttctaattaaccaaggtagtagctaatcacgggttaattagagacatcgtcagttatagctaggttacaaacccatggatgacgcatatatagtcgtctttttgttttgactgtccatgtatccaactgtaaatgcaatgggatgtttacgttggaccattggaagtttggaacaaagccctgcatgcctatgtgactattgctgagttcgttaggcccgtagaacacgtgcgggaagcgtgctgtctcatctgaacgggtgcaaattaaaatggattattattcactggattgtctatttaattatagggacgaataaatattttgatggataagcttaaaaagatacgtactcgtgatctaaataattcatcagaaaaaaaaaattctatttcaagacagtgtgaaataaatatactccctccgtttcaaaatgt

SEQ ID NO: 63319 - DNA, 1046 bp, Oryza sativa
caaaaggatcctttttatgtgtgagcatgaggagagtcagacaaagagtattacttgttccatattagttttacctagggcaggtcttttttgttgaagaacttgtccagatgtttggtcagaagggcaatgttttacagttccaggtttataatgcccaaaccacctttcttctttggctggcatactaggtcccatgtagccaaggagtggatcttagtgtttggatcatttgacttcctccaaagacagtgtcttcttgctctgtctatgtgttgaatcactttttttgaagcttaagagtgcacatgtagaaattagggggagcatatagaacaaaatttaccattgttagtctctgaccatgattgagaaaagcagctatagatgggagccatctctccactctgtcaaccagaggggcaaagtcaataatctttggttttgtggtccccattagtaaacctagataagtgaagggcatctccccacttgtgcagccaaaggttctagcaagaacttccattttttgactgtcaacatttatcattcccatttcggaggctattctgatttatttctagggatggaactttctgagacaaaccgatatcgatgtgccatttcagagtttaataaaataacagacatttatcattattacattcaattgtgtgcatataatattccaatgactaaatcccttctttataaagttatgacacactaaatgcaattaagaccctaaatctcaaacctcaatgttccacgtcatcatcaattctcagccgttggatcactagattagattacattttaggcgttggatgaacaaaacgcaatagccaccacatgaggcccatgtaccacgtgaagtacttagggtttcttctttgattagtagggtctccttgtggagttgtggtgctagaggcagctggttttctccattgatggcaagtggtgccctggcgtgcctcgcacgtggtgtggcactggcctgatgaaaaaacaacatgcattaccttattgctaacagacagtag

SEQ ID NO: 63320 - DNA, 3948 bp, Oryza sativa
  unsure (1)..(3948): unsure at all n locations
acggctttgagatccgattcactattgccgaactcgagctcggtacccactccgagtacctcgtcgaggaggagctcgaggtcgtcatcaagcaacccgccgccgccgctgcgccaagaaccggcgagccaagccagcatccgctgccggcggcgcaggcggagcgtgggcagccgtcgtcggtgaccccgacggcgtcgttcagctcggcgaggtcgcaggagcggtggagcaacaggtggagcagcagatggagcagccggtggagcagcgggcggtggagcagccggtacgacgccggcacggtgacggcggccgccacggcggagtggtggtgggacatggacggcggcgcggcgcccgccgcgcggcggcgcgaggtggaggagcagggcaacgcgttccacggcttcatgcgctggctcacaggggcatactagtaatttaccactcgatcaatgcccagttcactcgctcgtcaacctcgccggcgccggcgatcgccggagaattgaattcaactgaatttgaaatgaattatgaatttctgatgcggctcggctctgcttttgggcattcgtgattaggagtaattaatagtgtctccttttctcttttttttggctgtgaattcttgtattattttttttcttgagtgcgtggatttcgagggtggaggatgcatatggtgggaaggtttttgatgccgtacggatttgaaaactgcttcttcctccgaattggagaatgtcggcgggaagattgaggaattcggggactttgaggcaaatgaactgaactgcccaataaaaaaacagaattatttccagcttgatcgtataggctatagaaccatgctgcattttgtttggatattgcaaatttgggagcgagactgtgtgccagaatgcatatatatattccctctgtacttaaaaaaaaggaatcaatttttgaggatgaagctagtacttgatgttgattctttttgtgattgaaattagcaaaatgaaaattactgttgcatttgtacatatatatattcaggttatacttatgcttctgaacgtgccaaagcacatttcacttattttaactgattcaggttttatgctgcagcatatgatcagtactagggctttgtttctttttgtattgttcatggggagtgtagtatcttctctatctaatcatagcatgggtgtgtgtagtactagagtacaacagctgaactttgaggcatggtggtgtcaggtaggcatgcaggcaagagcagcatggatttgttcttcttcgtccgtccaacacaaggtgatcgatgatgatcatcgagtagagtagagaatgcagtgcagagtgcagtgcacatggggatgagggttaggataggagattcctggtccttgagattacgcacaacactacaaacctcctctcctctcctactacagtctacagtgctagtagtactgctacttggaaaaggactcgcctgtcccattatttccattgccatttgggacagatggctactagtacttggttcactatcagtgtcaccattagctgctatggttagctttaatttgtctgcttaattaactgatttgctaagtgtctactccctatgtcccaaaatatcgacttggcactactaatactaggttttgctgaagaatattttgggacgaagggagtagctatctgaacgagtagcgtattgttttgaccatggccatatatctcattttgaccttaaattattattagataattatgttataattgaaagtcgtctaggtacatattttgatcgaataggtattttataaactttccttaaaaagttaagtgatcatcaaagcttaaacttgaatagtgttcatataaattatataccccagtgggtagctattaagcagcttgacctagcaagctgcatgcttgcctttaggtagggatgagctgatattgatcagactcgaaagagagctcggcaggaggacattgatgcgtatgtcgcttttgtggttggcaatgccattgccattgccatgccatgcaccggatggaaagccttttcattgttgcccttagctttgctgtgtaaatgtatgtgatgagctacaggactacatgctgctgctgcttctgcaggaagcagcaggacttcacctttgcatttctccatgcatgttaacacactcaactactgaatatttgattgttagaaaagtgaagagagaaaaaatgcactatactgagtttcttattatatatgccttgttctttttgttcgttcagttgagggatgtttttcgttttattttaatagctgaatcgcaccgttttctgagaaattcacgtataaaaagttttttttaaaaaaaacaatcacgtcatttaaatgcctggaagcatgctgctgaatgaaatggttgcattcccatttagattataaaataacacgtccattaatttgggtactatagctatcactactgaatcactgattcactgatcgatatatatatattttctatccatccatccatcgagagagaggccggtcgatcggtcagtagctagctagcttcttgttgttgttagctcgagctgggggagacaaggaaaagcaaaaggccctctgcttctggattctgcatgcattgcaatttcctttcctttcaaccttcttttcctttctctctactcccaaaaaaaaaagacaaacactagttttccgtgccaacgtttgactgtccgtattatatgaattttttttataattagtattttcattgttgttagatgataaaatatgattaatattttatgcgtgacttatctttttaattttttttataattttttcaaaaaagacggacggtcaagcgttggacacggaaaccaggtttgtctttttttaggacggagggagtacgtacgtacagctgctgctgctggtactcacagtctcttttcagccttgtgctgtgaatctgtgatgatctgtgttgctgttcaccagccgatggggagtcaaaaaattcagaagaaaaaggggaggcatttgccatcgattgaccgacacaacacacagccaagccagctgatgctgctctatctatagctctgcatatatgcaaatgtcgtcctagctatagtacagtagtgcaggcatgtgtacatgttcttttgcatgccatgagctgatcaagataaactgttgtatgtacgttgccagcagctatagctcaactgctcaagtgtggactgaatcagtgagtgtaaaaagatggagatatatgatttattttttttactgtgcctcgcatgcgagagatgcttggtgctgggggagcacaacagatctggatttttcacattttggtccttttgaaaaacttatttcgcaagtagatccctagaaaaacttatcccaaaaatggtcctttttggggcgccagagtggctgccgccgtcccaccgccgacgtggcggggcgatgctgaggtggctagggggactttttattgataactcnagctgggggagactaggaaaagcagaaggccctctgcttctgaacatggatgcgttgtaattgtctttaatcccaaccatgttctacttcctgtctactcccaaaaaaaaaaaagcagcgctccttctacgtgccaacgttggactgtcccgtgtctgtgaatttctattataaatcagatttgcattgcggcagatgacaacatactaccaatattgtatgcgtgccttatatttttaaatgtctttataaccttttcaaaaaagacgggcggatatacggtttgaccctgcaaaccaggttatgttctctttttctgaccgatgggggtgcgtatgaacagggtgctgctgggtgaactaacaggttccttcttagccctgttcatcaagtttaggatg

SEQ ID NO: 63321 - DNA, 672 bp, Oryza sativa
ggagtatcacccaggatttggtttgttcattttaaggaatgaacttcaattatgatacaattacatacactcgccttttatggaatattttcaaactttataagtaatattgaatgatgtggaactaagatggtaacccaaaagcccatctggatcttctctgattagaagtgtaaacactgtatatgacttatctagtgaagttccattttgccatcttcagggaatacacaaaaacacttcatgcttctcaatttgaagatcctcgtttcactcatgtatcctctaataaggtatgcagtacaacagtatgtatcctctaataaggtatgcggtactgcaaagtaatataatgtttggaatttggactctaggtgagaaaccaagaggttattcattgagaaaaaatatggcattaaattagcagggcatataatggtgtaagccaactttcttttcagaaaaagaaaaacagaaacaggggaattaatgcattgagtcatacatagtacctggaaaggcaaattctgcaataatttggaattttgtatatcctgccatattattgaacttagtattcttaccaatttgtggagaaaatacttctttgtaggattattttccatctgagtcgatgaatgcaacagggctgcaggaatagatgcagtcact

SEQ ID NO: 63322 - DNA, 610 bp, Oryza sativa
ttaagatggtggttacagcgttgtccgcaacagtagaatcgcacactaactaggcctaaatctagcagccgccccgcaagcagagcaggtactctactcattccaatgttgactatcgcgggtacttcccgagaacgcctaagcatatcccgcagggggcagcatcgcgagctactgccagatcacaatatcacatcagtgagctaggcgctagcagccaagtagcagaaaccccgtaatgctcaagccacagcaagggagggagcaagaaaaacaaggtgaaggcgacgagtctacctaccctagaggccgaggcggaggcgcgcttctggaagcgggagccgccctgcagtgcccgccacggcgcgacggccgagcttggaggcggccgccatggcggtcgatatatgtgtcggttaactatcgagggggaggacgagtagggggttcccgtcttcctaagatgcgccgtggaggttccgttccgtgagcagcagcggcggccggcagcccgccctccccacgacggcacgatctggcaggtttttgggcgatatcgtagaggacggtggcttttccttttggccccctcccttcctttcctcgtttt

SEQ ID NO: 63323 - DNA, 1740 bp, Oryza sativa
taaccccccccccacgcccccctttgcccttttccccatgggcttgatgggccggctgcactgtagtggtggtgggccaaatcctattgatttcggcaccacccatttacccctttattttagtttttaattttattttagcagcaattttatattagtccctgtatttttatgtaatttagtgaaaacagttcattagttctacaaattttgtaatggtcctataggttagtcctcttgctaatattgtaaatttcagagaaggggattttcccacttcgattcgctgattcagctgcgaagctgcatttggtggtcgtggcttatatctctataatctttccccaccattgaagtttcccatgtaaaaaaaccggttccctataaaacccaccccacccaaaaagaaaatcagtgttttcacacaaaaaatcaagacaacaaaccggatagaaaagattaaaccgtataattctaattctgttgcaacgtacggacatgacattagttttctgagagcgagaatatacagtatagttggtagcgactaggtcgagcacaatagagtcgagggaggtaatggggagaggctttattcctgtgtattcctcttatgggtaccatgtggcatgtgggtatattaattgatccacaatatggaagttcagaaaaggcagaccaaagtaaaatcaaagggatacgatgagataagtggcaaattaaatgtacatactgctcaattatctgctaaatttataattgcagttaactttgtggtaaaacagagttgagcccttgcaattatatagccaaggagtaattttccgaaataatcaacggaacaaaagtcaaactgttatgaaatatttgggtgatctcatctatatatatggatagagtaacaaccaactcagggacacaacggttggtcgtgccccacacatgttctcgcctcacggcgattctagcgacggccgcgcctacagttgtgggctgtctccccctgtatatcgctacactgctatcaataaaggatccgctcattcattccctacattcttgtgttaaattctctctcaatctctctagatcaatcaattctatccacattcaacacgttatcagcactttcgcgatacaaccctgggttaaattctctctctcaatctctctcgctcaatcaattctatccacattcaacacgttatcagcactttcgctctcgcgaaggagatcgcgaagtgaaagaaggaaacatcgcttttgatttcaagaaaagcgaaagaaacagaagaaactaaggaaatcgcctaagtacgtctaccttgatttcatcctcgatgccgttctcggcctccatcgctgagaccgctttcatcaccttcttcacctcctccctcgattcgatggagtcaccaccatcgccatgtcgggcgccattctagggttggtggccaccgccaccatcctcggcgccgcatttgccgtcgctgacgcacctccgactccaccaccacaagcgcacaccacgagtgcaccggcgccccgctgcgtccaggtccaagctccatggatggactacggtgggacgcccgccggcgagcagtgctccctcccactggagatgcagtcgccgccggcaccgtttcccgttcgccgctcggcctccccactactttccgcaccattcatgtggctccccgagctacacgctcccgaacggagtgggggggagggggg

SEQ ID NO: 63324 - DNA, 2938 bp, Oryza sativa
cgtgcgtgcgtgcgtgcgcgcgccccgcgtcaattcgcgttgccctactcctgcctcctcggcgtaacgaaacctgcggctgctagctagcgcgccgctggggcggtgcaagtggatcaagtggggagtttatttggtttcgggatttgcctgcagggtttctttcattctttggctgtgcctgtgcttagcttgcttttgctattccctcccggagaatattaatcatcgttttggtggtactcgtatttttttttcttcttacccacttgtttgacttgtgagcacctgagttattcgcgcgtaaaattttataggccggggaagcaagctattcagtccagccataattctggaaagattatcgtgtttccaaataaaatagtcattattcatagtctcaatttatctaagacttaaacgaatagataacttagatgattgtctgaaacacaaacgatcattttaatattcattagttacacttacatgcacatatatacagtggcgaagccaccgtaggggccagggagggccaacacccccctaacccctatgtgacctcccctcccatctcttctcccaaggataattagcccttataatctagccattaattacatcattagttgcagatgagactaactatataggataactgcctagctatatatgacttatgaaatgacttagttaactgatttatcattttaaaaatgattacaagactccaattaaaatcatggaacaaactgtttaaattggcaaattatgatctatgggttctcattctctcttctagctaatcgctataacatgtatgatgtcgagttagtgatcatacatttcaaaaaaaaacacggtacaatatcactgttcaccgaaccttaagtaagttaccacgtctcgtaaatggcaccccccatctctaaattctgggttcgccactgcatatatatatatatatatatatatatatatatatatatatatatatatatatatatatatatatatatatatatatatatatatatatctcttttggtattcgttacatacagaatgagttatttttttctgatactgatgataaaagtaataagtttaacacttttttgatagagagtatagtataggtacgccaccaaacaagttgcaatatggtgtggaaatcggaaacgaatggataggatagaccgtaggagcatttgttgttttccttcgtttccctttcggagtgttgcacattgcgccacgtggatcctgatagaatagccactgaatacacaaatacacaatggtactcaataatgttactcctatgtacgcaccgatcgtaccaagtacaggagcaccaccaccacttgtaaacatcttttctgcacacccgatttgatgggctaattaagatatgacaagtacagtagtactgctagttggctgtccgttctactaagttaggccatgtttagttcacaccaaactttttccaaactctcaactttctatcacatcacatcacatccaaaactttcctactcacgtaaactcccaactttttttttcaaactaccagtttttcctaaacttctctccaatttaagaaactaaacacagtctccagactgatctctagactgatagtacttatcaatttgtggataatggtgagatcaaatattaaaatctttaactatgaataattttttaaatatttatcttagaaaattggagactagatatatagattagtcttaccactactttaataaaatcatatatttgttgatgctttttatatattataatagaaaataatgatcaaagttactttttatgatcatgtttttatctaaaacgataagtattactccctctaattttttttgtttgacgttggttagcttaaaattgaactaaccaacgtcgtacatttgtgcaaggaggtagtattaatctgcagggagtacttccaagtcgcttgctgaccttggtgatctcacctgagcgccacaaaaacgatcgccgtacgtttgacttaccagcttcaaaaagctgcctcgagtttttttagcccaactgtatttacgtttgccggtcagcgctgacaaaagttactacgaacccatcgacgggcccctgtcggtctcgtcctcctcctccgctttaaccggctcacggaccacggcgaaggccaaagcgacgtcgcgcacgggcgcgcggccgcggcggcacatgcagcacgccgaccacttgcctccccccacgaaacttttctcgctgtcacctgatatctctttccccccaaccaaaccactagacattggcgtcacagttctgatcgggttggtatgctctgttgcaacatggcagtgcaaatttgcaacggaaaattgcagcagaaaattgatgctagtagtgtacgtagttgcatgtatttgggcctggacagtacatgggcctggaagcttttctcgtctgcagattttaagattttatatgggcctgcatatgattctctctcttttttttttttttgaacttttgttgatgtcaagcatggcgcgaatgtgttgtaggggctggtggtcctgactatccaggctaggaccccgtcgctgatgccgccggtgtgcgccaaggtttccggcgcggcgtgctatccagtgaccgcgccgaagaaggcaatgctgttcgcggggctgtacgttacggcgctgtacatcagcggcatgaatggctacctcccgtcgcacggcgccgagcagttcgacaagcacgcgccgcgtgggcggaaggggcgctccaccttctataactacttcgcttctgcctctccgtcggcgcgctcatcgccgtcacgttcgccgtctgggtggaggacaacaaggggtggcagtgggggttcggcatctccaccatcgccatcctgctc

SEQ ID NO: 63325 - DNA, 3888 bp, Oryza sativa
caccaaaaattcacactaccttcgcggtgcgccacacgatgacgatcatagtcttctaaagttctacctgggtgtgtgcgcatccattcggcaacctttacaaccttgtagctgttgctgtttattaacatttcacggtaaaacgggctgaaaaggacacttggtctttggcaagcctttcaccgccacgaacttctcgttcttgtttcgccaattatcagcggggggccgaacgcatatttttcggccacgaacctcctagtaaagcacaaaggaacaagtgcaaaaggaaaaatgcggacgaaatcaatcccactttccagcaaaatcataaagttggcgaaacattaactttctcattaataaaattaaggtcatagtggctacaagacgaaaacggctcaaggtcgaacatgcaaggcgcctatatacatagaaagactaccaaaaagcctaaaagggcaaagagaaaaagtcacacgaggacgaagggcctcacacctcagggtggtcttggcctccgttgccttcaccctcgtgttcggtggctggctccgacgacccgcggtcctctccggtgttggcagcagcggcttcctcgtccttcgtgatcctttcaagattctcgcaaagctgagtcttcgcgcaatcctggccaccatcctctcataaacccattcggaaggccctcaaggccgccccggagcactgcgagttgtcgggccaatcctctttcacgaggtcagggaaatccccgatatggtcacagccgtgcgcgtgcaggaggctaagaacgaagcccgccgaaacatgtgcacagcagtctccgtaggcactggccacttcgacgaccaagccggccgcttcctgcgtcaactcggagaagtcgaatgccgtcccgtcgtcactcggagcgccttccccgtgcgcgccgaggttgttgagagctagcctgagggtgtagccggcttgtttggcggactccgtcaccggcgcctgagttgcagtagcagcttcggccgagacaagacgagcctcaagggacttgatcttctcttcggccatagcaagttgacgatctcgttcagcgtcccgcttgttcgccgcctccaggtcggcatggagagacttgttttcgcccgtgagagacttattctctgcattcgacttttttaagttgtccgcacgacgtgtctttcgtcctccttgtggcgaagatcctcctcgattttcagcggtcgaagccggtacccatccagcctctccaaggcggactttttcgcacttaagtgcgccgcaaggccctagataagagaaaccaaatctgttatgatgtggcagaaatgaaaagaggagaaattttgcaggcgaaagataaagttcacacccgcacgaacaagctctccgcggccgcgcaactctcgccgaactcatttagttcggtgaaaagcccaagaccgtcggatggtgcaatgacttggcacaccccatccacgaatggggtgatctccggccgcgtagcgaaatccgcgggaacaaagtgcggggcggtgagcatcacgtccgacacagacatcacgaacgggggggccttcccatcccgctgatgagtcggcgaagggaccgcctcaacccgttcgcccctcgagatgttcgccccaatcgccggtgccgaagcacttcctcccgtcggcgcttcagcgtcactggcaggaggtggcgaaaagcgtcccccccccggggagcgtaccgctgggctggcaaagtgggtgtcccatcagacccctcgctaactgaaaagccgggagcgacctgcaccaccccacccttcttcttcttcttccgggcgatcgaccctggcttcgccgtagagctagaaatcgccaggagggtcttcgcgccaacaacgttttgtggatgaatggacgaaacatgggaacccgccccagacttcggttgtgctggactgggcgtatagccatgcgacccgtcgtcctcttcggactcggcctccctatcgtcgtcttcctcctcgtcggcatcaacttcagccgcgtcctatgcagcacggcgggttcgcacttggccgcccttcgcaacggctcaattgcgcttcttcgacgttccaacgtcgtcatcgcccccgtggaggggatagaccgatcgggcaattcgccggcatgaactcggttcacccggccgtcaagctggcgtgaaagcaggtgggcgaattcagccgtagttaggccccaaaccatcttcgacgcctccgcttcagcgtcctccaacatgcgaactaaaagcaccaaaaagagggcgaatcagaccaaaaggcaactcagaaaagggggagagaagtggaaacgaaactcacgttcggtcccggcggggagaacaaggcgaggaagcccaagcacttattcgccttcgttgatagaaaccccccagtcgcgagcaagggaggaaattcgaagaaggcagaattcctcacaaagatcgcgggtacttaactgccgcacaactttgcgaaggaggatgagccgggactcaagggtaccgtcgatctccacgttcggcttcgcgacgatggaaactgcaagacgccggaaacgaagccagttcgccttaatgtcctcggcggggtagggattgttgatgtagaaccatttctgcatccagtttcgttcccatttcgccatagacgcaagtaccggccaggcatccgagcgttccggccgaagcatgaagttgacgcagctgaaaaccgtttttcttggcccgaccggcgtattcacatctttagttgtagcgcacgccgtgaacaagatggcgaacagctcggcggtaggttcgaaactgcatgttcggcacatccatgcaaagacgaccaatttggggaaggcggacgggctaagctggggaagcctaaccttgtacatcgccagcatcgatgccaagaaatcgtcgcaaggaacgtgaagtccagcggcaaggaaggcgacgaaaacgaccgttcacctgttgccaggcgaggggacaacggcttcacccccacaatccgcctggccctcggctagaatgccagaggagatgaaatcggccaagtcggcctccttgacaagggacttgccaagaaagcacgaccaccctacgccaaggttaccggggtcttcgccggtcgatccggccttggtgggcttacgatgggccatcgggtctatgccaaaagcaaagtggaaaaggcgaagtgaaccaaggaagtcgaaagagcaagcacgaagtcgcactggtgtgttaacaaccaaatttggtaagtatttgtatcaggaaaagggacttaatcggagaagagttggagacgaagatcgagttctggaacagagcaaggatcggctagagtctggatcagctacggctaggatcggctaaggttgagctaggctaagtaggctggtatagccgattctgataatacgacttgtgcgcgacgtcgggctcagtttgatgtgcttcaagatgattgccatgtctggatagagtcctgagaaggcaattgtatctattaattagattatttatgtaaattccttatagataagtgtgggcaagagtctgccgcaaagactcgtgatattttagagtttgttagagataatggtcgtggccggtacgggcatatcttgtaatcctcgggtataagtagaccccgaaccctatgtaacgaaatacacacattcaatacaattccggcgcatcgccacctttcgtttttgttttatttcgacgagttcttgcttccgggttgagctgcatcggtttcgatcttcaacaagaggtaaagctcgttatgacgaattatgttcttagggattagtgcttacatcttca

SEQ ID NO: 63326 - DNA, 2944 bp, Oryza sativa
catatatattgtaacactgttatcaataaaggatccactcattcattccctacattcttgtgtttaaattctctctctcaatctctctcgctcaatcaattctatccacattcaacacgttatcagcactttcgctctcgcgaaggagatcgcgaagtgaaagaaggaaacatcgcttttgatttcaagaaaagcgaaagaaacagaagaaactaaggaaatcgcctaagtacgtctaccttgatttcatcctcgatgccgttctcggcctccatcgctgagaccgctttcatcaccttcttcacctcctccctcgattcgatggagtcaccaccatcgccatgtcgggcgccattctagggttggtggccaccgccaccatcctcggcgccgcatttgccgtcgctgacgcacctccgactccaccaccacaagcgcacaccacgagtgcaccggcgccccgccgcgtccaggtccaggctccatggatggactgtggtggtgacgcccgccggcgagtagtgctccctcccaccggagatgcagtcgccgccggcaccgttccccgttcgccgctcggcctccccactactttccgcgccattcctcatggctccccgagctacacgcttccgaacggtgtgggggaggggggggacggcgtccgaacccgatcggcctcttactccgatgaggagagggagccgtcggcttagtctcgccggcggacgatggggacttcggctgctatggcggtggggacggcagaaatggaggcgctggcggtggtgtaatagggggagatggtggcggcgaaaatggaattggcggtggattagggaggcggcggcaaaagtggtgaaggaggaggcgccgaaatagacggcggcggcagacgaggtggaggaggcagcgctgtcttggtggcgtcatgtgcggcggcggcggctcaaactgctgggcggttagggtaaccctaaccccccccccacgcccccctttgcccttttccccatgggcttgatgggccggctgcactgtagtggtggtgggccaaatcctattgatttcggcaccacccatttacccctttattttagtttttaattttattttagcagcaattttatattagtccctgtatttttatgtaatttagtgaaaacagttcattagttctacaaattttgtaatggtcctataggttagtcctcttgctaatattgtaaatttcagagaaggggattttcccacttcgattcgctgattcagctgcgaagctgcatttggtggtcgtggcttatatctctataatctttccccaccattgaagtttcccatgtaaaaaaaccggttccctaggaaacccactccacccaaaaggaaaatcagtgttttcacacaaaaaatcaagacaacaaaccggatagaaaagattaaaccgtataattctaattctgttgcaacgtacggacatgacattagttttctgagagcgagaatatacagtatagttggtagcgactaggtcgagcacaatagagtcgagggaggtaatggggagaggctttattcctgtgtattcctcttatgggtaccatgtggcatgtgggtatattaattgatccacaatatggaagttcagaaaaggcagaccaaagtaaaatcaaagggatacgatgagataagtggcaaattaaatgtacatactgctcaattatctgctaaatttataattgcagttaactttgtggtaaaacagagttgagcccttgcaattatatagccaaggagtaattttccgaaataatcaacagaacaaaagtcaaatcacgcattagaatttcaactgagggagtaggagtataatacagagcagaacaggtaacaacacgatctacgcgtttaattagttcccgatgacagtgcctgcctcaccgtgatagataaaacgggtatgatggatctgcggtggaccatgcggattatctgcaacgatggtgtcaaaaagaaaatattagcagcaatccaagggcggggaaacaaaaacactgcgggcagtagctctagactctattggctggcaaagctaaatctgttgaaaatcgttttgctaatatataaagatgatactcacggactcctgggctgccttgctgagccgagagcatggggaggccgctgcctatcagaagagccaccaaaacaagtcgaatcagaagaagacggaagctgctcagagtgggcgacatgcttgttcagcaggcagctggcctgctttgtgatcgagctcacgaacaaacgatacaacctgtctgttttaccgtgcgtgccgggaagccactgatgtcaaataacgccagacaagaagagtcaagatgtgcgaggatttttcaactggttgaactcttcagcgctttgctctcctatggaatagcagtacttatcaaacgtggaatggctcttttactcccgatttgcaaccttttagccccgggtgcaaaccgggacacccaatccgggactaaagattatcgtcaccctcaaatccccacaaatcatccacaattgcccatccaaaaaatcatccgcaatccacaagtaattcacaaaattatccccaaatctaaaataatctacaacaaaatttacaaatcattccaaaaataaaaaaaattcacaaaacacgccgctgccgtccgcccggccgtgcgccgcctcccggacgcctccgccgccctgcctcccctcccgccatttccagcggaggagaggccgccagccgtccgctgcctcccatctcgccatctctgccgcttcggtggccgcggccctgccaccgctggaggggaggccgccgcccgcctgccgccaggccgccgctcgctgtcgccgtcgccgttagtgaaggggggagggggagttgaggtgaaggggaagggga

SEQ ID NO: 63327 - DNA, 2322 bp, Oryza sativa
  unsure (1)..(2322): unsure at all n locations
cgagagaaagacagatagttttcaacctcaaaaaggagaagtgataggtgttaacagtgtgtgaggttttttgttagaaggatagggatcctgtggactagagatagacgggagtagaaaaaatctcgtgggaggggngtatccccccccccccccccgaaattttttatttttgttttatttgtttgatatttttttcacgcttagggacacacacaagaaccaaccatagaaaaattgaactcaaatggacgtaatatgtgacatgtagaatttttcctctcctctcctctctccgaactagtgcagaggagagagatgtgcaacttttttatttttattttattttttttgatatttttttcacacttaggaactcacaggaaccaaccacgtaaaaaataaaatcaaacggatgaaatatgtggcatgtgaaattttccaaagctcaaccgaaaaacttctctcctcgaaaacacaatcttgcaagcggaatttggaggttttaatatttccgaacccggcaaagcgggggagaatcggatgtaactttttctgtagatgtccgtgcatatattatttgcctgattccgagtccgtatgagaaagttacgcctattttaatagatggcatattttgtccgtttcggtagagttttggaaaattctacatgtcacatattttgtccgtttgagtttattttttatacggttggttcctatgttctcctaagtgtgaaaaaaatatcaaaaaaatgaaataaaaataaaaaaaattgcatctctatgtactgtttaacttatatatgtcattttatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagttaagtggtagttcgagtttaaattttttttgtggttggttgtatcgtgatcctgagtgtgaaaaaacatccaaaaaaataaaataaaaatgacaccgttgcaactccatacagagaaacaggaatggaggcggcggcgccagccatgctggtgccctcctccctggggcggcgccagcatggctggcgccctcctcctgccacgtcggttcacgtgcgccacggtagcaggaggacggcgctagagaggctggcgccgtcccgttggatgacggcgccagccactctggcgccccaaaaaggaccatttctggaataagttttttcaggggtctatttgcgaaataagttttttaaaaggatcaaaaatgtgaaaaatccagcacatcagatcaggtgcacttggggctagctagctatagagcaaatacctacatatataggaaaaaaaactttcatcttttgtcggaagtgaccataagaagaagaataaaaatggcaaatccggtacgtgtttgtttttaaataatatgagcttttattaaactcaaacaattatatctaaggagatacaactatgcaatgagatccatccgtatgacgcatcctacgtgcagaagcaaatacagtatgcactggcaccgaccatagtgacttcatttgtaagtgtgatggatttctcttcgaactttatggtttatgagaggtatcaagagctaccaaattcttctaagtaaaacactaccaaattctacagtaaaaatacaatacctccctctatctcatcaaagattgaaacatcactatttcattactactcgtaagctaggctcaaaagcctcaaaccaatccatataagtagcactggtagagaaaccatctttgatcggtcgaccaaattccacaatagtcccggttgcaataaaaaccgggactaaagatcatttttagtcccggttcaaagaagttggtgggtagagtcaggcttcaattatctttagtcccggttggntttgcccccgggtcttttgtggtttttggtcggccggtctttggtggtttctctacctgtgcctcttatatggattggtctgaggctattgagccttgcttacgagtagtattgaaaatgtgatgtcaccctccttgatgagatcgcgggaggtttcgattttttcagttgattttggtagtgtttaacctcgatgatttgtgagctcatgatacctcctctaaaccttaatgttcgaaggggaatggtgttccctcttgtgtcgccctgctgtcttgcatgcctgcgttatccatagtgtctcctcaccggctgttcaaaatatcatttcccca

SEQ ID NO: 63328 - DNA, 16442 bp, Oryza sativa
cctcagctttataggtcttaaagtaatgcaatgctttcctttgttttcaatagatatacataacaaaatctagtgcaatcatctatcaatgtcatgaaatatttctttccccctttagtcaacacgccgttcatttcacacaaatcgaaatgaacaagttctagaggtgccaaattcctcgcctcagatgccttatgaggcttgcgagattgtttcgattgaacacaagtatggcacttagaacctttgaccaaagtgaattttggaattaaactcatattagctaagcgcgtcatacaaccgaaattcacatgacagagtcgcgaatgccacacattagactcaccattctcgctaatatggttcacaacattatgattattacacatgtcatccaaagaaaagcggaacaagcctcctctgtcataaccttttccaacaaaagttccatatttagatacgacacatttattggattcaaacacaagtctaaaaccttctctacacaatagagagccgctaacaagattcttctttattgaaaggacatgctgcacgttcttcagctgcacggtctttcccgaagttaacttcaaatcgaccataccaacaccatgaacagccgcaagcgacccgtttcccatcgacaaggaggaacctctcccgacctgataagaagaaaatagagaaatgtcagcacatacatgaatattagcaccagtatcaacccaccaatcagatgaatgaaaaacagagagaactgtaggtaataatttaccgtaccccgatgtttctccgcccttgctaatgaccatattggcagacttcctgtctttgcgcttaagacagtccttgggccaatgcccatacttgccacacacaaagcagtctccatttgcctttcccttgcctttcttcttaaaattggttgtagccttgggtttgccatcaggcttgactttcttgttgttgtgggatgcatgagggttcttcttctgtaccatattggcactagaacctccctcaacctttttgtgccggttgtcctttgccctcgccttctcctcaacacccaaagagccaatgagatcagaaacactgaactcttgtctcttgtgctttagagaagtggcaaagtccgaccaagaaggtggcaacttggcaataatgccacccgccacaaacttgtccgacaactcacagttgttgttctcaagttccttagccagcatctgaatctcatgagcttgttctactacagaacggtcatcgaccatcttgtagtcatagaactgctccatgacatacagctcactgccggcgtcggaaactccgaacttggcctcaagtgcatcccacatgtccttcccggaaggcatgtgcatgtacacgtccactatgttgtcagcgagtatactgatcaatgctccacggaacaggcaatccgaagcctcgaacttaacctcttcttcaggagagagaggtggttcacttcgtttaccccgtgaaacatagaagcattgcatcgctgtcaaccacaatagtgcacgtgctttccacctcttatagttagaaccatcaaatgcatgtggtttcagagcaaagccaactaccgaaaatgacctatcaggtttttggattgttggaaatatggtcatatatcggcatattttaatccaaaatattaagacaataatcatgacatgaacaatgtggggtgatctaatgataaaatgtaacataaccaggagcatgcttaaagtataataagcatcatgaacataccaagaacgcaatagaattgtgactaacaggacaaacagaggtattaaagaatgagttaacagtaggagaaagatataccccgagaatgtccctccactggattgtgaggcagaactgcctccgttgacgttgtcgttcacagcggctccggctcccggcatgccatctccagggacggtggcagcggcgccggctctaggtgaggcggcagcggctacaagtgcagacatggtggagacgacaatgaacagagcagaagtcgaaagcagtcatacagaagcactccccaaaaacctgatcacccgcctacccggtgcagatctcaggcaaaggtgtggttccggtgcgcgcaagcgatcagaagcggggaggcagaacagaggcagcacaggcgcgcggaggaggaagaacaccagcgagagaaagcaagcgagagagttctgatcggattagcggcctccttatatagcaggagtgatatccgccagttgccgcacgcgccgttacggaggcaatcgtgggatcgtgcacgcgccattacagaggcaatcgtgggatcgtggttaagtgccgttacggaggcaatcgtgggatcgtgcacgcgccattacggaggcaatcgtgggatcgtggttaagcggggaggcagcacaggcgcgcggaggaggaagaacaccagcgagagaaagcaagcgagagttctaatcggattagcggcctccttatatagcaggagtgatatccgccagttgcgcggaggaggaagaacaccagcgagagaaagcaagcgagagttctaatcggattagcggcctccttatatagcaggagtgatatccgccagttgccgcacgcgccgttacggaggcaatcgtgagttgccgcacgcgctgttacggaggcaatcgtgggatcatgggatcgtggttgcaaaaagggtagacgcgacacacgcctcgccggctcggcacgcgcgtgtggctttccgattcccacctcaaccggtcaacagggagcctccaataactctctatttaagttgagatacttctcgtttaattcatgaggtggtattattatccttaacatttattatgagcctttgacatttaatagaataaatcgggcctagcccaattaatctaacagttcctactactaagacacaacttgtgtttaaatgtaggaatatcgtgattcaaactctggtagatggatgagcatttatagatacatgaatagaagtgatgacaacattacagagtttgccttttcgtttttaaagtgaccgctctctccggtttaccggaaaccaataaaaccaatgactcatgccaatgtcatacggaaattggctgatatcgactggaaccgatacctagcggtttcacgaaaaccaatcgttttatgaatcctgcaaagacaaattgaatcgaataataatttgttttgaccaaagaacagcaggggaggcccatattgtaataattttcagtaataaatcgaagaaaaatacaaaggaatcagggatcgtgtaacaaaagccactgtgttaattctttcgtgcagcctccatttacccagtatagatgcagaggagtatcttctttggaggtcttcccacattgctaatgagacctcatttggataatgtgaactggaaataatttcccactcaccgaggggtaacttttaatcctacaacctatccatccattcttccagattcatttcatcctacccttatgttccaatcccaatccctcatatcccattatctaaataggccccgagggatgaacattctcaagaaacaaaccattgtgattgttccatattttccaataagccacaagggaatatccataaacatattccttggaattgatcatcgtccgttcaatagaaatcatagttctgattcccaaattgaaaatgaagccaatggaacccccacaggttgtactaaaattgtaatgttagactcgcataaagtcaataacatcatatttaaatagggaagtagtagttaattatgttcccctttagaaacgtaaaaaatttgtattgattaaaataccaacagtattctaacatttttggcacgtataattaactcctaaaattctttacattgtggataaggttaacataacattaactatcaataactttcaaaaatatttagtttgtagacattagaaaacgattatagattagtcttaaaaaatattttaaataaaattaaatatttatttttatatatatttgaagaccatatcattgtacaaataatcaagaacaatggaaacaaagggaatatagtataggttattagttgtcaacaatcggagacattaatgttgaaaaaagaaatgcctaccaacgggtggaatagagatcgctagtttttgaatacgcgtcgccggcacacatttctattgggattaggtagttaaactaatatattagtcttagctaacgtcagtttaagataatgacggtagtagataaggttttctttttctgcgagatttattttaactaacaaattgaaaagaaaatctatatctgaagtcaaattttcaaaattttaaaccagatttgaaaactttcaactcgaaattttaaatttttaagtcaaattttgaaaactttcaacttttcatcttaaatttgaaaactttcaactcaattttgaaaactttcaactcaaatttgaaaactttcatctcaaatttcaaaaactttcaactcaactttgaaaactttcaacccagatttaaaaacttttaactcgaggtttgaaaactttcaattccaaatttaaattttttttaaattaagatttaaaaattttcaagtcatgatttaaaaacttataacacaaaaaatttgaaagcacttgtgctgaaaatttttaaaagaataatcagaaaaaagagcaaaaagaaaagaaaaaaatcgtgaaaacaaggaaaaacgcatggaaaatattcgctaaaaggcggcgtgtggagggtgcgcgcgccagatacggatccggcgcgcgcgccaattagcaaaagccggtggaatgggtcaatttacattaacggaagaagccttcgagtggctgtgtcaaaataaatgcaaatggaggttttctaacaggagaagagagatggtgttggtgcggtgatgagaaatgacagaggtgtgttcatggcaattctctcagcattattcttatatttggcaatgctacgatggaaggtcatggttgaaatagattttatagaggtggtaaaggtggtgggtgttaaaaggaattagccggccatggaaatccaagatttgaaatctagcttgagtttttttttttttggcaggctatgaagttagtataggttcgtcgttcgactcacatggttgcacaaaggctagcgaagtaaggtgaatttgacattaagattttaacataggtgtaatacaattgaaagtatgtgtatgattttttctagattttttggtgacatttcttagttggtgtgcacgtgggtacacgtgagggcctatgtacatagaatatgttacaccttgtgcgccaccgcgtcatcggccgcccgggccctgggtgtaccccccgtgtacaccaactaaaaattatcacaaaaaattataggaaaactcatacatgtcgtattacatctacgtgcaaagtcgtatcttcaaattcattctacatagagaataacaaaaaagataaaattttgacaaaattgcaaccttaaaactgtcagattttttgtttttttgttacggctaaaatataatgaatttgacgttaacattttaaccctaggtgtaatacaattgaaagtatgtgtatgattttttctagattttttggtgacattttttaattggtgtgcacgtgtgtacacgtgagggcctatgtgcataggatatgttgcccagttgtttcacaacctaggtctcggttcgtccagattttattttacctatgttggccggttaatttaggtgaataaagtgtcagcatagtttaacagttactcgtgttatttatcttgctacgcctatactcgtattagatgttgagacaaacggaccaaaatatacagttgagtgatgtaaaagtacacagaaatacaatttcgagcaacttttgagttatagcgcgtcgattaaaccgacaaaatatgacttcggtttgagctatggcacgctgatctagtgaatacattcatgccacggtacaacagaccgaccaagaaggtataactatttcaaaatcactggcagttcaaaattaacaagcatcagaatgagccataacttcatcaaagctattccaagtcaattgccactatcagcaacaaacaatcacatcattttagtgaaggcaatcaccccacatatgaacaaaatcgacaccatggtgatgtctgaggtgattcttgaactgtcgaaacttaagtctatcccagagcgatatcagcccaatcatttgggcctctgaataatcaaaagagcattaattgttttttaggcttctcatctagtcatctactggttcattgttggacaggatcttcaatcttcagatcaccgtttagatctccctcgctttttaggcttcctttcttctatggattcatcaatgggttggtcttccccactcttcaggtcacctcttcggttaccgtatttcctttttggtttggtcacttctaccacttcatccctgttctttgacctgatcaatcacacaaaacagtagcccaaatactttagctaatgctaaatccacaaacttcaaaaaaacaagatcatctgttagtctttcttacccttttggtaaaggatctaagaaatttacgacttctttaagagcattgagagcaatcttcttaatctacaatttgttaaaaaaacacaatcagcataagggtagttatcacagaacattacaccgcatgagcaaaccagatagctgaatacatgcgctctaacctctagtttatcttctttagccctgtgatcagatggaagacgtctaaactctccggtcagcttaacacactcaccaacattttcaggggaaacaaagtctagagcaaccttgatgcaagactgcacaaatcagaatgggtcttagttttctggttctgagcccagattcttgatgccgcattcataaatatttaatgggaaaagtggtatcaataaataccaccaaaactttatattttcaacaaataccacaggatgggggagacagagggaagtattcagctgcacctttaaatttctcacttggtgtggacatccagcaggaatgaaaactgcatcgcctagcttctgctcgaatgtccatggttcaacacctaaaattatgcatgccaacagacaagaaaaacaacattatatcagtgttataaacagctttggaagagagatgacagcttcaaaatagaatgttatctaaccgtgttcttccttgagctttctcttatgctccacagttaaatagaaagtctggtcatgaattgggtgagaaacctgcacattgtacagagctattgctcagaataagaaaataaaacatataggattcctatataatgtgattggacaaaaaaaagggtacatttttcactggattgcagtgtatgtgccgaaattctgaggcatgcttccgaagataatcttgtaacttctcagaatcttctcttcggaaaatatcccacaaagcgccaccagttttctgttggtctgaacagtctgaatctttgcgtttgaatccactcctgtcaatgtatccttggttgtctgaagtacaatgagctccagcatgcatcttgacagaactattaacctcgtgattgtgttttgaacattgtgttaattcactttctacctcagattgacaaaatgatggtttatccccaatatcacttccagaatcatcaggtggtaaagcattaatgtccaaacctgcatgactcagaaaagaaattagtaaaccataaccagacaaacaattcaatttcttgccagctcttgattttaacaagtaaagttttattatttacccttagtactttggttagaggtgtgtttgttttccatgttacatgagattttcgatgcttcatcatcagctttacccttggcgcctgattctgaaaccccaaacagttcatgaagatcttgttctctcattttcattttaatttttgctatcttgtcaagctgttcagtgtcataggacacttcagctgtgtgcatcaagatatttacctggtcaaaccaaacaccttttgtaattaacctttataccatgagaagccagtgaaacccaatcaatatataatggggaagaacaaataatttatggtaagcaggcctggcaatgcaatttttattctggacaggatgtaaaagctataacaatctggggaaaaaaatatcatcatgccaattatagaataacataccgcatcagacatgtcgcaatgaagcttggtcacagagtcacccctgcctaactcttcataacatccataagcaatataagtttttggcccaagatcaggcttcagtacaccagcaggaagcctgacagcaagatttagcgggccatatcgtggatcagtatactcgggaaatggcaatgcagttataaactcagcaccatggcgaggtaacctctggtcaaacatactagatggtggccaatcttttagcttaagcatctcaggccaaaaggtcatcggatgtcttctacctctcatataccccataaagaacatgtgtatgttaatttccacctgcagtatcaaacaaaggtctgtctaaataaaaacaggcacggatatcatatttttaaaattgaagtttcaagttatccatagataaattaacaaagtttccataaacagaaaccagatatcagggcaggagctgccaaatcttatttgtctaaaccaactgtaaacaataaggctcgcaagaatagaacagaggggataagaagacacagtgctgccaactcacataaaacacaggaagaaccaaccacttctatgcctaagaaaaatagtacaagtaaggaaggaccgtccacttctatgcctaagaaaaatatagtaatgttctatattagggataatgttattctaaaaggatagtcaaagttgtacggcctataaaatcaagacggaacactcagcaacaaggaaattaagagttccaaacctcattccaatcaaggcaatccactgccttaacagcaaagtgctcatcttcaacatcaccattggttttcttctctcgcaatgcccgccacataaccaatggctcccagctcagaccagatgttaaccgaagagcatcagaaacaataaccggttcaccttttgaccaatgcatctgaaagtgcgacaggtcatcctcctggatattattggcatctggacagtacaagtagttatcacttgagccctttctgtttgctgcctctcgagtagcatttgttcttatcttgcttgtgtgataaaagcaagggcactgatcacttgtttcgtttattgctttatcaaatgcttctctcttaataactttgttagccctgtgttctaactcagaaagcataatttctggtaataagcatctgagtaccaaagatgaagcaccgcagccccctatttcctttggtggacaaggtatactgccatcactattagctttccacagtaacaaagggttatttgggtccccagcaacagccatgtcattgcaagtttcagtactgggggtctccatgtgcctcttcgaagatacccttttcttctcatccttggaaatattaccaaaaacatacttctgacctctctcttcccactgcacactctttgcctcttctcctcctggaatctcacctttgcgaagctcccagcagcatgcaaggcacaagtcatacgaacaagccttgcagcttctatgaaaatcaactatcgaagttttgcacctatcactacaataaaagaataaaaaggctgatcaaatgctcagtgccacaatatttatggcaaaatgtaaacagggaaaatgtttaaccaataaacacgctcatccatatcacaatcagcttgttccaactttacttcatccatagaaacacctgcaaataaaaatgtaaataggcagttagaaaatcctccaatacctgaatgcatgaaggaacaccagaacagcataccttgtaatctaccctctaattccttctccttcatctgctcctgttgaagttctttcaaccaaggaagcaacaagtctacaatacgaaaagcataacgtcgttgattttcctcagaaatcttcttttcagggggctgattcaatatgacagggcaagttattaatgccagactgtaaagcaatcttttgagcacaaacaaatctgtagaaaatatggaaacactagggagggataccaagtacataccttttcaactcctatcattcttaggcatgccttgcaattacagttctttctacaatatgggcattttgcagcaaaatcaacttctgacaaacctgggtacctatttatcaaaaaagttttagtgtagtgcaatgcacaagatcaatgtattacagccatagatcaatggccaacaaaaaaggtattaaaaggaacatcaaaattggagtagcacagtcatcaaaagaaaataattgaagtataaaactataataacatttctgaacagtggcatgatacaatggatatgggtagtccaattagtagatgacaagattgagacaacttggcataccatcgtttcatgcatggctcacagaagcgcttattgttgcatgatttacaccaaatcaccctccctttgtcatttctttgacactggtggcacatcaaagcattttccccagtgagcatcttcttccccttctatatgatcaaaaccacacaataattttcaatgcactcataaaaaaactgtggagtttccatacagaacatataatgaaatctgagcattaccttattgttcgcatcacacatttcatcctcaatggatatggtattattctcttcttcctcttgtttctttcctgcacctcttttcttcgattcttttgaaggcttcatcattatcgcttcatcattctgtcaaggaaagaaattgtaagtactgaaaaatatggttaagacttaggaggcagatttttattagcaatacctagcgaccaacactcaccagaagttcattaaattttcgatttctctgagctaaagtatacacctcccagaggttacaaagcatcctattaaaggttttacacataccaatgatgtaaggtttacagcacaggactcagaatagaagcacagttacaattccggggaaaaaaatattggagctaaaactactgcttatcaaagccagacaagacatcagagcaccaacgagccaactaatattcaagatctaaaaaattgggaaatgctcacttggtcagcagaccaactcattggcagagtattcttcctggcaaggaaagcaggattcaaagtactttgccctttctcaggtgcaggaattaattcagattaatcaaagactgaatgtgttctgccatgctacaacaataaaggagaaatggcctgcccagccaactaggcccatttctccaatctactttctttcaaaccataaaccctagaaacctccttcccctctctaaaatagtagtgacagcagtggatgtcacaacaagcaacagtggtagggagtagtgacaacagtggatgtgacaatgatagcaacaagcaacagctgtgcccaatagggacatcctgcagtactgtgtctccaattttttagtgttagttgagttgaactattgctagttgaatctatagatgttcacctctatccatgcacgccatcgaagacataatatctgttgtagtagtggcaagtgcttggagttttaactttgcactagaccgagatacagctgcctactgcttggacttcgatgcaagagaagagtggaataaccaggctgagttctaaacagctacttggatcgacaacatccttgttttctatgagcacactttccaaactactaaataatgtggactaaatttctatttacaagttcttgaaaaatcaaataaatccattttccaaatttataacagttaatacctaattaatcacacactgattacccatctcgttttgtgtgcggcatattggcccaactaaaatgctctccctaacagagcataaggatgtcagcacacgaaacaaatgaccagaatggacaaagtagtagtactcataaactgaccaaaaatatgaacagcattagcaatatcaggtctagtgacagtgagataaacaagactacccacaatgtggtgatatcaagagggatcctcaataggtgtaccatcagtagaatgcagctacaagaagggatgaaaacggttcagaaagtatccagttttcggatgtgttttcagaaacaaaaagtcggttggatttttttcaaaatgtttcagattcggaaacaaattaggaattttttttctcagagacggaaacgaattcggtaaggccactatccgtcggaaacaggaatcagtcggagaatgttttcggacttctttctcagcatcggaaacaaattacttttcccatacagcagattagctttagccttctctactctagatgtttagaattgtaccgagtattgaggtaattagttgaatggagattttttttctagtctgctgctttatatcaatttttccatactacttacatatagatgaatatagttcttaaatattataattctcatgaaaagtgaagtgtgcaattaattgtattattattaattgataaaaaatagaaatgtcaatttactgttttcaaaaatattgaactacatctcttcattaatatgagaagctcatttggagttgttttcatattcctacaaatatttgttaccgtaatcgctctggttggtattcgctttgttttcatattcaataatgttctatcccgattttgtatttggggtttcgatttcaattccaatactgaaaaaaatatgaaagtggaaaaggtatagctagtttccgtccattcccaagttgttttcatccctagctagaagtgaagatccataagggtcgtagctacaagtgaagatccataggggtggttgtagagaatgcaaaacctcaattcctaagaaagaactaaggcctaaaatcagtcttctgaaattgctcaaggtgcttttccacatggaaatgtggccaacgccatcccccctaatcaacatatcatccacatataggtgaagcaaagtacatcgagcatggcttgcgcaatggggcctccaagcgacatgcgcacgacacaaactgcaagcgccgcaggtgggcaaggtctttgaatgagattttggggcgattttctggtgaggaccagtttctcttctcaccatggtacaaaaaaccgaaccatgtcaaaccaaaaaaaatagaaaccagcactcactagtaggggtgggcattcggtctgaccgaaaaattcggtctcggtcttcagtctttcggtcattttggtctttgaaaactcaggaccgaatttcaccccaaaaaaactcggggccagcaaattcggtctcggtcttggtctgactgaatttggacagtttcaggagataagtttggaatgaaaaaatttgacagcacttcccctcttttcaggcattttttcatagttatatatcacaaaaatacaagataataggcaacatcatacaccaaataatatatcacaagataggaagattaaatagcataggtctcaagtctaaacttcacagtcacagtacaactcacaagtcacaaataaaagttcaaggttgatgagtacattacttgcaaataaaagtcattattatgcactggattcaaatcaaaggagtagatcaaaaaataatcataatacttacatcgcaagaatcaacagatgtagccatcgtaacggattcacagccgttggcttgctgcctccccgatgcagacggatgcggccggcaggatggaggcaccgagctggaggcggggtagcttgagagtggagtggagtggagacgaggaggcggcgcgatggatgcccgcggcgcgatggaggtgaagggcggaggtggcgggatggtcgatggaggcggaggcggaggcgtgaccgcgcgatggcgctcgacggatagggtagagatggattggaggcagcgctggtgaggctgagtgggagtggctgacttactccctgctggtgctgccctctagggttttgtgtttcactaggcttattgggcctcctaggcctattgagccacaaatcggttttctcggttaactgaagccaatgaccgaattgcctgaaaaaaaatcggtctttcgacagttgagaccgaactactaacagaatttctcggtatcggtgttttcggtttggtcctattctgcctacccctattcaccgtgttagtttgcttcgaggaccaccaatgcaatttgactagcatgatccaggtgaactaggtagattttgaggaaaatggctgaactggggtattatgaaccagcggttcagccaacagatgggcccacctaggaaggaccaccctgcatcttaaggcccaatttgatttattaaagaaaatgaggaaaaaagatggagcggtagggagtcaaacataggttggtagggtggccacattgtttaaaatcatgttgtatgctaaatagctttggccagttcagcaatcaacccagtctatccaaccggtgagccgatgaaccggaccacgagcggttcaatggctagtcctattcttttaccatgcttctcgcagacaatgcaagttgtttggggtggcgccatctacacgaggagataagatctcttttccctcagctaggtcatccaaatgggccaatttggtatatttgttttcgataagcttcaagaccaggatctacttccgtgggtttggcatactacagcaagcaacaacatgtaaagctctggatattgggtacaacttacctttctttaagggcttcaggatggggtccaccaacacccgtccctggtaccgccacccccattagatcataatcgcttaatcccattagggccttattcggtttggaggggattgaagaggattagaggggattgaagaggattagaggggattgagaaggaataattccacaccacagtaggtgtggaataaatcccctccaatccctccctcatggggattaaccgaacaaggcctaaggaaggggattggaggggatttattgtacacctattgtggtgtggaattatccatcctcaattccgtcgaatcccctttaatccccaccaaaccaaacatggccttaatgtggtgacattgtccgcaataatcttaggtttctttaaaaataatctatataacaagtcgagatgtaaaaagagtctgtcgtttgagtctagaagggtgtgctacagctcgaggacgagctactaaaaaagaagggagcaatgtgatggacattgggatgggagtcttgggcccaaacccctgcacgacatacgtaggtcaatggataaagtctgttaagatagagcaagttagaagagaaactaacctgagttagaaagacattatattaagatttatcttagtgcccccaccaacctgccttctcagcatgacatgatcttgctccgtcgcatcgttgaggtccagagccattcctgttacttcctcctcctgtaatctaatctatctccttttgccccgaaatattcttgcacgtgaccttgtgacccatcaatattgttggaatcatcaaaaataggagcattaggactaggcaggtgttgtgggaggtgttgcataatgagtgtataattgtactaaaaggtgtatgagatggtggtggtggagcggaagtgggtagagggtgctcagaagaagtgggtgtgatggaaatagaagtaccaggattaagggttgtagagacatcatcactagatgaaataggaggaaggtacaaactctgttagggtctatgaggtttgagtggagggattataaaagaatggatgaataagcaagtatgcaacgagaggacgatacccaaggaaacatattcaactaattggaaggccaacttagtccgctcatatggtgcaaggagaacaaacatgtgcatccaaaaacccaaagatacaccaaaattggacagacaatttggaggatgattgtctactaataagataaactgtaataggaacaacttcacctagaaatgagaaggaacaaaagaggaaatccgaagtgttcgagcaatctccatgagatgacgatgatggcgttccgcagcatgagcaccaagagtacctttagtggccaaaaactgacagaagacaagaaataaataatgaccactagaataggaccaaaaaagtattacggtgtagtaaactctattaaaatatagcgagaattttcattgatag

SEQ ID NO: 63329 - DNA, 3624 bp, Oryza sativa
  unsure (1)..(3624): unsure at all n locations
gtgggaattccgtaagaacagnaccttccnnccngcntgaggtcgactctagaggatccccggtataaacaaccaagactaaaaatagatctttagtcctggttgtttataccaaccgggaccaaaataaactgccgagcgcgcgctgaatttatctcctcggtatcccctccccttttttctctccttcattaaaaaacgccgagactaagcctcggtatccaccagtccgcctcctccccttcctccctgtcggtgacatgggaccgggagtatcatgactagaggcttgggcagctgcggtcacccacgtggcctgaccccctcggggggtcgggcccgagggagacgtgcccaccccctcctctgtctccccgaggggtcgggccgctcctgtttcggccccgagggctggggcgccccgaccccctgtggtattggcgccacgtgtgtgggttaggtgggcacagcggcgctcaccaaaccacatttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcccgtcgaaatgatgagagcctcttggcactcgtccctagctggagccggcgtggtaactcctggagttagcacgtcagtcccggctcgattcatgccaggcttcatcgcaaccattgcaaggaagtcactgtatgaagaagggcagatgtgcggcatgctaaactgacgcgtggtggagaagaatgaccggtctgtgactggactgacgccggtcacgtcatcggcagacaaccgtgctcccacgttgcatctgcttccggcggagtggaggtaggtatgacccatcccatcggagggtcattcagacagcggccattgcagatctcctcccattaatgaagaaatgacagggtgatcccctgtgtccgacgagtgacggcgctgggcatcactcaaggacaagcggtgatttagcttccaggcggaggcgcgagtcaagatttggtcaagatagggtgggtccccacccaaaagaagagtatgtagaagaagtgcatgtggtatccccttgagatataaaaggaggaccttgcccacttaaaagagagggggagattgagagagaaaaggaacgagaagagaaggaaaaagaggggttatagagcttgaactctcttgctctccatttgctctgtaactccttcacacacagatccaccagaacacaggagtatggtattacgcttctcagcggcccgaacctgtatacatcgcctgtgtcttgtgcatttgctctctcgtgaacattccacagatcgagggtgaagaacctcactcagcgcccccggccgaaccggcaaaggggggcctgccctgtctcccggtgaggagccccacgctccgtcactcccccttcccctttttttcgatcccccatccatgcctcctccttctccttcccctctttgctgcggttgcgcggcggcgacggaacgagccggccgcgcggcaggcggtcgtacggtggaggatggcggtgaccatgcggcaaccggtccggcggcggtggaactaggcggccggtggggccacgccccgtggccggtggggccactggtggtggccggcgacagcggcaacccgtgtttttttatctgtgattcacttagatgtattttgtatggataattttgtgattcattgcacatttgtatggatctgtgatatatttgatatgtttataatttttataggatttgggatgttactttgatttggggatttggggtttgatttgggatatatattccactcgattcgggagaaaaaaaagaaaaaaaaagaaaaggggaccatctcgctgccgctaccgtctttttagtcaccaaccgggactaaagatctcctctctttaccggttggtaacaccaaccgggactaaagatagcgatctttagtcccggtcagcggggttacgaaccgggactaaaaagcacttctccacaagtgtaggtggagtacgtattggcggatgtacagtactactaggaactgctataaaaaatgatatggacgatgtacttgccaacatgctctcctcattccaaaataaaccgacctaatactacgaattcatacatatagatgtttggctgtactacgaattcggacagagatttgtttgtccttattgagtacgactacgagtgtcaccaataacatatggttaggaaaataaataaataaataataataataataataataataataataataatagaagaagaagaagaagaagaagaagaagaagaagaagaagaagaagaagaagaagaagaagaagaagaagaagaagaagaagaagaagttgttgggcgagtgatcgcgaagacaaaagtcatgcaaaacgcccatggatggatgtaccgtccggacggcgtttgagttcccgcgcccacacacgcgttcgtcgccacgatctttttactttgtacgtagtacacgcatatatatgcatcgtcagttcgtcacccgttacatcactcgcgtgtgctcaggactactacgtactccctccattaaaaaaaaaacaaaccctgatttccgtgtctaacgtttgaccgtccatcttatttaaaaaaattatgaaaaaaattaaaaagataagccacgcataaagtattaatcatgttttatcatctaacaacaatggaaatactaattataaaaaaatttcatataagatgaacagttaaacgttggcatggcaacctatagtttgccttttgtttttgaaacagagggagtacttactaagcatcatgtgcactcatgcgaaatttccctattgacctaattagagaaatcacctaaatatgtactccttccatttcaaaatataaacattcatataaaaagtttgaactattaaatcgttgcacgctctcatcgcctagtttagaacccaccgtttcagtttcttttctccgccattcatctcctccctccccctgtttttattcatcttcgagtgtgagcatgcatgtgctgtagctcctacctttgctcatcatcaccatccgttatttttttaaaaaaaaaaattaaagatgccacatctgtttgaaacaatttagggcccccccaacaatttaaccaagtgaaaattaatgcttttttcgtcctgtgatccctagtgaaacaatttacccaagtgaaaaaaaatgcgcaacactttcctctatcataacacctgacgttttacaccgaatcgaaggcgtgatacgtcaattaagagatgtgcccatgatgcatggataaaaatcctagctagcttcgtactataagaggacgccacgtcatctgttaaaccagcgtgtttatatatatatatatatatatatatatatatatatatatatatatatatatatgaaagtcgaatttcttccaacataattaactgcattgatctcggtagctacggggtaccgagctcgaattcgccgtatagtcaatcgtatctccaccccacg

SEQ ID NO: 63330 - DNA, 731 bp, Oryza sativa
gttgggtgcatatactttgtacctctgagggtagaaaatcatggtacttattggtatttttctagaatggaagtcttctcttcttgttatcttattgttttttttttttttgggggggggggttataaatttttttttttttttttttttaatttggaaccaaccttacaaatttaatagtcgtattagtctcatcaggtcttttcttgaacatggtaggtgtatgattggatgacagagcgcagagatagattttcactctcatctagtgatatggcaatccagttggatctgattgcaaaagtacgtggtgtttcacatgctgaagaatacttcgaggagcttcctgatccattgaaagacaagcggacatatggttctcttctcaatgtttatgcccaagctatgatgaaagagaaaacagaagcacatttgagcagatgagaaaaaagggatttgcaactgatacattaccttttaatgtgttgatgaatttttatgtggatgctgaagaggctgagaaagtgtccatacttattgatgagatgatggaaagaaacgttgcttttgatgtctgcacttacaacatttggataaagagttgtgcggctatgcaagatgctgatgcaatggaacaagtctttaaccagatgattcgcgatgagactgttgttgcaaactggactacttacacaactcttgctagaatgcatataaagatggggaactct

SEQ ID NO: 63331 - DNA, 15103 bp, Oryza sativa
gatctgggaggagggaggggagatgccgctgccgccttctgcgccgccagatctaggaggagggagggaagacgctgcagcctccgccctcctcgccgtcgcagccacacaccccgccgccgtccaacccgagccgccggtcaccggcctcccccctcctccctccggccagatctgggaggaagggagggaggggagctgtcggccggcgagcacatactgcgccccgccgctgtccgccccacgccgccggccaccggcctccccgaaccctagcgcgcgccgcgtgctccctccgcacggtgagccgagccaccgacaagcgggtcccactcgggaccacgcgagaaggacccagcccaccggctccctctctcctcccctctcgcgcgtgccttgggccgccttctcgggccggctggcccattaagctcggccgagccgtgcctttttctctcgggccgcgccctagccgcccgagggaagtctatttcccctccctctttcttttctttttccaaaagggtttaattaaatccttttcctttagaacaaaagtccaataatcttagaaattcaatatcttctcaactgtatgtccgtttgactccgttcaacttccaaaaaatcctcaaatctcgagatctatctaatggcacgcttagaggtcaataatagggctttattttcgccgtttgttgagttgtcccgttttgcgtgtagtttcggagcccttagacccgcagtgcgagaatttcgaggatcaagcccaagatctcgagcaaggcaagtcacctttgatcatcttgcacctataacttaaatctaagtatttcttttccgcaaatattgcatgaataggattaacacgagtacttcggccacggcttgcgagatagcctactggccccaatcctaattgctgcaattaccctccttgaattattgaacacttaaacctcctttgtcaactgttgtgcttcgatgcacgggcctcctggtacgcgcatcggaacaccttccctcaaatttaaaatatccaatgatgggtaaaacttggggctttacaaaagacttgaaaaacccgacacttgggtcggtacttgcgaattaaatgaatttccaaaaccgcagaccggggaacgtaccgagagtacggttttccgctcttgcacttaaggaccgttttccttggaatttcatccgaacataagacaagtgtgatgattggtccaagtcttggcttccgctttccccttttgtgatgcagttgtgagctcgggatctgtccgcagcccaacatgactgtactcctactctgtaataaagagacctctgttgctgtgatattctgtcttcctgtgataccagcactgtttcctgggactggtatcgatgaacaggttaatttggagcgtcacaggatagttccgttcagggctagttcggggtgtgtccggtggagccggtgcgggaggctgcgggtgaggtaggggaccgtgaacggctcagcgggcgacgcagcgcgtccaccagcggcgccaccgccacgtgctgcagcgctgtggtcttgcctcgtgcgagcagcggccgcagtggccggcggtgacatctctccgcctcaagtgaaaccgagatgctctcgttcgctctctctcttggggtaccacgcttggtactcaggtaccaagatttgatacctaggtaccaatttgacaccagggtaccaggtaccaggtttacgtcggcgcacctcccgctcgtggaagcgccgccgctcgtggacgcgctgcatgtgatgcgtcgcccgtcgagccgcttgcgctccccgaccttgctcgccgcctcctgctccggctccaccggcgaggcgtgctccacttcctctactgtaacgctccacttttcgtgagacgttaaaaactaaattacaaaaaaatcctatatgcgaaaatttcgttccttgagtgctgagtttaagtcgtgccgtggatctcaatttaaatctccttgatccctctgtgtccatcaatcgatctatccacttatctaacctatctatccatctacttctcggaagaagtctattttacctccctatatttttggatggaccggtttcctcccccggccatctcccctcccagcccatcaccgccccccctctagcacgtgcgttgcacgcaaccgagacgagagagagagcgccgctcgctctctctgtttctctctctccctcgtcgaactccctctccccggcgccgatttcccgccgccgccgtttgaaatccggccgcgccctcgtattcgcgcgcgcgctcgccgaccgcccggtcgtcgccgcgttagtcctggccgcctgcgccacgcagccgcccatgccgccctgccactcgctccacctgtgcgcgcgtgcgtccaagacatggaggcagagcctcggctcccctctctcacgctctctccctcctccctctgctcgcccaaatcggcaaggagccgagctcctttcccctccccttttgctttttccctctcagcccggccacccgtgaccacctcctgccactccttgaccgcaagcgccgcgccagccgagctcccttgaccacctaagtcggtttcctccccccaaaaccgacttcccgtgcctataaaaccgcagccgagcccctcctctcaacccctcccgcttcactctccacgctgccgcgccattgtcgcccctgccctgcagtcgccctcgctgtccgtcgccgaagctccaggaagaccgatgcgtgcgaaggacgcaagaagaggactccacgtgccgtcatcttccccttccccggcccgaggccggagagctcgctcccgcgccgtcggtcacccatcacagcgcccgtctcgactcgatagtgcctctctccgttctcccttctcactcggcctctccctcttttggctcgcacgtagcttggtagccttcccgaacgcgcgtagacgaagccccaattcccgccaccgcccggcatggccttgtcgccattgccgcccgttccggggagccgccgctcatcgccggcctccctcggggcccctccgtcccatccggcaccggaaatgaattccttgcaccccggagatactctcgccaccttgaatcgacctttcatcgccccaccgcgattttcacttttgctcgccgccggccgccgccgtcgcaatccaccgcccttgacctctcccggcgaaatccgagccgttggctcgcctcctctcgcgcctatcttcgctccggtggtctcccctccttccgccgtgcctcgcgccgctccgccgacgcgcgccgccgtccgccgtccatccggccggccttcgtcttcctcctctcaccatccgacgcggccgccacgtaggcgccacgtcggctaggccgagtcaacccgtcagcctccctcccccatcccggtgcgcgtggtccacggtgcgctagccgccgacgcgtgggcccgcctcttcctagtccatccggcgcatgcggcatgagccgagcccactaaccctagcaccacaccccgcgtgcactcccccccaccgtgaaccaggccgccgccaagtggcccccgtcctgggacccccacgcggtggatccggtccaccagaccgcctccctctccccacccgagccctaatgggccaatctcctttgggccgcgcctcacgctcggcctaaaaagtctatatttcctccctccaccaaatcaattctcatacacaaaagtccatctttcccccttgttggacccacatatcaatgagtaattaaagaatattcttgggaatattcttttccataaatttaatagatcatttcttaaaccatttctcctattccagaaattccaattaagcttccgaaattcttatcttctcaaccgctcatccgattgactccgttccacttccaataattccgtaaaattgagatctatttaatggcactattatttagtctaaatagggtctttttcttggtctttttttctaggttttcgattgtttgcgtatagttgcggttaccggattttcgtcgatcgtggatttctcgaagattcgtgaagctcagtgaagaccttgagcaaggcaagtcaccctttgaccaattgctcctataattgaaaaatcattattattttgtttgcaacttgcattattagaatcacacacttaacttgcttggcctcggtttgcatgctaaaccgacggacctatccagtagtcgcactacttcctgtaggctgacataccctgatcccttgtcgctccaccattgtggtacttcagtatccgtgctctctaagcctgtatgccaattatcccacatacaccgttgtttgtcgaaaatttgggcaatgggtttgagaagccttgaaaacccgacatgtggtgtcggtgtgattgaaaataaaatgaattgtgaaaactcgcgatgcgggggttgtgcctatgtggcactgtcccgtattcgcatataaggaccgattcctgtgggaaactcatcgaacatgatcaaagtgcaaccacaaggtggaatgggacaccctagctaagtaactagtcggttcagggaaacctcgcatgccaatagttgggaacgccggggcggggtcggacaaaccgggttcctggtaaggcaaggacgagaagcttgctcacttaccgatcaaggtggttggagttgatttgtgaatgcctagaatggcctgtatttatgtgaggatttgatccttctatgtggcatgaggtaaccctgggtcggcttgagaaaggctttgtcgcgaacctctgataccggccagtgtctggactaagttcgtgtcttgtgggtaaagtgtacccctctgcagaggttaactaactattcgaacagccgtgcccacggtcatgggcagatgtgaggtggttcccgttgcgtagattttattgcctgtgctttgtgaaaagttgttgtggtgtgggaatcgttaccagaatcagcctatgtggcaaatggatgacctgagtggtcggaaacgaatctgtgtgattcgggatgtctgcgggcatcatagactaggcttcctgagtggaagcggattgttgtgctgctgggcagctggactctgggagtccgagaaaatgaaaaaggctctgggagccgattaatcaagtgaaatggctctgggagccgataagtaatgatctgacccgggaggtcggtacattaccatttgagttgttgaaaagcatctcttaagtcaaatcgagacgtaagtctcttttcgatccaaactcaaaaagaaataaatcacttagtgacttcaaaaatgatttcaaacaaaggatttgcaaaacaaccttgcctctcttccaagcttgcattaaacacctaaattcccgtgacttgctgagtacgaaattactcacccttgctctatatatatatatatatatatatatagtacatttgtttggtgctccatggtgcccgggcaccattgttgaaattgagtatatagttcctctgccttgaagtgaagatgaagtgaagtgaagattagggtttcgtcctggttcccagccgtcgtctgtggtgttgggtgttagcccgttggttccgctgctgctgctgttgttggtgttttctcgtccgcgtcgtcggttgcattctcggctgttctgagctgcaacctaagttaaggtaaataagtcctctatttattttaaggattgcaatgattcatatttgtcaccgtgggtaccagcgctatgtcctgggactggtactgagatcgcggtttcgtaagaagcggttcgcgccgttattcctatgacacgctcctgtcaggtgccgttgtacggcggtgctggattggggtgtgacatccacctcttccctcacgtgttcgacctccgcggcccgccccgctcccgctctccctcttgctcaccacgcccgccgctgagctcctcgccatcgctgcctcccccgcggcagcggccgccggctacagcgagcggtgcggcgacggtgacgggccggggagggctgtacctcaggtgccatctgatttgggggaggagtgaggtaggaggaggggatccggattagtatcctgtctccatgggataccggtgtatagattttctcctaaatatatgatagcgctgaccttttgatttatgcaaaaagagactatgactaaaatgtattaaaataaacctgcacttttaaacataagtctatgaaaatatattaaaatcggtgagtacgaaacattgcacttcacatctcctcaaaaaaaaaacattgcacttcacatgtgcatcaataaccttacacatatgccactcatttaatattttgatattcaaaattgataattagggagtatgtaacgaacatgagcattttttttaatttagcctgttataattcaaaattaaacaatgtactcaatatatattaaaatttaatatctattctataatgactggtgcgacgtatttgttgatgatcagtaattttcaataatacagaagttaagtctgaaagttaagggtgtcaaatgtctggttttgtagtttaggggtgtaaattcgaactgtcaaaatagttgaaggggttatttggatttttttttcctatactaggtattctctgaaatgtttcttccaattacatttttcttagtcataatacaaaggaagcatgtccttctgtccttcggtgccaattacagaacaatggaaaaactaaatatagttcatcataagaaggtacattaagaaaccacagcttacagatactaagcagtagttcctcttgaaagaaattgattaatacagtacaccttctgcataaccttacactgtatgcaatcaacaaagccgaaaacagcataccttaaggttccactgaaaaagaacattccaaaccatacccaaaacccgaaaaccactccagccattacacagaaggatagatactggtcctcgcattttctacaaaatctctcatccgatgcaagtgaagaacttgtgcatgaaatgttcaatggaaagccacatagaccataattgttgtggtatattgatgggtcactgagggtttgaagttgattcccagtgggtatcttacctgatagatgattattcgagagatttagaatgtcaagagtagatatatcagcaaggcttggaggaatggctcctgaaagttagttcaatgagaggtcaaggaactctagatttttcgtattaccaatgtttttaggtatgccgcatgacagatggtttcttgacaagttcagaaatagaaggccttggagggttgttaactcatcagggatacactgcgacaatgagttacctgacaaattgatacccgttagtaattcaattgttttttcgaaaaattgctcttgccccttccagattgtatcgattccatccgagtaaagcagccaatttatgtaagaagaccattctaatgtttcttgagcagataaagtatttggattcttcatggaagttaggttgccaaaagatttgggaatcaatcctgtcaaaccgttgttgcttatgtctaacagttgaagttgagagagattcgacaactctgaagggatttcacctgtgaagttgtttgatttcaggctaagaaacttcaacgacagaaggcctttcccaatccaaggaggaatacctccaaagaatctgttgttcccaatatctagggtgatcagcgccttacacatctctaacgatgatggaaaaacaccggtgaagccgttgtcggcaagatgaaccgattcaagagaacagttgtagttcgtctggactgtagggatttcacctgagaatgcattgttggacaagtcgatgaactgcagattttgcaggttccaccagcagtcgggcagcttaccagtgagcttgttgtttgacaggtacaggatctttagggagagcagttgacagaaatccgaaccagatctgctgttagaggaattccctgacgaatgatcaactccctgcatcttgaaattgtttcccatatttcccggaatcggtcctgaaatggagttatggctcagcttcaggaatgtcaaatggctgagatgacccaactcaggtggaatacctcctgtcagatcattatctgacaaatcaagatcctccaagcttgtcaaactccctaatgctgcgggtatgctgcctgataatctatttccaaacatgaacaacactatcagtttccctgcctttcccagctccggcggaatcttgccggtgaacaagttgttctgcacttggaaggatatgagctcgggccagctcgtgaacaacgccggtgggatctcaccggtgaggttgttcgttgaaatgctgaacacccgcattgcttgcatcccggcgaactccggcggcaatccaccggagagctggttcatggacagctccatgacagtgagattcttaagatttcccagctcaggcggcagagttgaaacgagctcggcgttcatgatgctgagctgctgcagcatctggagctggccaagaacaggtgggatagtaccgcccagcgggttgaatccgagatcaagaaccttcaactgcgacatcgaccccaggaacaccgggacgccaccggtgaggttgttgctgtcaatccgaaggtccaggagcttcgtcaacctcccgatcgacgccggaatttgaccggagaacgcgttgaaggacaagttgaggtacatcagattcgggagcttttccggcagcatgtctggtatggacccagagaaattgttgtgcgacaggtcgaggaaagtgaggttgccgctgcggatgacgaactccgggaagctgccgttgagggagttgaggaaaagagacaggaacgtcatggtgggcatcggcgagaacttgcggaagtcgagcccggtcaggtagtttgctcccaggtcgacatgggcgatcttggggagccggctgagctggtgcgggatggcgccgacgaggttgttgttgtagaggcggaggtcgacgaggccggagaggtcgccgaactgcggcgggatggagccgtcgaaccagttgctgccgaggtcgagcgaggcgagtgagcgcagccgcgagattctggccgggatcgcgccgacgaggtagttgtcgttgaggtcgagctcagtgagcgccgggagcgccgcgaagtcgagcgcgtggatgccgccgcggaggcggaggctccggagccggagcgaggcaacgctgccggcggcgtcgcaggccacgccgcgccaggtgcagaccggcgcggcccgcgtccagtcggacagcgaggccgcgtcgtccaggctggccttccacgccagcagcgcgtcggtctgcgacgacgacgctgccgcttcggccgacgcagggatggcagcggccgcggcgaagaggacgacgacgtcgacgaggaagaaacggtggacgacgggagccatgtgcgcagtcggttccttcatggcttcatggcagaggcgtagtagctcctagtagtaatccagttagctgactaacgagcagaacggaggaaaaacaggagctggttggcacgacgtggcgatctcgcgttggagtcgtctccgactatgcaggtatgtcaatctatctatctactcgggaagctattttaatccatctaagtggatgttcaaatggttataaaaatttcttaaaaaatttaacaatgcccatacaacatatatatatatatatatatatatatagtatatgctcactacacaaaatcttaggataaaattaactcacgcatcgaagatataaaaagacaaattcaacgtacaaatagcagcattctgttcgcacctgaatttatctttttctttatgtgtaggtcgaatttcaagttgattattgatagaccaatagatgtcactgtactttatattgtcattttttttcaataatttttcacaactatttgtgttggctttgaaaaaaagtataaaggggacatctaatgaaggtactagaatccattccctatctactcatgttttactccctccgtatcaaattttaaggctatattattttacacggttttcagagacatatttggggctttccaaagccctagttcaagaaaaaattattccatatcatattcctaacgaatatgaacttagcaacacatgaaagcataatacttagcatatatatgtttagtatgattatgagtccaaaagttatcgagtttgatttttctttaaaaaagagggcgccctataatttgggacggcatattatatatttttttctaaatcaaacttacgtttgactcagattaaatttagtaactttataacaccaaattagttttatcgaatgtaacattgattatatattttgatagtatgtttgtgtggtgttgaaaatgttactatatttgtttataaacttaattaaatttaaagaagtttcactaagtaaagaataaaaatgatttataatatgaaatagagagtgttaatttatttgttattaaagtaaagtagtaggttaggtcaatcatggaccatatcctatgcatacaagctttccattcacaccaactagcaaatatcataaaaaattctagaagaaaatggacacatactttaaattgtattacacttatatgtgaaaccttatctttaaataaattatattttagccataacaaaagagaaaattctgatagatttttattcttaaaaatattagatttttcttttttatggttaaaatataataaatttgaatatcagacgttgcaaagatgtgtaatattattaggagcacaaatccaatttttttcaagaactttccatgataattgttagttggtgtgcacggacagtacacgggaagtttgtgtgccagaatatgcttttgcgcaatcaagtggctagcatctatataaatttatgatgtaattgtgcggctagcatcaatataattttatattatgatgtaaattcatttgtattttctacacattaatatatataaaatttcttaagtagtcaactgtcacactccaatctggcaccgccgtacaacggcacctgacaggagcgtgtcgtggggaaaacggcgcgaaccgcttcctacgaaaccgcgatctcagtaccagtcccaggacatagcgctggtacccacggtgacaaatatgaatcattgcaatccttaaaataaatagaggacttatttaccttaacttaggttgcagctcagaacagcccgagagtgcaaccgacgacgcggacgaggaaacaccaacaacagcagcagcagcagaaccaacggactaatacccaacaccacaggcgatggctgggaaccgggacgaaaccctaatcttcactttacttcatcttcaacttccgggcggaggaactatatatatatttatatagagtaagggtgagtacttttgtactcagcaagccacgggaatttaggtgtttgatgcaagcttggaagagaggcaaggttgttttgcaaatcttttatttgaagacattttgaaatcactaagtgatttatttctttctaagtttgggccgaaaagagacttgcttctcgattcgactttaagagatgtttttcaacagctcatttgataatgtaccgacctcccgggtcagatcattacttctcggctcccagagccattccacttgattaatcgtctcccagagcctttttcattttctcggactcccagagtccagctgcccagcagcacaacaatccgcttccactcgggaagcctagtctatgatgcccgtagacatcccgaatcacacagattcatttcttgaccactcaggtcatccatctgcctcataggctgattctggtaacgattcccacaccacaacaacttttcacaaagcacaggcaaacaaatctacgctacaggaaacacctcacatccgcccatgaccgtgggcacagctgttcgaacagttagttaacctctgcagagggggtacactttacccacacgacattactaacccggatcacccagcccgtgagatcagccacgtcgagagaccctaaggctttcatgacaaggcatttcgaaagccgacacaggtttaccatatgccaacaagaggggtcccagaccaacaccaggttaggtcccagaccatactgtgccaggaagcccgagggttctccctgacaccaccccgttgaatccacatgtctcttggcatcatggctcccccgattagctaattactcagccaggggcgtcccattgcacccgtgtggtcgcacttattatatgctcggataaatttcccacaggaatcggtccttatatgcgaatacaggacagtaccacataggcacaacccccgcatcgcgagttttcacaatctattttgttttcaaacacaccgacgccacatgtcgggttttcaaggcttctcaaacccatttctcaaattatcgacaaacaacggtgtatgtggaatagttgatatacgcactcagagaacacggataccgaagtaccacaaaggtggaacgataaggaatcagggtagtacaacctacaggaattagtgcgactactaggtaggtccgtcggtttggcacgcaaaccgaggccaagcaagttgagtgtgtgattctactaatgcaagttgcaaacaaaataataatgattttccaattataggagcaattggtcaaagggtgacttgccttgctcaaggtattcactgagcttcacgaatcttcaagaaatcccgcgattgacgaaaatccggtaaccgcaactatacgcaaacaatcgaaaacctaaacaaaagaccaaaagaaagatcctatttagactaattagtagtgccattatatagatctcaattttacggaattattggaagttgaatggaggcaatcggacaaacggatcgagagatatgaattttctaaggattatttgattttctgtctaaaggaaaaggaattattaattctcttggaaaagaaaaggaaggagggatcggatttagactttctcgagcaacttaggcgcggcccgagggattcacaaggcttggccggccattgggccgagcgtggccacggggaggcggcccattagggcgcgcggggagggagggaggcccgacggggtgggcgcggtccgccgcgcggggtcccgagatgggcccgcatggcggcggtcgggtgtatggtggggagggcgcacgcggggacgggcgagacggaccggtggattgggtgcggatgcggtgcgctggtcgacaaggaggcggcgggcccacgtgcagcctcatggctcaccggggtctgcgcgcacggggatgaagggacgagggcgagcggctgaccggcttgaccgagtcaagccgacgtggcacctatgccaggccacgtgggcggcgagaggaggaagaagggggatgccaagatggacggcggacggtggccgagttcaccggagtttgatgcggaggtctagggccaaggggagcacaccagaacgatggctaggataagagggagtgagcctccggctcggattccccggggggggggattcaatggcgacggatttcgacggtggcggccggcggcgatcaaaaggggaaatcgcggtggggcgacaagaggtcgattcaaggaggagggagcatctccggggcgcggggaactcatttccggcaccggatggggcggaggactgccgaggagggctggcgacggcggtggcctccgggagcgggcggcaacggcggcaagcctatggcgggcggcggcgagacctggggcagcgtccatgcgtgttcagggggctagccgaggtaccacgcgagctagggagggagaggacaagcgagaagggagaacggagggtggcactaccaagccgagacgggcgcagtgacgagcggccgacggctcaggagcgagctctccggcctcgggccggggaaggggaagaagagagatggccggagtcctcgtctcgcgtccacacacgcactggcctccgacgcgtgcgacggcgaagagacgaaggcaagaggtgggagcggcggcaaggcgtcaacaatggcgcggtgagtgtgaggcgagcgaaaacgagagaagaaggggtttggggtggcttgggttttatagtggaggcgatgtcggtttggggagtgagggaaaccgaccttggtggcggtcaaggagagcgagctggcggtgagctggtgcagtcgcacgaccagcgtccgcgctttggccgcaagcggctgggaccatggatgacatcggcggtggtcgggaaaaaggggaaacgaagagggaaaggagggcttgacccttgccgaaacgggaaaaggaggagggagaggggagtgagacaggggctgcctctctcggccttggaagctagcggcgtggagcggcggagcggcagcgcggcagggcacgacgcaggcggtgccagggtttgacgtagcggcgaccgaggcgttggccacgcgcgaacccgcgcgggaagggcgaatgcggtgggagcggcgtccttgccggtcgaccatgcgcgagcgcacgggaaacggtgacacggccggaattttggggcggcgtcggcgggaagcgaagccgagagagagagagaaaaaggagacggcgctgtctctcgctcccgaacacgtgcgacgcacgcgtgagacgcacgcgtgagagagctgggccgagaggaggggatgggtcgggagagagaggaatcagctgtagcgcccgttccgtcgtggcgcctagcgggaaaactatctcttaaaaaactctatttgcgaaatctgtttctttgcttgttgtctagtgtctgtgccatctcagatctcaaatccccgatctatcgccgagttcaatcccgaatccaaatccttcccaaatcaattcctccgcaaaagtctattttgcctccccggggtcgatgggccgaatctctctcggcccatctaccccggggtgg

SEQ ID NO: 63332 - DNA, 765 bp, Oryza sativa
aggaggcggaacaccggcgtgagcgtgtacatgggcgcctagtcggcttcggctccggcatctccgggcgccggcttctggacggcgaagatgccagagagagtgagcacgcgcatgaggcggcgcaggcactggatcttggaggggtggagcgtgaccctggtggctatctgggccatggtggcggcgccgccgtggtggtggatggcgtcggcgatgccgaggtccaaggcggccttgagagccatggacttgatgacggagaaggtgttgccgtagagctcgctcagagcatcgagcgagctggtggcatgttgcccgttgctctgaatgggcgccatggcactaccaattaattttgtcttccttttagtttggaatgggtttatgcacaagatgcactataaatagaggtctcaaattactgtatcaatgcaactcgttctggaaacatagaactactatactaggttatcagagaaaatgaggaaaaatgtactagtttcagggattccaaaattccaaaaacaaccagcacaatatcctatgcaattatgtaaccaatttttaatttaaattatgacatttggcaaaaatgtaaatgcacattaaagtatttgctgttgtttctattatttattgtgttgcttccatttgtcaatatagatgaaatgaaacaaacatgtccgctagaaggatctcgcggcatcatctcgctggagactttgcgtattaggatcatccaaacggacatcaaaacatttt

SEQ ID NO: 63333 - DNA, 1909 bp, Oryza sativa
caacttcctaaagattgtgtgatcaaatcaaacaaaaaaaatactatgatgactcgacatacagcaacaaaatgattaaaggtatacataaagatctatacttagttaccttcattgcttctgtgtactttttattcatggcatgccattgagattcaagatcaccaccttgagattcaatggggcatgtccatctcaaataaaattggggccaaagggtaggagcaagtgctgcagcaggtggcactaggggaccattatgctttaatggatcatagaatggattacgatgcttatggaagctgccaccagaagctcggagatcagccaagtacgtccacatgcaatggcaagagcttacagcaccagattgctccctttctcgctcacttgcattttaaattgaagtcagatatgcacgatattttccaaacaagatagatcaagaactataaaagaaaggagtcaaacattgcttattaccaagagacaggtgcatacatgaacaacaaactataattttctggacaagcccgttttgggaagacacagtcaaaagagtttcggaccacatctagtggactacacagcctaagaatggtgtaacaactaacattattactggcaaactattaactatattgttcacatgtagccagctaatacttcaaaataatgtgagaaccagacacattagaagacagtacaaacttacaacagataaatcatgacagatgatgaatagaaacatttcactgctctttcttttcccccctaattgactagatggcaatatagcataaagccttccattcgtgagtcatgacatcatggaaaaccgtagaatcttacaatggtaatatgaaaaaacgaaaatcatgtaccctcaaagagagactcagtctcaaacagacccctgcaactaatgtttcaatttacctaagcatgtcactctagtcagaaaagaacttccattattttggacagatgaaaacatgagcatgtccgcatgtctttatttgattgcttcctctactcgttcacttatattcactcaatcacaaaatatacatatgaaagtagctgcaatgagatatctagattaaatacctattgcacaagaagttcccaaagcggcatgacaacacacaatccataaagtcaacaaggaatttctgcagtgaaaagcagttcaggttataaaaattcatgaagagacctagtttcagcagagtaatgcagctgcaaaagaggagacgacttacagatgagaactcaaatgcagatggatacaaacgtaacaactgagaaatacaatccagccactgaaaaataagatatgagtgttctgaggtgggttaatacaagttttgagtgatacagaaacaattgatatcttaatcacaagatattcactgcgagaattgccaaatggataatggttcgcattgttcataaggaagattattaaaaagccagaatgcagtcacttgaatgtagtagtcactatagcaccgcctgttattaactaataatttcaatataaaaatggaaaccatctgccatgcatgatttgcgagggcgtgcaacttaatcctaaatgctgagcggtcttcagactcttcagtgctcagtttgtacaatacaactccagaagagtattagcttatgcttaccctcacaaaagagtataacatctgccatacaggcaataaggaaaccaattacagaatcagaaaaggttgattgtgtatgagaaaataaaagaagaaaaaacattattcatttagctcactgttggcagttgctgatgcttgtttatgaattgaggtacattgggagaactgagactcagttacatcaaataaatttgactggaaaagtactgttttaacacaggggctgcagg

SEQ ID NO: 63334 - DNA, 10770 bp, Oryza sativa
  unsure (1)..(10770): unsure at all n locations
caaccccgttaattagctggagcccggcagccggttcaaggtctggactctgcataagatgcccggattaagaaatttgcctcagctttcgtgaggttgaagattcccagcttcccaggcttcgctctcgggatgcactactctgctaccttgtttgcagcgagcactagtcgcattcgctggctccagaacccttaaagatgcttattgactaatccagcttaccgtccctaggtttcttctggtacatgtcaacagtagaggtgaacagggcagtatgtatcacatgcatttctccttgacccttagagattcccttcctggccttaatttttctctgagaagtaaatactatgtatgggattgtttggttcattgccaatcctaaccataccaattgttttagcaatggcaagaattggttgtgaccatttgtttgttttggtaaagattggcatttggcaaccgtttttgtttcgtatgctaccacaaaggtgtattttggcttaggctcaattcaaccaaaccaaataaaccgtcatccttttttcatttttttttgctataaaccaaatagaatgacaaatattttggcatctccaaattttcggcttggtcgagattggatatgcgaaccaaacaagccctatattcccttcgctctaaaataagttaatttatggtcataaatctagacacataagtaaatttttggctataaacctggacagtggtgtctaggtttatcgacttattttggtacagggtgagtagtcgtattatcttcattcataaatatattattattgagtaagagtaccgctgctcttgtatcatggagtgtctttatttttatacgagccacgtacaaaacaaaaagaatctcaaggcagtgatcaagtacaactcacaaggtacttctagtgaagtagagaaggaaaacactactaaattactaaagtgctactagctaagctccagtaaattaatttgctaaaatctttactgaaatcaactactaatgtatagtagaatcatggatgcaatcattgacaagatcaggagggcaaaagaaaagaatgaatgtgcatatatgctctggctggatgtgctcatatactacgatctctctctctttaaatctgtttgtttctttgatggatgttctaattaattaactatagcacttgggcatcatgctcctagctagttaattggtcctccggcagttagccctgatctcgccggcggcgccggtcttgacgtcgacggcggcgagcttgttgagggcgtaggggaacatggaggagaagaagtcggtggtgccgaggaagttgaccatccaggcggtggcggcgtggtcgccgagcttctggtcgacggcgaggacgccgcggcggtggaggatctgggagtagtagctcttgtcgacggtgaggatgctggaggggtcgtccaggtagacgatgttgtcgaaggcctggctctttgggcacgcgaacgtcgtcaggatccacacgtatatcgggtccatcgacgggtccgcctcgccggtgccgttgaagttgtacagccggtcctttatcaccgagcagtgtgtcacccccaccgtgtgagcccctgcacatataatatcatgatgcaattttattttagaacagacgcatggttgtttgagccatgttacaatgcctgataataagccgtgaagaaatgaaccaagtaaccggaataagttatgggtaaaacgttattaccggtttaaaaagtaatgatgcaaaatggactatattaaatttaaaatctaaatttggttgtcactgatgaccaagaagctaatagcttgtctttgcagacacactataaacagagtatggtcatatcagatggggaattgacggccaagattttgtaaaggttgtaaccctaaacacagtggccactgtatcatcatttttatatataggtgtgtgtgtgtgtgtgataacggctgtggatctcactcttcccaattaccaatgtgtgccagctgatcaataaagcatagcttcagatctcgatcaacagaattctttaagtaattaaacaaattaacatgatcgatgaggaaactgagtatagtagtgctaattgagattgacggtagtaagtactcccacagataccatgaacccctttttaatgcgtagcaccggtatacgtgacattccatgtgtttagcccctcgattatatattctgatgcgctctgcccccggtcaaattacgccaaagtacttaaagtataaacacatgcacatggcctagttatctactagcttctttgattttgaaaaaaaaagaacagttaatcgatcacagttaagttcaatttgtactctgtttttctttttgtgaagaagtttaattagtactctgaagttgaattagtagtgagttagttacccatgaggatggccatgtcgaagctgttgaggcccttcttggcgaacatgtcgatggcggtggggatgtcgacgtcggggcccggcaggtccgccgccatccacgcctgcgacaccgtcccgtccagcctccccagctgcacctcgtaccgaggccctccacactgtttcgtcatcgcaaatttgcagaatgccaaaattttaatttggattttcgattcagaaatgacaaatatgaattggagtattggtttgagaaatgtgtgtgtaccatgccgacggcgtccctggtcgcggcgacgatgatgtcggcgcaggagacgacgccggggcaggccttctcgagcgtgtccttgatgtcgtcgatgaggtcgtagccgaagatgccgttgttctgcggcgccgtcttctccgtgtttggcccatccagcagtatcgacgcgtcacacccctgcaccacacacacatgtccagattgtagccaatttgttaaaatatagtacattactaattttgacaatttaataatattgttaagttttgacgaaatttcctgtgtatttatcagagtttagtaaaaaaactaaatggatgcacatatttaataactttaagaaaaataatatggtttgaaatgatatcaatccgaacaacccctatatacattcatcagttaatcataataagatcgaacacaaatttatccatcgattaattcagcgatgattcagatacagtattgattaattagctgatcgaactgatcttgattaagagagcagtgtgtatatggattgtacgtacggcgacgaagcagtcgtggaagatgaggtggaggaggccggcgaccatccgcttgtcccaggcgaggcgtgcctggacggcgtcgtggatgatgctctccacgtccaccgccacgctcgagttgccgccgccgccgttcacgcacttgccggcgtagtagccgctcgccagctgcgctcggcatcgccccgccgacgacgcggcgagcacgagcaccgccaccgccatggccagccgcggcacgccgccgccgccccgccgctgctgcattctcttgtgtaatccgctgtacgctatcgatttgtagctagctaccaacccttgattgatagatacacgcgcaagcaagcaagctcagctagctttctcttccggttaatatgatcttgtcgccggcgagcttgcgttgccgcactagcaatggctgtgctagtggctactactctactctaccttcctgcagctgactaagctaagctatacgcgcagcagctgcagctgcaggaggagctagctgctagctaggcagatggtgactttgctgcagcagaagcgaatataaatgtacaggctagctagcttccctgctgcttgatgtctcgaatcgaagcagcacacaggatggaagatatggaggttgggatcgaccggccagctatatatgtaggtaggggaggagaggagaggatcgggaacatgcatgattagaagaagaagaactgaagaagaagatgcagtggcagtgagattgcgtggggagtcgtgggggcgcgttcggatcctgtgctactgtcactggcactctgctctgcgctgccacacgtgcctgctttctttgctggagtacttagctcgccgacgccggccggacggtgcaaaacctcatagtaattcagtatacagtgtagctgtttgttactgttcgttacgagatgtacaagttgaatttgaacttacatgtttgtagagtattatatcacatgttaatacaccttctcaatttttttcataaccatttaagtgacatgcaaagaacgaggggttattctctcgagggattaaaatagtttcccttgttactataaacaaaattcagtatacaatactcatcctgtgtcatcccttaaaaaaaaagagaagagatcttatggagcacagaaatttgactgcattgtctgcaaaactcactctccatgtatgtaagccaagcgagctagcttaggtctctgtaatcgtgtgtcagcattgttcagttgatctgctcatcagcaactgctgggattccaggattctagtaaatttacgtcgttcctgaaattatgctaatagcgtgtataaacatacatcacatgaatccatatattcaccaccgactctcatctgtcttccatgtactatatgccatttttgaacagatagttatatagtagttccagctggatcaactcgtacggttttcaggaataatcaccttttacctgtactactagctaatgtacttactgaacaaaagcagaggcagtgaatctgtcttgatcgatggtagtaacatttctatccaactcctgttgcctctgctttagttttctgtggattgcggcaggcattgacccggccggtttcaatcctccaaatccattttactgacgcactacacaatcttcaattccctgatgcagtttttttttcaactgaacatgtacaccagctcaatacaatacaattcaatccaattatcatatgctttcctgctttacatatataaacctgattgatcacctcctaattatcacttgaccaatgtactcataagatccgcaaatgaaggaacaacgcggtcgatgataattctgcatgtgtgtgctctacctgcataattcaggccagctaggcaggcagatgagcaaattaaatcgtcatatcgatttcctaatatgttctgaacctagaatcatcatatcggtttcaagaacaatataaattgaagcacttctcaatattaacaatgtaattagctgctgcgcatgcatgcattccaggtgattttaaaaatgatgggagtcaacaatgaaatggttgcaccgaggagagggtagtaccgaagtaagcaaaacaagaagcttgagatgagcgtgcatgtgatcaactggtggctcagttggctggggcatgtgctctgattcgtaaacacaaacctcattactagtagtacattatgcctcccaaagagaagaggtcgccacctagctagtagcttaattatctgtaattaacttatgatgatatactaattgtatttctactactgcccagtttacagttgcagttagttgtccgaggtagatcaagctgcttgttattgcattcctagcattcattcattaatgcaccaagtagcttacttggtctgacagggagatggaaacaccggccttgcatttcttctttcaagtttcagctgacttctcacattttcagaaagcttagaccttccggccaatataatttcagctcgaacattaagggcttttgctgctttgttcaaggtcctgatctgatttcttttctgcaaccaactttcttatatagtgaagtatgtatataacttgtatacttcactcctattcacaagtcttctgtcatagactttgctagagatccacgcaaaaaacacttctctgatgatctattgtcgtagtaggcagtagccattagtatagtgttgtgagtcgaagctaccttaattattctcttcttctgttcatgcatgtgcattgcgcttagctagctagcaagatagttatagagtgatttggctagcgatataagctagggatatatctatattgtctctnnnntgatcagttaaaantgaancaaccaaacattcattcattcagtcgttggctcgcatatatacaacacaaacaggccgggcagatcagatcgatctgccacctaactatgaagaacatatgtactccggatcctacctgtatagatgctcatgcagtgatcctaccatgtgctcataactatatatatcctgaattaccgatgatgcatcatgcatatgcttggtgaataatcttgagcttttttgagcattacaccttcccctgtgatgttgatatcgacggatcgatgtagtgtagcaggatggccgatgctgttgaaacaaaagcccaacgactagattaaactactccctcctccattttaggttataaaacgtttttgactttagttaaagccaaactattttaaatttgatcaagtttatagaaaaaaatagtaacattttcaactcaagacaaatttattatgaaaatatattcaattattgatttgatgaaactaatttagtattataaatactactatatttgtctataaacttagtcaaacttaaaacagtttgactttgatcaaaatcaaaacgtcttataacctgaaacggaggaagtagctctctaggagtagctcacatgcaattccaatgaattcgccggcgacggcgaagagaagacgatgacgggaatggaatggagaggttccctcggtcgtttagcatctggcttggttctccttgcaggccaagcgggttcggagtttagttctccgaacaccccgttttctcaatttcttcattttttttcaagtcaataaggacagaaccataatgagaaattgcaaatggcttcaaattcaaagtttctacataaaatttctctctatctctctctctcttaccgtcatgctgtctcaacagtatattcaaataattacaaaccatctctgcgtcgaagcatctgaaatgaaatctgcaaagtcacctggtatacgctgaaaaccagactgaaattttttcctcacgcacctactccctccatctcaaaaaaaaaagtgaatttagtactggatgcgacatattttagtacaataaatctggacaactagaatatatcacatctagtggttggttttttatgggatggaaggagtatttgtttgggcttgaacaagatagtgacgtacgtgcggcccataccccaattctccctactactttgggctgaaacgggacaacaactatggagcccatatttatttcgctcatttctacgtacgtgcggcccataatagttcgggccggaaagggcttgcgagggaataaggcccattaatgcgtgggttgattctaatacccgccgccgccgccgtcttctccggcgagcaggagacccctcccgccgttcggagctcggacgctttctcgccgctgctcaccttccgttccctccccttccacgcgccgccgccgccgattctttgctccgtttggcggccgctgggccgtacgggagggggtgggactggatggagtcgtcggtgcggagggtgcagcagcgggtgaggaaggcgcgggaggagatggatcggtgggacgacctcaactcccgcctcctctctcagttcgcaaacgctgccgccatcgttgctcgtctcccggtatcctcttcctctcttctctgcaaaaaaagatatatccccttttggtggtttggagtacagttttactgtggttgtagagaaacaacactactcggtgtggcagcaattcttttctttttctttattttgacacggcagcaattcttttgttgacaaagaaatttaatggacatgtaacaagcatttagttttgtggtagcatcatgcattggggggcagatttcactaatgtaatgaaattacagattcagttagttttccccctcggataactgcagcaagttcagggctttcagctagtgctgacaggaccacttctagtattttccacctgcaagttttttcaagctagatggtcggttgctcatgaaaaacatatcaattgataatttggtagacacactgtaattctagtgagcagtaaatgcattgtgatattagctgcgtgacaaatcatatgttaaaaggtgctggaagaggttaagaactatggtgtcctacgatgtgtccctaacatcagagagaatcttttgggtaagcaaatggagagtttggagatcatcttcgtctctatgagggagacagtgtaagtggctttgctgctgttgcaatcccttttagtttcggtgtgacactagaagcagacggagaaaaaaaaattgatctgacgttgctgctgttgctattgttcagggaggaattcaatagcattgccagatctttacataaggctttgcgggatactaatcaaatggtgagaggtgggtctgcactcagtgcaaaacagatgcagttacaagtgggaattttgccaactatagcagactgcttggatgggctacggactttatgtgaaatgcaccaggccgagtaatgacctaaagaagacccccccccccccccctttttttttgctgttgtgaagctcattgtactgaacctcatccattatagttgaatcaaaattaaaccaaccttatggccgtcttacatatatgcaacaccccaagcactgttttccatttcaccaatactgacttcagttgcagcacttagtttgctatcatcatatattaagatgctctttattctgacgctgcacatattactttttttttctgtactgaagccactccgtgttgcggtcctctgaattgcctaaattccatttgacaggtatgcactaaaatcatcagtcatctcttcgctgacatggacgagcaggtaaaagttcaactatttgtttcaccaaacatctatattcctatctgtgtgctctgtatggagttctgtatctgcttttagtttatccctgaattatcaattcagacatgtttgtcagtcttcactaacttgaatgcccatggtgctctttctttgcagttccagtgacattgccgcgatgcgtcaactcttagtagaccagccaaacataccaaaagatgaaggtaaggaatgaaagaagagagaactaaagttgtcaattaaggtttctagctatccaatttatgaggctgacagttacattccaatcttgttttgcagtgcaagctatttttgacattatattcgcagatgaaatctgttgatgtacttgcacgattgctattggaagcactatgccctggagtcctggacatgttgacatcattatgttttgatgtacttgcatgcccagatggccagatgaaccaaagatgctgatgcactgtaacaaagctggaattgctgtgtctggctgccagcaagagagtaggatgtaggagtagctttctaacatacactaaaatatcttccctttttttatccccaaattttcctagttctatgttaacagtcatgtcctggagactaaaatttatctttgactgaatgcacattttcatgtcctggagactataatttatctttgactgggtgtgtttagttcatgctaaaattgaaagtttgattgaaattggaacgatgtgacagaaaagttgaaagtttatgtgtgtagaaaagttttgatgtgatggaaaagttggaagtttgaagaaaaaagttgggaactaaaccaggcctgaatgcacattttatgtcatgaatctgtttcttgtgtgaaagacaaatcagacacatatgagcttctacgtctgtctcaaaatatagcaactagtatcggatagaaacttaggtaaatttcatttctgtgcatggtggttgcatatgaaatgatcctatgcttcaggttctcatgatcttggttgacctgcagagtccattagagccgttcatttttattttgtttttgaattggacggcccacgttgactggcggcgaccacatgcaagagtattttgtctgagtccgccgcctccgcccacagattacttcccttccccgcccgatgtccctccccgtcggctcgccgccgccgccgccgacatcgccgccgtacaccggcatcctcgccgccctccaccgcagcatcgcaggaggccacgcggccgccgcggtggccctcctcccggagctctcccgcgccggcctgcgcccgcccttcccgctcctctcctcgctcgcccgcctcctcctgctccgccgcgccacggcgccgtgcttcccctccctcgccggccgcctcctcctctacgtccgcctcgccggcctcaagaggctcgtgccttgctccacccagctcgccaaccacctcctgtcgctcaacttcctcctccgccgcccgcgcgatgcgcgccgcctgttcgccagaatgcccctccccgacgtctgctcctacaacgccatgctcgcggggtacgcccgcctcgcgctcgcggcccccgcggccgaggtgttcgccgccatgccacaccgcgacctcctctcctataatgctactctgctcgcgctcgccggcggtggtgagatgcagaaagccgtggcgctctactccgagctccgcggcacgtcgacttcacttgggtacagtgatcaaaccttcttggcactccttgtaggctgtgag

SEQ ID NO: 63335 - DNA, 1451 bp, Oryza sativa
tcatctgctccacctagacatcaccatcgtgtacaccgactggtatggcggcacgtcttccagcttaagggtggacgtggtccaggtatacccacgggcctcgttggcccgtcccacgattttggcatcaatgggcagatgggtcggtccaaacaaaaacaatcagctctacagggtacccgggtcggcttcattaggacactgaacaggctgagcgcgacaccccttcctctggcggtggtggcgcgagcgccccttcctctcaccgtctcacggcggcggcgaggcgcccatcaagcgcggaggcggcgaggttcagcttcctctcatggtggcgccgctccatcgtgcctgtcggtcccccttccccactagcaccagcgtcaccgctggccgagccgcgcctcttcactaccatcctgtcgtccaccaacctccttgactccctacttgctaccctcctttgccacctctccctgcgcctatctccgccatctccttcatggcgatggcgacacgacctcatctagcctcgatggcggtctccatgtcaacagttcctcctgtgtctggagatggtatgttccaactagccaacaactcctcttttattgatttcaatccaagaaagcatgtttttcttcttaatttcgatctactgtttccttgccaagtattggcggattgctagctaataattctgtaattcttttgtaacgtgggaataagttcatacaaattgaattttcagtttcagcagaaatttttacagttcagttttagcagaacacttagttcagtttcatcagagagtttcacttcagtttcagaagaaattttaagttcagtttcagcagagattttatttcagttggctgatttcttgacaaatgtgcagaccagagctctgcacaatttcttcctcccacccttctgttccttttttatgctccttctgtgttttctatattcggcctggagtcctcatgttgaatacaagtgttatcttggtatgagattctaaagttttgtgtattacatctgtgatttgtatggattgacagagttgtgtgtattccatgtttgaaattgaatattcggcacttggtagaatctgatgatgctttgttgttcatcacgtgttaattacaaaaatcaatgatagcacatactgatgggccgacccattctacccaatggatccaatggacaatgggtcgacccactcggtattgttataaaccatttgggtaacatggtctaagtatgggtcgacctgtcccggaccacacccacccatgttccagctttgtggatgcacgagctcattttttttctttctttctacatatgcagtggctggctggttgctgccgtgccgactgctactgtagtgcaccagtagcatttcatttgaggcttttcagctgcctgagcattataaagaatcc

SEQ ID NO: 63336 - DNA, 5882 bp, Oryza sativa
agcactaaatttatctatcttagaaatttcattagctagcgacaaaacatgtttgtcctgtttctaatccaagttttaagatctgttgggagtggttaacagcctctagaaggactgaatgtatgtaactgagggtacataataacagatatgaatattgcctccatgtggaaaatatattttctagaaatatacatgtttccatccatattgcctccacatgggaattaggaaggggtatttacctatgcttacgggaatgagaatagaagtgactattggctattgcaatttattgagagggatactgtgatatggtttcaagttaaatattttaaggtttgacgaacaaggagcttgcttcctcattgatatactcatggacaactaactattgtctacaaaccttcatttcattacctgtgtaatatatattcttactttcctactcacatttgtttttcttgttatagactcttgaattgccatcaaaatacccgaatatctttaccaaggcacctgtaaggttgcgatcaaacattctcctctatggaccatctggatgtggaaaaacacatattgtgggagctgcagctgccgcttgttctctgcgattcatatcagtcaaaggtccagagctattgaataagtacatcggttcttctgagcaatctgtaaggactcttttattttttatcgctgtgatgtaccattctttgtcttatgcctttttctagtttcagagacatttgaagggctagtaactgtgacatttcctgcaccttgtattactcagacctgtcttaatatcttatcttatctgtgtagctgtagttatagaggacatagaagaccattgagattaatatggttctgatattcttcttttacatggtcatggttctgattttaataatctgattccaggttcgtgacttctttgcaaaggcagctgctgcagcaccttgcctactgttctttgatgagtttgaatccattgcaccccagcgaggaacacagagtgcaggagtttctgatcgtgttgttaatcaagtaagttgcctttaccattactgaatataagttttggatcggtctatagttccaaaagagcattattttttcttgttataatcaagatcatatttatatatggtttgtctgcagttcttgacagaactagatggtgtagaaagcttgactggagtatttgtatttgctgcaacaaggttagctctcaaagcataagaagatgtagttggtgcagcatgccaatcaattttaaatggactgcaatgaccagtcgcaaaacatcaagaattagtcagcatggaatgaaatgctatgaagactgaaattttactgatgagaataagattggaactaaaatagcttgattgttttcctttaatttttaatggtttcatctttttccttatgtgcagtaagccacaatcaattgatgctgcactcttgcggcccggaagatttgaccgtttgatcttatgtgattttcctggatggcatgagcgtttggaaattctgaaagttcactctagagaggtgagttctcatttgccattttgtcttttgttgatatttttaatcacgggttttgccatctgtgaactccttaaattattgatatcttaacattctcattgttattgatgatgcattttcatttttaatatcttctgttggtcacaggtttcactggcaagtgatgccagtctggaagaggttgcttctttgactgaaggatttacaggtgcagatcttgcagctattctaagagatgctaagctggcagcagtgcataaagttctggaggacagaaataatggtatctcagacacacagccatgtatcagcaaagaactcctaatatctactgctagggaggctagaccttcgacatcagcagaacaaaaaatgcagtatgacatggacttcggtcaatttgtatcgtctaggaagtctgtttcaacgaaggtgcggttcatgctccattttttggcatataaacaatgcgtttttcaactgaaaattccaataccgcatcttattgatgctcccttctgtcggtgtttgatgtttcttgcaataagattcttggacagctactgaaatatttctttgcaggcaagggaatctaaaggaaaaaaggtcacgctggcttgagtctctctgcattggacaagtaaggccacctcttcgatctgttgtcttcatggttcttaggaatccatgagatatgaatttgttgagcatttcaatgaaccttgatgtttccccctctttgaatccaggtacaattacgttatgttcattggcgcagaacaagaatggcgagcgccttttttctgctcggcaaatctcagttttgacttaccaactccacccctcttctttgagaaagggaaagaaactcattttgtagattgtagtgcaggcagcgaggggctgtgatgatgtatagcattgtgccaaattttgatacgaatggcttcttcttgtgcagtacgaaatagaaatgctgacagaacgcgtgtagcgtttgaatgaacattgggggaacgtactgacgtatctaatgctaattgtgtcgatatactttatctgtttcacattataagaaggttttggttttgaatagattcatgcatgaatccatatatgtgcttcatatatatgttgaaattcatataaatgttaataaatcttgacgagggacagagaaacaaaaacgtcttataagataaaattcatataaatgttaatgaatcttgacgagggacagagaaacaaaaacgtcttataagataaaatggaaggagtaaatctttatgtttttttatgcaaagatctggtcttgatatgatcaaccttgtgcctgacattgcaatgtgtttattgtgccaagaatcaataatatagtacatgcttaaacgcaaatttcttacacaatttgtaatctgaatttgaatcgagagggacatacattgcccttttcttttcccccaccaaaaaaccaggatagcgctaccaatggcagcgatcagaattcccgtctgttctgaccgcccgatctagcacgtgcggttgagatcgaggctaagtacggtttaacgggtacatttccacccagcccctccatttacctcatattatcgaaatcccacaagcactcagaggtggggtggggccacatcgtcagtgaaacggacgggtatagggttagggagttgggggatcgggaggaagagagtagggagacgagaggaggaagaagaggcgggcagcgaggagggaggagatcggcggcgagcggcgagaggggaggagaaggtaggttgcgatggcgtccgggtggggcatcaacgggaacaaggggcggtgctacgacttctggctggacttcagcgagtgtatgagccgctgccgccagcccaccgactgcggcctcctccgggaggactacctcgagtgcctccaccactccaaggaggtaatcctcctctctcctctctcctcactcctcaatccatctcccacccgcccttctcggtttatttttgatggatatgcccgcctcgccaaccacctagatctaccatttacagttttcttgaaggggtggatatggattgttcttgggattaacatcacccgctaattgggggcactgcatttgattggagtagtaatcgtatttcgaatccattctagtatgatatgattgttggaggttgggattccatatgctttcatttccattctgttgtactccctctggtttcattttaattgacgttttggacaatgacacggtctacaagatatatctttgatcttatttttctattataatatatataataaataaatgcatgtttacttttattatagtgctttaaaagacaaatctatatatgttgttctagttcctttaaactaaatatttttaaagttattgatggtcaaagttataaaagtttgacatcaatcttgttcaaaacgtcaattaatatagaaccggagggagtagacaaggttgttaatagtattattggtctctccttgtctcttaggatagcccaatttcccatttccaagtgatctctgaatatttcggagtgtctgttgttgcttggataactagttcagaaaatccctggttggttccagaatgtgactagaatagaattattcattagcataaaggcacacaagtcgtaatactatttaacaagttcttattacttcttggcatgcatgatatcatcatattctgaattgtttcttgtgttttaaagggatatatgcttgccctgattccttacagcaaaataaaatttatggattcatgctagtgcatagcttccagtcagtgggagaaatgaatcaggatgcaacagtactctgaattatattgttctagatttccatttcattctattagcgattctaacaaccaagatgacctgatgcggaaatgtatgattctctccaatgcagttccagcgcaggaacagaatctacaaggaggagcaacgtaagttaagagctgctattcgtcgtagggaggaggcggcaaaggagaaggctgagggagctcctgctgtttcagctcagcattagccactccgataaaattcatgtgtgctttttgtttgctgtcaaaactttgttctactgtgatgctaagagcaaggcaataattccccaccttcatgttggactacacaaactcttttcccctctcactccatgactttgatctgtatcaaggcgttgcataaaccatcatggtgatgaagttttcgtgcctgttttggataattttgcgataatgatggttggttcgatcatcatattttgcacgtttattgctatcgctcttgatgttcttataggattgacagcgcaacattggttttgtcgattgtacttggaatggtcttctgactgttgctttgcatgctcgttctattataattcttgatggccacttttccattccatgcttgggttctgaacttgaactcgcgatcacataaccatggggatgatcttgtttttcagcatatttcgctgcaaatgcaaacagcatgtggtgacggcaataaattgatttcaaattttgctgtgcaatcatcccctgttgcatttattgttttttcccgtttgattcagtagtcttgtgtgttgactcgtttctactcatacatattagcaaaacagggataaacaagtccctaaattatcttccattgtttcctaggtctcaaaatcgtcttgcaagtgttaattttaacctcaagatatcgctctataagtcaattgatctcacaaaacaaggctacaacatttgtgcaaataaaatataattaaaataccgaaacaaaagaacgaacaacatagctggatagcccccgtcatatcacattttatttcaaccaagcaggatacacattgtttctttattcccaacgtaactaaaccaattttaatgaaaataaaagaaagaaagaaatgtcccttatcccttttacatcctgcattatactgttaactgtatgaatctatctccttctatatacagctcgaaggactgattttcagtcccagtagctactaaccagttgctaactcctctagtgaagaacgcctaatgcccagttagagactattacagaggtattccaagaaacaacaacaaagaaaaaaaaagtgagcttggcgtacttcatggcaaaatggttaaaagcatgtatcatttgatttgctttccgcgcatatagcttgatattagtgcagctgtgcaggacttggaggcgccaacttgtgaaaaaaaagtattggcagctgccaagtgc

SEQ ID NO: 63337 - DNA, 665 bp, Oryza sativa
ttttacgcgactcaaggtggaagacgagtgcgccacagataggtgggccgctttgtagggagcgagagatgggccttttggccacttttccatgggcctgaaaaatagtgctcctactacagcccacctgatctggcccgtaggcgaacgatgaaggtgacatcactcgtggacggcggcatagcaacctggaggctgggggtcgaagtttaattctccgaccccatgttttctcgattttttgtttttgttacgctgtctggatcgacagaaaaaaaaatgttgttataaagattcttatttagacatttttgtttctgttacaatgcctggatcgacaggaaaaaaacatgttgttataaagattcttatttagacaattttattttgctgtgacccattgattgcagatcgtgaggtgcaaaaaatgagttttgggcctcaaaacctgtcgacagcccaatagctagttcctatttgaaagggaaaaaaattactttgactccctcaactatagcccgagtataattcatatcctccaaccacaaaactgggtatatcgacttctccgactattaaaataggtgcaaacaatatccctcggtgtttttggaggtggttttggctgacgtggcgcctacgtaggctaaacatagactaattta

SEQ ID NO: 63338 - DNA, 1350 bp, Oryza sativa
ctgctaaaccaaaggaaggggcttctttggcatatacccatggacaattcagggcatagtgtcctcgttctctacaatcgtgacaaaaggggacatcctcttctggcattggaagctcattgacctgggtggcaaatgctcgatcaaacacatactgattttggtcttgacttccaaccaatggtagctgtgaactaagcagcatgcttggaatggaccaagggtgtgcccttgttaactctcttgaggccagtggtggattgagttggaaacttaagttactagaggcatacccgctgacattctttcctttttctctgttaaacatctgtgatagggattgaggtgagagaggaaacaagccaggaaagaatagaccagaactagggacaggaccttaaaggaactaactcttcttgttgatgtgttgtttgtttcacttattctgcaagttgattaagcaaacaacctagcatggttacatcacacaccactgatgcaaaccacgcgctacacacacaagcaaaggagcacacgactaacgaaacactagagggtggcttaggttctgcgacgggttctccaagatcttcactcctgcttcacagctggcttcattgcttccttcgcttcgctagcggaccctgcggtcttccggaccttcggcgaacaattgacgacatcttcttcttcgtaaaactaaccatctagtactagctgaaatttgaagaaggaagaaagagtaaacattttgcaaatagcacaggggaaaggaggaaaaagggactttcgcaaatagtttcgtttataaaatatgtccttaggttttatccacttggcttatcctacagtcgagatggctctgataccagcttgtcgcgaccgagaaaattgccttttcccgaacgctagtgtattaatccccgtcccaggaaaagccggggtacaccacacaaacatgatataaaagacacatctttattatatcgataatatttacattattacaaaggcacctcaggcctgacaaacaaaaataaacagcagcggacttgcgggcctacggctccatcttcacaggcgctcaactggggtataagccaggactccacctaagacttcttctcctaagcttctcttactgaaggggggggaaaagattgagcaagaatgagtacaaccacagcactcagcaagccacaccggcagatgcatgattaatgcaagggggtacaaggggtaaaaatataggggttaagctttgcagaaaacagcatttaaaagtcacttagttgcccaaagccattttataagacgatcctagagttacacagtattaattaatcaagg

SEQ ID NO: 63339 - DNA, 896 bp, Oryza sativa
ttcttaataggttcttaatagatgacgctgttaacattcgaatatacgtttgactaattatctttttaaaaattttttaatgtaagtgtataagatatgaatcatgcttaaagtatttgtgaaatatattgtatatggtagttagatattaatatttgagtcataatatcttatactgcgaatatttgactcattgtggattccttcagttcttccatatctgtaatttttctttatcttcttcccatgtactcctatatgtacctgcctccgcaggcttaatacaataagtcaaatattcacagtattcctttcttcctataatattcaatatggtatcagagtgggcgatctagcgccgctcgaacgcttccgccactgctgcccctcctccccggcgaggagtagcgatctccaagggcggccatcatttttcctttattttttccatcgtctgcaccgttgcctggaggaattgattagagtcataatagaatatgattgatttgtgtgtggactccttcatatatgtaatcttttcttatcttctcccaacatacttctatatataccggccctataaaggcttaataaaatgggtcaaatattcgtggtatttctctcttcctatactattcaacaggataaaataactcacaataaaatagataataattaagtaactttttaataagatgaatgatcaaaagtgtgttaaaaaatcaacagtgccatctatatttaaaaattgagggagtacttattgtatatctatacaaatattctccattgttttgatttgaatagatatatgtacctatggtgactttaagttgaatagatatatgcattattttgattaaatttaacgaaatttctactttttattttctgaa

SEQ ID NO: 63340 - DNA, 32364 bp, Oryza sativa
agggagaggcgctcggtgcggctcacgcgcacgcgcgtgcggcgcacgggcagagcgagggaggggagagagagaaagagagagagagagagaaaatgggccgagagggaatcggtccacagaacctgagggaggcaaaatagacttttcgggaaggattgagattagggatttgaatttgacgatggattggggatttgagatttggaattggcacggaaactgacaacaagcaaagaaacaatcttcgcaaatagggtttttagaattaaaattttcccactaggcgccacgacggaacgggcgctacagaccaacccccctaacaagaatcttgaccccgagattcagcacgtaagggagcagctccggaaactcggcgcgaagatgatcttctcgttcccaggttgcttcatcttcggaatggttgctccattggaccttgtagaacttgatggtctttcgtcgagtctgacgttctgccttttcaagaactctgatcggcctttctttgtaggtcagattcttttccagctcgatattgcctaggggaacttgttcttctggaacacgaagacatttcttcaactgagacacgtgaaacacgttgtgcacatctgcgagaccttcaggtaacacaagctgataagccacttcgccacgtgtagcgcccgttccgtcgtggcgcctagagggaaaatgtaattcctaaaaacccaaatttcgaaatatgtttccttgcttattgtctagtatccgtgccaattccggatctcaaatccccgatcgatcgtcaagttcaatcccgaatccaaatccttcccaaatcaaatccctccgcaaaagtctatttcgcctccctcaggttcgttgggccgaatccctctcggcccatctccccctccctccccatccctctctctctctctccctctctctctctctctctttctccctctcccccgctctgcccgtgcgctgcgcacgcgtgcgcgtgagccgcgccgagccgagcgccctctgccctcgttgccgtttcccgccgacgccgcccaaatcgccgcgccgcccattgcttcccacgcgcgcgcgcatcatggtggccgaccggccagtcgccgccgccgtcagcgtctgccgcgcctgctgcccgtgtcgtcgctccgctccaaaccgccccgccgtcatcgccatcgtcatcgcctggccccccgccactccgcgcgcaagctgccaaaggacggaggcagagctcctcctccctctgccgcgtcgcccccgctccctcctccttttcccgaagaggcaaggggacaagcccccttttctctccctcttttcccctttttcctcccgccggcgtcatcctcctccctcctccctgtcgccgctttggccacgaccgccgagcgctagccctctcctttgaccgccctaagtcggttcccaaaccgacattgccatcctataaacccaagcttccccctttcctttcctctcccattcgcctccacgccattgccgccgcctcccgtgctctgttcgcagtcgccgttcgtcgttgcgcgtgtcggaggagccggcacgagcaaggacgcggaaggggactccgagcgcgccctctccttcctcttccccggcccgaggccggagagattactcccgcgccatcggcctctcgtcactgcgcccgcccgcacggtagtgcatctccccgttctccctcctcgctccatctcctccccttagactcgggtagtagcacgagtagcctccccgtagctagccggcgccgccccgaccgttgccgccgctcgccgtgtgctcgccgccatcgccgcccgagctcggaagcgccgctcgtcgccggcctcgctcggcgcagctccgcccaatccaacgctagcattggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagccgttggctcgtctcccctcgtcctgtgcaaccacccggtgtgctcgctttcgcctgtatcgccgtggttcgttccggccggcgtcgtcgtctatctcccgccggcccgcgtggcagccacgtaggcgacacgtcggcgccagctcggccaaaatcgggtcgggccgaccccggtcagcccctcccgtgcgcgcgttccaccgcgagccgtgaggcggcgcgtgggcccaccgcatccgcgtcctccgcgaaccgcgcgcgtgcaccgcgtccctcccccgcccgcgcgcgtgcgccgcgtgctcgctccgcacggtgaaccgtgtcaccgacaagcgggtcccacccgggaccacgcgtggtgagcccggtccactggctctctctctcctcccctcccgcgcgcgcgccttgggccgccttgggccgccttgggccggccggcccatttagctcggccggaccgctccatttgtctcgggccgcgccctagccgcccgaggaaaagtctattttccctccctcttttcttttcttttcttttctttttcaaaaaggatttaattaaatccttttcccttagacccaaaaatccaataatcttagaaattcaatatcttcccaaccgtaaatccgtttgactccgttcaacttccaaaattcctcaaatctcgagatctatctaatggcacgcttagaggtctttaatagggctttattttcaccgtttgttgagttgtcccgtttcacgtgtagtttcggagcccgaagacccgcagtgcgaggatttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattggcggacctacctaatttgttgcatttgatccttcctttgttaattgttatatcatgtccccttgtaaccatctagttgcgcctcgatattcgtgcaccctatgctagtatcgacggtcgccttcaaacttaaaatctgaaaaacttcttgggtaaaacttgggttttacaaaaggcttggaaaacccgacacctgggtcggtgcttgcgaactaaatgaatttccaaaaccgcggaccagggaacgtaccgggtgtacggtttcccgctcttgcacttaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggcttacgaaatgccttgtcatgaaagcttggaggtctcccgacgtggctgatccccatgggctgggtgatccgggttagtaatgtcgtgtgggtaaagtgtaccccctctgcagaggttaacaaactgttcgaacagtcgtgcccacggtcatgggcggatgtgaggtgattcctagcgtagtgttgttcgactactgccttgtgaaattgctgttgtgaaaaggggatcattgtttggaaaatctgcagctgatgggatcagctaggcccgggtggccatttgaaagttgttggcccgggtggccatttgaaagttgttggccgggtgccaatcttgatcaattctaaagactgatacatttgcacatactccgaccggacgagacgcactgtctcatccatgtcgtttgagaagcactcacttagttgctttcagaaaagagttcaaataaaatcaattgcaaaaacaacagcctttccttgaagcctgcattaaacacttatttcccatggcttgctgagtactcctgtactcacccttgctgtacataaataatctcccccccagttgctgaagaagatgaagcggatcccgctgacgaggagttcttccaggagcaagccggctacgatgagttttagggtttcggcctagttcccaagtcgcgcctatgttgtttggtccaagtcctggcttccgcttcccttttgtaatgcagttgtgaactcgggatctgtccgcagcccgacttgattgtactcctactctataataaagagacctctgttgctgtgatattctgtcttcctgtgataccagcactgtttcctgggactggtatcgattaacaggttaatttggagcgtcacgggctagttccggtcggtactagttcggggcgtgacatcagcccatcgacaagggaggcaaaatagatttttgctgaaagattttgatttggagagatttggagtttgggttttgaatctaaatttgatactttgtacacaagggttcaaggagtcaaggaaggaaacaaaacatgagtttggatattttgggatttggaaatttatttggcgaggattcaaaggaagagattgactttcggaattagattttagagacttgaattggaagaggaaatttgaggcggaggattttgatttcgatgagagggaacaatgggatttgaaaccgagatccatggcacgacttagactcgcactcaaaggacaaaatttttcacatttaggatttgccgaattagtttttaacgtctcacgagaagcggagcgttacatcaactcgtctcagtatcttaatataggatatctttacatataactaatggctaacattatctttcagttgataatgtgaagtaatttattcatgggctcaagtcaaacatgatgctagctgattttggtgcatacgagtggaacaacaaacatagcatgtatagtaaaaagaagggtgaatagctaatacgatccctgaagtttcgcttcgggcttaatttagccctcgatatttcatatcgtccaagcaagtcctccaaattaattatttgggttaatatagtccttagacccaaaaaaataccacatgagtatgtcaagtcatccttgcatgcagcggtttgaatgaaatgaccattctaccctcatatatcatgtagaaaagaaagagatttgtcaacatagatggtgatatcaataggattggaagagatttgtcagcctatgcttcctttgcaatgaagtctaaggcttggtttagttcccaattttttttcaaactttcaatttttttcatcacatcaaaactttcctacacacaaactttcaactttttcatcacatcgttctaatttcaatcaaactttcaattttgacgtgaactaaacacaccctaagacaagtgtcatcgcctactaaatttatatggttgtttgagttagcaacttagcatcggccaatatactaatacctcggtcccacaaatacttgtactggtagaaatgaagttttttgaatggagggtaattaattaccgaaggagaaaaaaagagaatggcttggctcgactatgatcacacttttcaaaccagaaaagtatatgaattcccgcaaaaaaaagaaaagtatatgaattcttgtccaagtatatgaatttgactatccaaaccagaaatttcatccaaatatagcttgccaatcaagtcaaacaaagaaaaatcgccctcttcaggcaaactgctgagttcaagtgcagactaatctcatacgatttgggggggccttagctccataaatacacttcgtctccttcggtccttcctcctcaacaccaaccagacagaacagaggacaccgctcacaagcaaatacagagtcgagagtgagacttgaggcagaggccatggccggaggaggagacgagctgaagctgctgggcatgtgggcgagcccgtacgttctgcgagtgaagttcgcgctcagtctcaagggcctcagctacgagtacgtcgaggaggatctcatgaacaagagcgacctcctcctcagctccaacccggtgaacaagaaggtgcccgtgctcatccacaacggcaagcccgtctgcgagtcgcaggtcatcctccagtacctcgacgaggcgttccccggcgccggcgccaccctcctccccgccgacccccacgaacgcgccgtcgctcgcttctgggccgccttcaacgacgacacggtacgtcggtaccatgtcacctcacatcgcgatcatccgcatcgtctccgactcttccgtttttgattcaatttgatttgttcgcagctggtggaggcgtcgcaggcggcgtcgtgggggaagacggaggaggagagggcggagggggagaagaaggtggtggaggcgctggagaagatggaggtcgggctgagggagtgctccaaggggaagcccttcttcggcggcgacaccgtcgggtacctcgacgtcgtgctcggcggcttcctcgcgtgggtgcgcgccaccgacgtgatgcgcggcgtcaagaggttcgacccggccaccaccccgctgctggcggcgtgggccgagcgcttcgtggagctggacgccgccaaggccgtcatgccggacatggacaagatgatcgagttcggcaaggtgctgcaggctcgcgccgccgccgccaccaactgaagtgacagttgacttgtcgtgtcatgccgaagacgaacggatgttgggattgtttccatctgtttcacagtcgagtgtcgtgtacgttacgagttcagatgtgttactacagtagtagtaacttgggttgaaaaaatatctagggaacagtttgtccaaggtaaaatgttataaaccgaaatgaatagtgttaattagagaaaagaaactagtacaagtggcgtctgggtgagaaaggtctttacaacttaataacatggcccaatgaaaataattacagatttggctgtgaaaaaaaaagagagaagactatactgtgcgggacaatgaaaaggtacaccaataatatattagcggtcataatctaataacaatgcctattcgtaaataaattttaccggcattaaaaagaaggtaccgagagataataaatttgatacgtgggatactgagaggcatcaaattttaccagaaaggctatttctctttggtacctttttaagagagtatcgaacattttaagataagtttatgcatatgtatgcatttaaaataaaattgtaacaattattggggaatgctatacagcacgagattgtgctatttcactagatataggcgtaaaaaaaatacatcccctagaggcaaaaaagagctgtacaaaattacataagcgttgtggttaagttgggaggaattctccaagtcaccttgtgcctgccattattcaggttcttgactcttcctttatttttgccataaggttgggggctaccgtttccttgtgctcgaagatcctttagttcctttctttctagatttcttaggctatgagtaggattaaggatcgcagccctttcttgggcactttctttttgttggctagcatttcccaccattcatgtacgctttggcatggctcccaattgctcaggtccaattactgataagccacccagccgaccatcagtctccagatccttctggtgtatctaaaggaagctaataggtggcatgtcgtctcgttcgtcgtacggcatagggggcacactccgctatttggccatcctcttgtagctagtcgatcggaagtccagactctattttgaattacaagccacgcatagaatttgcattttgcaggagcccaagatttccaaattaggggattaaagtttgtgccgactattcctagacactgagccttgtatgccgaagaggccgagcattctccatgattcgagagcttccagacgatgtggtctgactcattttggtttagtatgatgtcctgggttgcgctccatagggacacaagttggctgatcaggtccactgtaaaagtagtgttcctatttagctccaggtcatcgatccaggtgtcattttcaatgccttcatgtagtgatttacttcttttcaatatgccttcgtttaattttttagaccaggttagcggatcacatgtttcaatacatctgaatatgggagcgcgcattcaacgagccacgcaatcagtatactagctaccccgtccacagaacacgaaccaaaaccatttatttaaccatctcaaatctcaaaacctcactcacacgattcacagttcaccaccaagctacagctagaagaagctaatggccggagcaggagatgagctgaagctgctgggcatgtggacgagcccgttcgctctgcgagtgaagcttgcgctcagcttcaagggcctgagctacgagtacgccgaggaggacctcagcaacaagagcgagctgctgctcagctccaacccggtgcacaagaaggtgcccgtgctcatccacaacggcaagcccatctgcgagtcgcaggtcatcgtgcagtacatcgacgaggcgttccccggcgccggcgtgcccctcctcccctccgacccctacgagcgcgccgtcgctcgcttctgggccgcctacatcgacgacaaggtgattcacaaattgcctcaaatcaatcgcaacgccctgtcttgaatttgcatcgaatcaataccaaatgacgatgtttctggtgattgattaactgtcaactgctgcgcttggtgcgtcgtcgcagctgttgaagtcgtggctgcaggcgtcgatgggcaagacggaggaggagaaggcggaggcgttgaaggagacgttcacagcggtggcgaacctggaggcggccttcgaggagtgctccaaggggaagcccttcttcggcggcgacgccgtcgggtacctggacgtcacgctcggcgccctggtcagctgggtgcacgccggcgaggccctgtacgggatgaggctcttcgatgccaccaggagcccgctcctggacgcgtgggtggaccgcttcgccgcactggatgcggccatggcggtcttgccggacgccggcacattagccgagtacgccaagaagaggcaggcggagcgggcagccgccgcggctgcgaacaactgaactggcatgcaggggccgtggttcgcgacgtggttgggcctcgacgatgaatttggtgtcatggtgtgccacttgtagtcccgtcacatgtggcgatgtgggctttgtttgccacgtgaatttgttgtctgtctgcgttcttacggttggatattgttcgtgtggttttggttagcccgtttcttccaataaatggaattattaatttttagaggaacaagagtgaacattttttttttcaaagatgacgaaaattattacatcctgggcttttacataaggaaaagtgtagttggactaaatcctagttacccttaagtaataaaaacaactgaaagccaaaaaaatcacacaaattttaaggatttagcaaatatatgttagctacctgagccaattattaaaacattttggtttattattaaaattggtagtgaatatgtctcttgcatattgcgaaaacaatatttctctcgctaaaatttattgaaatggctagaaatcaagtaattttaaagtggccagacgagacagtcgtgcccgctacaggacatgggtgcctctgtgatggcacgacagagcctgagctggagccacggatatgatgtggcgagctaatgggcactcgccatgtgcccccactgtaaatggccttattgcaccatttcttatgtttcctcttttatttctccaagaaaggatggaagacatgactttctcggttacttactaaaatgcttttagaaaagaaagaaaaataagtaagttgtagtttgtaattaaacaattagcccgatcaaaagtgtccacacaatatttctgagtatatgtctttttttttccttttagttagtattctctttcttttttttcaaacttattgtttgaattcatttttaattcatcaagtgggccacatggataggggagcaatgggagacgcgttcggcacaacaattgtgtgcaggtcccagttggtgaggatcttctagcataattttttatttttgagaatttgtttttttttcaaatttgaccaaattttgttacaaaattccaataattttggactgaaatttttcaaaattttggaaatttcgccgtaccccacctctggatacaaatgccaaaaacgaaatattgaaccctgatcccggcatggtacaaaccacctattagagttaggtaccccatgcagatgcattttaaacagcccaaattcggctaaaccataccacacggatgggagaatttggggaaaagtgaatcaaccgattgttcctttacagtttacagtcatctctattgtagtattgcatcacagtataaatgatccaaacctattgacaatttcatcttttgattatgtggccaactatatattaataactttggggaatccacataaatgacacttcctctaaattttaatatatgatgtcgtttactttttgacatatgtttgacggttagtcttattgaaaacttatgcacaaatatgtgaaaatgtaagtaatgagtaaagtacacttaatggtaaagcaagttataataaaataaataataattatgtaaggtttttaataagataaatggtgaaacatctgtaaaagaaaatcaacaacattatcatttgtttagaacctgaggtagtaaaatggaacctagtcaacttaattcccaaaacagcagaatctattcgtttctgaataatctcagtctgcattcatcgatgacatcatggatgatgcattggcacgccgcaggcatcatggatgatgcatcgatcacccgccaccctccacttcaatctggagcaccatatatacatcaccaccctgctctgatcaagcatccaagtatacgcagcaaaacacaatccaaagcgtgttcatccaatcattctctgttccgctctctcaccccagcgagatggccggatcaggagacgagctgatgctgctcggcaaatggccaagcccattcgtcaccagggttgagctcgcgctcggcctcaagggcctcagctacgagtacgtcaagcaggacctcgtcaacaagagcgagctcctcctcgcctccaacccggtgcacaagaagatccccgtgctcatccacaacggcaagccggtctgcgagtcgtcaatcatcgtgcagtacatcgacgaggccttccccgacgccggcgccggcgccgccctgctccccgccgacccctacgagcgcgccgtcgctcgcttctgggtcgcctacgtcgacgacaaggtaggatagctaagctacctttccttcatttgtgtcacagttcgagctgttatctcaaaacacaaatattagggaatgatctaatatcaaataattcgaaggatgatgctctaaacccaaatcggctagcccactaccttgtgaaactagccagaaaactcccgggcatttctctcgaggtttttatctcactgatgcgatgatgtgttgggtggcgcgtgcgtgcagttcgttccggcatgggtggcgacgttcagaggcaagacggaggaggagaaggcggaggggatgaagcaactgctcgcggcggtggagacgctggagggagccctgaaggattgctccaaggggaagcccttcttcggcggcgacacagtcgggatcgtggacgtcgcgcttggtggcctcatctcgtgggtgaaagcgaccgaggtgctcgctggctccaagatcttcgacgaggagaaggcccctcttttggccgcgtgggcgcagcgcttcggcgagctcgacgtcgccgagaaggtgttgccggatgtcgacggggtggtcgagttcgctaagatgaggctggcagaggcagctgcggctgccgcggcggcttcaaaaaactaagatggatatgtttggttatgtcgtggtaactcccattgtttgggagaaaataatgtgcttgttggaaaaattatttgggagaaactaatgtgcttgttggaaaagaatagatttagttgatttagtgttttttctgtatcagtatcttgatttatgtctgaataatgcaaggaatattcaatgaagtcatgaagatgcttgtcctctgtttattcagtagttaggggatctttttcttctgttggtgtctattagtttgtgtttgcttagctttgtttatactatcgtgaactttctatataagtttttttctgtgtgagttctaaaataattgactataactctttaagtaaaggccggaatgttttattctattattaaaaaaaaaatgaagatgcttgtcctctgttttctctgttactcgctgttggccctgttgcccttcagagattttgcaacttgcacggttgttttgttctcctgtatttatccatttccttcattgaaaattcggcagtgtgtagtaggaattttttttccatcactttgtctttttttaccattcaaaagtttattggttgggtacctacgacagagacagggacgtaacccattttttttctttataaaagagcctatagggtgaagttttatctcaaatattgtggattccgcccccattccttttagcttgtttatcatatcattgttgcgatttatttactccatatttctaaaagtatgatttctcaaaaaaaaattcttatatggtgttagcagatcacttgttgttacgagctatttattaattttattttttattaaagtacttaattatcctgatagatatctgtgatactaattcggtgaataatttgttccaagcattgcaactactcataccatttaattattcagatgaatcgtatgttctatggtgcttgtacctttaattttgggaacttttacagtatatagtggtaaaatatatcaccaatataaataatccaagagtttagattgatttgttctctcacttaaatagtttgtagtataaaattaaaagggtaaaaatattttcactattgggtgtaaattcgtagaatatagtgtgaaacaatactacgtgttttcactaatcgatctcattccttattcctcatcatccttcaccacgatgagacgccagcagccaccatgagtccacgcgcgccaacaccttcatagccaagtaagccaaccaccacatttttaatcttgtggcaaaattttaaaatatttatattatattgacggtatatattttcttgtaattttacactagggatgtatgttgacatctttagtgatactcagggccggatccaggaaaaaaaattagaagagttcagttacatagtttattcaatctccaaccatttagaaacctttaatttatcaattatggtgaaaaaatcgaagggggtgttacggagatatccatgggtcttatgagtataggggagactccacgttggatccacccctggtgacactctcttattcccaaaagccaaaatacatgcatgcggataattgtgaaataatttgcgaaaaatattactaaggttttgtaatcatttcttgtgccccaatgcacaaacacccacaagtgcccgcgatgtccatgtcatccactgccactggttttgttcttgggctctcaaaactcacaggtcaaagtaaacgtactttaactggtaaagcaaagcgatactatgacggggagcagcgccatgatctgtaggtttgtttaatttaatgccccagatcctaagcttcctcttctccaagaaagagtagaagacgcatcttgacagtctcagagatgctgactggagtattttcaggaaaaaaaaaagtgtactccagtttgaaaacaatcagcctggtcaaacgtgtcggtgtcaccatatccgtttattattgatttatctgcacatgttttgactaaagttactgatcgcatgtttttgaatacatctgaacactgaaaagagctttcgacgtgttaaagagtagttgtggaaacccctatttcaattgtgcaatcaagcatcactcgtgacgcactactagtcttctatagcatatacaaatattcacggttcgtgttgtgctccgatcaagtgctagctagctagcaaaagacaactcaagccaaaaccatctcagagcttcagagaggaagacaatggccggtggaggagatgagctgaagctgctggggatgtgggcgagcccgttcgcgctgcgagcgaagctcgcgctcagcttcaagggcctgagctacgagtacgtcgaggaggatctcaagaacaagagcgagctgcttctcacctccaacccggtgcacaagaaggtacccgtgctcatccacaacggcaagcccgtctgcgagtcgcaggtcatcgtgcagtacatcgacgaggcgttccccgacgccggcgttcctctcctcccatccgacccctacgaccgtgccgtcgctcgcttctgggccgcctacatcgacgacaaggtaatcgacgaattgcctcaacccaatcgtcttgaatttgcatcgaatcgaaaatgacgagatgaactgatgcgttgtgtgtgcatcgttgttgcagctgttgaagtcatggctgcaggcgtcgatgtgcaagacggagcaggagaaggcggcggcgatgaaggagacgttcgcggcggtggcgaacctggaggcggcgttcaaggagtgctccaaggggaagcccttcttcggcggcgacgccgtcgggtacgtggacgtcacgctcggcgccgtgatcgggtttgtgcgcgtcggtgaagccgtgcacgggatgaggctgttcgatgcgagccggagcccgctccttgacgcgtggctggaccgcttcgccgcgctggacgctgccaaggcggtgttgccggacaccggtaggctggccgagtacgccaagatgaagcaggcagagtgggcagcagctgccaccaactgagccagcatggccacgtctggtactctcgtggggagatgaagttggtgttggtgtgccacccgtaccgtacgtagctagtcctgtcacacgatgtgacgactgtgtgaactttgctactatacgcaataaaattgtgaagtcgttaagttttcgtaagtacacaccggcaacgtgtaatggaattatctctactggtcgtcctccttaattagtccttcactcctaccactacttagaaaatgcatttttcaaatgtggggttttttttttcacaggcgaacataaccattgaaaccaaatgaccgcatacaaaaatataaaccgggctgaagcttattgtcttgcaggcggaccattccgcctgcaaataccctttattttcacaggcggatagtccgtctacgaaaattagtgtacaatataaatagaggcgacatcggagcggttttttttccaagtcccatttctcctctcctctcccgttccccgttccccctcccctccacctgtcctctactctccccttccctaacctctcctttccccggccgtcggccggaggcggctacaaggcagtggtggcgcaccccagcgagggcagtggaaggagcggacgcgggacggccagcggcggctctcctccctccctccctcccagatctggccggagggaggagggggaggccggtggccagcggcgcggggcggacccgtgtcggggcgtagcgtgtgctcgctggccggcgacggttcgcctccctccctcccagatctggccggaggggggaggggggaggccggtggccggcggcgtggggcggacagcggcggggcgcagtatgtgctcgccggccgacagctcccctccctcccttcctcccagatctggccggagggaggaggggggaggccggtgaccggcggctcgggttggacggcggcggggtgtgtggctgcgacggcgaggagggcggaggctgcagcgtcttccctccctcctcctagatctggcggcgcagagggcggcagcggcatctcccctccctcctcccagatccggtggcacggagggcggtcgcggcggcagctaccggctgtgatggtggaggcggtggcgtttgttttgattttgaaagttaatttgtgatgcgtttgatttgattgtgaactactatgattcttctatgttaacttgtgatgcttttgtgaatttgatttggtttgatggggaatggaaactggattggatgggggaatgggaggaaaacggagaacaggaagctgctgctaccggtcgaaacggcggtgggcggtggctgcccttttttttaatgctgggagctattttcgcaggcgttcatttgtaagcggaccagttgtccatctacaaaaacttgtttagtccgcctgaaaaaatgttttttttccagttgttgacgaaaaaatcgaacacaccggcctgggagatctgcttagctcctgtgcaggtccaaatcttgatgagatgcgggcgtgccagtcagtttgatcctgcaactgacaagatatgcaaatagtagaccaaaacagccgatcggctgacaagccgatgtagtagttccagccgatagtgataatagctgatgccgatgccagcagatagcgatagggtttaagcaatcggttatatgtccaatgtagataatgatataaaggcaatcggctgatgatgatgtaataaaataacaatataatccagtataaaccaatcggctagtaataatatgataaataagcatcgatccgaaggttaaagtacacatcggctggaggtctgatgtcatgaaatccacaatattagattaaacagtaaaacctttgttgcgataagctaaatccaatatgtatgcaatccttataagccgatgcaacatccagataactcatcggctgaaaccccgatgaaacccttattggcaatcaaaaagtaggctagagattatggttctaaacacgacttagtagatcaaacttaactgatgcagcactaagtatgaaaagaaacataatatctagacaatcaagccgttgactgagttttcagggtggtagatgtctaagctaatctaatctagcaacacgatttagccgataccggcagaaaccctaaagcgagaagcagccgatagaggtaaattgatatgctaagactagattaacagagacatatgataaataggtagacaaatatatcatccaaaccggaacaatccaagaggtcgaatgtattgatgcagccttgaacgacgctgatgtagatgatacaatttcctggaccggcggaacattggacttatcccttcgccagagatcgaagacgatgcagccccgcgtcgggtgccaagtcccgccggacgataaaataaagtagaaaaggtaaaaggtggcgatgcgccgaattgtattgatcgtgaagatagattacataggtcccgggtgcacatatttatacccgtgggttgatacaaatccttgtcggagaagaaagaaaaattcctaaagataaaaggaaaagataaagtccttataggacactaaacacactttcctaacggtaaaaggaaactaacaaactgttcttaattaatagataacttgccatgccgcatcctctttgaacttggtctcttcttgataagcttcctttagtagatcaatttccttaaccgaatatagcaagaatccgacaactgacgacttgacaactctcatcggctaatctaaggacttcgaagccaatgactactccgggcttaccaaatttcactgttaacacatgccccccagttttggagtatgagaattcatgcttcaaaatttcttgtcttgataactccaaaaccgatcttccttcgcttcttgcaatcggctttcatgagctaatactgatgtgcttcaccatgctgaaacttatacgcttgccccccgagccgagattgaatgatcttggcattgacttcttcttcagacatgtggatataaaattcgtggtcccaccaggcgtgccaatctgtgttgacgagaaaatcgaacacaccggcctgggagatctgcttagctcctgtgcagatccaaatcttgattagatgcgagcgtgccagtcagtttgatcctgcaattaacaagatatgcaaatagtagatcaaaacagccgatcggctgacaagccgatggagtagttccagccgatagccgataatagccgatgccgataccagccgatagcgatagggtttaagcaatcggccatatatccaatgtagataatgatataaaggcaatcgcctactgataataaaatataacaataatatagtccagtataaatcaatcggcaaataataatatgataaatcagcatcgatccgaaggttaaagcacacatcggctggaggtccgatgtcatgaaatccacaatattagattaaacggtgaaacatttgttgtcattggctaaatccaattcatatgtatatgcaatccttatgagccgatgcaacgtccagataactcaccggctgaaaccccgatgaaacccttattggcagtcaaaaagtaggctagagattatggttctaagcacgacttagtagataaaatttaactgatgcagcactaagtatgaaaaaaaacataatatctagacaatcaagccattgactgagttttcagggtggtagatgtctaagctaatataatctagcaacgcgatttagccgataccggcagaaaccctaaaacgagaagtagccgatagagctaaattgatatgctaagactatattaacagagacatatgataaataagtaggcaaatatatcatccaaaccagagcaatccaagaggtcgaatgtactgatgcagccttgaacgacgccgacgtaaacgatacaattgcccaggccggcggaacatcggacttaccccttagccggagatcgaacaccgatgcagccccgcgtcaggtgccaagtcccgccggacgataaaataaagtagaaaaggtaaaaggtggcgatgcgctgaattgtattgattgtagcgatagattacatagaccccgggtgtacatatttatacccatgggttgatacaagttcttgtcggacaaaaaagaaactttcctaaagataaaaggaaaaaataaagtccttataggacactaaacacacttttctaaagataaaaggaaactaacaaactattcctaattaatagataacttgccatgccacattctctttgaactcggtctcttctggataagcttcctttagtagatcaattttcttaaccgaatatagcaagaatccgacaactgacgacttgacaactctcatcggctaatctctggacttcgaagccaatgctgtctctaagccgatgactactccgggcttatcaaatttcactgttaaccgatacatctagatagctcgactattgttgttcagagtattgtcataaaataaatgatattgcataatgcaagcaatcgatcatatcaaacatgagtcaccaaccgacgacaccttttgtgtggatagttctagaattaagtagccccacaaataatgcaacaaaagaaagtagccccacaagcaacctagcaggatccacattaaaagtgcctctggacaatgtagctctcacacaaaacaactgtagcgattgaactacaatgggctattgaactgctagatcacaaaatagatgttattctctattcctttaactaatgtaggattgaaatttgaaaacttaagcctactagagatggtgataggggagaacaaataaagattcacaccaaataaaagacaaaaagggaacttttttctattgttttgtcactgttttgaaatataaaatcaaataaaactaaaacaaaaactaagcaaaactagaagaacacgaaagagaatgagattaccacattttcctttgtgtaaagatggtatttattacatcaaagtgtttatagtgtgtatccaattactcatccactatactagagaaaagcactttggtgttcgttgggaaatttaagtatgcataaatgtggatacaacacagccaactgctacaatattgcacctataatcactacgacataggcagcaacacaactactgtagtatggcagccgaacaagcccatagatgctgggatttcctatctagtaccactcaggcaggactaatgaccttggataattggtgtggttccacagcaaacacctttgaggcacacatgtggcaaaaaaagtctcaaattctcaatgcatgcatcggctcgattccaaccgatgcattgagttgctccccgtaaccccaaaaaaaaatcgaacaaaaaaaacttatgtacaagctgaatcacaaattaaaaaaataagacctgttgtacattctaagtcatgactaaataacaaatccaacaaaaaaactcatcgtcatcgaagggatgggcggcaacgattgggaaagggaaagggaacacaacgagatctggtggttatcgagctcgagacggcatcgtcacgtcgccctggtgagcgggcccagggggaggggttgtgctctacttgttgtacacggcgaggtacctgatcttgttgacggaccatgcagcagcacccccaccaactgtagcatctgcttcccctttcccttctccgcctcctctccgcccctcactgcctccctcccacctcatgcacggtgtgcgacgtgaatgctgcgccatggtgccctgtcacaccccaatctggcaccgccgtacaacggcacctgacaggagcgtgtcgtgggaaaaacggcgcgaactgcttcctacgaaaccacgatctcagtaccagtcctaggacatagcgctggtacccacggtgacaaatatgaatcattgcaatccttaaaataaatagaggacttatttaccttaacttaggttgcagctcagaacagcccgaaattgcaaccgacgacacgaacgaggaaacaccaacaacagcggcagcagcggaaccaacggactaacacccaacaccacaggcgacggctgggaaccaggacgaaaccctaatgttcactttacttcatcttcaacttccgggcggaggaactatatatatttatatagagcaagggtgagtactttcctactcagcaagtcacgggaatttaggtgtttaatgcaagcttggaagagaggcaaggttgtttttgcaaatcttttgttttgaaatcattttgaaatcactaagtgatttatttctttctaagtttgggccgaaaagagacttgcgtctcgattcgactttaagagagatgtttttcaacagctcaattggtaatgtaccgacctcccaggtcagatcattacttctcggctcccagagccattccacttgattaatcggctcccagagcctttttcattttctcggactcccagagtccagctgcccagcagcacaacaatccgcttccactcaggaagcctagtctatgatgcccgtagacatcccgaatcacacagattcatttcttgaccactcaggtcatccatctgccacataggctgattctggtaacgattcccacaccagaacaacttttcacaaggcacaggcaaacaaatctacgctacaggaaacacctcacatccgcccttgaccgcgggcacagctgttcgaacagttatttaacctctgcagagggggtacactttacccacacgacattactaacccggatcacccaacccgtgagatcagccacgtcgggagaccttaaggctttcatgacaaggcatttcgaaagtcgacacaggttcaccatatgccaacgagaggggtcccagaccaacaccagattaggtcccagaccatactgtgccaggaagcccgagggttctccccgacaccaccccgttgaatccacgtgtctcttggcatcatggctcccccgattagctaattactcagccaggggcgtcccattgcacccgtgtggtcgcacttattatatgctcggatgaatttcccacaggaatcggtccttatatgcgaatacaggatagtaccacataggcacaacccccgcatcgcgagttttcacagtctattttgttttcaaacacaccaacgccacatgttgggttttcaaggcttctcaaacccatttcccaaattatcgacaaacaacggtgtatgtggaatagttggtatacacactcagagaacacggataccgaagtaccacaaaggtggaacgacaaggaatcagggtagaacaacctacaggaattagtgcgactactgggtaggtccgtcggtttggcacgcaaaccgaggccaagcaagttaagtgtgtgattctactaatgcaagttgcaaacaaaataataatgattttccaattataggagcaattggtcaaagggtgacttgccttgctcaaggtcttcacgaagcttcacgaatcttcgagaaaacccgcgatcgacgaaaatccggtaaccgcaactatacgcaaacaattgaaaacctaaacaaaagaccaaaataaagatcctatttagactaattagtagttccattgaatagatctcaattttatggaaatactggaagttgaacggagtcaatcagagctacggattgagagatatgaattttggaagtttaattggaatttctgggcaaaagaagatatttgtggaacaaggggaaattgatttatgaaatttatagaaataatattctcaagaatattattgaccgtcactgacgtgcgggaccaaggaaatgatttatggaattttgggaataaggaattgatttatggaataggggaaaaagggtttattaaatcccttgaaaaagaagggagggatgccatatagacttcctagggcggctcaggcgcggcccgaggggtttatgcggcttggccggacctaatgggccggcgcgggcacgggaggggcggcccaagagagggggcgcggggagagagaggccgacgcaggtggacgcgatccaccgcgcgggacccacatggcggtggttgggttcacggtggggagggcgcacgcgggggcgggcgctagggtttcggatgcgcgcggttcgggcgcggcgcaccgggtggatggatggcggcgggcccacgtgcagccgcacggcttgccgtggaccgcgcgcacgggagggaagacggagggaggaggctgactgggcgcgacttgacccagtcaagcgggcccagggctgaggtggctgccacgtggtcggccacgcgggcaggggtgaaaggggaggaggaggaggaggaggcgcccgggatcagacggccgacaacgcgtgaggcgttccggcgagcggtggctaaccggagcgagcggctaccgccggcagctagaggaggtcagggggaatccatttaacggcacggatctgagaggggaggtacgacagtggctggcggcggtgaccaagcttgtcggatcggggatgtggtcgcgcaagggaagggacaagggggcgcaaactcgggcctagccgaaacggtacgcgaccgtgatgcgcacgcggtgacgcgggacccgatggtcaccggcgatgcacgcgcggcgttgttatgcggcggcggaaacggcgacacgacgcggagacaaaggagaaggccggcggccttggggcagccagggggaggtcaaggggatccccgggagcgtggcagcgagaggaatcggagcgaaaggagccgacggtggtggattgcggcggcggccatcgccggcggagagaaggggaaatctcaccggggcaacgggagttcgattcaaaggggtgggagcatctctaggacttagggatcccgtttgtggcgtcggatgggatggggaggcgccgtggaggtccggcgacgagaggcggtctccgagagcgggcggcatgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaagataaacggcgcagacggctccactccacaggcagcttgaccaaggctacacctaatcctccacaccatcagcatcactgtagaactcttcctctgatgaatgattgcaaggtgagtatatgacatactcagcaagtcacgcagcaaatatgcaagtgcacaaggataccaaaggatggcatagtagggtttcatttgcaaaagcagcatttagcaaacatttcagaatttaataaaacagttaagtattaaacaatattaatccaacgctatacaacataccctgttgtataggcccaaccattctgaacaaccatcccggctgcacagttctatctccaaaccaggagctaatcaaattattaccaattaaagcaccttttattatggtgagaagggtgagactaatcacgaaagatattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacctctcgtacaacacaatccactgcagcgcacctttcctggatcataatcacccccttataaacaaggcatagactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccagtccttaattgtcatgagcacgaccatcaaaaccatgtgctcacaacccaccattatcaggttttagttggcacattaattaattaaccaatcatgatagaacatcgtgaactatcattaagccatcattaagtaatagtgagtcataagttatcccaatagtgtgctaatatttctaagcatggctaagcaatcatatctaatatctagctgaaccaatatatataaagttcaactagtcaagttatattaccccaaggtatcaaggaataaagtaatcaagaacaaaagggctataacaaagaataggttaattccacccaatgacattcgaaaataaatgcaataattgaatagaaacaatagctttaaataggatcaacatgctcaaagggttgtttgggatctgtgtgacttgccttgctggccttggaactcttcaaattcttcttctgcaaaaacggactctccggtaacgacggaatctaagaagaaaagagcaaaatcaccaaaacagcacataaacaagcatgaacagtacatgtggatatttttaacatgtagatctcaattttagaaaaatttagagacttgaaccaactaaatccgactaagatgaattagttatgaatttttgaagatttaatcggattaaaacacttatattgattttaattgaattatgacgcaataatgaattatttttcaaaaggaaaagaggatttattgcgtcagcggctagggtttcggtggaccgggcgcatgggcgacggttcacgcgaacggacggccgagatcgacttgatccaaaacggacggccggaaacggaaaggatcgatcgaattttgaagggaacggcggcggcgcgaaactagggtttcgggcggcggcggccggaggttgacgacgactgacaagcgggacccacctgtcagcgacagcgagggcgcgcgcgggctgcggactgggccggactgggccgaggagagagagaaaggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaaaaattccatttaaacaacaatttatatattttgaattttcagggtgtgacacggcaatggcggcgaggctgtgccgggcggcgacggcgctagggaatggtttggggaggtcctagggagctcaaggacggtggtggcgcgagggattggcgagggggcccatggcggcgcacaggcgggcgcggcggcggcgaagcagagcaacggcggggcggcacgtttagggggacgagcgagcaaccgaacggctcggggcttatccaagatgatgcaaatggcaagaatttgggcgaggagctcaccggcgtgcggaaacggtatcggcggcgcggatggagtcgcggcgaggcggacgcgacggcggggcggcacagcgccgagagggcgtggccggggaagaagagatggagaggcgcgaggatgggggcggcgcggagctcctcatcgactcctcgtgctcgctagctccccgacacgcacgacggcagaggagggcgagaacgacgacgaacggcgaggcggcagtggtgtgatggaggagaggaagcgagaggtatgggaggggggtgtgggttttataggtggcgatgtcggtttgagagaaccaaccttggggcggtcaaggagatgaggcgggtggtgcgagcggtcaagcggcgcagaggtggtgacgctggcggtggtcggggaaagggaaaaagaaggggggaaagggggttggtcctttgccatattgaggagaggggaagcagctgcttctcccattcttggacgatgcggcgtggagtggcgggggccatggatgacgtcggcgatgacggcggcagttagtttgtcatggagcgggggcaaggcggcagcacgtggcgtcggcggcgcaagggctgatggcggcggcgttcggccggtcggccacctcgcgagcgagcgcgcgcgcgacgcgggggtgcggccggatttcgaacggcggcggcgggaaatcggcgccgaggagagggagatcgaacgagagagagagaaacagcgagagagaggaagagaacgagagagcgagagaactctctctcggctcggctcacgcgcatgcatcgcacgtgcgagaggagggaggaggacggcagagggaggaaatgggctggggaggggcgttcggcccatagaacttgggggaggcaaactagactttcacagagaaaactgatttggatagaattggagagatttagggtttggattcgaattcaaatttgatattcgaactcgagggtttagggatgtatcaagggaaactcaaggagaagtcatggaaaagattcaaaaggaatacttgggtatttgttctcgggaacatagggtggagtcaaggaaatgatttggatgaggatcgattctctcgaaatcgggagaaagatttggcaacgagttcaaggaagggagagattgacttcaagaattgggatttggatgagagggagtcgccaacgggattcaaaaaaggggatttgaatctaaatttgatacttgtacacaagggttcaaggagacgagtaaggaaacaaagtgggagtttgatactttcgggaatgggaacaattatttggagaggattcaagggaagggattgactttcggaatttgatttcggagactcgaatcggaagaggaattttcgaggtggaggattttgatttcaatgagagggaacaacaggattaaattgagatccttggcacaacttagactctcacacaaagaacgaaaattttcgcgaataggattttgccgaattagtttttaacgtcacgcaaaaagcggagcgttacatgcccgcgttccgcgtgggagccgctaggagtcgctcacctaggattcgcgagagcacgcacactgccacctccactggcgagtttaagtttgagagagagagagagagtcgtgggaggggaggagaaggtgaggagaggataaggacgaaaggactcggtcgatcgactcggctcaacagtttagggtgtcgttttatttaaaaaatcggcacctataaggttattatatgtgtcgatttttataaaagaaaaacggtacatgcgactgacaatatttgggtgtcagttttgtttttattaagaaccggcgttttgtagtagtgatatgtcatctcaccaactaaactctagatgaaaaagtagaaattctaaaacccattctatttctccacataagtatcttaggtacgtaattgctatctttttctagtagtatttatatagtcaaaaccaaccacatcagttaggacaaccaatcctattagaaatccctgacgcatttattctaactatttcctaatcttcttaattttgcactctctccaaattttgatttattagctaggtctctcaattctactggcgttccctcacacatttattccaattcattcatcaatcttctcaaatttagactacctctaaatttgacccctttcaatatacacatacaacatacatcatatcatacgtaaatctgaattttatatgcaccggtccttctcttaactatctgaacctcattcctttagggtttagtttcgatcttatcaccaaccatgctcctcagaccctcaagcaacattcaaagcaaatacatgaaactcgcactgtcttgtgcagtttgtttcaaaaagaaaaaaattcaaagaaaaaaaacatattcaaagcgaaaattcatagtcctttccacgccggtcaaaccaaagctgccatagcacctcgaaacaccaaactattgctattaacattttatctaattatctgttgcaatatagtcatcactgtgatttcacacttactaggtaggtggtctggtggaatgatgctgttatactgtcaccactcatcgatgcatgagtcaggcggtcaccatcacacacacttacattcgacgatcacaggatttgaggacatctcaacactcaacagtgtgatcgaacgcattcaacaggccgtccattaagcaatacagtacatatctcgtattctcattatgtggttgtttaaatccacgtagccatcacgcatgaagcttactggttaccctccatcagacaaacatatatattcgatctttctccggtcaagttctagcacaacaaaacacaagccaaaacaccatttaaccacctccaagcttcgcattccaagagaccgagcgactgttcagccagagattaatcagagaatggctggagaaggagatgatcaactgaagcttctcggattgtgggtgagcccatacactcaccgagtgaagcttgcactcagcttcaagggcctgagctacgagtacgtcgaggaggacctcagcaacaagagcgagctgcttctcagcaccaacccggtgcacaagaaggtgcccgtgctcatccacaacggcaagcccatctgcgagtcgcaggtcatcgtgcagtacctcgacgaggagttccccaactccggcgtctcgctcctcccatctgactcctacgatcgcgccattgctcgtttctgggctgcctacatcaacgacaaggtaatcgtcaaattgcctcggttaatcgatctgaatttgcatcgattgatgtgatgttgtgtgcgtgtgctcgcgtgtgtcgtcgttgcagctgatgccgtcgtggctgcagtcgtcgatgggcaagacggaggaggagagggcggaggcgctgaagcagacgttggaggcggtggcgaacctggagacggcgttcaaggagtgttccaaggggaagcccttcttcggcggcgacaccgtcgggtacctggacgtgtcgctcggcgccatgatcggatggatgcgcgccggcgaggctctgcacgggaggaggaccttcgatgccactagaagccctctcctgaacgcgtggatggagcgcttcgccgcgctggacgccgccaaggccgccatgccggacaacaacaagctggtcgagttcgtcagggtgaggcgggctgccgctgcgaacaactgaagccgaaacaatactgtattggtcagttcccagttggtacgagatttgctctgctccaacaaagagtatcttaaggtattgatacctcacggtaccaaatcgtttctaaccgttgaatctaacaatgtccatcgatgggaaacgatttagtactgtaaggtaccggtacctcaattactttttgctgaaccgaaacaaatctcatcgtcactgctttgggcctttggccaattgtcatttttcaagttgcaaaagtgtgatgttcttccgggtcatccgttcgatcggatctccttgttaccgggacatcatttcttccaataaaggaaaatgttgaattttggtatttaaattgtttagtagtatgtgatataaaaactgaattttctatttcaattgcgtgcctagacgtcagattgttcaaccagatgcatatgctccagatgaatacatgttatttaaatagttgcataagaaattgaacaaatatattacaatgatatagatcattatatacggacacataattagctaggttttctctggagtgattttacatttcttgaggaggtaacgggatatacaatattttctaatataaaatttattatctcttagtacctccagtaaggaatggaaatttgcacagtactacctctcaaggaccgtaaaatttctcttttctctaagtgcatatcaaatttagcgtatatgactcgtgtcatcataatttatcctataaaaatctttgatttttctatcaacatttaatctgcatggaaataattaatgtatatatgcattactacctctccttcgtaacttcaggaatggatggtatgtatgtctcaatctttattggcccctgtattttagttggtgatgagagtgtatgatggcaaactcatcgtcaccaacaccaactgcctcttttaaataaaaaaattgatgtagcagagacttttttttctcattatcatatattgtatatgatgtttggacaaatgattttaagcctgcaatggcgaactatatcatttctcacatgccgtttaaatagttataataaaattgaaacaaaataggcaacatacggattgtaaaatgcagatgttattctgaaaaagaaaacataaggggggcaataaagagtgatgctaagtgttcttttgaatggtagtgtgcagttgttattttttcaacatgtatatgtttttgtacaatggagttgcacatgtttcatggaaattaaatgtgcatatttggaaatgtatgttttaatgggaatgtgtttacaatattatttgaatttttttcatggaaatgaccagatgtatttcattgaaaatgcaaaaaaaaaaatcaatacaacattgttgccacaatcaaatgttccatgcaacattgtttttgtgggtgaaaaatgggcaatgtacatatgtttttcgtttgaatgaaaatgtgcacatatgtgtcttctttgtatgaaaatgcttaaaatggtagcatttcaaataattaatcagatcaaacattagtgtcaccacgcctttttttttcagttgtaagtatgcaccatcctcttgctaggtgtggtggaatgattaggtcatgtaggtagggtccagtagggggctctcatgtattccacatcagaaaaaaaaaacccacccctacaatggttagttgactttacattaatacatactagttaaattgtcacaccccaatctgataccgccgtacaacggcacctgacaggagcgtgtcgtagggaaaacggcgcaaaccgcttcctacgaaaccgcgatctcagtaccagtcccaggacatagtgctggtacccacggtgacaaatatgaatcatagcaatccttaaaataaatggaggacttatttaccttaacttaggttgcagctcagacagcccgagaatacaaccgacgacgcggacgaggaaacaccaacagcagcagcggaaccaacggtctaacacccaacaccacaggcgacgg

SEQ ID NO: 63341 - DNA, 6510 bp, Oryza sativa
ctgcagctagctggtgactgatcacgacagccaaatgcaaattgagaataaagcgaaaattaacgcattatcactttaatgatttcagggtggcacgcattagagggtactcaataaaaacatatttttctaaaacaaatgaataacatatgtgcgatattttatcacatatagcaagaaaaaaaaattatggcattataaccatgaaaagctatggaaaaagaaaacaccaccactacaatccgactagctgtcactaagcattatcgaccaccgctagactaacaaaagagctatagctataccgctcaacaacttcctacaaaccgtttaacgcctagctagcacctataaaatgtgaactcaaactgtgtagcaaaactagaaagttcgcgtctataggtcattaattattctgcatctcaaacttgcacaatcaaacctttcatatattcacattccgtttcctctaaagcatgattctaccaaattaactttttgcctctccggtcatatatatcccaacagctgatggaactgaacacccagataaagaaagaactgacgcgtaaaaaatgcgacgagatcgaagaaatgaattaactaaaacgaagtcgtcgcgtctcttaagatcccggaggatacaatcgatcgccactaagctagtagcaaagaggatccctccagaataacctcgtcgatttccacggtcccctttgcattatttatcctcttccaattcgcagcctgatggaaactaccatggccacacaaaacagcccccatggatatgcagaattagctgggttgatgatgattcagctagctaggagggccatgaatgacatgcaaagtgtacatgtcgctcagaggagatgaggtttccatccaaaggccgggtgcacgcatcgaccaaccaaatgagtcccaagcatgcgtgccggccagggtagtccatgtcaacatgaagcactgaaatgtgcagaccaaatagtaaagccactaagttactatataaaaaaataattcaacccctcttatcacggtcaattctttacctatcactactattttatgaaaaccatttttgcacacggcaaaactaaaataatttttccgcagacggctggacacatggcttcatgtgaaaatgaagctttattttcacatacgggcacttagtcttatatcgccagatatgacgggtagatacggtgtgacggtaggcaacaagcgtggaaggaagacactcaggataagcgctccctacccctgccctcccaccaatccatggctggcccctttcgtctccctctctattcacaactagagtcaccactcaccccctcacctagcagctcggatcacagctacagagttataccgacccaacggctgtcagatttataccacccagggttttcaatatcgaaattgctttttctgcgcggggggggggggcgaaatttcccagaaattttgaattggcctaaattgtttgaaattttgtatgaatttaaataaaatttgaccaaattcacaaaaaaaaatataaaagagatatgagcttgccggtgggggaggggtgcaaatatcggaaatttcaaaacaaaatttgaaacgttgataccaccctaccactgcttcaccggatccaccatggcttcactctgttcttgacctagagggaggagagggagggagatgaagagggagtgggaagtttggatgagggagaaaggagagaggaaggaggataggcgatgttgttagggccctagggtgcatacatttgacgtaaaattattcatatcaagatcacctgatgttttcataggtgatctgcttagacaccagtcctaggagtacccatttttagaggtggtcatctaagtgggctacctacgaaaattgacccaagcggccgcctctgggcatcaatttttagaagtggtccataaccttacacctccttcactatttgtaccaacatgttcctatttaactgcttttatagggaaatggggtgttgtggaaaattattgtacagagggtagcgatagaggagtttagggataaaaaggaaatcgtgatgcgacagtgatcaagtattgttcgttacactgttcatgctatcactgttgtttcttattataaactgcatgataatagtagaatatctaatattttgatattcataattttatacaatgggttgtatatatggagctaaacttctatgaaagttaaaagttaatgtctcaacaacatatatctgttactacttggtgttgtcacatatatttgttaaattactacttgatatagttgatactttttcttttgagaccatataattataagtattcatcaaaagattaaaaaaatggaccaaaggaagaaacatttatactccaatggtattactaataaatagatgagaaggtacttgggtgtttgtggtgtaattcgtcttctatttagtttatcttgctattgttaggtgatattgtgttggtaacaaaaagcgttaacaatgagcttcacgtacatggaggacaaatcctgatgtttgaatcatgtctactgcacacatccctattttgcatgatgttagttaatcataaccaataaatatagagtactctatggtagcgatacgtacgtacgtacggtgcagatagcaaacaaagtcgtcgtgttcaatcaattgtgcatcaacattaacaagctagtcgtcgtacacgtactcgtactggctagactagtgcaggttacaaccctgatacgtacgtaaaattaaccgcttaattatatactgccctaccctcatcggcacaccgcacaaataatggagaaacggtaatactgcaaattgtgcgtcacactcttgatcgtgctatcagttcgtcagttacgcccgatatatgagtgcagggcccaatcacttatcttcaagcgcaaaggaaatggaagagagaaaaacacgtgatcatttggaaaagtgtaagacaaccccccatgcattaagtcaacaaggatatatatatactttatttttcgcaactaattaacaaggatatgcatgcatgcgtgatcatgtcaacagcgggaaattactcctcacttaagtataactagctgggttgcccgcgcaattgcgcggctagcataaaaaaatcatatatttttttaagtataattttacttaaaatttattaaatagctatctcattgttaagactttgaaagatcaaaccttatcatccttgtgtttctaattatatagttttaaaaatcacaccaattgctaccccttatgtcatcttctttatttgcttactcgatctatcactgtttctattcattcatcttggaacctttaaaaattggattttatagtttttagagttaattgtcacgttgggtttcgtttttataatttctagatgtcccgtcaaacgttgccattatactcctctacagcccgtccactatctcttctcttttattgtcattgagattttaaaaatcgaacataattatagtttgggtttatttttactttccagaagtcccgccaaaccatcagcggttttgccattgtattcctctacggctcgctcgctgcctcccttttttattgtcattgagatttaaaatagaacatgattatcattggttttttttttacttttagaagttctgaatctttaaaaattggacttgtagttttattttttataatttttagaagtctcatcaaacgatgccactatgcccctctgcagcccgtccgctgcctactctttattgtcattgtgattctaaaaatcgaacataactatcgttgcaattcattttttattttctagaagtcccgtcaaccgtcggaggctctgcaactatactcttatacaccccgctcgctgcttctccttttattgtcattgagattttaaaaatcgaaaatgattatcaatgtggttttttttctttatactttctagaagtcccggcaaccgctttacttgtttactttacggcctgcctgatatccctccttttaatcgtcattaggattctatttgttgttttattaacaatttttatatgctgtattaactgccaccaactctactactttataggtatgttacttaatttatctcgtcatgtgttttagatggtcttttctttcaatagtctttatttttatcataaattttagttatttataaattttattcctaattgaaatccttttttctaatttcagaatttatttttttctaaaaaaattagttaataccatattgtgttcttttaatgtttttattttttattctgaatttcagttgtttcaaaattgtattcctacttgaactctgttttagtttttctaattttggatattattatatttttattctaaattttaattaatctcgtattggattcttatatggattcttctttcaatattgctatttctaattccgaatttaagctaattttaaatcgatttcctacttgaacacttctttattttctttcgctaatctcagatttatttttatttttattccgaattttaattaatctcgtaataggttcttatatgggaacttctttcaatattgcttatttttaattccgaatttcagctatttttagattgtatttctacttggactctcgtttccttttctaatttggattttattttatttttatttcaatttttgattaatctcgcattgggttcttatatggaaacttcttccaatatttcttatttttaattccgaatttcagctatttttaaattgtatttcaacttggactctcctttccttttctaattttggattttattttatttttatttctaattttgattaatctcgtattaggttcttatatgggaacttctttcaatattgcttatttttaattccgaatttcagctatttttagattgtatttctacttggactctccttttcttttttttttctttttctccgattaatgtgggaatttctagcccccacagcgaacgtggtgactcatttcaaagctgttttaataatataatagattagctcatatgcatgttaatattattctgatcttaaaccaaagggaaagaagaggagagagatagatgagctcatttggttgttccattttaccattaatatagattctccatgatgatccacaggatctaacatttcaggcatttgtaaaaatgatttagacagtaatgatcagataacactctccaatgattcatcttaatctagtcttttttccgcacaaaggggggaaagattaatagcattcgagttttacattaaaaatgattgaattaatttccatcaaacattttttacgcttccatcgtagtgacaatttttaatccgttttattagacagtaacaatataacttcaaaagtgtgagtggccttataaggttgcgttctatgttgttgtttggcttacctactccaagcacgagaaacgttacagattattaattaagtattaaccgttacaaacttaaaaaataaatttatttagtttttctaaataactttaatatagaattttttttttaaaaaaagaaaaacgtaccatttagctgttcgataaatatactcatgataaataaggcagtggccccttttagccacgtaaaagagcgcaacttaagatagatccttcacgcataacctcatctaattaaatggtaattgtggaaagataaaacaatataagcccttaggacaagtagaatagtttagccttctacacagagatagtatcctcttctatagttgagacaataaatgctctttccactaatgctatatccttatctagcaaagttttctcttttcttgctttaagattaacaccgatttctctctcttatccacattagtagatagatataggttgcaatttggcgagccagctgtcaattgttgctatacactcagcaaattagtttagttggcagtttcataagctatctaatagttgttgttgtacaacccataggagatagggtcttattgtttaccatataaagaataagccattgttagaatataaaatttgaaacttaattatctttttttcagattgacttttaagtcacaaaagaaacacctataaaagttttactcccaaattttttccgctaataagcccttacagcttataatcaactcttggtcaaccgatcgatgggaggtaacaaataacaacagaacttctaatgaatttctctcaaatccaaaacgaaaaacaaacaagaaacactaaacctctcttttctcatcctaatttcccctctctgtttttttctcttcttttcattcacaagaggaggaaggggaagggcatcttgagatcgacgtgcctgcttgcatctcccttgtggatgcggtcacgtccatgtcgatcaccccctgtgtgctggggtttgtgtgtga

SEQ ID NO: 63342 - DNA, 31820 bp, Oryza sativa
ggcgtccggaagccggcgcacggccgggcgaacggcaccggcgtgttttgtgaattttttttatttttggaatgatttgtaaattttgttgtagattattttagatttggggataattttgtgaattacttgtggattgcggatgattttttggatgggcaattgtggatgatttgtggggatttgagggtgacgataatctttagtcccggattgggtgtcccggtttgcacccggggctaaaaggttgcaaatcgggagtaaaagagccattccacgtttgataagtactgctattccataggagagcaaagcgctgaagagttcaaccagttgaaaaatcctcgcacatcttgactcttcttgtctggcgttatttgacatcagtggcttcccggcacgcacggtaaaacagacaggttgtatcgtttgttcgtgagctcgatcacaaagcaggccagctgcctgctgaacaagcatgtcgcccactctgagcagcttccgtcttcttctgattcgacttgttttggtggctcttctgataggcagcggcctccccatgctctcggctcagcaaggcagcccaggagtccgtgagtatcatctttatatattagcaaaacgattttcaacagatttagctttgccagccaatagagtctagagctactgcccgcagtgtttttgtttccccgcccttggattgctgctaatattttctttttgacaccatcgttgcagataatccgcatggtccaccgcagatccatcatacccgttttatctatcacggtgaggcaggcactgtcatcgggaactaattaaacgcgtagatcgtgttgttacctgttctgctctgtattatactcctactccctcagttgaaattctaatgcgtgatttgacttttgttctgttgattatttcggaaaattactccttggctatataattgcaagggctcaactctgttttaccacaaagttaactgcaattataaatttagcagataattgagcagtatgtacatttaatttgccacttatctcatcgtatccctttgattttactttggtctgccttttctgaacttccatattgtggatcaattaatatacccacatgccacatggtacccataagaggaatacacaggaataaagcctctccccattacctccctcgactctattgtgctcgacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttatagggaaccggtttttttacatgggaaacttcaatggtgcggaaagattatagagatataagccacgaccaccaaatgcagcttcgcagctgaatcagcgaatcgaagtgggaaaatctccttctctgaaatttacaatattagcaagagcactaacctataggaccattacaaaatttgtagaactaatgaactgttttcactaaattacataaaaattcagggactaatataaaattgctgctaaaataaaattaaaaactaaaataaaggggtaaatgggtggtgccgaaatcaataggatttggcccaccaccactacagtgcagccggcccatcaagcccatggggaaaagggcaaaggggggcgtggggggggggttagggttaccctaaccgcccagcagtttgagccgccgccgccgcacatgacgctgccgagacggcgccgcctccttcacctcgtctgccgccgccgtccatttcggcgcctcctccttcaccactttcgctgccgtttccaccgccgcctctctcatctaccgccgattccattttcgccgccaccatctccccctgttacaccaccgccggtgcctccatttctgccgcccccaccgccacagcagccgaagtccccgtcgtccgccggcgagactaagccgacggccccctctcctcatcggagtaagagaccagtcgggttcggacgctgttcccccccccccccactccgttcgggagcgtgcagctcgaggagccacatgaacggcgcggaaagtagcggggaggctgagcggcgaacgggaaacggtgccggcggcgactctatctccagtgggagggagcactgctcgccggggggcgtcaccgctgtccatccatggagcctggacctggacgcaacggggcaccggtgcactcgtggcgggcgcttgtggtggtggagtcggaggtgtggcagcgacggcaaatgcggcgccggggatggtggcggtggccaccaaccctagaatggcgcccagcatggcgatggtggtgactccatcgaatcgacggaggaggtggcgaaggcgatgaatgcggtctcggcgatggaggccgagaacggcatcgaggatgaaatcaaggtagacgtacttacgcgatttccttagtttcttctgtttctttcgcttttcttgaaatcaaaagcaatgtttccttctttcacttcgtgatctccttcacgagagcgaaagtgctgataacgtgttgaacgtggatagaattgattgaacgagagagattgagagagagaatttaacacaagaatgtatcgcgaaagtgctgataacgtgttgaatgtggatagaattgattgaacgagagagattgagagagaatttaacacaagaatgtagagaatgaatgagtggatcctttattgataacagtgttgcaatatacagggggagagaggcggcaaccggaggcgcgtccgttgctagaatcgccgtgaggcgagaacatgtgtggggcacgaccaaccgttgtgtccctgagttggttgttactctatccatatatatggatgagatcacccaaatatttcataacagtttgacttttgttctgttgattatttcggaaaattactccttggctatataattgcaagggctcaactctgttttaccacaaagttaactgcaattataaatttagcagataattgagcagtatgtacatttaatttgccacttatctcatcgtatcccttcgattttactttggtctgccttttctgaacttccatactgtggatcaattaatatacccacatgccacatggtacccacaagaggaatacacagaaataaagcctctccccattacctccctcgactctattgtgctctacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttctagggaaccggtttttttacatgggaaacttcaatggtggggaaggattatagagatataagccacgaccaccaaatgcagcttcgcagctgaatcagcgaatcgaagtgagaaaatccccttctctgaaatttacaatcttagcaagagcactaacctcttgaaaaaaaattttagtcggtctctctcatcccattcctacatttttcctacgatccaatcaaacaaccgttcctatgttttttcctatattttgtaatcctctgttttatacttgcattcttatcaaaatcctgtgtgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatatgcccctagaggcacccggaccccccttatatatgggaaggagtccgtgttacaaaagataatccatatccctaacggaatatgcagatacagataaaatacagtcgtaaccgactaagtctcaaggtatttccttgatgtacaagttgagaaacaaacccgagacacaaataagatattctatctatatttggtatcctgtactcagcccaaataccattgccgtgtagatatgggataaccataatctccacagtagcccccgagacctttgcagtcaaccatcgtagccttctcaaagataataatccgagtgctttcaaacctttcatgccaagactgtaaagggcgaaaagataaagaatacggtgcatcgaatagatgcacctaattaggtgtagcccccaactatgtgattagttaacaaactaaacatatagttgagaacaaaataatagcacaatcgtgcatcgcatgacaaaagcatacgcggcgcctaaagaggcattctagccgactgctttttagccataataaaaggaatccgagtggttagcactctaaaaggttcacgaatgaactcacttgacaggcatccgaataaaaaactctaaagattacccaccaaatattataaaaattatggtaatgaataagtctaatagcctaggctatgactatttaccataatgaaaacaggcatataacataccaaggaaatgactatgataaaaacaagtcattctaagttaaccctgacagctttcgtagcctaaaaaagcttacaaaaacggcataacacctttctgtcgggcaccttttaatttgcattgcaataattccaaagaattatatgaccgcgtaaaaaggattttatcagcattgggcaacactattgtgcgcataaattgccaaagcaaaaaaaatgcctaagtccctaaggagcacaatgggccacgctgtttaaagtactgggctgaggtactgttcaggcttaggcccatttgcacctccgatacccttaacaataaatcccaagatccaatcgacgcttcgtcttccccgccggaactctcgccattttccccactccctgctacagtacagagctgcgccggcaaactagggttcaccattccactcaaatccaccttcgaaaagttcatcaaaatccttcctgtgatccaccgcctcaatccctcacttctcccaagccatccctcgaatcaaatcagcgcattcggataaaatcaatggcggaagagaaagaaagctttgaaggccaatgggcgccatccgacgtgacagaggagaacctgaaggagatggtggcgcacggcgttctccctgctaaggagatcatcgggtggcgaccagcgtgcggtgaggcttttccgacccccgatacacacgaggttgtagtcttctcccatttcttctatggcggcttcgctcttccgacctcaaaatttttccgcgggatattaagcttctatggaatcagcttgcatcacctaaatccaaattccatagtccacatcgccaatttcgtccatgtttgtgaagccttcttggggattaagccccacttcgctctgtttcgccgaatcttctttctcaagccccaaccgaacaagagtaagccatgtgtagtcggaggggccggatttcagctgagggggactctgagccaaaagtacttctctatgcccttcaagacttcaaacaaagggtggcacgcaaactggttttatattcagaatcctgagcctgctcttcctgagtattcttgtcttcctccggtgtaccaagatacctggaactctcttccgattggggatgaagcagcccaagccttggaattgatggatcgcatgctaaaactcaaagaacaaggcttacaaggagagcagattactcggcacttcatcaaatgccgattggcaccaattaaagaaagatcccgtacagcttttgagtttgacggcaagcatgatcctaatcgtgaagaaccagactctctggattttaaaatcatgaaggagagaatgtataaaatcttctcaaatgctattgtcgtcagctactcacatcagctgccagttgtgccatataacgcattcaatccgcctccgcaggtatgtatctgaaatcctcaacccgttaccaaaacataatcttgtcttcatgttgagttatctaaccgtggaggcatctcattcaggaatatgtattgatgaagtctgaccccccaatcactcagcgccggtctcctcgccagcacaccgttcagggaggtggagggccgacaatcagatcagacccacaacctcaaacctccaatccgactgggcagacaggttctcgcaagagaaaactggtgcttaacgacgacgaaggcgacgacggcaacaaatctgggaacaaaggcttgaccaataaactcccaaagcataccactcccaggaaaaactggctagccgtccaatgccaaagattagaacatcttccaggtataaacctctcggtatcatttcacttcggcatgcttctctcatgaaaataatactgaatattgaaagaatattttgcaggaaaccatccgacatagatccaactggaaaagatcctgatccggctgtgacagagccaaattcatccaaggattctgagccaactgccgaaagccagccgactggcgcccatacttcaggtgataaggccgatccgagtgaccaacctccgactggaaactagtcggcagcaactgaaactacaacaactcaagagcccccgactggaaaccagtcggatgtaggtccagatcaagaaactcccgaagttgaagcgcagacgacaacttctcgaggaccagaggctggtaacgactcgatgattgggtctccgaataaagaacaaggatcaccttacgttcagctaggaacatcctcaggtaactcatcttctcaagtgatgccgatttgaataactccagcttattcgtctaatgtcttggaaatacatcagaaccaccaggcgatgaagaagaaattctccgcataaaggcggctgatgactctcgtcctcctatcttactcaaatggtgggacgagaactcacaagctgccggcatcgtcataaatcgtcaaaaagaagatgaggaagtgtgccagctgaagaaagcacttggagaagccactcgcattgtgaatgtaaatcttccgggcgactgcctttgatgactttgttttctctttagcagaactaaaccatgaaccatcatgcagagaatccatcttcgtaatgaggccaagaccgcaactttagaaaagctggttcctcatttgggaactcttgaagcagttagggaccagctacacgaggccaaggagcttgccaagaagacagagaaggaattgagggaccaaattgctcagctccaggattcaaacttcgagctgagaggttcatcaaaaggtaatcttctagatctgtcccattaatttacgctgtcataactgtatcctcaaccatttggatttcaaacagcgcaagccaccaggatggcccaaatggagaaacaaattgaagccttgaaaagagacaaggtagaactggctgcacaaagggactcggccttgaaggagattgaaggtactgccagctaacaatctgaacttctctcttttaaatgcagcaaattcttatcataaatatgttttgtagaccgcaaaatcaaatctcaagctcaatttgacgtcctggttggcaagatcaagaggcttgaaggagcaagagatgaagtcgctagtgtcgctacgccactcgtccaagctatgttcctcaataacagtggtccgagtgcactcgacgcaaccgaaatcttcgacaagctgagagttgctccggatgtatatttcaagaatatcaagaaagctggaagcatgggagctagcatggcattggcgatgaccaaatccttgtacccaaggattgaaattgacgccattgatggctttgctgacgggacaagcgaagaagctgctcttgatcttatcagcaatgctcaaaacgcggctgacaaaattgcaagtgacgttgtagatagattccgcaataccgacctgcagccgagtagtaacaactctgatgatgaaaaaactgaatctgactaagtatgaatgtaacaaatggaggctcaacttgtacaatactagtgtatttatgctgtgtttgataattctagccaagtctttgatttcttaaaagcttttatcaagctttgttgagcctaaaacccaaagaagctattaaaaactttcagtcctcgcagactaagtagaaaaatcaagcaaggcaatgatagaccaagtaagcaaattgaattgataaaaaatcacactccattattatgataatagcccccgactgacaacttcaagaagaacacttgatgttgacagtcaagatagggaagtacaatgataagcttaagcgtagaaacgacgaagatgttcaatgttccaagagttgtcgacgagtgtgccgtcttcgcgcttgagtcgataggaacctggtcgggtgacttcagagatgataaatggcccttcccatagaggagataacttgtgccgatctcgtgtagtttgaattttcctcaaaaccaggtcgccgactagaaaggcacgggatcgaacattgcgattatgataacgccgcaacccttgtaagtatcgagccgactgaatcaaagctgcttcgcggacttcttccaatcggtgcaagtcatccactcggtcctcttcatagcgttcttcgcggaaattacgaaagcgcaaagactcgaattcgacttcactcggcaacattgcttctgcctcatagacaaggaaaaaaggtgactggcctgtggcccgactgggtgtagtacgcaaagaccaaagtactgatggcagctgttccacccatttgccggcataaggttttagccggtcaaaaacacgcgctttaatcccttgaagtatcatgccattggctcgctccacctgtccattgctcatgggatgcgccactgaggcatagcaaatcttaattccaaagtcttcacaaaagtctttaaaaactccgccagtgaattgtctgccattatcagtgatgatccgattgggcactccaaatctatgcacaatgttgatgaagaagtctcgagctttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgggctggtagatgaatttgtctggcgaaaaattggcaaccttcgcacgtgcgcacaattttgtcggcatcggacactgcagtaggccaaaagaaaccctgccggtaagctttgccgacaatggtgcgtgcggcagcatggtttccgcatatcccagaatgtatgtctttcagcaattgtctcccttcctctaaagatacgcagcgttgcaggatccctgaagggcttttcttgtacaattcagcttcatgcataacataaagtttgctccgccttgaaatccgctcggcttcatctttgtcttgggggagttcttgagaggtcaaaaatcgtatgaggggctctcgccagtcggcttcaatcatagctacgtcatgagtgcccgcaacttgagtagtatctttgtgaggtactgtcggcgcataaaggtgttcaacgaaaacatcagagggcgccacctcgcgcttggatccaaagttggcaagtctgtcggcggcttcattattgtgtcgaagaacgtgactgagctcgagtccatcgaacttgtcttccaatttgcgtacctcctgtcgatatgccatcatattgtcgtcaaggcaggaccactctttcataacttggttgacaaccagctgtgaatcgcctcgaactattagacgctttatccctagggaaattgcaatccgcagtccatgaaggagcgcctcatactcggcgacgttgtgggatgccgaaaaatgtatccaaagcacgtagcttaatctttctccagttggggaaattaaaaccactcctgctccagtgcccgaaagtcgttttgatccgtcaaaatgcatggtccagtgctccatcttctccgcgggggtatcctcctggcactcggtccattcggcgacaaaatcagccaacgcttgggacttgattgaaattcggggcttgaatgatatgtccaaagacatcaactccaaagcccacttagcgatccgcccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaagtaaatcggtcgctggactttctggacatggccttcttcctcgcgctcaacgaccaagactgtgctcacaacctgggaggtggctgatacatacagcaacaacggctcctgcgggtgtagtgaggctaagattggtggttcggtgaggagtttcttgaaatcttcgaaagccttctgtgcttcgggtccccactggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaaaccaagcagcttccctgacggtactccgaaggtgcacttttcagggtttaatttcatcttgaaagcgcggatgctcgcgaaggtttcttctagatccgaaatcaaatcatccttttgcttggtcttgacaactacatcatccacataggcttcaacgttgcggccgatctgcgttgagaagcatctctggatcatacgttgataagttgctcctgcgttttttagtccgaacggcatggtgacgtagcagtatgctccaaagggcgtgatgaacgaagtcttcaagcagtcggattcctttagtcggatctgatgataccccgagtagcaatccaaaaaactgagaagctcacagccggcggtcgagtcgactacctggtcaatgcgaggcaacccaaaaggatctttagggcaagacttgttgaggtcagtataatcaacacacatgcgccattgccccgttttcttccgaactagaaccgggtttgccagccagtcgggatgaaggacttctttgatgaagcctgccgctaacagcttggttaatttctccttgatcgcgtccttcctgtcttgtgcgaatcggcggagtcgttgtttgataggtttagcatcttctttgacatgtaaggagtgctcaatcacctctctaggaataccgggcatatcagatggtttccacgcaaagatatttttattgttctgaagaaaggtgatgagcgcgctttcctatttacaatctaactcggcgcctattacagcagttttagtagaatcagaaggatctaggggaatctttttagtcttggcttcgctttctccattttttgaaatcttggtagcgggcacttctccttcgctcgccgtggctgcagccagtcggatatcctctcgggcagacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcgcattgctcggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcaggctgaacagcattaatctcccgttcggtcaacttttgcttccttttagactcataagccagggggccgccgaaaatatggttgagctccttgcggtggtcttgaaatcctgcctgggtgtcgccgtcgtccttcttcctcgacgtgctttgttcttcatcggagttcttccgtgtagtcttggtgtattgctccgcaaactgcttgtagacgaaacaatctttgggcacgtggttggagttaggatggtgcgggcattgagagttcatgatcttgtcgaacgtgttgacgcgcgaacgctgtcgagaagaatgagtggcggttgcaacaagttcctcaggcttacgcttgcggtccttatggttgttacttccacctcctcccgtagccggcgtacccttgtttggcttccaactgggacccgactgctttgatgcggtgacggcgtcttcagctttggcgtactcgttggctttttcaaacataagcttgactgtcctgggaggcttacgcccgaacttgccgaccaattcttcgtggcgaatccctttggtgaacgcggcgatgataacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttgaaagttggcgatgaagtggtcgcgtaattcggcccaagatccaattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggcaccatcgtacttctctattccagtcggcttaaagccagctggccaatccactcgacgcaggtcgtcggtgaaggctgctactccgtcaaggtcgtcgtcgtggcggtccggcgaatgatgatggcctcgagctgctcggcgctgtatgattgtatcgcgaagatcgacggggcggcgacgaggtggtgagcgaggccgttccactcggcgctccctataatggtcgggaggtgagtgaacggaccgctcgtcgtgacccctgctcctgcgattggatcctgcgccggtggtgctgaggcttggatgacggtagtcatgagatcggaagtgagggactcggctgccagtcggcgtgtggacgctttcggagttaactgggaccgaagccgcaatcatggtcttcgtctggttcaagatgttgacgacgtgatcagattgattgagctcgttttccttgaggagggtgtcgaggagggtgatcgcggcaaccgcattctgttgaggggtacggaaaaccggtgtcccttcaacatcttgttggccgatgaaatcacgcgctcggcgccctgcttccaaggctcgctgccgtcgatcctcagcctccttcgcggtccgctcacgctcctgctgctcacgccgtagccgttcttgttcttgtgcttgactctcctcctccagtcggcgacgctcaatttcgcgacgtgcttcggtttcccgggcttggcgttgctcctccgtctcgttatcggccatgaagacgccgaagtagagaggggtgtagttgtcatctaggcttccgtcgaagtcgtcgagatccagatcgttgtagcgagagctaaactcgtcgtagtccacgatgtcggtgggacgcgagtcgacggtgggagagctgtagtagccatccagctgatccgtcgaaaccgtgccgagtggttggaggatgacgccgacttccctgaagctaggcgaaatcggtgttgaagccgacttccgcctaggcctacgggatggaggtgctgtcgcgatggagacggccgctaaatcgtcggggagcttcatcaggattggtgggtaagccccatcatcttgatctggtgacgttggagaagatgtgatctcgcctgagtggtttgaagccgactcgattgagatggtcttgaagtaacttccagccgcgtttgggagtccaaacgggactgaaatccggttctctcccgactggtccgactccgagtcaaggagagagatcttgccgaagttgttggtgacgaagtcgaggctgccgaaccgaaacgtctgcccgggtgggaagacgaggtcgtcgatgccggagacggatcccattgcactgatcggcgaaaagcttgacgcaccccctacctggcgcgccaactgtcgaaactagatttcggcaataataaaagggggtggctatcaagctggaaaagtgtatgggtttggagacaaaagatttatacaggttcaggccttcttattcaagaagtaataccctactcctgtccggggatgaatccgccgagtgtattattgattgtatgatttggagaaaatcaacatatgcccctagaggcacccggaccccccttatatatgggaaggagtccgtgttacaaaagataatccatatccctaacggaatatgcagatacagataaaatacagtcgtaaccgactaagtctcaaggtatttccttgatgtacaagttgagaaacaaacccgagacacaaataagatattctatctatatttggtatcctgtactcagcccaaataccattgccgtgtagatatgggataaccataatctccacactgtgttttttctattcctccgttttttgaaccctgcgatttaaagagatcctaagatgtcacatctgtgcatacaatattacaaaacgatccagacccacaaacatcggattggatagggtccataaggggagggctaatggccgggtgatcgctcgcccatggcaatcgggcacccccccccctccctcccctaacacgcacgtgcctccccgttgctcccttcctactgcaccatgaatttcaaaccattaaaaaagaacaagttagaaaagaataaaatataatataaaaatctagaatccttaaaaatatattcatgtgactttatacttataaatatatacacagtaaacttcgtatgtaaacaaattatgtatagaaatactctatataaaaatatttgaacccaaattcgaatttgagtcgcgtatataaactttgaccaataaattttaggtgtataaacttcagatgtataactttaggtatataaacttaactaaaaagaaaaactatatggtgccaaaaagaaaaggtaagtggtgaaaaaagaactatcgtctggctcgattgattgctaattagcgatctcgggtccatccaccgaacggtccgacacatagatgaattgttccggaacgattctgtaatatctttgtcgggtgattttttgtttggtatttgacgtttttctgttcgttggattgcactatgattcgtgctggaacagtgcgggatgaggatgaggcccgtgtttggacatgcctcgtggtagtcaacgtgactcgatctctgtgcgaaatttttgattttgcgcgccatgtatgtagagtgatttttttctattatatttgatgttttcttagctgtaggatcatacgtcaagattagtgcaaaaaattacagtcctatataactaaaatcgttaataaattcagctgatatgatatgcaagtgtactgtaattttggtaaaaatattatgtatgtaaatatgtatttgttatttcctttaaaatataaaattacagtcctatataactaaaattatatttatttgtaggtttagttgatataacatgtaagtgtacttttagtagatgggttggtgattattttttcaatgtaaagatctaacaaataaaatatatgcaatatatataattaatatatgttgatacatgtgcactcttctaatcaagtgatcaaatgagcctaattcaactatttaaagtcaatatgatttggatccaaaaatatgtcgcgcgatatatagctagtaccgctgaacctatcttattagtcaaaacattttcaacgatgtggatgagaaaagggcagcaatttgttactgatgcggtgatgccgatatgatatttgtccatcttaattgcttataagctgtatatctagaatcatgtgacaccatcgtttcgcttattaaccgaataagcaaaacaacttatttgcaaacagaaaatattttgtaaataaaacttttagggataattgctcatttaaccctattttagaatctaactaccaataaatttctagtttgcttatttaaccatgcttttaaaaaataaagttaccgtttatccctattttcacaacgatgttagggtttcgtttagaaaaagaaaaaaattgtattattttcagattgaccaaaataaccttaagaactcaaccctatccattcacttccaacctcatccactcattccttatctctttcaggtggcacgcaggggagggagggagcggtggtggtggcggcggcgcgggtagagagggagcggcggcggtgcaccgaggaagggagcagcggcgctaggtgttgcgcggagggcggaacggtggcggtggctgctcactgccgctgggcacggaggggggcgcatggagcaggagctcggcggcgcaggtcgaagagggtggtgcagctcgccgctgggcgcggcacagcgcaggagctcgacggcatgggaactcgccatcgctcggtgcaaagggaggggcatggccagcgatgcggtgaggaggcgcatggagagaagacctcgacgactcgacgcaaagcacttgggcgctgctcacggcgcaagaaagggggtggcgtcctccttctccctttgcggcggtggagtagagagggggcggaggtggtcccgcgacgctgtagatctgaccatcggcgtggtggatggaggcggcgagccgtcggtcgtggttgcaggcgatatgcacaccaacgacaacaccatatggggattcgaggagatgtagatgtacttctgcttgtgttgaacatgtattggtgcttttgtttgacatgttttttttgtggacacaaatttgtaccatgtatatttttttgggcaatttaatattcactaattggtttaaattcacaaggccataaatgaaattttcgtctggagttaacactgtcatgttgtcttcacggaatatggttaggcctcatcttcgtttctacgaaagagggtcaaacaagcaaagtcaaaagatcaaggctaaattggtagttagttttaaagtagggtcaaaagcgcaattaccctaaacttttatatacatgttcttagcaatgtaaaagcaaaggctgaaaaataaattacgatgaaaaaaatcctaaaataaactcgaaatttaatattgaaaatttaaattttaacttataagcataagcataagccaaaagttaaggttgatgtacgtcagcagtagcgcgcaactcgttttttcacttatcagcatttctacttaactagctgccttacttcccacgaagccgtataatttcacggaccacgaacgcataaagaaacagaagtcctagactttgatattttgaatcgaccggcaagtgtatatagagccaagaagtcatcttcacaaaggatcagtaaggtggcgtttggatcgagggacttaactttagtccctatatttagacactaatttagagtattaaatatagactacttacaaaactaattatataaataaaagctaattcgtgagacaatttttttaagcctaattaatccataattagagaatgtttactgtagcatcacataggctaattatagattaattaggctcaatagattcgtctcgcgaattagtccaagattatggatgggttttattaatagtctacatttaatatttataattaatatctaaacatccgatgtgatagggacttaaaagtttcagttccttctaaacagggtctaaattagcccttgtaagtctataggcccaaacctatcttgaatgctgacagtgacgcgagaggaactatacaactacgatcatgctcgaaagtgctagcgtcatgtcgtagtatatcttaccgtacagcaatctaaacattgacgagtctagaaccacgacgttttttttaaaaaaaaaaagtttctcaaaatgagtctagaaccacgaccaaagaaggtccacatttgttggaattaatatacgggtctttttctgtttaaatattaattatttgaaaagtcacaaaacctcatctccttaggtgatatgcatgcatggagatgtttagtaccacattacctattttagaagagggagatatccttataaggaaggacgctctcctaggcacttgagccatatgtggtggagagaacaagactaacatgcacgtgctcgctcacttggtcaaccaggccaggctatatacgttgtgtggagatcgtgcaggcgtcctgataggttgttgggaaattcggttgcctcctcctcacaacacacgcgaaaagcaatttaggatttgcctcctcctctatactggctaatccaggttgttggaaaatttgtttttggaaacgtagtttttgaaaacacatcaaataatctagtgcgtggagcggcatggtgtccggataagttatgcgcaacttatcaggttcggttacgtgatgtggagatcgtgcacatgtcgtaatatctttatataaaccgagtcaccgcctccttacaacacacgcgaaaagcaatataggatttgcctcctcttctgtactgtattgtcgctcgtagtctattctgtcccgatcgctagcgtgcaccgactatcgggagagtagatttccggaacattcgtcttcgatgccctgcatcgagagaaggcggtaataaggattctaggaagtgcttcgcgtgactgcttgctgttcgtccaccacgggtcgtcttactcttcattcgtatgctacgtgccatcgtcaacatctgctaccgcgagttcttcatgcggtgtttgctgctcctcatcaacccgctccacagcagaaccagagtcctcgatacgtgttcaccatgtttcatctatttgatcagttcatgatttactgtctagtttacatgtttagatttcatgatgtggttctgctagtatacatgttcaatgtctttatttattgatggaataatttaaatctacatgtgcgtgcttatatattcaacacatttctcaacagctaacacaaatacgaacttggtggcttcttttcaattacttgatgaagacaatagattatagttcttgacgagacattcaacattgtagttgaaatattttttcctttgagatcgtttaggagtcaaatatttgttacaagctcccagatctgttttgaaaaaaaaaacaaagtttttaagttttcaaatgatctcggatagaaatatgttctatttcaaagttgtatagctcgacgtgatctaaaaatttgaaacgtgaatttacattggttctccgcggttactatgttgtaacaattaatgatcggcaaatatcgtaccaacggccggccatgaacgaacgagaaaacaaaaggcctagacttggtcttgtggatcaactggcaagtgtatatagccaagaagtcttcttcagtagggtatatgatcagtcatcccttgtaagcgtacaggtccaaacctatctcgaatgcagacaaattaacagctcaacggaagcaaaactttgctactgcgattatgatgctcgaaggcaccaacgccatgtcctaatatatcttaccgtatatagtaatctaaacacgtgtgtagaactacaaccaaagaacgtccaagtttccaaacaactgatacaaatattgacgaataagaatatcacatcacacatacaacatccgtgggatttgtcattgagtcaaaaacaagaggtcggaacagaataatgttgcaaacatacaaaagtatcatcttttcattacagccataccctagcgtacaccaaacggatacaaatatcacttggaaagaaaatacatggtacttgaccagtattcgagagagcgaggacactgtgtggatgaaagtgaccaaattgtcgaagggtgtgtttagttctttgggtgcaaagtttttgaagtatacggatacacatttgaagtattaaacgtagactaataacaaaacaaattacagaattccgcctgtaaattactagacgaatttatttagcctaattaatctgtcaatagcaaatatttaccatagcatcacattctcaaatcatggcataattaggctcaaaagatttatctcgcaatttacatgcaaactattcaattggttttttaaaaagatttaactgtaatgaatttaatggtgcaatcaaataaatattttataaaaaaaatgttttgaggtttaaaatcatttgtgaataacaagtcttgggcgtcacattggacaaagtgaaaggtatacccaacgtagccgcaagcagcagagccacctaaatcggacggtgtagatggcacccaatattttcccccaaatcggacacccggcatggaattctttccggattaatgcaaatgtgatgatgtctgcagtgacaaaaccactgcttaatttttttcacaggtcataacctttttcatttcatatgcaaccccgaaataaaaaccatcattaaaaatggccgtggccatctcagaatcataaatcgcatgtaaaaaaattacatatgggtaaaaaaacacgtgtaaaaatacgtctatcttcatggacagttttcctaagaaaccatctgtgaagatcatgatttctatatagacggttgtcttaatgaaggcccgtaaaaattgatttttgaggatggttctcttataaccgcctttggaaacatgggaaatattatttaaaaaacattcataactccactatatgaagttggatgatgaaaaattttatctgagagaattgtagctaccgatgagatctacaacttttttgttgaacaaatttacattagtttagggtccaaaaattaattcgttacaagatctcatatctatttttaaaaataaaattttgagtttctcaattgaccccagcgggacccttgttacatatggagtcttctgacagaagatctcagattgtttaggtgactatataatttttacattgtctgagatatattttacgaatggttcttttatgaagtcaaaactttaaaaattatagaaaaatcattttaagtccaattgtggtaaaacaaagttctttgactaacatcaactttcgtaacatatcactcttataaagacttcatgacataagtaaacaatcatactaattaaagaaacagtttaagaaatatagactcgatcatatttaagaaaatactgtaaggattatagggaactttgtttcaactcaatcagacttaaaattgaattttctataacgtttgaaaattagacattttcaaaataataagagaaaaatgttttttttccgtatggacttctttaagggatctccctttaaataatttttataggcggctctcataaggaaaggcctgtaaaaatatgttttataggtggttctatcataaaactgcccttaaaaggggaggagagcactactaaaatatgacttttcataacatatgaagtatgatggtgacaatctttctatgagaatctaattgtactgactgcggactgtggagttgtggactccctccaacaaatagttgtttataatctgaatctcaaatatttctaaatatatctaaatatttcagatattatttctctacattgtgtattatttcaatactatttatttctttattttcaaaccgaattttacattgtattttttttgcatgtagtattatttaaaaaatatttatttattataaatccaatatttttcaaatatctaaatcgtatttcaacatggactcttctctaaaaactatttattttttaatctgaaatttacatatttctgaattttatttttctacatggactattcttttcatattatttttaatttcgatttcaaataattctaattcatctttctacttggactcttttattataatattttttattcagaattttagactttaagttatatttctacatgagcttttttttctgtttaatttgagaatttctatgccatgatagagaatgtggtggcttatttttctattaatttattaagataatagactataatcctcaacgagatctttaactttctagttgaaagttttgtttttcatttgagatcgtttagggtcccaatattcgttacaagctatcatatctatttataataacatttttttagttttactaatgacctttggatggagacatcttctatatgaaagttaaagagctgggagcaatctaaaagtttgtcttcaaaatttgtaacatgaattttgtcacttttttttgcagttactctgcgtggtaaccatgctaccgttagggttggtaaatcctctcgaattcctaatacttaacatgcaaagataccacatcatcatccactaacacttatcatatttaagcatcatgtaagcatgctatattatctataatttaatagtttattaaattttagagaactaaaatgtaagcatgccaaatcatccaacataattcacgtaatatttcaatatatctctccatcatttgcctatatatatttcatcctcacctagttcatgttatttttgttttctctcgttaagtcatatctcatcaattgtttatagtcctaagatgattaatctatggttcaaattatctctcttattttcttatctcattaagccatatcatctcaatttgttcaccccttagatgtatgatctaaattatcttcttcttttggtctctcataaaaaccacatcatcttacttttacatgaaccatcattctaatactatttaaatttaaatcacatcaatttatataacttatgtgtatgtaagcttatgttgtttaagctatcttacacattatttttactagaaaaatgtctgtgcattgcaacgggtgacgactattttgatcttattattgttatacggtttaattaagataaaatttactgtgtaattcgcttaaaatcatgagttgtaattagagtccgatcatctcaagttagcatgtgagttttttttaaaatgatttcttatacgactcttatgtacttatgtatttgcagaagcaaacgaacttaataaacgactcaaatacggatatgtattttcaaaagtgaacgaacttgaaaccgactcatacacagataatataccaaagcattggcaaaaatatcttcaatttttataatagtagagatttattcttatcattgtaaactcctgtagtaacgcgcggagtttcatgtagttaatagcatgctaagaacggatgagagaaaacaaaatatttatacttgcgcgctgggaattgactggcaagtgtataaggatgaagtcttcttcagtttggtcggtgagtcgtcccttgtaagtctacaggtccaaaacctatctcaaatgcagacagtttagcagctcgacaaaagcaaaactctgctactgcgattatgatgctcgaaggcaccagcgccaggcccaaatatatatttcttttttttaaaaaaaattgcctaaatcttatcatatagcactctaaatattgacgtgtctaggactactcccgtcccataataaagtaagtcacaaataaaataaataataattctaatatttttttaaataggacgaataattaaacagtgtagaaaaaaaaatcaaaatcgttaatattatgggacggagggagtacaacaaaagaacgccattcccagggactgatacaaatttcgacgaataagaatcacatcacacatacaatatctgcaggatttgtcggtgagtcagaaacaggaggtcggaacagaatgttgcaagcttacaaaagtactcgatccgtatcatctttgcattacactcacaccctagcgtacaccaaacggctaaggccttgtttagttcacacataaaaaatttataccatatcacgtttgaacacctgcataaagtatttaatataggttaaaaaataactaattgcacatattgcggataatttacgggacgaatcttttaagcctaattgctccatgatttcacactgtggtactacagtaaatatttgctaatggtagattaattaggcttataaattcatctcacggtttactgtcggattctataattagtttttttattagtgcccgaacaccctatacaatactcggtgtgacacgctaaaactttacacccctggatctaaacaccccctaaacatagcacttagaaagtgaataaatgttacgtgtaccagccggcattggggagagggcacttgatttggatagaagagtgatcaaattatcttttttttgagagaaagaaatttaccaaattatcaaagccgtgagaagcatcaacttttccgatacgcgaaggcacagtgccatgtcttggtatatcttatcgttttgcaatctagacattgacgcgtcaagagaacaaccaccgaagaaccggttcgtatttttcaacaactaatgcgaatatatatggataattagcacatcacacttatagccagcgtacaaattgtcggactcagaatgaggttggaacagaaggttgtaacttgcaacccgtacaaaagtgtcagctttacatttacgcgtgccccagcgtacagcaaacggctagagataagaactttgaaagagaatacatatagattaaagttataaattgtccaagctgcaaggaacatcaatttttgtgatgcacaaaggcactggtggcttgtcaaagtatacgtaccttgccgtatcggaattaatctagacattgacacatcacgaactatgactgaagaacgcgtccgcatttctcatcagctgctgcaaatattgatagagaggaatcacacatcagacatacaacctctaatggatttgtcggatagtcagaacaagaggtcaaaacagttgcaaccttacagaagtgtcaaattcacaatgttgcaacctcacaaaagtgtcctctttacattactcataccacaatgtacaccaaacagctagagataagcacttcgtatttggactactcagtagccggtggaggactcgatgtggttaaaagtgatcaaattgttaaagctgcaaggatgactccctacaggcatgagaaacttgcaaggaatgtatcatgatactcttccaggcaaagcaagtgacaccaaagattctcctagcggagataagaggaggctcttggagagggaatattggagcattgcctcttcttttaatttattttgatcatagaaactttctaaatttaagagagggaatatggactcgattatatggactgagtaggtctaaagggaaatttaatatcctctcactcctacgcactacccttcagcactatccactcgaactaccccgatgcaggattttaggaatcgaggtacgatgttaaaagtaactacttcatttcatattaaataagtcactttggttctgtcctaagtcaaacctattcaaatttgatcatgtttatagaaaaatatagaaatatctacaataacaaattagtctcattaaatttatttactatgtcaaactggaagatgtttgactaagcacaaatccaaagtgacttataatatgaaagaaagcgagtattgctcaataaaaatgatgcaggcctgtgtaagaagaactaatatgaacatagctgaaagtaaagtgaatatggtgtacaataaattactaaactataaagtactcaattgaaattcctttctgaaaaagggacattatgtatttaccatgaatatgtagaaaaaagtcattttcaaataatgtaatcaataaattgttcaagtattattatgttcatgatatttcttcatttatttcaaataaaaatcaattgcaatatttaggacaatgtccgtttgcaaaaatcaatttctatagacggtccttctaataggaccacctgcgaaaataatgatcgccagcgaaaataatgaaaatagttattttcgcaagcggtcctgttaggaggcttgcctggcaccaggccagcggttggcctgtccccactccctcttcttttatctcctctcttatctacttaaaaaatctcctcacccccctttcctcctcccttctatcctctcatcacccctcctccagtgccccctttttcatcccttcctccactgcccgtagtctccaggaatgacgtcgcgacgacagtggtgatgggagcggcggtggctagggcgatgacagcgggtggatccaatgccatcagacgagcaacgacgacgatggctcatcctccgctccctctccctctctcttactctctcctcctctcatcatccccttcctctcctactgtacaagccggcaaaggcacgcgaggaggttggtagattgcagcgacgatagcgaggggtccagcggcacgggaggaagccggcaaaggaggcacgcatccacggcggcagcggcgtgcttcgacaacatcacctcctcagggcatctctgccacctcgggagcagtaggccccgtcagggatccggcgttgccggccttctcccttgtggattcggcggcagcggccttcttcctcacggatctggcgctgccggccttctccctcacggatctgggggcgacagcctcacgaggggtggatctaccaccattggcctccctcgtaggtctggtgacgaaaacgagagcggcaagccacctagcagcggatccagctgccccggtccagggaggggcagatcctcaaccgccgtcctcgggtgtagcggggtctcaacgacaaccattgcagctaaggcagatttgagctagggttttgacattttctttttctttttttgcaattatcatttttgcatgcggactgcattactgaccgcatgctaaagttacttttcgcatgtagttgtgtttctcattacgaaaattactgattttgattgagaaatatatcaacttgttagcaaaactgaacttttttggtatatagaaaaaatgcctgtgcgttccaatgggtaaactaaaattataacaaatataaatatattagatgagtagggtttaggttttcatgatatgaactctttaagaaaatatattcctaaagatagaaagaaagttctcataaactgcaagggcattatcgtgcgcaatgaatgaagtgcatgcagcccaagagtgctttggcccggcgatggaggcctgctcaacgctggatcggtatgagccattcgttttaacggacgacttggatcggttcagaataagtcgaaaccgacggtgcccaaaaaccctaaccctagtttcacatcttcccctcccctcccatcaccgccggccacctgtccccaccggtggtgcctctccccctcaactcccctatccccataggcatcaccactccctctccgccgctccccatcccccttccctcccctcaccccactatcgactcatttcctcctcgttggggtgctaccgccaccccgctcctcactagatctggtctgaggctcatcaggtctggccttgggaggcggcgacgggcggcaatggcacggctcaatcgagccaccatcggcagccactctgtgccccctccttgctggatctggccttgggaggcggtggtggcagctcgaaggcagcagcggcgacttaagctcgacgatggcaaactcatgccgctcgtgtctccggcgtccggcgaggtccgatggctggatttttgttcgatttgggtattttcttcaattgtcattcttcaatcactacaaaaaaccgtaattttcttggcggtcaaaaaccaccaaggttaattattccgtcggccgaccgccaactctagaaagctaggaatgttacaatttcttggcgcttaaccgtaaggaaatgccttctgggcggtcgaaccgccaagcaaattaagaagattgcccactttcgaaagcgccaagaaaagtaaccttgtcggtttggaccgacaagaatatacctttacttggcaacaatgaaactttctagacttggcggccaagagaagtaaccttttcggtcataatcgcaaagaatatgtacaaacttggcagccgttttttggccaccaaagaaatcacttcgccaccaagaaaattgcggattcttgtagtgaattcttgtatttgggatttaattcgaggaaattttgtgaccaattttcgtatgttgtttctcctggtgtaacacgaactagtttaaattttgtgttatttaatgcggactctggataatttttacccgcgttggactcaggatgttacgaaaaaaaaaggtgaggatggacggaaattttcaccagaattcttgcgtatctttttatacgggtataggtttctaaagacaagaactatttattgtcaaagaacatatttacttagatgggtttttttgtgttacatactgcttaaatgcaagatcaaattcaatctaacatgaagtaaaatatatattttgcaataatttatgtgtcaaattgaacatttgatgggaaattaaattgtaacctttaaaaacttttatttctatttaattagaccgcgttcatgcaataacgttaatttgggactagattagtatcctcaatcctcagtagcgaccaggcaaaatgaggacgcagtctatcgagacggtgacactgcaggttgaggttctataaaaccgaccagcagcctagagaagaagaggacaatgagcaagtgagcaactggctaggttacctggttagctagtaacaactcaaacattgtaagcgcatagaggagtctggtgctctactcaactctgaaacaatcaactgcaccagtgtactaattaaatatattactgtacttaagacatggctatcgcgtcgtcgtcgttttcacttgctgctatcctcctcatcatcatcatgtactgctgccccacgggtttggtggaggcagctcgcaaggggccggctgctgccggcggcggcgacgacagcgcgatgagggagaggtacgagaagtgggcggcggaccatgggcgcacgtacaaggactccctggagaaggcgcggcgattcgaggtattcaggaccaacgccctgttcatcgattcgtttaatgctgcaggaggcaagaagagcccccggctgacgaccaacaagttcgccgacctgacaaacgaagagttcgcggagtactacggtaggccgtttagcacgcctgtaattggaggtagtggcttcatgtacgggaacgtgaggacctcagacgtgccagccaacataaactggagggatagaggcgctgtcacccaagtcaagaaccaaaaggattgtggtgagctttaattattcagttcattcattcctttctttttttatatatatatgtatatcttctttttcctcctgtgtcatctcttaattaaactcaagtaactcgtaaaactaatcataataaaattaatgatcggaaaaattgcttacggatcaccagtagtactatttctatgttagatatctactagcaaatatgattttccatatattgattaactacttttttttttctttttgtgtcgtcgtatgtataaacagcgagctgttgggcgttctcagcggtggcagcggtggaaggcatccaccagatcaggagtcacaatctggttgccctctcgacgcagcaactgttggactgctccaccgggaggaacaaccatggctgcaaccgcggcgacatggacgaagcgttccgctacatcaccagcaacggcggcatcgccgccgagtcagactacccctacgaagaccgcgcgctgggcacctgccgcgcctcagggaaaccggtggcggcctccatcagaggcttccagtatgtccctccgaacaacgagaccgccctcctgctggccgtcgcccaccagcctgtgtccgtggcactcgacggcgtgggcaaggtgtcccagttcttcagcagcggagtgtttggcgcgatgcaaaatgagacgtgcaccactgacctcaaccatgccatgacggcggtggggtacggcaccgacgagcacggcaccaagtactggctaatgaagaactcgtggggaaccgactggggcgagggaggatatatgaagatcgcgcgggatgtcgcgtccaacaccggcctttgcggcctcgccatgcaaccctcttaccccgttgcctaataaactaaagagacataaattgagccgataaccgtgttagcgtctggtgaaaaagtagtacggcgtggtgtaatatgcgattcatgtgataaattattatcagtgtttgttatattttactatgccgttttcatgacagtattacttttagaaagtacatatatgtgtgctgtaaagaaatactttgatgacaataagtcactactacggacaagagttttttggacgcccggcacttttggttccaggcaggccataactcgaagtgcacagaaaaaatgaggggaccggcgccggactatcgcccgcacggaaaaatgcattttcccgtgcgggcgtcctaacccgaccgcacaggataatccttattatcccgtgcagtcgactttagaggaccgcacgaaaaaatcaattttcgcgtgcggactttttaagtgaaccgtacggaaaaatactctctctcttctctctcacccatttcaaattttttacacactctccctcttcttttttattctctctccccatttagtctcctcgatctcctcccctcccctctcctctttcttcctctttttctcatcctcacccctctctctctatggctgtatttagatccagagtttggatccaaacttcagttttttttcatcacatcaacctgtcatacacacacaacttttcagtcacatcatctccaatttcaaccaaaatccaaacttcgcgctgaactaaacacagctatttctctctgcgcgcacgcagcatctttacttcacatctttcctttcacaagaagcatcagccgcatcttctccatttctttttctcctctgcttttgaatgaactcgagaagcatcagccgcatctctactacccttgctctgtgtgctccaagtccaagcagcagctagctagtgtggcggtggagtcacggggatagggtggtggccgccggctgtgtggcgatggtggggggtggtggtcgtcgtggaggcaggcgcggacgatggcgggggccacgacaacgacgagcaggcggcgccgcgtgcac

SEQ ID NO: 63343 - DNA, 6915 bp, Oryza sativa
atgtcttgagttgatttattatatagagtatacataatttgtttatggtgttaatcgataccactaaattttagtggtatatatataattttctcttttaaaaattagcagggtggctcattggactctacttcgaaaaatctaatagcttccggggtgtggaccacgtaaaaaaaattgctcaaactgtgatcctttgctaacatacaagttaatatagggtttaatttttttcttggattatacatctaattcaccatttcatgtttgtggggattaatattggataaatttattaaaattatttgtgctaaatgttaatactattttgctggggacaacataaaaaagagatacaatgttgttacatgtatgttttttctagtgaatagtagtctcatgtatggacgtttgtttttttctttttttttcttttccgacaaatatttgtatatcataggaatagggagtgcgtatttgtattcataatgtgcgtatgcacgcatttatatgagctcctacgattgccttttaaattgttagtaaaaaaagtatttttaaaaatttgacaggaagagggtggagcaacgggtgacatgagacaatggtgtggcaaggagtgatcactacgtatatgctcaatttagaaaagaaaccttagatctagaaataaagataaaacaaccatatgggacaaatcatatacacactcttcttttttttccttaaaaacttgacaggaagagggtggagcaacaggtggcatgagacagcggcgtggcaaggagtgatcactacgtatatgcttggatctagaaagaaagagaaaacaactatatgggacaaatcatatacacactcttcttctttttttcctttttatatatcttgcgtaggtatgtacataggagatgtgtataggagatgtgtatgtacgtaagaagtgattagatggtttttagacagagggattattatcatagatctaatttaatggttgaaaaataatggatcaccgattttgtgtgtaaatcgatgaatattatttttattttattttacagtttttcttagattatttctaattagagcatcacatgatatcttagaagcgtttgtatgagtatagaaatgctattactcatagtcacaatctacctttagtcaactattgtttgcggtggattagttgcatcctctacttacctataatttgttgatcgttgcacacttatatgccctttatcatcggtgtttgatgacatacatgctcattatatatcagctacccggctgttaggtgcgttgtgcacgaatacctcataagtaatatgacttggtgattagtaaatggtgacttatatataaaacttatatatatggggatcattgaggatatacaattgatattttaggctaggattgacaaattatattgtatactacatattaagtttttaatatctaagtaataaatttaagacaataataatgttgtaaagtgcttttaagattagctactccctatttaatttatttggctaaaattatttatttagtttttatctcatttgagtgaaaaagaaaaagaaaaaataaaaagaaaggaaggaaggggaaggacgtacactaacgaagtatgtacatacgtgaacgtacacgtacgtgagtgatcgacatggatgtgtggctttctgaattttaaagatgaattaaatatatttggtattttagatctaacggttaaaaatatgagttcaccggattaaatgaaaatcaatggttagatgttttaaatgccacttggcagcctagaagcgtttgtagagatgccatgtggcagtttaggagcgattgtaggaagtttaatggacttttagtatataatagatagatagatagatagatagatagatagatagatagatagatagatagatagatttattctgaaattcaaaattgttattctgaaatccatagtagtcactaacatttattcgaaacaatgtttccatacagaaatagttatgtagtgtgcggtcatgttcaattaataatagcccatgcgaatacactgactaattaattaacgacttggctcgtactcaaaaattatatatcatcatccatagtccatacgaagatcttgctctgtgttgaggattacctgacttcaaagcccatttagaaatatacaaagaaaaattttcgattcctgctcaataaattaagatactccagaagtcaacgaccctccccaaaactctggaattgtgttgacagctgccatgatttcttaaccagcttacccgcccttgaacgtgcattgcattaaggtcaacacttatgaacaatctggtttacatcgtagtatagtataagtgaagtatatagattttccaatgcacacccagacgatcactggtattagtttctattattattatattatcgaggaccaccgcatattatgatttcttgatgcattaatggtacgtgtgggtgggtgcagtaaacaagatcaacacttacgaactaatctaaaatgcaccgctagtaactcaactcgtgaggtgggtgtaatttagtcacccatcttgtaaaatgctcgaataagttactcatcttatcttgtttttagggtgcaaatcacataaaacatatgttgtgtagggtgttcgcaatgaagttacgtgttgtgttgatttgttttgtaaacatgatcacacgatctataaataagccaacgtgcaatactaccggtattaaaatccaattaaagatgaattttgttattgattattaagcataatatggtggcgttcattaaaaacatgagtattaggatatacataaaaaatatgtgtattaatttgtaattgtaatgcttgccctgctcacatagctaaaaaatgcacgatgttaggtcaatacgacctccaatttgaaaacaaacaatccatgtgacaatgtattcggtaagatttgcaccatcgaagcaaaatgagtgacatatttgagcaatttataagatgaataactaaactgcacccatcttgcaatttatgataccaccgacgtattatactcgaccgttaagttatagcaattaaatatataacaaatcttgggctgttcgaaactctatattgaagtagcatattagtgacacgtaaaacgaacaactcattagtgtgtaattaagtaagtattaaatattacaaatttaaatataaattatttaattttttaagaaaaaaattatacatatttttttttataaaacacatcatttaactgttcaacaaaagtgctaatgtaaatagtattactagtactccatccatttcatattagagcaaggctaataatacagtcgacctgttggctataaggttctttgtagctttctctcagtctacctatatgatagttagctatttataattaatatagggcccacttgtctctctcacagagtttattggttattgtgcccgcttctcctgtcttctctcctccacctcagcatttagctggcttatagtctactatattatacttgctcttataagtcgtttgacttttttctttatcaaagatctttttgtttgactaaatttattaaaacaattagcatcatctacaccactaaattagtttcattgaatttaatattgaatatattttggtaatatgtttgttttgtattgaaaatattagtatatatttttacaaacttgatcaaatttaaacaaatttgattaaaaaacaaaataacttatatataatacgaaatggatggagtaacatgaattaacgtatttctttttataaaacacatcagagtacagcgacagcttacagagtacagtacgcatatacagtataattttcccagctatctggaagtcctctgcagactacacgtcacacgtatacaaagtcatcggaacgtagtgcaaaagtctgcactaattaattgtatcgtgttactaatagaggtcataaatatatctttacatggaggactgaaaaatgccacgtagaagaatatatatttgcatctttatcatggtgtggggtctaaaatgaccatagctaggttgatcgatttgtttactaaaaatacaaattctatttatattgatataaacgaaacagtacgtaaatacaaaatgtttgtacgtatttataaaaaccggagcgagagttgacttgcaaaattaaattaatttagtggaaagaacggcaaacatatggacacgtatatgatcatgacatcgatccagatctttttgcaaataaaatgtggattattatttacaatttattcaaaacgtcagaatatcaaccatttggacttgaattagcataagccaagtccaagccgtgcgcgtgtatatatatatatatatatatatatatatatatatatagctagctagctgttcttcgctatctagtagtgaacgggccgtttagttcctaaaaagtttttctcaaaaatatcacattgaatctttggacacatgtatgaagcattaaatgtagattaaaagaaaaactgattgcacagttagggaagaaatcgcgagacgaatcttttgagcctaattagtctatgattagccataagtgctacagtaacccacatgtgctaatggcggattaattaggctcaaaagattcgtcacgcggtttacaagcgagttatgaaattagtttttttattcgtatccaaaaacgccttccgacatccggtcaaacgtccgatgtgataaaaaaaaattttattttgcgaactaaacagaccctagtgagagcatcattccgatggctacacataaataattattgattttttttaccatactactgtttagtggttctgtttgatgttacatgcactctaatatcacggggcgtatacatgaagaaatagtaaattttggcgtgcatatcacactcattttttggtctcgctcaaacgttttatagactgcgacctatgtgagtacatacggtgcattgcagaaagagaaagaagaaaaagaagaatgcagtggagtgtactccctccatactcgtagaaagtcattttggacagcgacacggtctccaaaacacaactttgacttcttatttctataaaaatatttattgaaaagtgatatatgtatatttttatgaaactatttatcatgacaaatttattcatataatttttatatttttaaactcaacaacttgaaagttatttataatttatatttccaaagtttgacttaaaccttttcctaaacgactttgtttacgtttacgagtacgacagagtattcagggaagccatacagtcgaaagctcaagttgcagttgactctccctacacgtgtagaatacatgcacatgcatatatacacggaccaaactgttcaggatttcagatctcatttaactagataaaacttggtggatatatggaaatgaatatatgctaaatattatagaaatgaaggacacatttggtttgggttaaaatattatgaaaatgatgtgaggaatgataatttattatgctttataatgtaataaactgtagatgtaattgctaagcttgaatcaagtactattcaattcaagttcctctatttgaaaaaaaaaacataaatccaagtctaactaacgaataggaagagatatacactactaaaaatgatttttctgtacgaacacatcaataggttgcaaacgggttataagtgtccgcgtctataaatcgacccatattttcccatacagctcctcaagagacgcgtatgcaaaaaaatcaatttttccaagtgaaccacttaaaatatccacacgtgaaaataagggtattttcacgtgcggggctcttaactcaccctcatgcaaaaaatcccccctcctcttcccactcattttttttattctcccccctctctctctctttctctcacccacttctcctcctctcctctctctcggcctcccccactcctcctcctactcctctcccctctcttccctcctgacggcgggcatcggtggtggcaggcatgggcgacggcgacggcgcgcggcggcgtcctccgccctcctcccccccaacccccaaatgcaccctgacgcgtggcgggcacctccagcggtggagagcttggctgcgagttctggcgggcggcagccaacccccgcacagatctggtgcccagccaccctctcctcgcacgggtctggcgcacggcagccccctccggtggtggagggctcggctgcacggcggctatcccaagcacggatttggtggtggcggtcgtccccagcatggatccagcaggagccgccctccccctgcgaatctggcagcggtggccatccccccccccctccccctccccccgctgatctagcggcagcggccctcgcgacgatgatgacctcgatggctagcgggtggcggcagactggatggcagcggatctaggtttcgggactagggtttggatttttagacttatatttttttatattgcagatgggcagcttatgcgcccgcacgcaaaaattggatttttgcgtgcgggtgcgtcacccgcatggagaaatgataattttttgcatacctcttggtgcataagggtcttcgatccacacgcaaaaatctagttttggccgtctaaaaaaatagttttttattagtgatagttggatttatgttaaaatattgtgaaaataatgtgaggattatttgatatgcttacatgttaagctcttgaatgcaataatttacagatttgcacgtgtttgtatctaaaaatataataattgctagtgaatgatgataatatgtttacatatgaagctttagaatgtaatgacttgtat

SEQ ID NO: 63344 - DNA, 16979 bp, Oryza sativa
gggaaagggagctgggccgagaggggaggaggcccaagaggagggagagaaggagagggagagaaagagagggaggagagagagacttcgggctgggcttggcccaaaggaggaagaggagaattatttttaggtttttctttttaataaactttgttaattgtttttgttgcttaataaatatttccggcgctctgaaaattcaagtaaaatttgagggctccttttagaccaaggagaatttaacaaaaattctccgggccacatttgaatttttcttgtacgtattttagtgtttgccaaattcttttcgaatttttaattaattctattattccttttagaaaatgaattttaattcgggatgaatttatcaggacgtgacatttaacaggttcaagcatatcagctttacatctcctcggaggttgctgatgtggcctaactcctggtttaataggtagccgatgttcgacgatcgatcggctgagtccgggcatctcatagtattcccaagcgaagcaatctctaaactcttttaagagctctatcaacttggttctgaactccgaagacaagcctttgctaatgaatgtcggccttggtcgatcgcccggacctatatcaatttctttcaaatcatcggccgacataaaactttgaccctgcttatcatcgagatcatctactgtgtccttagcacaggtatctgaaccctccacaacgccctcaaagtaatagcttgggttctccatcttcaattggctgtatgtcagaatcggacacttttagaaaatctccatcccagacttttccagataaacaatcaaggccatccatttcctagagagctaaatcggcattggcaacattgactgaccggtcggctggcacaacctctatcttgtcacattgccactgaatcaagcactgatgcatagtcgaaggaatacaacaattggcatgaatccaatccctcccgagcaataaactatatgaacccttcccatcaatgacaaaaaacgtggtaggaatagtcttgttgccgactgtcaactccatatttaacgcacctttggtttctgatgggttaccgccaaaatctttgagcaccatattcgtcttgatgagatctacggcattcctacccagcttcctgaacgtagcataaggcatcaaattcaccgctaccccaccatcgaccatcattttagacatcggcttcccattgacgtaaccatttacatacaatggcttgagatgccgattctccgttccctcaggcttctcgaacaccgcctgctccgatgatatgaccaacttagccgattcatcctctacttcatcgacatcggcctggctgattccaaactcggctggcagcgtaaaaaccatattgactggtgctgtaacgacactctttccttttgccaatctctttgcctcatcggctgtagtatcatcggctgcaggaacttgggtcttaacgcgccacacctgccttggtcttggtttcctcagtcaatggttgatttcctcttcaacctcctggaaacgctccctactcctcaatctctggaccctccttttctggttcttcgtaaaaataccagaaggacaccattgattcttcctggtcaactcgtcctcttgattacgatcgtgactcattggacccaatctttgatgaacagggagtcttgtctgtctcagccgatcacccctatcatgtggtcggcttaagctcttaatgacgtcgctacatccaggacaattttcgatagatggcaacctcatcccttcattccagcagaatctgaagaattcacaatcccaatgaggatcaaaaccgttgtcattctcctcgtagcatctctcctgctgcttgttatacctcctttgatatttatcaatgattctggccgaatgtacttggaagctcttcaaacgaggtccatcggctgcttgacttgccgtatacaccatattgacaggaaaaggattcccatcgaccttcatcggcttcttggagtcatcaaatttaatctttcccccttcgatggccacctggatttgctgcctgaagaccttacaatcattggtagaatgggatccagaattatgccacttgcaatacctcttcttgcctaattcctcagccgacgggatcgtatgaccggcaggaagctgaatctgcttttctcggattagcaaatcaaagatcttgtcagccttagttatatcaaaatcatatttttgctcctttccagggttttttacccattgacacggtataaccttcttgctcctcacccactcggctgcagcgatctcaggatcatcatcttcatcatctgattcatacatatactggcagacctggttaacctttttagagcttctcctgacgtcagccgacctatgctcatgcaaggttaccttttgtattaaatgcgacaagctatcgaaatcttcggatgaaaatttctccctgatcggagggatcataccctggaaagccaaatcggctaactgggcatcggtcaaacttaagctgaagcacttattcctcatctctctgaacctctgaatatactcatgtacaggctcatcataccgctgcttgatcgctgttaagtcagacagcttcatctcgtgaaccccgctgtagaagtagctatgaaattgtttctctaaatcagcccaactattgactgacccatatggcaaagatgagaaccatgtaaaagctgatccagacaaagacaatcggaacatcctaactctcaaggcgtccacagctgacgcttctccacactgagccagatatcggctgatatgctcgtaggttgatacgccctcttgtcccgaaaacttagagaaatccgggattttaaaccgattaggaagaggaaccctctcaaaccactctagataaggctgccgatacaagcttccggtctctttaggcttgagcccgaattgttccctcattacatcggcaatcacatcggcccacggtcgttgctgagctgatccttgcggttgctgctgcatggattcgaactgaccaaactggggagcgaactgctgctgagccgatcctcctggctgatattgggcttgtatggatgaaggctggtacctatagcttaagttgcccccttggtagtcgtgcagatccggctgaatattgcgtaccaagtgctcagggaccatctgaggtatcacagtgccatctggttgtacgtgatgaaccaaatgttctggggtggcttgattcccaaactgctgcgcaggttgccccccaggtgctgcgaacccagccgatgcattagccgaccccaggtgttgaatcgactgctgccgtaccggagtctgctgaatcggctaaagtcgttgcctcggcggtgtttgttgatttggttgaaaatgctgctgcggcaatgacgcttgctgaaccggctgcagaacttgttgttgaactggttgtaccatcggctgaactggtggcacaacttgttgctgaaccgactgcactatcggctggactggcggtgcctgctgaatcggctgtacagcttgttgctggatcggttgcaccactggctgaactagcagtgcctgttgtgctggttgcaccacttgttgttgggttgattgtaccgccggttgaattggtggtgcttgctggatcggctgctgttgcaccaaattaacaacgggtggtggcaggaacatagcagcaacctgatcctgagttggctgatttgtaatctgttcggcaggctgtggatactccctcaccagtaatcttggattcatcggctgagccgccacagtagccgatgcagcaggtacagatgttgatgctgacgccgttggttgggctgttggcgcgacagatggagccgcctgcacaactggctgagcatcagtgattaaggtccagtaacttggaaaaactcctcatggcaagtaaaccgggcctgtagcctgaaactcagctatcgagccatcggctattgccttcatcatgtttgatagcgtgtcgactaacaccccggactggttaatcaaagcatgatgtaccgcgtagtcaacccgatcttgaaagttgtggaaagacacttgaagatcttgactgaaatctcctcctggtagttcttggggaatacggcttggagttccatgcacctctggaaggttatcgccttgattccctgcaaaaccaccggtagctcctttggcgctcggctgagccgagccatctggatctcgcttaatttccccatctttagatgaaccggttccagggatgtcggcgactagcttcaacttgtacttctgaacgagtgatcccttgcgggtttgcatgtatgagctcagatactgatcccgtgcttgttgcatcattgcttcgaagtcctgcttctgctctgcttgaacttctcggggtcaaccggcaggacattgtcgtcaacgatgtcggtcagccctggctttggcggtttgcctttgccggagcctgggcttggcggtgctgttttcttggccatgagggggatatgacgtctgacttctaatcaggtcccaccgggcgtgccaaaagcgtgttgatagaaaacacgaggcctgggagatctgcttaactccagtgcaggtccaaaactcgccttcggatacgtgagcgtgccagttgatttgatcctacaatcaacaagaaacagagacaaaagaaccgtggttaaatctataaatgatagccgatcggccaggtgccgatgacatatcatttacgtttgagccgatgtcatatatagatcgatcggcaatggaaaatagataataaagaactaaatctattcgatcggctgtagatattaacaatacataattcttatatcgacatatacttaagttaagtgattgggatagatcggccatcatgccgagacagtacaaatcacttggactaaaagatatgtttataacagaactatatacgtctacagcatagccgatcaaataaatctagcatgcatcggctaatactccgatgcaattctatgttaagatattataacaagcagaatatgccaaacaaaagcttaatgtatgtaaatgcaataatatcttgacatgaaaggcagatttaacatatcagtgcgacatataaagcgaatatagttaaatcaaataagatcggctgaaaccccgatactatcctaattaacaaccagaaagcaggctagagattgctattctaagcatgacttaatggatcaaactcaactgatgcagcattaagtatgaaaagaagaacaatatctagacaatcaagccactggaagattcatagaatggtagatatcttatataatccaaatcaacatcgagatctaacctaatcggctgtcttttgcatgcaaatgttagccgataatagattagatagagatattgttgaagattatgtaagatatgtgataactcggcgaattatataaatgagattagagtatcatgaagatgtaagcactaatccctaagaacataattcgtcataacgagctttacctcttgttgaagatcgaaaccgatgcagctcaacccggaagcaagaactcgtcgaaataaaacaaaaacgaaaggtggcgatgcgccggaattgtattgaatgtgtgtatttcgttacatagggttcggggtctatttatacccgaggattacaagatatgcccgtaccggccacgaccattatctctaacaaactctaaaatatcacgagtctttgcggcagactcttgcccacacttatctataaggaatttacataaataatctaattaatagatacaattgccttctcaggactctatccagacatggcaatcatcttgaagcacatcaaactgagcccgacgtcgcgcataagtcgtattatcagaatcggctataccagcctacttagcctagctcaaccttagccgatcctagccgtagccgatccagactctagccgatccttgctctgttctagaacttgatcttcgtctccaactcttctccgattaagtcccttttcctgatacgaatactgaccaaatttggttgttaacacatgccccccaagtccgggatattcgataatgttccggatttgctataagccgactccgagtaagtttcgcattttaccgtttccgaccgttaccgccgtgctttaaatatttaaccgtcacccccgagaaacctcacaccgtaacttccgtttccaccgcttaagcaaatccaatcccctttcttctccggcgacttctccgacgcaaaggcgactccccggcgattcccctctcgacgagatctctgccctcagctatgtcttcttccgccagcccttctggtgcgccaacaactgagtacgctgaggtaagttccaatcggctaaatccctccttcttcagcaatacattgattttctttcgtctcataccgcttctcccttttccattgcttctggatttatagcacctttctcatcaagtcgcaatcccaagtctttcgcatcgaaaccactatttcctcggcccaatcggcagcctcgaccccaccgatttcattactggtgaaaccaaccggattcccttcaggctagccaatcccaacctaggtcattggaagaacacctttaagtcctggccatctttggagaaactttcgcctgacaggagctggtccacttggtatcagcgtgtatcggctagcaagaaagttcactaggacgagatcggaatcggccaagcacttgccttaactatagccaactctgccaaagatgaactattaatagctgccgccacttacttttggtcaaacaccatcaatgctttcctattcaaccaagggccaatgactccaaccctaatcgatatcaccatgatcaccggattagatgtgacttcatcggccaaccccatgagcaagaacacccggaataaatttgatttcaagaccaaaaacataggtggttggtctggctatgtagcagcatacatgggtcaaggatctgtcaccccccgagagcatgtagcctttttgctcatgtggctggaaaaatttcttttctgtggatccagttgtggccccacaaccaactggcaatttgtagccgaagccctggaatcaaagaaagaattccccctaggaaaaattcttctcggctacctgtaccagatgctaaacaatgcatcagctagaattgctgtcggctcaacagttggagcaggtggaccctggtggttactgcagacctggttaaacctaatggttatgaaggttgtcaatcggcctcctgtgacagaagctgaattccactgccagagccaattacaggtgatgatggagaagaacgcacacatcgcaggtgcacatcatacggggaatatgcatccacacctaccgacgctggagcaaagctatcggctgagctgctcaaggactggttctgtagcttctacgaaggtttcaagaaagatgctcggatctggttcccatatgaagactcaacagaccttgaactcccatcagatttcaggttcgaagacataaatcacgagaaattccagaaatccagagaaatccttatagctgcaatcagcccttgcatccaccccgtcggcatccatcaaggaagaaacatccaggtgtcttatgaattttatcatccaatgagctcagccaggcaacttggattaggccaactcccaatcggcttattctttgccgacaagattcaatgtcgaggccaaatcacatccactctaatgatggatcggctactcaatctaccaggacctcctctgggcagtattgagaacattgagttagccggtttcagaagcaaaaacttcgacagatggtggggtgaatggaagctacatctgtttcaccaattggccacaatgtatatgacagatcttttccctgacgtcataccccaggtaaatattgtcatcattaagtttgtatagtcaattgatcaatttattacttaaccaatcttttttccccactttacagacgacagaatcttcccctcctcatcaaagtaacagcggtaaagacatcgaatacgctgcaggcttgattccaaacggaggtggattagctccccctgtcatcggctaccatgcccctaagacatcaactctcctccatggcctcactagagaaccggccgatgcaggccaaaaaaggaagaccagagcttcaaccacaagcatctcaatcctggctccaaagaaaaagaccagagtcaagagagccaaaccagatgacaagccagccgatgatctgcctgacttagatccatccatcgaacaagccttagacgaagaagccatcggagatgaagtcgatcaagccgcagccgaagtaagcgatactgaaagaacaccatcggcatcacccaagcaaacccttccaactccatctgctccagtccactccatcttcactaattcctttttgaacccttttaccttatagccgatcacccccgagtcttataattgcagaaaaagaagaccgcagtgaaaaagagaccggctgcaacaacatctaaaccagtttcaccagtaagataacttaaactttcaattttagctggctctacttaacgcttgctttcttttcagctttcacctcctccttcttcctcggcccaacaatcatcgagtgatcagaccccttcggccgtgggaagtcaccacattgaggaagaagaacaaccagccgctcctgctatcccagtaagtttcccctagcgagcatccaaatcgactacaattgtttggtttctaaccattttcatattatcaccacaggtcctagccgatcttttctcttttgatatcagagattatcttgatgaaggagaagaagataccacaagcaaagcattggcccctttatccgaatgatgtcaagaagactctaaaaagtatcttagatcggctagaagcatcatcgctagacagcttggtagttgactgtggcccaatcagagctcggttgcatgaaatccaagctttaatcccggatgagttagccgatgtccttactccagctgtttaccttgaacaacatcaattcaagctggagaaagccaagttaagactagccgagcggcgggaacgcaaagacattgagtccactatccaggccaaccgacaacttgtgcatgaagaaaaatccaagctcgatcaattatctgaaggtccaatcaagtccaatattgatcggcttgaagcacgcaagatcgacctcctagcacaacttgaggaatgcaacgctgagctggatatggagcgcaagaaactagccgatctccccaagtcaatcgaagagcagaaagccagactgaaatcggctattaagcatgtcgctgaactaaccaagtccttaaaagttattcctggaaccgacgctcaagatgctcaagccatagaagaagtagagcaaattaggcaaaaagctatgtcggctatccagcaatacttatcacagtaatcccaatgtaataggacttagaaatcttttgtaatcggcaaaacagcttgatacttcatcacttaacatccttctatgccgattaatataaatttaaaattcgcgcaaaaaattttgccctctgtatttgctgcattttaacagacatatatgcccccctagttttacaatgtcaatggcattgataaaactataaaacaactaagggcgatataacaatatcggccattgcaaatcggcaaaccgtcggccgattacattataaaacaactaagggcgatataacaatatcggccattgcaaatcggcaaaccgtcggccgattacattagaaaacaactaagggcgatataataatatcggccatctcaaggcgatgcacatacatcggctatcatgtatcgacactaggaaccgatcatgaattaatccatacactcggataatacttcttcaagtatttaccattaagcgctcgtccataaacttcaccatcaagcccttgcaacatatatgcccccttagaaacaactttatgaccacttgtcgaatttactatcacgagtatcaatcggcaatatcaacttccatacaagctcgccctctgaaaaatccttaggcacaactttcttattataatgccgagcgacgcgttgcttgtccttagtaaccttcgcaagggctcgcaaacatgactgaaccaaatcctccctctcatcggccataagattgtaatactcattggctgtcaaatcattttgcaactccgttcgacgagaaccgattctaacttcccaaggcagaatagcctcatgtccatagacgagtttgtaaggaggaacttggatcaatccatgacaagccatcctataagaccataatgcttcggccaaacgagtatgccactgccgaggataatcagaaatcttccgcttgatcaatttgatcaagctcttattagacgcctcggcttgcccattagcttgtgcataataaggtgaaaaattcaacaacttgatacccacgctatcagcaaactgaacaaactcatcggacacgaatatggaaccctgatctgtagtaatagtttgaggaagaccaaatcgatagattatatgctcttgaacaaactgaatggcatctcccgaatcaactttcttcaagggaattgcttctacccatttggtgaaataatcggttgccatcaatataaatttatgtcccttgcttgatggtgggtttatcatgccgatcatgtcaattccccaacctctgaacggccatggtttaattataggattcatagccgacgctggtgctcgttgaattgctccaaacttctgacaatcctgacaacccttataataccggaaacaatcctccaacatcgtcggccaaaaatatcctgcacgtcgaatcaaccacttcatcttgtgagccgattgatgagtaccacagatcccctcatgaacttcaccgattgcaaccttagcctgatcggcactcaaacacttaagtaataccccatcaattgtccgataatagagctcatcatccagcaatgtatacttcaatgccttatatcgtaattttctagaagccgattgggaaggattgctcaaatactgatgcacatcatacctccaatcattggctgatattgctgcaatctcaaccttcacatccttgatcatcggcttataccccgatgccccttgagtcaaatcgttagcgtcaagattttgatctcgagatacatgcttcaaagtaaccagccgaaactctttcattaactctaagcacttctcattataaaccagcaatgtatcattcttgcattcatattcgcccaccaactggctgattactagcaaagaatcccccatgatttcaatagtatcggcttcaacttccttgagtaactgcaacctcttgagcactgcctcatattcagcttgattattagttgcatatggtttaatagtataagcaaactcaaaacatgccccctaggggaaattataaccaagccgatgccacaaccatgggtgcagaccgatccatcaaagaataaagtctatggcactatttcaaccgagccgatcgaattatcacgatgttcaacaatgaaatcggctatagcttgtcccttaattgccttcggtgattcgtaccgaagatcaaactcggttaaagaaaatatccattttccaactcgcccctttaatatcggagccgatagcatgtatttgattacatcggctttgcatataacagtgcactcattagataatagataatgcctcaaccttgtacacgaaaaataaaggcacaagcataactctctacaggagaataccgagtctcagcatccaagagccgtcgactaagataaaacacaactcgctccttcccttcaagctcttgaaccagaaccgagccgattgacttctcaccagccgataaatacaatcggaacggtattcccctctgtggaggaatcaaaacaggaggagagctaagataatccttgatattatccaaagctttttgctgctctaccccccaagtaaattgctgatcggctctcaacctcaataaaggcatgaaaggttccaactttccggataaattggaaataaaccttctaacaaaatttatgttgccaatcatctcctttaactcggttttattttccgggggtttaatcctctggattgcgttaatgctccgctgagttacctcgatccctctttcgtgaacaagaaatcccaaaaactggccagccgatacaccaaaagcacattttgtcggattcatcttcaaaccatatttcctggttctctcgaagacttatattaaatcggctatatgatcagcaatttccttagatttaactaccacatcgtcaatataaacttcaaccaacgagccgatcaaatcgtgatatatatagttcatggccctttgatatgttgccccagcactctttaggcccaaagtcataacaacccattcaaataagccgattgcaccaggacatcgaaaggccgttttatatatatcttcctcagccataaagatctgattataacctgcattcccatccataaaactcaaaatcttgttccctgatgcagcatcgaccggctgatcggctgctggcattggatattcgtccttcggtgttgctttattcaaatctcaaaaatcattcccattggcttgggttcttgagtcatcggatccatcattcccatagcctttgttaccagtattatccatctgtcacaaggtagaggttgagaggggaagcatacaaggaaagaatagaccagaactagggacaagaccttaaaggaactaattcttcttgctgatgtgctgtttgtttcacttattctgcaagttgattaagcaaacaacctagcatggttacatcacaacccaccgatgcaaaccacgcgctacacacacaagcaaggaacacacgactaacaacactaccctagagggtggcttaggttctgcgacgggttctccaagatcttcactcctgcttcttctcagctggcttcactgcttcctccacttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccacttggcttatcctacagtcaagatggctctgataccagcttgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccgaagatgcataattaatgcaaggggggtacaaggagataataatataggggttaagttttgcagtaaacggcatttaaaagtcacttagttgcccaaagctattttgtaaagacgatcctagctatacaatattattaaccaaggccgtgaaccctcacgaacctgccttaacccaaggcctacgatgattcagaccgaactggcaacccgaccctgggtcccagctcgtcccaagccaacccaggccaaccattccacagtttagttgttgagcaaattttaagaattataacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccaagcttaatccttatagtacccgaggtacgactaacaaaacccaaccacgcacctcgagcccagcctaaaccattttgggggttttgaaaagagggggaggtgtgtgtccaattccaacataagccaaccattccaaagtgtccaaatgatatgagaatatcccaaagtctagagttgtaaaaccgcctaatgttacctaattaaattgcgaagcatctacctaaatttaaactagggataccacgagtagagtgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcagagagaacggccttccgaaccttcggcgacgaccacgaaccacgcttctggaacctccggaacgacgaagactacgcgaagcacacaagcaaagctacaagcctaaaaagaagcaataacaatacataaaaagaaagcacacggttctttaggttatacaaacattaggagacttgaacgggtcgattcagagctcgtatgaccaagatatgatcatccgaagtttaatgctgttatatggagatttgcgaattattataattaagctttgcaattataaaacatgtgtaagcgctagcctggaaaagacaggaaggctgcgccgttgacatgcggaccccacatgtcaacctaaaggaccacggtagaccgggtacacagagacggtccacgggtcgacggaagcggaccccgtgtgtcaaccgaggcgagtggccaacaaacggagtccactagacaccacacgggctgcacacgtggaaaccacgcggctaccgagcgggcacactaacacggtcaccacacgcacaagcgaacgactaccgacaccggtacacgggtaccggggtcgacgaccgcacaacgggtacggggcgacaccgaaaggacgagggcggggaagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacggggcttgacgacgcggagccgaggacgaagacgaggacggggctgcagcggcgcgcttgacgaacgcggacgacggacgagaacggctcgacggagggacgaacgccacgacgaccgggaacgacgagaggacgacgacgacgacgacgaccgggaccggcgaggaggcgacgaggacagccggcagtcagctgcacggagatggggacgacgtggaacacgccgctacgatgccgacgacggaggcggcgccgcgagacgacgagccgggcgaccgatgggacgtcgatcggcgaggacgaacggtgacaaggaaacgacgatggcagccagcagcggctgcgcggaggaggggacagcgtggaacacgccgctgcgatgttggtgaaggtggtggtgcagcggggtggcgagccgacgaggaggaaggagaggccggcgcggagacgacggcgttccggcgaaattcgggcgacgccgtggcctggccgggagagaggacggcactgcgacgtcaacggaggagacggcgacgtcggtcggcgtaccggcgacgaacagcagccggccggagacggggaagtggtggcgacgccactggacgccggcgaggacgcgtctccggtgctttccccgcgaaacggagggctgaccgagggagagggggcagccgcgacgccgggagaggtggcggcgcagccggagggtgcacgggtgaggcgggaggtgcggctggaggtggccggctcggagaaaagaggagggcgacggcgggaaggcagctccgggggtcacctcgcgaaacggagggcaagccggggtggaggaggtggcggcgacgctggaggaggcgacggcgcggccggacgacgctccggcgaggcgggagaggcggctggaggccggccggcaacgtgggagagagagggcgacggtggggaggtggctagagactacgggagaccgcgggagggggctaaagcgatagaacggagcgagggggttgcattttatagcggagggaagcgagccgagcacgggagagggcggaacggcgacgggaaggatggccggcggccatggttggtggccgggaaaagtgcggccgttcccgatgattgggggcgccattcaagggggaattaagggggaaagagagaggagggaaaggggattaattccccctaatcaatttgggaatcccatgcttgattcgcgcggatttgagggagtaatgg

SEQ ID NO: 63345 - DNA, 28326 bp, Oryza sativa
  unsure (1)..(28326): unsure at all n locations
tggaaactgaatctgagaataagatatagactaccacttctcggaccctttctttaggcagtaaaatacccttcttttgagtaacttctttgcctttttgagcaagtctctttggtgatgatttggatgaaacagtgaccaactgaagattggaaattgaagctcttgcagctgtatctggatgtaccagcacagcatagctgagaatcacccccagttcaacacctttatatttgaatttatgcacatacttcctatctgctgcttgaacacgcaggagagcctttgtttgagcttcttccttcagtgcactttgcttttgcacatcctggctggagttttctctacgttttttgggtgccacagcaacttcagttcccggaacaagttgaactaaaagaattaaaagcatgacaaacattagaaataaatacagaaggtacatgacctcaaatactgaaggcattttttatgagaaactaaaagcagcatgacatactgtaacacagtgcagcaagcaaaattcatgatgcgttagaacaataatcattggggttttgtcagaaggtgctaaattaggttaaggtacagtcggatggactaccagtgtacgcaaaagctacaatctaatagcagtatacaacagctgataccatttcccccatcttaatgaaatttggtcgccgttccttcggccgacccggcaaaaaaaaaaaaagctgataccattgtaagaaattatttatagaggcttggacaaaatatgtacgaacttatcaagctcatctccatgcttttgttgataacatgatttcatactagcgtaacatcctggatataagaaggtacatacaatttgaagtagtttggatgaaacagctaggtcactagatacaaagtgcgcatgagcggaacattccttagaaagttcattcgaatggaactatggtttagataaaataatgcactggatgtaacacgaggataattcagataagaaaaggagccatacccagtgatttctttggagaagatgaggtcacaacaaacttcacaatattatggccgtccaaccacaatgggaatttcataccctcgtaaacaacgccaacctagtttgaagaagagaatttaaatagtaaatctttacacattagagatgattatcacttggctaatcaagcaaacaatgtatataacagaatagtacctgagtcaagattgtttcttcagccaaatcagcacggctctccagtatctcccaatcatcctcgctgaaaggttctatacagactgaatcagctttggccagggagcgagctacactcaactgtgcaactgttccatcaggcaacgagatgcattctgccagctcttgagcaacctgcaaaccccaacatttgatcaaagatttcacgctggaaataatccacagcctactgcacagtgtttacatagtagcaacgaatacaagcatatacagggtcatcacaatcatcgaaaattctactcgcagaagccagattgaccgaaaagcagcaaaaccccggataattttgaccaggataaagcgagcaatcatccatcacagatgctaaaagtaaatacaattctaggatgggaataatacgggagtcgggggggggggggggggggacctcnatggcgctggaccgggacgcggcgccggaccaggcgagggaccagcgggcggcggtggcggtggcggcggcgcggaggtggagcgcgaggaccggcgggaggtcgccggaaacggaggtgcgggacagggcgtggatcaggtggagcgggagcgcggcgaaacagctccgggcgccgcccaccacccgcacctccaccttcatcccgccgccggcggtcatcgcctcctcctcctcctcctccgcagttcagctcccctctcctctcctcgccgtcgaaaaacgacgactccacctcctctcttgtatccggtcaaaaaaagtcaaggggttttggattttcttttaaattattttatttttggagaagcttatatagagctccatgaagaagaaatcgcacttgtactcatgcacgttggatcctctcttcggttaacataatactttaaaaataattgaaagaaaaatatttttaaaaaaattataatcaaagattctaaagtttgatcttaacattgtctaaaacgacaagtattattaggtcggagagagtaagtcaaactaaaagctaaaatttaaattttcaaacttaaatttaaagatgattgtaaaatatttttaatgtaatttctttgtagtattgacttttaattgctatgaataaatataaaaaaaatatctataaaatatttttattttctaataaaccgtttgtttattagagaatatggtaatcttgtaatttctagagacatggtgaatgctactccctccgtcctaaaatataagtatttttagatatgaatctggacaagccaaaagttactatattttagtacgaaggtagtatttatcttggataacccggggactgtcgtttttgtccattctttatgcaagttttttttggggtccatctatatatatggcgccacaaaatttagtccaaaacagtcggattggacttcacactgattaacaccatttcaaacacaaagttgaccattaatgagccttggcaatataacaaataagtaactttattataatacacaatataaattaaatttacgatagaaaactaacaatcacaaaagttacacttaaataaatttaaaatcacatatgtaattttaatgtattttcactgtaagttctaaaattacatatgtaattttaatgtattttctttcactgtaagttctaaaattacatatgtaagtgtcctaaaattacatatgtaattataatgtattttcactataagtttcaaaattacatatgtaagtcccaaaattatatatgtatttagtatgtaattacaatgtaagtggcatataattgcataaattatcactatattgtaattttcattaactacgatttactttgaggatagaacgaatagcatcttgtgctcagttggtcaaaagcctggtgctgtatgcctgtaactcgtcgatcacgggatcgactccccgccaccgcaccgcaccttaatttttctcggaaagcattagcacgaattttgatatagatcctagggtctaaaaatcgactatttttttacagaaaaagtggcgccatatttctagcaaatctgttttttttgagcgtattgcgtccaaaattcaattaattattcattactattgtacaaatcacagtcaaatactaactcccggagttttatatgatttcgttcggaattaattaccgagaaaagaatgctgtacatgacaaaactctttgctcccaccacatctctttgctcccgatttctctctcttcctgaatcagacaaggttatgtaattatcttcacttcatcagatgtaaaactccacattaattaatcttccttccttttaatgcttcgacagcatatgctgatcacttgttcttgcagattctgcttccagtgtcacctcgccggagattagcattgtccggcgatgatatcgccattgccggtcatcagttgcagatttcacctacggaacggtggcggcttcttctggaatgttccgggagcaaacaccgggaaggactcgccgccgcgggccctcgtccccgccgcctcgtcccttcgaggttcgccggcggcggcggcgccgcccagcagtggcccgccgaagaatatcgactggccggagtacgtcagcctctccgacggcagcgtcgacgacgacgaaggggcggcgttcgtgggcgcgggcgcggcgggattattgcggctacgggcggcactcaatggctcgcgctcgccacctgggttcgccaagaaaggcggcgccctcgccgccggctgctcggcgccaccgccgcctcctcctggcctcgccgttgccggcgccggcgccaccgacacgtaccggccggcctcctggtcccacacgaccgacgccctccggttctcccggacgtacgacgtggccgactggaacatcgggttggatatcctcgtcgccggaggaacaggcggcggcggccgaggtattgccgcctccggagcagcgttcaccggcggcggcggccgaggcggcacgttgtgcgccgccggcaatggcggcggcgcgagcttgtggaggcgcaccgggctgctcatcacgctgctgccgctctgctcgtactcgtcctggctcgccacgctctgcgcgcacgagctcgggagagaggacgccctcctcctctgctccttggcggcggcgctcacgctgctcctgacgctgccgttgccgctggagctcaggtcgccggcgtcgtggccgccgcggtggcgagcgtccaccggccggaggacggaggaggacgcccgagctctcgccgccgctttcatggcctcgttggtgtcaagcttggcgagcttccacgcgctgatcttcacttgcttcttggctctgtttgctctctcagcatttccagccgtgtcagggtcgatggttgatggcaccatcccagcctccaggtgtgggatcacttcatcctgcattgcaatcattcagaagagaaatagtacagcgctactccctccgtttcattttagaagacgtctttgctttaatcaaagtcaaactgttttaagtttgataaagtttgtaaaaaaattagtaacattttcaacccaagactaatttattatggaaatgtattcaattattgatttgatgaaactaatttagtattataaatattactgtattcatctataaacttagtcaaacttgaaatagtttgacttttagcaaagtcaaaacgtcttataacctaaaacggagagattatttagcaatgttgtttgcaagaattcagataaatatgttctttgtaatgctatttgcagcttgaagattcatactgatattcattcagatgatacaatatctgattctttatttatcaggagagattgtctcagaagagacgggtcatcgtttgcagttacctgatcaacgaaaatccttggaggtgtgcaccatgaacccttgtagggaagaccaagtgagcttccaccgctgaatccagtagttgctgaatttgttggggaataaacaatgttcaccccatcctcttcttcctcctcttgaggtgcttcactcatagctctcattgcgacaacatattcgtaagttgtgatcccctgattcagttcaaatgaaagcaatgtaggggaatttcaagcaaatgacattacatttctatgcatctgacatgtcatttagatattacatttgattcggtgagaattgcgatacaaacctttctgatcagtatcatgtggaagaagaagagttcacctaggggtatacaagcgattatagaaagaagagtaaatatggcctgcacaagaagtttgcattcagtcaactagagaaaatgtcttgcaactaaagtatgatgatttctgctagtgcaacttactactatagttgcaaagggtggacgagttaaaccatttgcaagcttgtcttgaataatactttctgaattcttgttgacgaagcatacaacaagaacagcaatgccgaccccgatttcaatggcaagctgccagatcacagattaagaatagatttaaaatgccaatcagctgaactaattaatgaaaaatgcaaagaatcttttagtactgtgttaaacatgtattcggaatagagattaagtaaggccactttacagacccagaggaggctggtaatcatcagagcaagaaatgtgaaatagttcttgcgcccaacgcaattatttagccactgcaatggatgcaaaaatcagacgtgcgaataaaatttgaagacaaacataggtttgtataagaaaatacccgacagtgatgatcaaaaccatccacacatttatcacaacttctgcaatgtttactgaatttgcgaacctgaaaattttgcctttgtaattagcaacatctgacaacagaagttttcgcttttacaaagttattacagaggaaaataaatgatatattttgcctgaaactgagacaaaaatcattatgcagttccaacgttgagcacatatacaagcttacctcagcattacataatgtgcaaaacaaggcatcttctccatcagcttgatgctctgaatcaacaagcgtcctgcaatcctcctcaacaaacagagcacaaataagtcctccgactaaggagcaacttgaactccttggtggttgtgagctcaaattatttccatctccagcagctaaaccagcatggttagaacgtccatctagagagctcttaaaagtagatgttggggaattcgttccagtagcaacatcaccccttcctggcaaatttgtgtcctgtaagccggtgccacttgttggtgcattacggaagccattttgaaactttgacatgatcccgggatctgcaggatttatgctagtgcaccggatataaaggatgaagacaacaaatgcctgaaaattttaccacgtggaggagaaacagtaagtgtacatctcaaataactgtcctcacatgatatgctgcaggtgtcatttggtaggcttaccacaggagtatagatgccgaatgcgatatattcaaggacttgctttcccaggaatggtgcaaagaaggcataaaaggcaaccaccagaaggaagaaaacggtaattgcaataatctgtttgacaagagattcaacttagtcatccactgttcaaaagtccggtaatcggcaagtattacaaactacagcgtgtatcatgaaccaaaagttgtgaacagaaaatacgaaatcgtattttttgctgattgacatcaaattaaaaaaaaatgtcccaacaattggatgtatatgcattaccctttttatatgaagaactgtcaataaatgcttttggagggtattataggcataggacaacacggcaagttcacagttctttgtcctcttatagcattttaggctgcgttcgttcataggagataggggaggttgttactcgttttccgcgcatacgcttttcaaaccactaaatggtgcgtttttttgtaaaaattttctatagaaaagttgctttaaaaaatcatattaatccatttttgaagtttaaaatagttaatactcaattaatcatgcgctaatgactcacctcgttttgcgtatcttcccaatcctctctccctcaaacactgccttagtatgcttaaactgacttttcaatttttcagtaatagcataatgaaagaaaaacaataatcttattgatgctacaagggcaactggaagatagcaactggaagattggaagttactacttaatttcaccagtccatgaaaatcacattgtttaataaccatggagtgtccaataagtcgccaagcagcaatacatgaccaaggcaccaagctatcccttcagaagctcaagctaccagtgttcttacttgtttattttgttagtaaaactgtatgtgtgaacccaaacaagtttgtccctttttgcacccatttcagtgccaagtcatggagagcataatctttcactccatgtctccatctctctgtttatttatttaattttttgaacaattccgcactccatcatggtagaaccaggatcatgccaaaagatgagattttgtagttagtagcaaaagggaatatccaccgcacgactaaaaaccactccactaaaatgcaggaatcaggaacaaaaaaaaaaggctacctaggagaattcgcccaaagcctaaacaggttcagagccaggcattcctaaaaacactagcgaaaattacagtgatcattcctgagcagtgcactctagaaactgaactctacttcgtaagtctacaacatttcatcacgcatttatctcctccaatccacacacacacacgtaaagtggaagttgagatataagggagtggataagcaagatcactagcaactgaattctgccaaactgatccacaaaaagagaaacaaacaaaggctgaaaattttctttcagttcgggaagatcgagatgttcttcaggcctgaaagacaaggaattcttccggcggaatttccggtggataccgcgcccgataacaaccgcaagaagccaagatagacggaaaaacaacaagaagaagaagaactgatcgaaagaaattgcacctggaaggtgtgtgctgggagctgccacccattcttccgcaccatggcctctctcccctcttcttcctcctccctttccccccttctccaggtctctctctccttttctctctcccagtggaaaggggagtcctttcctttcccctgctttcttgagggcagttcaagaatcaagaccagaggaacagaaaaaagctggagattttataaaaaccccttgctctcttcctcatttcctggtgaaaataattttctaccgtcgcccttttgtcgctggttcgttgggtgggatcaatctccagccttggaaatgcagtgcagggctgcagagaaagaagggaagatcgagttgacagattcagactctgccactttttatactcacactgcgctgaaaatactgaattgaatgtggactagctgcctgccactctctctctctctctctctctctctctctctctctctctctctctctcttcttttggcctttttcagaattttcgctttcggaataaatgcatctgctgaaaattacttaaccgtgtacttgaagggccgtataccggtacaagttcaggaatagttttctcaataatagaattcatttcattattacataggttaaaggacaagtgacgattacgaattataaaatttccatctatgtttggccaaagtatgcaacttcagtgctccgtatttgttattccatcgatttttttcttgtaactgaaaaacaaagaacatttggtgagtgacaccatcaatcagctggtacgctttgctgttgtatacatttgtggtgtgatacagataggcaggtagccgtatgtatactaatattagggtgtagaccccagcagtgtacgctgtacattactccctttacctactactcctactctcctgattgtatgcccaagtgctcatgccttgatttaggtgaataacaaacctaacctaatctaatcaaatcatctgattgataatgctatgataatagtgttgcttgaccagaaagcatgcaggaatcatgctctccagagtccaagccagctctagccaataactatttggcaaataaaatagaatgaaaaaatcccgtatccaatgagttagtagacattctttaggattaagaaatggccctcatcatctcctttccttagcaggaatcaataagaatttaatcggagaatgtagtgcggcaagtacttagcagagtgcagtttagtttagggtacagtacagatggatgcatgaatgaatgctggtgaaaatgattggagagggcaaatgtaaatgcaatcaataatgcactgttgagtcccaactactcccaattgtttgctaattgccttagaattgtcctctcttctccctgtaggtgctttccagatccaaatccaatgtggcctttgttttctcctccatggatggatgatgagatggtccatcatcatcatttcctagtttcttcgttgattttatttttattattagctttcgagagaagctggattgcattgtggcattgtggcattgttaactacccgatactagcatgattattccttattatctcaaaaactataattgtttcattataggggataatcaagccagtgacatctatttaagtagcgatttagaaggaagctgggttttcataaatataggatagtaatttctcaatgtaatttattttcttttgggaggttgcttttgtggcaacttccatttacttcgataacttctggttgaagtcggaaaccttgtatatttgtacatattcctcattctcaatcttaagtacatctatttaagtatatgtagtattctctctgtttttttaaatgtccgatgacgttaaattttaaatatatatttgactactcgtcttttttaaaaaaataaaaatataagtcatactcaaagtaacttatttaaaaatatataaattttaattacgtacacttctctaaataggacgaataatcatatgtatgtctataataagttgctaggtgaaaccccgcgcattgctgcgggaatttagtatgataacaataaaaaaaataacgtgtaagatagctagataacatcaggttaagtaaattaatgtggtttatgataatttaaatttaaatagtatgtagaatagtgattcaaacgtaaaaagtaaggtggtatgactttatggaagaaaaaaagtagggagatagtttagacctagattaatcatctaaaggctaaaacaattgatgtaatatgacttaattagaggaaaaaaagagaaagataatttggactatagattaatcatttaagcactaactaagtgaggatgaattatataagtatatatgatattataaaacataataaagatatacattaaaacattatgtgaattatgttggatgataatttaacatgtttgtatttgaaaagctcttaaattataaaaactataaagatatagcatgtttgcatgatgtttaaatgtgatgattgttagtggatgataatgtggcatcttattaattagtggatgatgatgtgacatctttgcatgttaagcttaatgagttagtggaggataactttatagtaagatattataaggacgttaataaatgttagaaaatggagagagtatgtagtgctacgtttataatgggccgtgttgggccgggccacactggcaatgggcactctcctcgtggaccagaggcaaggccaagctattattattaactagatgaatgtcccgccgcgttgctgcgaaaaaataaattatataatatgtacaaatatgatgaaatatgattattaaaactaaaacaaattactacttatgaattttgagcctataaataattgagattgcatggtgttattagagaagaaagaagagacaatttgaaccatagatctatcatctaatggctagaaataattgaggtgatgtggcttattaagagaagagggaaataacaataactacacttagtgaggattaactatataagtatataggatttattaaacaacaaaaatattagtaatttcataaaccatggtaattaaggttgcaggggatgaaatttacacttatgtattttttgttgggtcggaatgggattgttggaccggaatgtggccaggccgcaacggggttacgaagattatgcctgccgttcaattcaattagttagctcgaccccgattcactgattagataataaccattgtaatttgaaaattcagtgataatttcctggacgtgaagattgaaatgcgatacatttacagcaagtcaactgatcgagcactcacttaactaattaagtctactcctgccaagaattagtgcatgcttggacttgacctggtcgatcttgtactcctggtaatttctaggaatttaatatgctaatagctatactagctaggttagttgagatcgattggctagggaaaaccagcgatatcggtttggacgacactgtcaagtgaagccacacctatggactatagtctcttacttagaagatatatttgtgaaacccaacaaattcaaaccgtataaccttcaaaaacaatacatgtagctatatatgacttacatatgtgttcttcaacattatttaatctgacctgcagtcaaccatgaaggtaggaaagggatagatcgaattaatttcaagaacgcgttatgaccaacagacatgataattcaaactaaatcaacttgcaggtcaaccacgaccctgtttgtacttataaacatatatgcatggatgatgtcatggaaacatggattgtagtcaaatacctataggaaaaataaataaataaatttggtaacattgattaattaggatagcataagcctatacacaagcatacaggttaaatctacaaatagaggggaaaaagaaaaaatcaagcagcgaatagtatgtgtgcaacatggtgaaaagcatttcttttttttctacagtttaaatttagatttgcatgtttgtttattggtttataccatcataatctatcttgtaaaatttcattaaattttttttgcaactattcaagttaaacacatttattttcgtgcaattgaacataagcataaacttactttctgataggtacatactaaaatacatatgttctgtttggaaaagttttaaattatgataggcatttagttaatagctggagaagctaaaaaaaccaaaccagtttatgattttaaatttattttctgtatgtaactaccggttttcttagaatttgatgaagattgatattgtttgaaaagtttttgattatggagaagctgcagcggcttaaaacctccctaattaagaggccaacataagtgcatatgtactgcaggcataagtgcatatgtacatctataaatacaggcatgcatcatacagacgacgtactacagagctagagctagctagcgcctagtgaatagtgatagagtcctatatataatggcggaggtgcaggtagatgaggtagaaggaggcgaacggcggcggcggcggccgctggcggagtacgcggcggagctggaggcggtgagcttgagcgtgcgggcggcgccgccgctgcggctgaaggcgctggtgcgggcgtgccaccacgcgctggccttgttcgacctcctcggcgtggaggccgggttctggaagacggaatacgcggagcggctggtggcgctggagcgcgcggcggaggccatggacagcgcggaggagctcgtcgaccgcgacgtcgccgccggccgcgtcagggccaccggcacccactccaacaacctcgtccgcgtcaagcgcggcatcgagctcaagcgggcgctcttccagctcatgctcgcgcagctgcagcagcagcgaccaggaggaggaggagtctccttcgacggggtggtgtccatggcgtacgccgccgtgttcgcccggtaccacgacaagaacgtgcagagcaccgtcgccgactccatctgcgccatccccgtcaagtccatttccgacttcttcgccaccatcaatgagaccggtactgttccatccatcatccatctatagatcaggtttgctaattagcgcagacacgctagctagctaactcgcgcgcatttcggcccacggcaactgtttcgggccttccagcccacttttgttttctttccgtaggaaacgacacagacatacgcgtgcaccacacggtaacgtaattagtttctaataatcatcgttctaattatcgtgctaattatttttatttttcttttttataggttgtttcttgtactaagattttaaaaatccttacgtgaaatttgaacatttttcagttcaaattttgaaaactttcatcccgaattttaaaaactttcaactcgaatttgaaaactttcaacttgaatttgaaaacattcgacccgaatcttgaaaactttcaacttgaatttgaaaactttcgattcgaatcttgaaaactttcaaatcaaaatttaaaaactttcaacttagatttaaaactttcaatccaaatttaaaaactttcaacccagatttgaaaactttcaagtcaaatttgaaagctttcaactcaaaatttgaaaactttcaactcaaattttaaaaatttcaagtcaaaataaaaaaaactttcaattctacatttgtaaatagatatgcaaaatattgaaaaaaattggaaagaaacagaaaaaaaaagtgttggaggagtcaaaatcaggaagaaagtgcgaaaaaagaaaaaacaaaaaaggaatcggaaaaaagtgcgaaaaaaagaaaaaatcaaaaagggcgcgtggagacggcccagctgacgtgcgcgctagcaattttgctggcacgtaagcgcgcactaggatccccctctatagatggccataaggcccgaagcctgatggccggcccaagcacaccacggcccgactgatgtcggacccgtgctggcatggcccgatagttgggccatgcctaggccgatgccttcgcacggtgggccagcctggcacgacactgtttaaaaacatagcagaggatccaaaataaacttaattaaccatgtaaggcaaggcccaaagaaagatgatagacttaatttccagccatataagacaaagctcgaagagttaaaggaaaaaaaatagacttattacatggaagagcacgatgggccgggccggcatggcacggtccaagtcttattgggccatgcttgggccgtgtgtgcagcccatgggttggcacggcacagcccgacgtggaggtcgggccatgctggctcgactaacctcagctcaggcccggtcgtgtggcccatttggccatctatatccattttctccttataccgcatttgattttaaatacacgatgttgttcacttttaggggcgttgctagttggcgcgcgcgccagctgctcccggctcatcagcccatcagccattttttcttttttttcgcgatttgttttatcgttttccttttgcgatttttttcactttttttccttttttttcctgattacttttttttaatcttcagcacacttttttttaaaatgttttgagttgaaagtttttaaatcttaacttgaaaatttttaaatctgatttgaaagtattcaaatctcgagttgaaagttttcgaatccgagttgaaagttttcaaatttgagttgaaagttttcaaatctcgagtcgaaagttttcgaatctgagtcgaaagttttcgaatatgagtcgaaggttttcgaatcggagttgaaagttttcaaatctcgagttgaaagtttttaaatctgagtcgaaagtttttatattttttcaaatcttaacttaaaaattttcaaatctgtactggaaagttttcaaaatttatcttacacatttaaatttcgagttgaaaatttttaatttgagttttaaaagtttttaaaatttgacttcaaaagttttcaatcggttagtggaaaaaaatcttccgaaaaaaaggaaatcatatcttaattactgtcattatctactaataacttagttagttaggctaaactattcggaaacgctcaccgccaacacgctcgcgcgcgttagcttttccgcacttttaggtattagatttgatcattcgtattattttgaaagaaaataatgctaataaaatgaataaatataagtcatattcaacagtcaactgtgtaatatattttgaaacgaaaatggtactaatatatactcccttcgtgttatattataagtcgttttgacgttttttctagtcaaacttttttaaatctgaccaaatttatagaaaagtttagcaatattttcgaaaaaaaaacatattatcaatatatattaaatgttaatttgaatgaaactaatttcgtgttatagatattactaaattttctcataaacttggtcaaatgcaaatgaaatcaataatgcattgttgagtcccaactactcttaattgtagtgggtatcagacgataccttagagatatcatcccatctgaatgggataccgtcatgtaacatttcctctttttttaagatgattatacgcatgcttcttgatgattaatttctcaatttgcagctatataattgttcatatgcatgcttttttatgattaatttatcctcaatttgcaactattgtaattgtgaactgcggcagatgaatctgcggctgcagagatgcaaaagtacatcgatgcagccaacgggatcatcagctacatcgacgagctattcgcctccagaggcgtcagcgcggatttctgaagtctgtcattcacacatcatgcaacagggatgcttaattatctgcagactatgcgaacggtggtcaataataatgtagtattaatatttacttatactctgcctatggtcttctggacctacagtatatatgcagtacaacatggtgtttttcctcttcttttatcaatgaaataaggtagtaaaactttcctgtcgcctcagaagacagaatggtggtcaacatttttgctctgaatgctgactgaagatacttctgtgactgacaataatggatactattatattgtagatttaattattgaaagggaagattagatcgaccaactgcatcagaataaaatcgttaggacaggacggacggatgacacttcacaagcatgctagtactccctccgtttcaaaatatttgacaccgttgactttttagcacgtgtttaaccattcgtcttattcaaaaaatttaagtaattatttattcttttcatctcatttgattcattgttaaataacctttcatgtacacatatagttttacatatttcacaattttttttaaataagacgaatggtcaaacatgtgctaaaaagtcaacggcatcaaacattttgaaacggagggagtattaattaatagtaccacaacaatctacgttacatatatattcctcttcgtgcaaattaaacagggaattttctagttcttgacatggatactgagtgaataatattggtatgataacgagcaataaagataagacaagtacactaagtacgtatctgttcgaatgaggttctgaacaagtataggtgttgttcatgcttttctctgcctgaatatctccacgcccaaatagtcgaggactccctgaacagcaacatgaggtttctcaaccttcactcgaactgcagaaatctgagggaacttgagcagggttgagtttgcaatcgactgagccaccgattccaacagattgtgcgacgggccttcgactacattcttggctatcctatacgatacaaaaaataaaagaatatgaacattctttattgagtggtactagtagcaattctgaatcatgaaaaggatcggcaaaacatatgctgaacttttttatatgattctgaactcatgcactgtgctgacgagttaaaatctcgttacagcatgtcagtagccgctaaactcatcttagccttggaacgaagtgcactgtgaaccacatctgtaattgcaacttgaaaataacgaatcccagtagcaacttcattcagggagcatatcagtagcaagcgagattgaactctctagattctggatgttgtgggggattcgataagggaggtaggacggccaatggcagaaaccagcaagcgggattaattaattaattctgaatttgggatagagaggagaagagagctttaaaatgagcgacctgtagatttcggtgtagctgacggtgtcggagatgtcgtcggagtccccggcggcggcgagatccatccaggcgtcgacgtcgatgacgaacttctggcccagcttcttctcctctggcttcaccccgtgggtgccatggaaccgcagcccccgcaggatcagcttgtcgcccctgtacacaacagcctcctcctcctccttcttccccgccatggccccccgcccccgccgccgccgccgccgcgctcttatagtggccgtggaggcggaggcgcctccggttggtggtggtggtggagttgttgcagacagagacaaacagatttgttgggggtgtgaactgcgaggaccgaggaggcagctgacgtggccgcccataccttgggccgtcgcgatgtcagcccacattatttttctgggggcccacgtaaggttttttacctccaccatcggttacggtccatatttcaaacgggctgaattttaaagtttggattcctacctttggtttatggtccatattcaaaggagtaagttcaattgaggtctcccaagttgtcgccgagtttaaaattcatccctgaactgtaataccagttataccgcgtccctcaacttccaaaaccagtgcaaataaggtctcaaagcggttccacttaaagttaaaaaaatatgggacccacatgtcaatgagtgttcaattaaaaaaatatagtggtacccacatcatcgccactatctttcccctttctctccctttcttcttctctcttctctctgccctcttttctcttctctctctctcatgcgcaagcacagcagtagcccggcagagctcggtggcagatggagtcatgcaatggccgtgtgaggatggcatccaaggtcgtgccaagatctaaaacagttgtttggatttgcggttgtagtcttgcagagaccagagatcacaacacgttgatcttcatgactagagacggagtgcagcaccaatatgaggtttcactccacataagggaaaacctcataatgaatggtggtgaggtggcacgtcggagcaagacgccaccaacgtcctcaacgaagttgttataaaagttagtcgatatagcggaacgacgactaaccttcccgatcggttcaatcattaatcacccaagacatgccagatgacgacatagtaacacacgatatttgataacgaggttcaaccgaagcctacatccccggggctctgattataggcactcctccccaaccaacatagcttctagccgctacgagtccatggccacgtcgccatcatctcccgcgtatctacgctatattgtagtcgctatggttacattgtggtgcccctctctctatttaagagagatgccgggttacagagtttgactctaactccaccccctaacacctattacaactccaagttctaaattgtaaccgactacgtacacatattcgacacaaactctaacagaggccgtcaggtacctcgatcactcaaggtgactagcatgaattgttgcaactgctaaccccccccccccggtgccacgtcagcgcgttgttgatgctcacgctccgtctcacctcaccttggaggggatcaggaagagagaagaagtagcggataagaggagattgaggagaggaagaaagtgatagccactgacatgtgggtcccacgctgactcaacttgtcacatcaactaaaactgggcataatactggttaggacctcgggtgatctggttttgtaaattgagacccattatatctggtatttcgttttaggggtgaatttcaaacttagtgacaacttgaaggaccaaaacaaagacggtccatagttcaaacgggctgaattttggcgggcctagagccattggacggcagcaaaacaaagaaagttttaaaaaatacaaaattccgttgccgggactcgaacccgggtctctcgggtgagagccgagtatcctaaccagctagactacaacggatcatgtcttggatatataggtaccattttataaccttttatattatagaaataagatgtacagagccaaaagcatgtccagtcccacataaaagacacaattgctccagatctatgtcttgctactccaatacgaagtaatacactaatactacactatctgcagatgcagattattgtgtattttaaagaggaatcttatctgcaaatgcagatagctacacgcaatcatgatgtgaggagcagcaacagatctggcgcctaatcgtttcgtcttgcgcatctaaacgagtggaattaaccatgacacagacaagtggacaaatctaaatctagctaatcaaccaatcacaccaaagcgcaaggagttcccatcggaatccagacaggatccaagtccatctcttgaattaatcacaaacttatttaaatataaatcaaaataatactccatccgtctcaaaacaagtgcaattttgcactattcacgttcaacgtttgatcattcgtcttatttaaaaattttgtgaaaaaattgaaaatatttagtcacacataaagtaatattcatgttttatcatttaatagcaataaaaatagtaatcataattttttttaaataaaacggacggtcaaatgttgggcacggatatccatagctgtacttattctgggacagaggtagtaataaacttaccggccatgttagatccaatccgagatcaaagcgagaccaacatgagataaggttaatacactaccctctttttgtttttttggttttttggctttgtacggatcgatcttgacttgactcgcacctgcagctgccacgtcagagccacgtcggattccaacacgtattccggcgtgggcatcggctctttctagagcaaaccccaaatcaaatcttgcacgaacacccctccaacttccccacgtttacaaatccaaccctcaccctataaataataaatagcgaattcttactctttttttttattaatatataataaaagaagatcgaagcgaagcgcacctctctcctcttcttcttcaattgatcaggttgagagggacgacaacatcagatcacgagccacgcaatcgcaatcgcagaggggagagagagaagagggatcgaatcgaatccagtcgaggaggaggagggcccctcgggccgatccgatcgagaggaggagggatccgagctgaacgattcaacccaaggctcgcgggatttggcgcgagttgagccataccgatccctctgccttccgacggacggatccctgatggaatcggcgcacggcggatcggatcgcccaggttagcgcggggattttttttttcgtctctgtttcgatttttggctggatggttgggtttggggttgctcttcgatctggggttgcatcggtgcgattgttttttggttgattcttgctgggttcgggatgttccccttgctagatcttgctgccaagtgcgtcggatcttggcgcaagctgtctgcgtcgcttaattatgacaattcatagatagtatacgtgattaatttttccctgatgccatccatgtcatagactcatagtggtgccgttggaattattgagtgaattagtggattattaagattagatttcagggattcgggcagcgaagacctgctcaagcatcgacattgccgtcttcttttctcctcttcgcgtccgtgaataatggcaggtggtgtggactattgttggttcgcgtgcaggtttagcaatgtgcgattttgtcggttgggtaagatgccgctttcagatggaaatcgcatcacgtgttcatggtttgtacaggcagcaacctgcactaaaattccggcgagccagtatacctgaaaaagatacggacgcaaccaatgcctctagtgtgtctcctgtgagcagcagcagcagctggcgcagggatagtagctgcacgaagggagaaggtagtagtggtaggatgcctgtcagtatcgacaattgcctgtagaggccacaattgtggtttttagtatggttttgactagttgataggacggcagtgaatgatggaaaattgatgcctttattgtgcacggctgcatatgctattggctactatgtggtggagaagtactcccccgaaataagttgattcctaatgtctagattcgtagccagaaattaatacttattttgggacggaggaagtatgtggtactaaagtacactaatttcagtaatttggaatactagtgcccatcagcccatgtatgtgattgtttagaagtgtggctttgttcatgaactgaatgatatggttctatggtacatctaagtaagtacaatggggacttaggcacgtagctgtctttatttggtacttcaggccatttacgatgcttacctttgttgattagtgtgcctcacctttttgtttcgaagtggcagggtataaaatgtattacttattaattcgcctaacaaagaagtgcctaatacagcatgatccttaaaaattactttgcaatacaattttctcttacttttgtgttttttgcgaggaattttctctacatttaattggagtaaatctatgttccttgaatgtttgatttgatctgttcaatctccctcccacaggctcaatggattcgcaggagccaagagttgatgctgaacaaaaacctgttctttctgataaccctgaagagcaggtcattactttatgatatcatttagagatgttctatacaatcttctgattgtcataattgccttttttgtgctgattgttgtagtttttttttgtttgctgaaattgctttttatgaccttagaccattcctagcaaagatgagaaggtccttgaacccaccatttcacacgattcaaatggtatcaatctaccaagtgaaggacaagcccaagctggcacttccaatataggtgggggacacaatgctgcatatcctcaaaccatgtattcttctcaggcacagccattctattaccaaggtcagatcacaaaccatatgttcttctcaggcacactattctctaattgatgaatgttattgttgagtccttgacataattgataatttgtcttttatgagcaggtccaggatatgataacccttcaaatgaatgggatggatatcctccttatgtgagtgttgaaggcttggaagcaggtccagcggtaagcaatctgtttttttggttgccagaagtttttcgtcaagcaccttttctaaaattgttggcttttattgaaggttgtatacaatgatgatcctcaattgatgtaccatggtggctatggctatgacccttatgctcattattctcctatctcaacgcctgtaccggctgctgttagtggagatggtcagctctactctcctcagcagttctccttctcggctccttactaccagcaatcagtaccacctggcatgccatatttaagctctcctactccaatatcacagggtgaggcaatggtgccgattgacccaacacaaggggcttttatcgccgaaactctgagtcctaacagcttccttttcggaccaagacctggttattatctatcttatgccttgttcagctgatactcctaattcaggtttcactttttaggcatgattttaaccttttatctcatgatgataatttcagaatggttccgatcgtctgaaggaaatgggtcgtttccatcacctgcggcttcacctcaacctgctggtggcgtttcagggccctttggacaaagcaacttccctatggcttctggaatggtattctatgcacatgccatctcttgtctatttcttttgtcaaatgaaatagtggttcaccctgttgcgagctactaattgtcataggtgtctggggattaatccattcagtttccaaacaatcttgcctaagtttaattcacataacaataagcttagtagactaataaaaaatgctatgcaatctgcagtgccttttctgattgaaatagatggccgcatattctctcctattctgttttcgtgtgatcttttaggccataattcagttaccataaacatggtcattcttgaatttggatataatatcttctgactagacatgtaatggcaagaatgcctggttagaattctgtaaattcttataatgaatggtcctgattcccgatatggccaagttgcctctagttcaaatgcaaccttaagctttggttttcttcttgccagtgaatttcacagaaatttacttagaattatgaattgcttttcctgataaggacactgtttactatctcaaaatgactactatcacttgtctgataaggacactgtttacttgtcggatatttacaatgacacaggcatatttacttgtatgatctatcttctgacactcttccttttttcccctctaatttcagcaatctcctcagcacaggcccttctatggttttgggacaccaagtgactcttacggaagagtgttctctcatggtggatatttcccacaggccactaattatgggggccctttccctagctttggcctgaatggtacgagttctattccgatggaaaaaggccgcacgagaggaaggggcaatgctcttctttgcagctgcaatggttcacttgacttcctcaatgagcaaagccgaggcccacgtgccactaggcctaagaagcaaccagaggatggcggcaaggatgagaagccttctgcaggcgttgattgcgagttgtacaacaggcctgactttgttacagagtacaagaatgccagatttttcatcataaaatcatacagcgaagacaatgtgcacaagagcatcaaatatggtgtttgggctagcaccacaaacgggaacaagaaactagactcagcctaccgtgaagcaaaggagaaagaagagcattgcccaatttttctgctgttttcggtaattaaagctgtgacctactttcttattgttcctttactgccttcatttttttgttagtggttttgttactttgaatttgttgtttctcttcagagttaacagtttgaatgctatgtacaggtgaatgctagtgcacaattctgtggtgttgcagagatgattgggccagtggattttgagaagagtgttgactattggcagcaagataagtggactggccagttccctgttaagtggcacattgtgaaggatgttccaaataatcttttccgccatataattcttgaaaacaatgataataaacctgtgaccaacagccgggacacacaagaggtacataataacgataataattcttgttttccccttttactttgatatgcatgttgatattacaatgtaatggtttcaaccatttaatctgacacaaatagatgtctgcattatattatattaggtaaaactcgaacaaggtatggagatgctgaaaatcttcaaggatcatgaggaggatgcatcgatactcgatgactttgacttctacgaggagcgtgagagagccctgctggacaataaggcgcggctgcatcagcaacatcagctgcccagctctactgtggttgagcccaagaagcccttgactgtggccactgatctagttggtcatataactaagagctttgcgcaggcagttcggcttggtgaggccaagaatgtgagccctaattcagctgacaaaggtgccagtggggattcatctgtcgctgcaaagcctttggaagttaaagaggccggcttagcataaagccccagggtgattggttcatactgaaaattctctgatccatgctcttcctctttgaaatactaagaaatgggcgaagacaatgtccagcgcttctgtctggtgaagcattgtacactaggataggatggaagcctagctccttaaatagtttctttttttacctttcttttgttccttatcttttcctgttggtaatatttttcgttgcgtttatatgatgatcgattccttagtggctagccttaaggagagctgcagtttttgtgcaagcctctgtaaatttcccagttcaatcgatctcaagatgaataaggccttttgcctcctccagtaaaatcctctttaatctacttgtcttatactgaacaaggtgtgtctggaaaacaacataacatctgtttgggtgacctggtgatggtaacaataacaacttgttaataataaagagagtgtgaccttgtggtggtcgcttatgtgatctgtgtctgttctggagactggttattttcagtgatgatttgcttgcttccagtgcttacaaattttgtaacccttgtactatcttacttccgagacatgagataccaggcaggtatagaaatggtagaaacatcctgcatgggttgcatagtgtgtctaactggacaatactccctccgttttgatgttaatgaatttcacatttacattcatattctatattcattaacattaatattaatgtgggaaatgctagaatgacttacattgtgaaacggaagaaatattatttattgcccatctataaaaaaaaatcacaattatgttctggtctggccctcctgtcagtcacaattccattctggtcgtcccgttcagccccaactgtgacggcccataggaggcagggggttggcggcccacacataccctgcctcccccagtccactgccttcgccccctgtgcatcatctagtaggtgattttgggccactttgatctgatgctaaattgctaattgagtatttggtactatccctgtttcaaaatatagcatttaaaaattatcctaaaatataaaccctttcacctatcttttattcttaaccctttacaaccaatcataatatttttaatttcatctacttaatatccgtgtccaacccagaagaccaacggtagtagttttcagtagttcttagtagcaatttggattggagccaagttttaccacatttatagggttgaggcatgtgtatactatagtttcaaaccaaaatgaccctcttgcccacaatccgggcaagggaagaaacccaagaaatatgttttcctaaaaaaaaaatccttctattgcattgtttaaatcacttgttttaaattcctttataagtttgattttttaaagaaaaatatttaatctatctctataatcaagtagataaaccattggtaactacaatccatccaataacctaaatcaaacgggctattgcccacaatccgggcaagggaagaaacccaagaaatatttttcctaaaaaaaaaatccttctattgcattgtttaaatcacttgttttaaattcctttataagtttgattttttaaagaaaaatatttaatctatctctataatcaagtagataaaccattggtaactacaatccatccaataacctaaatcaaatgggctacataaaaaaacgtaaatattagaaaatgacctaatatcaaataagtaggagtgagaaataagtaggagtgaggatttgaacccaggccggctagcccaccaccttgtgaagctagccaaaagacctctagacatttctcaaacgtgctacatcatttggtgagcttaccatgcatgctagaaattcgacgcgtgggccaaatacaaattcatttcttcacttgagacccatatttcatacagaaaaatcgaacgaaaaacaattagccagaggacacatttagtgtattagttaatttttcatttgctgactgcctgacttttgttcagtcactttacatatttttagacaatggattttcattaatccggtctctatatttataaacgatatacacagtcaaaatatacacgagttcttagattgtatatatatccggtcgagagagaagaaaaaacaagtcaacaacatgtagctggcaataatattcatgtagaggatgcaggcttttcaattgaaaaacaagatggaggagagtaccagctagtttggtggagactgatgatgagaatcgatcgcgaagagtttagaaggctaatatcttgagatagtttttgctatctatcggcctcgaagttgtcgatcgatgcagatctcatccggacccatgcagcatgcctccctgccgaccaaatctctgtcagattgcattgctaagatcaccaccatctcatcttagctactaccacagcagcatccattgaattttgcatgcacttacacactgtttgtccacacattgatcagcttgcttctcactgtgtaggagtacatccagagagctgagctgcatgtaggagtaggtctcaagattcctcttgcatactcctactactcctcaaatctatctgcacaatgctgtccagtatgaaccactcctccatgcccggtacaaccctggcatggcatacacagtgtcagtgcagctggagtttgattctgatttatagtggtagcattattagcaacatttgatattgacatagtactactactcagtactggctttaaatatactatagatttgcatgtcatttctgcggtgaaatgcagcccacgaactggaaagaactggaaaccggactatttgcatccttttgctactgtttgtactcactactcacacaggcagcaagcttactgtttgtgcatactgtgcctgcaagttcaagctgtgcagcgatcttgatac

SEQ ID NO: 63346 - DNA, 5043 bp, Oryza sativa
  unsure (1)..(5043): unsure at all n locations
cctggagagagcaaggacggatggcctcttcctgttgaggaccgcgattttgtatgccccagcagtctcgttaccatcagcaggacgaagcatcagaatgttgggcatcgcacggaagctcaccaagtgctcaatgggctgatgggttggaccatcttctccaagaccaatagagtcatgggtcataacatagataactccggcttcacacaaggctgagatcctcatggcagctctcatgtaatcagtgaaaacaaagaaagtagcacagtatggaatgagtcctgggctgtgcagagcaatgccgttgcaaatggcgcccattccatgctccctgactccaaatcggacattgcgctcctcaggcgtatccttctggaagtcaccgaacatcttaagcaatgtcatgttggaggatgcaagatcagcacttcctccaagaagaccaggaacaactttagcaagtgcgtttaagcactgctgtgacagattcctggtggcatctgcagggctctctggagtgtatttctgtacaaatcaagtaatctaccattagaatgtcatcattcacataccagctcaaatgttatgagtagaaatggtaaaagacttacaggaagagcgtcagcccagccagcaggcaactcccctgagacaatgctcttcaaggtcgctgcatcttctgggtacttcttctcatactcggcgaacttagcattccagtcagcctcaaaagcagcaccttgaggcacatggcggctccagtggctgtaacagcccatgcaaataaaccataaggtgagtgctatgaaatttcaacatctcattcagataaccaaaacaacaatagacaaacctcttcacatcctcaggcacaaagaatggctcatagggccatccaaggttctctctggttgcttcaacctctttggtacccaaagcacttccgtggacgctgtatgagttggccttgttgggtgatccaaaaccgattgtggtggtcacctaaaaagagtacattttggctaaatatgataagctctataacaaaacacagcataacagaatgtacaggaatctaaccttgattagtgttggcttgtcagttaccgcctttgcttccttaatggcggcacgaatctcatcatagccatcgtttccattcttaacccagattgtatgccacccaagagcctcaaagcgagcactcacatcctcagtgaatgcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatacagtagctgcacaaaatccatgaatcatgttaccaaggttgcaccaccataactaaagtgaaaactaaaggtattcatgataaaaaaaaaattacgtgtagtgatcaacaatctcgctgtcgggcttgttgaaacgagcagccaggtgcttctcagcaagggccagcccaactgcatttgcaataccctgaccaagaggtcctacagaacgaaaccaaacaagaaaccgaaacattcagttctgtatgtattcaagcatagaaacttaaaggtgctatgagcttcagttgagatgacagaccagtggtaacttcaactccgggcgtctcgaagttctcgggatggcctggagtcttgcttccccattgcctgaattgcttcaagtcctcctcctgcagcaatatgcggccatagttacagcaagctcgatgaacaaatcagttgaaactgaagtcaaccatattaaacacttcaccgatcactccagaatttacagtgaacaattgctcgacttaatagcatcttccaactaatcttcctaggaagtattacataagattaaattccactaaacagatctctgacgactggaaaaggtgcacacttttactaggaaaaaaacgaagccgccacacaaaaatagcagtcaagatccacactttccactgcttcacctaacaagatccgaaacttgcacgaacctactcccgatttatccgccccaaaccaaccaactcgagaagcgaaagagagatgcaaggagcaaagggatatgggaagcgcttaccaagacggcgtcgtagccggcgaggtggagcagggcgtactggagcatgcagccgtggccggcggagaggatgaagcggtcgcggttgaaccagtaggggttcttggggttgtaccgcatgacctcgtcgtagaggatgtgccccatgggcgcgcaccccatgggcaggccggggtgccccgagttggccttctcgacggcgtcgatggcgaggaaccggatcgtgttcaccgacttctcgagcagcgcccccgtcgccgcctgcccctcgagcgtctcgaccgccgccgcgcgcacgcggttgttgtggcggcggcgcgacgcggacgccgatggcgcgccgcggcgaggcgggagcggggagcggaggccgcggccggcgagcgcgctgaggcggaacccgaggcgctccggcggcgcgggcgctggcgcggcggcacccgcgcgcgcggcgatggtggcgtgcgcggcggcgacggagtgcgcggccatggcgagaggagtggtgtggtggcgaggagaggcggagatggcgaggttgtggggtgggagatgggatgggttatgtatagacttgggggtgcgttttggggggactcgtagccaataaaaaggagggggctatggtgtggacgtggacatggtgcatggaccagcatcctaagccgccatggctggtgagattaggagcactttcttcgccgcaattattgaacctataatctttataaagtagttattgtacttatttgatctttaaattagtttttatattgtagttaacaaatgttactccctccttttatattataaatcctttaaaaaaattttatcaaactttttttaagtttaactaaatatgtagaaaaatatattagtattttcaacacaacaatcatattatcaaaatatatacaacttagatttaataaaactaatttaatatcttagatgttgttaattttttctataaattttgtcgaaattaacaatatttgattaggaaaaaaataaacgacttataatatgaagcagagggggtaacttggatgtttttagataatagataaaacctgacatttgttttaacagaagctatagctacttacttacatagtctatactgaaaagaaagtatagcattatcaacaaatgatgaaaatatgacacaataaaaaaaacttaacaaatgttaacctaggtaagtactccctccgtttcacaatgtaagtcattctagcatttcccacattcatattgatgttaatgaagctagacacgaatctagactgtctagattcgttaacatcaatataaatgtggaaaatgctagagtgacttacattgtgaaacggaggaagtatatgcaacatcttggataaaaaatttatgcatatttggcaaaggtgtgaaaatattcacatagaggagtgatcttactaatttctttatatattttgcttatgtttatagcacactaatctgatgagaattagttcgttttacatgaacattgacctgactgattttgtagctttcacaaaattctacagttaggtttaaaaaagatgctggaaatggtatcaattcttggaataataaagtgcaagtttgtagtatgtatatatgatagaattgttatatatattctgcagctatacatgtggttttgattagatttgcgtgtatggactgggtttatgtggggatgggtgtggtgaggtgggttggtggatgaggatatcagccatgaccgttgatatggcaaacaagatgatcctggccgttggaagagggtaggaaacgattggatattattaaagatattttcgcctatttgttagtggtctggtgagccttttgaaaaaaaaattgttatgggacatatttttttctaagagataaaaataatgtaaagattgtcctggctccttgtgtatgttggggtcgtcgccgtcacagttgttttctggcgtcattccatggttgattgtgatgtttatgttgaaaatttggggtcaaaaaaatcaactttttagatgcagaggtatatgatcctggcatgtaaaattgccattcttttcaaccaaatataaattgcaaaccgctcttttctgtgattcgccaagatggatgatgaaaccgagccacacgagaataaataacaagatagacccagatgggcatagaatctattcagcaggaatctacctttgtggaatattcttatttatatggtttgcttgtttttgtaacagttttgatgttgtttttgcttctgatttatataccttactacattagaagatgctcaagcttagttagttagtttaacctcgtcttttttttttaaaaaaaaaaaaaggagagcttaaattgtacgtacagatgtagattctgacatgggaaattaaaacagtttgaagagatcagtagtcatgtgaccatccctggggttaattgtgtttaattagtcattcactaagccaacatagatatattaggatgcattgatcctggctgctgccacattcaaaagaccaagagcagcacgccatcttgaatttgactctttggttcatgctgggtagcctttcaaagccccaaaagattgggtcgggtctctctttcggctctcgtcggtggctgcttcccacaaagaccgccatcagacgtgaatgaactgcaagtctgcaactacgactccagttgctatccccttaaattactttactactacctttattctaagggccggttcggataattgccaaaatcaatcgtaccaaattttaataatattaggatgaaataaatatgttgcgccaaaattttctactgttactgaaatttggtaacaaactaaacacaaccgtatatttatccattttaccaa

SEQ ID NO: 63347 - DNA, 603 bp, Oryza sativa
catctttgtcgatttgcgccgtaaatcgtccaccgcccctacaagagtgcgacatctctttgtaggtttgtcctgaaaaccttccgttttgcccacgagacgggtagttatctagaatcggctccgttagccagtttagttatcaaaacctatcttggtttagcttttgctagattgagatggttggtgactctagtatcaacgcaaggcgtttacgtgctgcgatcgtgcttgtcaacttgtcacaaaaagttgccaagatgatttttggcgactccactagggaaatctgctcaacgtcatctcaacttcgatatcgccatgacaaagcctccatcaaccaaggcggaggtggaaccggtcaatgtgataccagtcgcattggaggagcttgatgagggagcacgcaaagctttagatgaacatctcaaggcatatactcaagatctactaatgaaggcgtgcgctaggacccgccaaggtgtgattttcaagccgggatcattgcctaaacatactttcgacatggtaagtgctgaagaggtatcacaatctatccaacaacaaattgcgcataccatagattcatctatggttacttta

SEQ ID NO: 63348 - DNA, 519 bp, Oryza sativa
atttaggtagatgcttcgctgattaataggacaacattaggtggtttttataactttagactttgggaatattcatatctcttggatactatggaatggttggcttatggtggaattggacatacccctttcttcctctttcaaaacccctaaaacctgttgtccggtggggtttgggtgcatgccagttgtgggaagtagcaccccggccaatataaggattaagctcgggcctctgttgcaaagcactaccgtacttccacatgtctagtgggtaaggcttcgtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctccctacctgtctcggggtttccggccgtaggtggggttgggttggtactcttgtctatggttaggatgggt

SEQ ID NO: 63349 - DNA, 15317 bp, Oryza sativa
atatattttcgatggatagccttaatgtctgactactctcttcatcgcaacaaatctaatataatacaaatctgaataggagcttatataaatatatagtagtagaatatgtcataatattacagtggtattccatattggatttgttgattatagaacgacgaaagtatgcgttaacttacaaggttgtttacattatgacgaaatgaagagaaggaacgcacctactgcgaagagctcaacaactacttcctccaaatttccactcaccaactgatcaccaccaattcacttgtgcagtgccacctacccaatttcattccagtggcgtggtacgtaggttccgcatgtcagtgtgacaatcgtacggactgccatgtgtattgtgttcaggtaggtgcactggtcgtggtctcaccatctctcctccagtcgtacggcgccacgtaggcagtacacgtagacggccttcttcctcctccctcgagttgagttggttggtgagagtgagacaccgacggaacggaaggagaaccacgccgcttggatttttcttttttaccttttcaaattttaatttaaaaaataaaaccattttaaaaacttatcttcaaatacaaatcttttaaaaacactaacacgtgacacacagcgggcacgtcacccaaacgggcgtgacaatattgttttgccacaccaatccagctggtgtggacaaaatgttcatatattgaaaataaaatttaaaacaatttatattttttatctatatcattataaaaattgaagatgtttttaccggtattttgttactcatttgtgcatgagtcggtttttaagtttgttcgcttttggaaatacatatccgtatttgagtatgtttttaagttcgttcgttttttgaaatacaaaaggaatcgtaaaataaatctattttaaaaaactcgcatgctaacttgagacgatcgaactgctaattgcagctcataattttccaaaaaaaaatatatccaaacgagttcttatagtagatttcaccttaattaaaacatataaatgttcacccggtacaacgcacgagtatttttataagtaaaattaaaagtttaaaataaataaaaatcccgccaccacggcgcgatggtaaaagggggacgcttctaaacgggccgggcacgggacgatcggccccgaacccggcccatctaaccgctgtaggcccaccgcccaccaatccaactccgtactacgtgaagcgctggatccgcaacccgttaagcagtccacacgactcgactcgactcgcgcactcgccgtggtaggtggcaacccttcttcctcctctatttcttcttcttcctcccttctccgcctcaccacaccaaccgcaccaaccccaaccccgcgcgcgctctcccctctcccctcccaccaaccccaccccatcctcccgacctccacgccgccggcaatggcggcgaccatggcgtccaacgccgcggctgcggcggcggtgtccctggaccaggccgtggcggcgtcggcggcgttctcgtcgcggaagcagctgcggctgcccgccgcggcgcgcggggggatgcgggtgcgggtgcgggcgcgggggcggcgggaggcggtggtggtggcgtccgcgtcgtcgtcgtcggtggcagcgccggcggcgaaggcggaggagatcgtgctccagcccatcagggagatctccggggcggttcagctgccagggtccaagtcgctctccaacaggatcctcctcctctccgccctctccgaggtgagacgcggatcccttcctcttgcgtgaattccatttctggagatgagattttagggggtttattaggtgaggtggctgtgtttgtgaaatcctaggaattatctctcaagtcaatctaacgatgagatataactgaggttctggttttaatcacacactcatataaccaatttattgaaacattttggtttggcataagaaactgcttacgaaggtatgatatcctcctacatgtcaggctactaaattttcacgacggtatgatccactcaaaacaagtttcttaacgagtctggtgaggtctgttatgaaatttgtgtaaactaaggcaactttggaggtttcgcactgtaccaatgttatgtttgaacattttgcaagcagtgctttctcccaaaattatgcaattttgaggctcctctacatcattataattccccaatacattgctctttattcttaatagctttgatcgcgaaatttaacattttaattcttgagctgttattttgtagcatcagtttatcatgagccatgtttggtactaaatatacaatcccttgggtttatttgtttccaagcatgtcattaacttatcttaatgtggacaagaaactgatgcctgcttacattgctattatttcaagcgggtattgatcctttgacatgtgattgatcatttttttttctctggttattagggcacaacagtggtggacaacttgctgaacagtgaggatgttcactacatgcttgaggccctgaaagccctcgggctctctgtggaagcagataaagttgcaaaaagagctgtagtcgttggctgtggtggcaagtttcctgttgagaaggatgcgaaagaggaagtgcaactcttcttggggaacgctggaactgcaatgcgaccattgacagcagccgtgactgctgctggtggaaatgcaacgtatgtttttttttttaatgtttatgaaaatatgtatggaattcatggggtatgttttatgacctttttctttaccatcagttatgtgcttgatggagtgccacgaatgagggagagaccgattggtgacttggttgtcgggttgaaacaacttggtgcggatgtcgactgtttccttggcactgaatgcccacctgttcgtgtcaagggaattggaggacttcctggtggcaaggttagttactcctaaactgcatcctttgtacttctgtatgcacctcaattctttgtcaaccttctgcatttataaggaacattctatgatgcaattcgaccttacactgcacagtaacttgaaatgtttcatgcttaatcaatatgccatattcctgccaagctcaagcgagcaatatttgtttgaatttggtaccatatttttgtatatttgggcattcctttttggtcttgatgtcttcttttgaattagcatttaactgaattacactcaacaggttaagctctctggttccatcagcagtcagtacttgagtgccttgctgatggctgctcctttggcccttggggatgtggagatcgaaatcattgacaaactaatctccattccttacgttgaaatgacattgagattgatggagcgttttggtgtgaaggcagagcattctgatagttgggacagattctatattaagggagggcagaagtacaagtaagcttctacctgccttactgagctgaattattcgggtgtttatgattaactccctaaactaaccctttttcttttctttggcattgacagatctcctggaaatgcctatgttgaaggtgatgcctcaagcgcgagctatttcttggctggtgctgcaatcactggaggcactgtgacagttcaaggttgtggtacgaccagtttgcaggtataactgtagtgcctgttttgacattctaccgtttagtcaagtttagtcagtagtcacatattcagaatatagcacaatctgtattatgccactgttaatcaaatacgcttgacctagagagtgctatataccctagcttaatcttcaaactaaacagttctcttgtggcttgctgtgctgttatgttccctgacctacatgttaatattacagggtgatgtcaaatttgctgaggtacttgagatgatgggagcaaaggttacatggactgacaccagtgtaaccgtaactggtccaccacgtgagccttatgggaagaaacacctgaaagctgttgatgtcaacatgaacaaaatgcctgatgttgccatgacccttgccgttgttgcactcttcgctgatggtccaactgctatcagagatggtaaacattaaggcctattatacctgttctatcatactagcaattactgcttagcattgtgacaaaacaaataaccaaactttcttcaaaataacttagaaatataagaaaggttcgttttgtgtggtaaacagtactactgtagtttcagctatgaagtttgctgctggcaattttctgaacggtttcagctaaattgcatgtttgttcatcatacttatccattgtcttccacagtggcttcctggagagtaaaggaaaccgaaaggatggttgcaattcggaccgagctaacaaaggtaaattcattaggtcccgtgtcctttcattcttcaagtagtttgttcataagttgaattctccttcaatgatgtttaaattcatcatcttcttttttggtgttgtgccagctgggagcatcggttgaagaaggtcctgactactgcatcatcaccccaccggagaagctgaacatcacggcaatcgacacctacgatgatcacaggatggccatggccttctccctcgctgcctgcgccgacgtgcccgtgacgatcagggaccctggttgcacccgcaagaccttccccaactacttcgacgttctaagcactttcgtcaggaactgaactgagcttttaaaagagtgaggtctaggttctgttgtctgtctgtccatcatccatgtgttgactgttgagggaactcgtttcttcttttcttcacgagatgagtttttgtgtgcctgtaatactagtttgtagcaaaggctgcgttacataaggtgatgagaattgaggtaaaatgagatctgtacactaaattcattcagactgttttggcataaagaataatttggccttctgcgatttcagaagctataaattgccatctcactaaattctccttggtcctcatggcaatgcaacgacagtgtgaagcactgaagcccgtaatgctctatcaccaccatgtacaacagaaccatatatgtccatatgtacaactcgagtgttgtttgagtggccagcaaactggctgaccaagccacacgagagagaatactataaactcaatcatacataacaagcccaagcaacagaagacagaacacaacaacactcgagtctgggaacagcaacgccgatacactacagcatactgcaacgacacaaaggaattggtaaggaaatggcaccaaaatcttgtagatctttagcgagtcattcatttatagcatatgttggaacagacatgagtcacaagatttatgatagcttagataacagatggtcggaattaaccgccgagagcctatagatgaacaaaaactctgttccaccagtgttctcatgctaaaaactttctgaaataccctaccctgttcaccgaatttctccacctgttggatagcagcattttactggtcgctgatggtcacttcaacctccacacctggctcaatggtgattgaggtgatctgcttgacaacatctgcagagctgacaagatcaatcacccttttgtgcacccgcatctcaaaccgatcccaggtgttggtacctgaaacaatgtttacatcattaacatttccaaccgcccatgggagatgcagaacaaagagggcaactaaaaatattgcattgatgtttctatacaactagagtggaaacaaatacagtttcaacaggtaaataagagcaccacaacttgcaaaagagaaatgctccaactatagtgataaaataattgcaaacaaggggttcacattattacttcaaggctgagcatcagttttaaaaagctcgatttttagacatcaaataaatcagtacaaacataatatatcatcatctgctcaacatgtccagaaatatacaatcattaaaacattcaggtgcaggtttgccatgcaatgtggaaaaaaatagtagtgcatggtacaaagaagtactaagaagcaactaagtcattaacccaaaaaggtcagtatttggacaaataattaccaagcattggataggccaaccatcagttttaaaaagctcgattttgttagtcttcaaagaaagactcagcaaaaacatattttagcatcatttggccagcccatcatagaacaataaccacattaaaaacaatattaattcagacagaacaagcataaggtcctaaaagaagatttcatatcagcaattccataccaagtacaaaatcgtagcaatatactcaaacttatcagcatcgccagtaagtttagcagaaaccatgcaataaccataaaaccatccacactacacttgctattacaaggccaagcatcagttttaaaaagctcggttttagagacttcaacgatataacatctcagtagcatctccttgtaacatcacatgctcggcctacaactaacaactcagctctcatctaaaatgctttaatcaaggcaatgctaactcctaacaaacaacacaattgaagatgatgatgatatgctaagcatcagttttaaaaagctcgatttttttagacatcaaagatcaagatctcagtgatcaactagtatttaacatcatctgctcagcagatcatcatcaacatgacaaatcatagacaactgttctacacaacctaacaaaaccatcaacagacaagccagatcatctcgagaagaaatgtcaccttctccacaaggagacttcctggtggtgatgtggagcaccttggtgggcatccgcacggggcccttcaccttcaagctcttgtccttggctcccttcaccagatcaccgcagactgcccccacgcaacacacatccaatccaacaccaatcatcagatcaaatgtcgcacataaaccccatcaccacaaaacgagaaatcacaaagagggtttacctttctcgaggttcttgacgctcttggaggagagggtgatgcggatcctgtgctgcacctcctgcgagctctcgaagccgatcttgccggacttcatcggcggcgcgtacgccacgtcggcggccgccatggctggcgcggaaggggaggaggtcctcggctagggtttcgcctcgcggatggaggagggggagaggtggcggcgcgagatggggatctaggttttcgcggcgtcgacggaggcggagggtttatgtagaggcgggaggtaggaggtggggttcgagtggccgttggatcgaatggtcggagtgttttctggccgttggatgtgactcgttctgggagaggggaagcattggtgggtcgtgtctatgacagtgggcccagtttgtcttgcaagggatgacagtaggcccagttggaacccctcctcctagcacacacaacgaagcatgtaagtatattgcacgattaattaagcagtattaactatttttttaaaaaagattactataattttttaaaacaactttcgtatagatattttttttaaaaaaaaacacactgtttagcgatttaagaaacgtgcgcgtgaaaaacgaaatatgtggaaagataggataagaactcaagcctgtgtctgctgtttctctgactctctcctatggccgcgtttggatatcctagttgggaacttgacacatgattaattaaatactaatttaaaaaatatttgagaaattgattaatatgatttttaaaagcaactttagtttaaaaatgttttaaaaaaatacatcacttagtaatttgagaagcatatgtggagaaaacgagtattagaagtcgggaaagtaaagtatagaaagcagcctatgtttgcctccttacttgcgaatatggaattatgaacttgcacagcttgttattttacgccaataaaccagtctgaatgcaaattgcatctgaactattgaaatctgaatctgatggaccatacaacaacataaatcgtcagtcgtagccaattgtgtattgcaatatactcagttacaagattagtagtaactgcaaagatggaattggataaactggaggagccattgacccaatcaacattaagaacagcttactgaagcttcacaacaatgtctacctctccatttctcaaacgagcataacctaaacttgtttgcaaaattacatttctttcggcctttcagggcacaattcccatgaactgaagaagtagatcgctatacgcatgagcaaaattacaacagtgttctctatttttcaaatggtatcggtgctctccctggccatgtttcaattttctcgaagtacttcacaggaacaacgccatcgaaaccctctgtcagaatcaccttgttgtctgaaatgtacagcttcattccatctgagaaacagattcagctatcagaaaccagcccctagcaagttgataagagaataaatagattgcttgtggctataaacaaacagcatcataccttgcagtgccatactgacatccaaatatatcaagatgttaacactctgccgcatacctgaagaagatgagacgttagttcatgattgcagtagtggaagaaccaaaagactacatacaggaaagcaccattatcaataatagcttgtcatccacctaagcgggaataacagaaacacactagatttataacagaaactaagcaaacggccatagccttccagagaaaacaagctcaacaatggtgcattttgtacttgcgtaagggtaaagcattaccgctaataactcccccatctgtcggtaagccacttgagaaatgtacatgtaaccttgccattcgttttagcccctgatgcaagattgaatcgaggttcttcctgtatgttccatgcacacaaactgtggataaaagaatcagtacaaaccaaactattattctgtagagagtgcaaaggggaactcaaaaatcacataccagagacttcatctgctgatagaatgggtttcaacaagctctctgaagtaacagtctgcaagaggttttgcagggttgttataaagcagacaagatcaacaagttagatgcaattgagacatctatctaaccagtatatagagtctaacatcacaatttgtggacaatgggaagtctatggcacaaacttggggcgtttgccattgggccctaatgcaaaacaactcactttcaaatattgtttggtcatctttgattacaatggttagttgtaaacactaaaacaattcactcgataggaaaattaacctagccctctagtaaactagatgccttatgcataggagcagttgtgcattatgtaaatttcagctaagacctaaaagagaggcaaaacgtggtgacctcaaataccatgcataccataccattgcaatacacataactgaacatttaggttttttgacctttaaactatgccaaaaaatggcagagctatcagtaaaatcctgtaaaggtgtatgtggtatgctgatgaaacttgtcacttagcaaagctatgcaagcctctaaaccaaaaaaaagaagtgctacagaagagtatatgattacagaatacaagacgctcgatcagagtactagtgttaggcattataaacacacatgaattgtgactcccttttattttgtcctagttcgggtcaataagcaattgagcgacattgttctcgggtagcttgttagcaggggcgaagctatgttgtccgaagggggttcctaggaacccgggtaggaaagtgaaattagttattaataccccctaatgaccatgtgggcacccccctgggctcacgtatgtgtacccctagatcgataattaagctacggagacgtaaagcccactttttttcttaattaatttgatcttgcaaacaaaaaaagttatgttttgaatataggatttgattaatacgaatacaaagttattttctcatgatagatcgttggtgtttgaagtaaagttgtatacatattgttatccaataatgtcagtgctgtataggcgattttttttgggattttttttatatataacaagtggccaatagtagagtgcaaggaatatactaatatccaggctttgccttactgtttaacaaacattagaaaattagatgtagagtcataaatagtactagaaggtaatgtatctagtatttgacatgaatagttcataagtttttttacttcagagctaacatgaaggttggggcaatgtatttcggttttgctggtacaatgcattcacgcatattggttagtacttttaatcgttgtactcctcttttgatacgattaacatcacttattgaattttcttttttaataattgatgggaggcataattatttagtacaatatcacttaaaaattctatatggctttatggtatggacgcatgactaagtggggcacccccctccaattctccctagctccgccactgcttgttagcaacataaaaaatcaacagtaagttatgctacagtgggaaaagaaaaaaaaaactatcttgagcaaaacacaaaatatgtgttttccaacagctaaaacagtgccccatagaatgaaattgcacaaccacacatgcctgtattacttctcttttcgtaagtctgagcttgctggcgataacagaagcgatgcttagtcatcacaaacaatcataaacaagtgatagtgtattttataccagtataattgcatcagtgcagggggttttggtagagaacataccgttactgtgtggccctggttagctcgaatcagcagctcaccatcttcctccaacagaccaaacctctgcttgttatcccgtctaaccgcctaacacgccataattaaagcaacattcacttatattcacatactaataatcatcagttcatcactcacagcacactggtgaatccaaacacaagctggcaagctgaaacaaacacgaaccctaaaccgaagcatacggttgatataactgggtagattgagctagtattacctccttgatttcgtcgacggtgtgggacttgagagggatcttggcgaaggtctgcaggttgagcttgagcaggtcgcggacccgcacgtagccgtcggtcctcatctccaggttcagctccgacgccatgtgccgcaagatccgcgtcctggggagggaggaaggaatccaacaatcagcaagcaagcaaagcaactgcggaaaaggagaatcgcgggagcatgggcgcgttggccttgtatcttacaggaggcggccgagggcgtcgatgcggtcgctcccatcgccgccgcggcctcttccgccgccgcgtcgcccccctcggccgccgccgccgccgcgaggctgcggggaggcgaaggcggcggccttggagtggtaggaggcggcgccgcgggaggaggaggaggaggaggggttcatggggagcgcgagacgcggggacggcgaggaggagaggaagaggaggagggcggcgcggagcggggaggcggcggccttcatagccgtcggtcggaggtggacgacgatgacgacgacccacgcgtgcgggggacgagaccgtgcgcgttgggtgggccggttgggccggaattggcccacctcgaaggtccgtggacgtaccgcatggggaggtgggctgggcacgctggcccatggtgagttgatacatgtgaaagttcctattggctccctcaactaaaaccggatcaattctccgttttgagaatggttttcgctggcatgtcacgttgacgttgtccaccatgctaatgtggcaattacgtggcattctattaagaaaattttagaaagcgttggggcccccatctattttgctgacggccaatctatggagccttggtggactaatgagtgatgttggattaacatctagcgccctagccatcgtcttccatattttgatgatgacgactcaccacgatgacaacttccttagctaaccttagtgccaccaacacttaaattctagtaggctttgtcggattaaagtttcaagggtgagagcaatgaagacgactatagaaggatgggcggggtggtggaaaactggtggagattagcatgcgaggcgccatagacgcgaggatgcttggaggagggtggtaggtgggttaatgatagggagtggcgggtcttgtggttaggaggtggggttgaaggtagtggatccgatgactctctaatagcgtgatccgccaaggacgagggaggagatcacgacgctaggggaaagacgttgagcttgatgatggtgaaaataacaaacggtggatctatggtaggagcgaggtggtagagagggtggttgaccaggattgggcgagagcaaggtggagcaccgtggcggcggcgacaacgacaatttactcggacataggaggaaagataggggttaggattataaagggtacgaatctttaaagcaatcttgaccactaaagtgaatactattaatgggaagatcaatagatcgatgattgccacacacccaaaaatggatgcttatcatgccgttgatggcccgaattggaaagcataacaagaagtgatgcatgacctaggtgtgttaacttccctccgtttatgaatgtaagatggtttggttttgtccgaactcaaatttctctaagtttgacaatatttatagaaaaatcatactagtacaactaaaacatcaaattaattttattaaatccactcaaatatatttttataatatatttgtttagtattaaaaatgtgtttttacatttttaataaacttggttaaagcagcttgacttaggcttagttcaaattggctagtttggtcgagcttttccttggcatgcaaaatgacaaaagctattagcgcatgattaattgagtattagctattagaaacttgataaatggatttatttaatttttaaagaaacttttatataaaaagttttttttaaaaaaagacaccatttagctcatccggaaagcacttagaactcagccttgaagacaaaccaaaacatatcatattttgaaactgagaaagtgaggagcatacatgttgaagttactccaacctccaaattaagatagcaccttggtctattgtcactttatgagatgcaaattggggagattaattgtctacagcaagcagcccgcagcacatcaactcagtagcaactagagtatatatatagcagtagagtagccataatgatgtaatccaggtctgatccaaagttcagaaggcacctagctatcaggacacacaaccatgaatcatacaatatttcgatcaccatcaaaggacgttcaaggttgccatcctcagcacgtccttaagatagacacggccaaagccctcctctccaaactctatgccagcactattctgatacaccaggtactcttgcccctctcgtcgcccaaatccgaccaccaggacacaatgggaacgtgtgactccatcctcgtttttctccctcttgttaggctcgtaggagtaaatctcgcctggcttggtggtcctgaagttgctagatatcttgaatcctgcagccatgaccctagcttttatcccgatctcttcggcaatttccttgaatttaacatcctccttgttaatcatcttccagttatagattttatagcgcatgccctcaaggccaggatcttctgcagcaataccaatttcttgtagcactcttagtgccacatgcattcggctttgacctctacctccacctggttctgttccgagctctcctgcattaagcaatcaagacaagaagtatcttaatgctgcatgcatgcatttgctatttgtaacacagaaatttttgtatacccctaaacttttacctaatcccttctatgtcgctaaattttgctaatcctttttatgcccctgattttttatattatcctctatacttctattccgttaattagttggctgttaagtggccattatattgtttttctaaaataaccatattacctctagtgcactctctccatccaaaaataaaccaatctaggattggattggatatcacatagtacaataaatctggacatgtgttatgtccaaattcgttatactatgtgatgttccatctaattctaaattggtttattttaggatggaagtagtacatcataaagtggtaagcgtcctcactaaataaaatgtttgagtggctgatacatactaaaaataataattgcactgaattcgaaaaggaaactttagatattaaacatttttttgcatggactgacaatagtgaccaaaggtaagtattactactgcctcaaagaaaatgcattcctagcaaattttagacagattagcattcaacacaaattattgccaatctaatgttgtttctaatgattgaaacttactccttattcctaatccaccgtgcatgtacatattttatatatatatacatatatatatatatatatatatatatatatatatatatatatatatatatatatatatatatatatatatatatatatatatggtggtccaatttttcattatttcactaaacgagcatgtacatatcctatctcactataaagttgatgcatatatagtaacttgtaaagcttaacatgctagtatgtcacaccatcacctaatagcaattattatccacaatattttaaacaacatgcaaatgtgccactagcaattattatctagagtattttaaatatcatgcaaacatgatatatcaattacaattttgttgtatttttagaactcaatatgcaaccaatgtcaaatcattatctccacttcattttcacactatttaaacacatacatatatcatttttataatatatttatgcattcattcatatattccgcaacaaaatgcaggggaatcaactagttaaaaggggaaattcagccaatcagtcaatctctcaaattacatgcattaacaggatggcgagatgagggatggaaagatataggagggccggaggtaggatatattcatcaactaattagttagtagggtctcaccttgctagaaacacaacttatttaacaaatttgaaatggtagaaatacattctttttggaggaggtagtacatggttatggcaaaatccatacttttaaaaccgtatatttattcaagaattacttttcaaatttgatgtaaagttttacaattttttgaatttcaatgattttgctaatgtatc

SEQ ID NO: 63350 - DNA, 7754 bp, Oryza sativa
tgatgatcccaactcagagcaaccccagaatatactacctctgttttttaaatagacgatgctattgatttttttatcaaatcattcgtcttattaaaaaattacgtaattataatttattttgttgcgagttattttatcccttaaagtattttaagcataatttatacaaacatttgtataaattatttgaataaaatgaatggttaaatatgtattcaaaaattaacaatatcatctattcagaaacagagggagtatatgcttggcttgatttcctaatcgaacctgttagatatcggaaaggctcatgtcgctgtttgcctgtttaacatggggatttaaatctattatattattaaaagaatagaaaaaggagtctccacgttcgctctcatggcctagaaattctcacattaatcggagaaaaagaaaaaagacagagtccatatagaaatacaatttagaaatagctgaaattcggaattaaaaaataaggaatattagaagaggagactagagtccatatagaaatacaattaggaagtaactgtaattcggaattaaaaataaggaatattagaagtagagtatagagtccatatagaaatacaattaagaaaaaaaaatagaaattcggaattaaaaaataaggaatactggaagtagaagtagagtatagagtccatataggaatttaaaactaactaaaattcgaaataaaaaggagcatccacgttcgctctcatggcctagaaattctcacattaatcgaagaaaaagaaaaggcagagtccatatagatatataattttgaaatagctgaaattcggaattaaaaaataaggaatattagaagaggagactagagtccatatagaaatacaatttagaaatagttgaaattcggaattaaaaataagaaatattagaagaggagactagagtccatatagaaatacaattaggaaataactgaaatttggaattaaaaataagaaaaattagaagtagagtatagagtccaaatagaaatacaattagaaaataataaaaattcggaattaaaagtaagaaatattagaagtagagtatagagtccatatagaaatacaattaagaaaaaaaatagaaattcggaattaaaaaataaggaatattagaagtagagtttatagtccatataggaatttaaatctaactaaaattcggaataaacataataaaattaaaagtagtgtttagagatcatataaaaatacaatttacaaataactaaaattcgaaattaagaaaaacatgggaagaatagtttaaagtcaatataggaatacaatttagaagtaactgaaatttaaaattaaaaattaaagaatattgaaagatgagtttagagaccacatagaaatacaattagaaataataaaaattcagaatttaaaaaaagaaatattaaaagacgagtctagagtccatataggaatatatataatttacaaataacaaaaatttgatattaaaaataattaataactaacacatatataaaatacaatatgcatattacacattagtagtttagtaaagttattgcaaaatttaaaattatgttgtcattttaatatatttgaataatataatgagaaaatatatatactattacatgagagaaaatataatgatgctagccgcgaatctgcgcgggccaccataatagttaggaagtatagtaagatggacgggctgactgtttctaccagttcagattctacagcccactggtatgggccctgggctaggaatatggatggtgattgggccgaagatagtttatttctcttctctctcggcctatagtcttaacaatcttatcttacgtgttttaaaggcccaacacgaccaattttgtcaaagatcacggttaggtagcagattaaaagaaaatagtaacattttagagagatataaatacctgcacaagcagaaaagaccgcgtggcctaatggataaggcgctcgcctccggagcgggagattgtgggttcgagtcccatcgtggtcgtgtttttttttaacctttttgaactttccaactcctccgtatttctgtactagtatttcttttttccaaactaatttatttcgttgcgtcgtacattatgagtatatcccaattgtgttcacgtgtgttttattccttactccattttatataatataagctccctaagcagcacaaacatcgtctaaaggacgtgttgcggctccactactttagctacggtgcaaaatagtcccttcgtattttaatgtataatacaattaaaatatttaaatataaaaatatttatgtcatgtctaaagggcatttattataattatataaaataaataatcattatatttttttaataagagaatggttaaacgttagtaaaaaaaataaacggtgtcatatattaaaatacaaaaggattatgtattttttgtcagtgcagttatggtaggagtacgttgtagcgcaacgtgcagctgaatacggtctattataatagatatttaatgttataatcccatgatatagcatttacaatatgtatgatgtaaaatatagatatttttatgtaaacgagatgattaagcagacgccatcaacgaatgccttatcctatcttattataaagttatcccccactaacttcttaagcttaacatacaaagatgccatatcatcatccactaacaagatgccacatcatcattcactaattaacaagatgtcacatcatcatccactaacaatcatcgcatttaaacatcatgcaaacatgctatatctttatagtttttataatttaagagtttttcaaatacaaacatgttaaattatcatccaatataattcacataatgtttcaatgtatatattcatgcaaagatgccacatcatcatccactaacaatcatcacatttaaacatcatgcaaacatgttatatctttatagtttttataatttaagagtttttcaaacacaaacatgttaaattatcatacaacataattcacataatgtttcgatgtatatcttcatactaaattcccgcagcaatgcgcggggtttcacctagtttttattatacaagctgctccttacgagataatcctaatccgtcaccgcatctatctgaaaataaataaagcggtaaatcaggtagcaccgtgaaaaagatcacgtttatgttgattattttgaaattagaaggtcttcataaaaaaaaatagatggtcaaccggttggattgaatccctcctgaccacatgaatctctcaactcatagaaaaaaaacatcatcattagataacatttcataatctcattcatgtaccaaccacacatctccatcatcaaatagagtaattatccttctgtgccaggtattcgaaaaaaaataatcctgatttaccagagcagttgtaaacaattttagtctttcatcatttatcttttggctcatcaaccgctaccaaaatttttaaaaattaaagtttagttttcaattttttaaaccaaagtttgtttttattagcttttgaatcgccaaaaacaaaaatataagttttttatccataaaaaaaaatagcatgattcatatttttccacgtcttatcagcaaatgagtatatgactaagaaactataagcagtataaatatttaacgtctaggactgatcaaacttttaaaactatggtaatctcaataatgtctcaaacaattagttcaaaaagataaaagaaatcatatacgtaaaattttgctcgaagagtaatactcctctactcatattagtacaatatcacaaacttattgtagattttataaatttaatctaatacattttttatcttatcttaaatgtcaaatatattaataatagccatgtgcgtcattagacggtagtacgatcatacataaaatcccagtcaaagacagggaagcagagcagagcaggaggaggaggaaaacttgtagcaagtgatcatttcatttggtcgcgttaacttgtcgtagcatcaggcacgccacatgctacatacaacaaaagcgatcgcatgtgttgttcgcgtcgcctccctctcacgacaagcaaacccaacccaaaccaaacacgagccggacgagacggagcgctccctccctctctgtcgcccgcgacgccgcgaagccgcgggcgccaccgccgccgccgccgccgccgccggagatggacggctccggcagctgggacgccatagactggaaccaaatcaaggtcagtttgcttccttccttcctcggtggtgcgcttcatccctcccttcctcctgcctctccatcgatttctctcctcgctctcctgcctgcgtcttcgcgggtgtggctgtctgcgacgactgcgcttgcgggaggggagctggcctgtgggtttgggatcctcatgcgcgggcgcggggccaccgcctgccgcgcggagaggcttcatcttctctcctctcctctcccgataagtgcgcgagtcgttgcggggggcggttttgatttggagatagggttcggttgctgttttgggggtgatctccgatttcacgttttgtttctattgatgattttgttctctccgctttctaggagccgaggccgccgcggagttcgtcccggggcatggaggacttcctcctcgaggatgaggaggtttacgcccaggtaatcgcctccttttcccccacatctgtgactgaattcctccagtttcgatgtgcaagcttcatttcggacggaaatctccgaatcagttgcgtgacgtggtgctttactaaccttgcaatatgctttgtcgattgccctttggattaactcatcaaattcattcattactgcctagaatgattcgccggactatcctgattgcaatgcacccatccattccctgttcactgataataagtaggccattcacaattgacaattctcctctcaataacacaaccggggcagcagaatctgtcacaatgggcagcgcatttctagtgctattgttcaactgcagcagtacaagtagtacaccaattgcctatcactcataatctgtaggccattcacaattctgaatgacacaaccggggcaggataatctgtcacaatgggtagcacaattttagtgctatggttgaactgcggtggtacaagtttaagtagtacaccgaacgggttctaggccgcttacagtggagttaatggaagcaataatgtacctagtctggatgtacattttatcagggaaacttttacgtaaacactaacgatttttgcacattttcacctactaaggcacaccaattttctgtgcgtaatctagtgatcatgatttcccactttcaaattttgatacatttttgcggagcctgtcggcttccagatcatcaccttttcaagggtatttaatcttggatagttgtttttgagccttttggttcttataaaatcctagggacaattatactccatgagtttgtaatcaaccaatgtgtttcagactgaaaccaaaagccttacacagacagaaacagctgcttctgacttttgctcttttacatctctaatttggtccctcttatatctccttatttagggtcatggtgttgttctactaaacacagatgaggctggcattctttcagtgacaaatttccgacttctctttgtggtaagcaatcatattattagttttatcacaattattagaaacaattcgacgtgatttggatgcctcctgcatgtctatacaagttcattctactatacaacattctccgtttgttccttatatgttctctcaatttttttccatcgatttgaaatatgaataatgtcttgtttgctttttgagtgggaatttagtatattatgacccctgtttttttttttggcttgaactaagcattctaatgatggacagactgctccctcagtcctttccttttcatattactcttgttcttcttttataaatgctaccccttttacagagccaagccacaaaaggcgttatagagttgggtaccatcccactaactgcaattgagaagataaatgatgtaagtctataatttccttcattgggaagttcatgttttcaagtcttcttttgggttcatggccactattccattttctttaattcattctataagtccttagaaaatattgattctgtggcaggacgtaaagcttcaacccttgccccgccagcatgataagaagcagccccgtgaacttcttcaagtcatcggtaatatatttttttctttttttactttgtaagtcagctttgaacacaattcatatatttacagtcctacttaatcatgactgagtagatcttggcagaaatttgtaaataatctgtcttgagaaggtattcatggtgtgcctgaaaggatctatgttgacatagtattaatactgccagagacctctattacatgtcctcttgtaattgaatccatctttcgttggtgggatatgaattaaaaacaataattatcttcttgaaccattctgtgatttctgtgcgataatgccattttccttgttcttttaccatagtatcgccatttttattggtgatttttcagtctatgtatgtgttaataattttacctgacatctaaagtagtttgcaaatgtatcttgttttgaccttacctttaacttgatctttttttcatccaggtaaagacatgagggtcattgtgttcgattttcttcctaaaaccaagcaggtagaaatcctgtttcattctaatattcttttgtattatattttgttctattctccatttgttgggtgatgcatcgttaaaacctcatatggtctcatactttgttatgtcatgtattttaatcttttgtgtttcatttctgttacttatcttttcagaaaaacgaagtgtttgatgctttgagaagatatagcaaacctactcatctgtgggatctatatgcattttcttgtgatccctccactgtttatcagaaatctgatccaaagatgcggctcttgaaggaataccatcgcctttttaggaaatggttcccgcatagtggatccgagttcgaaaaagacttgcgtaatgaatggtggagggtaagtaaagtaaattccacctactcactatgttcgacgtacccatctgcattgattgtgccaaggagcataaggtacttttataccattcataatatcttgtggtaattttattctcttacacatgctcagcaccaacattttttttattatctgttagtgatgaagatttattgcaagcttcttctttccgatccggcagacgcttgcctgttatttcgtggtgtgaccctggtatgcatgcttacgttttgccaataaatttcatcattattctctgcagtcttatgctccctatattttggaaaggctgatgactgttggtgaatggtcttatgaattatgacctcattgccattccttttatatttatatagttcataattgttccgctactttcagattttgggggtaacactgtaacatcattaatataaagtatcatgttggtttcagttccctttatacgacatgcataaaacttgagtgtgtttgtgttacaggtctggagctgttctggcaaggtcatctcagccattggcaggattgatgatgaattttcggaagt

SEQ ID NO: 63351 - DNA, 1001 bp, Oryza sativa
ttgctcctaagcattatcaacaaggcatgtcaaatgggactgatatgcaaacctatcaatgagcctgatggaggcggattaccaattagtcaatatactcgtgatactataatcctgatgagggcttcacataatgaactttttttttgccttaaagctttgttgaatattttgctcagcccactggcctcaaactgaattttcataagtcaaagtgtaatacctcgtaatgtactagaagtaaaaggtggaacaactagctggtacttttgggcgtgtagtaggaactattccatttacatatctatacccttaccttgtactacaaggtcaaggggattaaaatcatctaacctatttctctctaacctgtgttactgacatatgggccctctacccagtagacctttatgtcagtgacttaaagtctgagggaagtaagtcaaaggatcatcttcccaaggtcatgggtagtggatcatgctcatttgacagacagcatggagagaaggctcataacaagtgttattttcttgaattatggaggaagaacaaccttagtattttctttagggacaagctgacgctactggctgaggatttatatgtaaagaaccttggggtacaaccagttttacataaaagcccagtgaagatgggtaagttacatataggcccagaattatgcaaagaaggatttaacaagaaataggaaaagcaaccaggccgtcgatgcacacaatgacggtgaaagcagggatatcatggcaagttgtagaagatcatgccttggcacgaacccaaacagggcctcacaaggggggttgaggcctcagcaagaaaagaaaaaaaccagccatatcttgtatgtctaccaccggagtcaacgaggaagatcgatgcagaagcagatccatggccagcacaacctgttcctggggagatttggcgcactcccatagaaggcatcgaagtaatacctaatagtgatgagctactgt

SEQ ID NO: 63352 - DNA, 73764 bp, Oryza sativa
attcctgcagccctaattcacaatggttgcagaataacctcacaattttctctattcccagaggtctatgctgctcgtgaaaaggttggagtctacatcccaaaagacagatatcagcaggaggagaatgagagaaaggtaatcttttggatttaatggatctgaatggggaaatattcacaaacctgaaatatgtactgtcaacatatctgttatgtaactctagatgttattatggtattgagaagatttggagcagtttggctgatgatgctaacttttcttatttttcctttttaaggccatggctgatcaaattgaacagatgactacttcgttggaagcaaatcagaaggttcgtaaagtgcttgttgtgtatatttgatatttgttcttgtttaaaattgatcttttgcttgggtttcagcaaattaatgatcttcaagaaaagtacgactcagagcttcaacattctgctgatctaagcaaaaagcttgaagccacagaggtaatcatgattgcaagttagttcctttctccttcatgctattttgtgatcgaaggcttatagtgttgtaccatgatagaaatgtctggaccatacaagcaacttactatccacaaccaaagaagatttgaaacaagcccagtataatctgaaggagaaagattacataatctctgagcagagaaaagcaggttcgattctttgcacattttttattcctgcaggtcaattgttaataattctaacagtattttcatccatctgtgttgatcagaaaatgctttaattcaacaagcctgtcttctgagatcagacctggaaaaatctaaccgtgagaatgctgcactctattcaaagattggtaagctcttttggcttaattcgatgactattccaaaatgttgcttactatcatctttgtcattggttctaactgaatgattaccatgacaaaatagctcgaggagataaactaaatgctgcaaataggtcagtggtgaactcattccaagctgaccttgcttcaaagttggatattctctccactacccttgccacatctatagatcagcaaaataaacaccttaaatctgtggagaacttatgcaagtcttgtgttgattcccatgacacggtatgcattgctacttcataaatctccatgcctaattttgcaaattagttatgtgggctcagtggttccatattatatttatatgtttttttttgttaaatgtttaaggctacttcggagataaaaaagaagattttggcttcaaaggcactttatatgtcacatatggaagccttccaaaatgttgtgctcctgcataaagcaaattcaaattctacactagaggatatatcatccctatctgctgcaagctgttgcagccttgatcaggcaagcaatcttcttagttatccaacaaatacagaacctgatgctctttactctgtgactaccctttgattgagttattctcatggcattattgttaatgacagcttctagcttgtgtcgagggagaggcacagaagatatttggtgatatccagaatttgctagctgatcatcgaagcgaagtggcacatttcactcaagagttgcgggaggtcagttacttgatctgactgttaaacattctaaattgtcaacatacttgcctatgatcagctcttaattgaagtttgctcctgttattatgcagagtttccgcattagcttggataggacgaaggacatgtctagtttcatccttgggttgttcgataagtatgtggaggaaacttcgaagttgcagagccactccaatcacacacatgaagcacaagtcaaaagccttgaagatttccagaaggcttatgaggtgatcgatcccccttttgtctgcttgattggcaaaatttggttgctgtatctaacatcaattttatgcaggagcaatcaaaatcagaagaacaaaagcttctggcggacatcaccagtttggtttctaaacacgttactcgacaacgagaactggtgcgttgcatactttcacctcataaatataagtctggccaaccttttgaggcatgcttttgatgtgtgatcataattttgtatcttctcaagatgcttctggggcgtgtgaattcagttgtagtttggttttgatggaagcctggtgtattttcctgcaggtgggtggtagactaaactctcttggtgacgccgctcgtggaaacaaagcatttttggatgagcacacgtccgccatggaggtggtcacgaaggacgccaagagaaagtgggaaatgtttgcagagcaggcagagaatgactgcaaagttgggtccaacttctctgcagctaagcattgtcgcatggaaaccattctgcaggaatggtatgccttcagttgctgcttcttcgttccttcttcccattagtttgattggctttctctaactaatgatttgtactggactcagtgcatgcaccgtcgacactgctgctcaacaatggaaagcatcacatgcaactgttaacgatctatgcagaaaacaaatagctgaagttgaagcactcgtcaggcaagctcatagtttctcttaagctagctgttgctggttacaattggttaggaaatattgtttagtgcttcttcatcagatttccacttatcgagctagcatttcaaacaatccattcttttaataatcgtgtttgccaagtagcacataatttcacaacaaaagggaacacttctgaattcgttgtgaatgatggcagtggaagttttgaaaagtttaaaatctaacgagcgtctttatgttgtatatttcaggagtgcaatcgaaaccaacgagcagcacgaagcagagattgcatcttcccgtgccacggccgaggagcatgcgtccaacagcagcaaggacctactccaagatgttgacagtaagttctgagatctcatcacagttgcctacttctaaaacacggagttgcgtaaagctaatcccaacctgtgtttcccatatgctcgcatcagatatgctgcaggaggcgcgcaattcgtcgtcgagagtggtgtcgacggtggaagctcatttgggagagagccagcatctacaggagagccactccagccataccgccggcatcaacacccacgccgacaacgctttccagagcagctacaaggtgagcgagactagtacactcaaaatcttgtgaaccgatgacaattttcatttcaccgaccagagcctgatgaacaactccgctgttgcttgtgcaggactacgagccgaccggcgaaactccggtgaggtcggagccggaggtgccgagcaaagacgcgatcgagtcgctgcgagcgatgccgatggagtccctgatggacgagttccgcgagaaccacccctacgagccgagcaaggaccgcaggccatcgctcatccctcgctcgccgctcgccaccatcaacaactgatgaaaatccattggaaacgcaacgcaatgcaatctgtctctgtgtgtgtactagtgtaatcttattagccgtaagtaggtcatcaaatgctggcttttggtgtcctttggttgttgtggctcagtgccagtgccagtccagcttcttgttgtgggttgcgagctatctcagcttcccccggcgcccttacctaactttctttcacattttattattttgatgtaccaatctgttgcttttctgtgtgattattggagctgcataagagatttgttgagcattgcattccaaatctcatctcattgcattacacttaaccacacatgagaaacaatcgacgaggttttgtcatctaaattaaaaggaaaatgagatggcatcaggtgaggtagagctgcatctcggagtggttctcctgctcgatgacgtcgaggaagacggggtcgacgacgatgtggctgtcgatgctgacggagaagcggcgggaccagagggccacggcggcctcgccggcgatcttgacggcggcgtcgagctccatgtggcggcgcgcggtgtcggcgaggatggagcgggcgtggtgcgccagctcgacggcgtcgaggcgggcggggaggtggagcaggcggcaagaggtgggcggctgctcgccggcgtcgaggcgggcggtgccgaggtgggcgccgtcgtagaggatggagacggtggaggggccgtagcggacggggacgacgttggggttggtggcgtggacggtgagggtgaggccgatgtccagcgccgccggcggccggaagtggaaggtggagaggctgatggagatgagctcgaacgtcgggtcacgcggccggcacagcagcacggccgccgccgccgccgttgaggcggcgcccacgagtgccgagccccagctccaccgccccctggacgccggcgccggcgacggcgagctgtccatgtaggcgtattggggatttgggttagccacctttttcctttcctttttgcgcgtggccttgaggttgttttggcctgctccttcagagttggaatcaggttcttcgcgtgcagattttgttacttctactcaagacttgattagctttgttaatccgtgaatcgacggctggcatttattctggtagttgagatagtgaaggttaagctaagagtaaattgcgtcagcggtaaaggaacttgttaagtgtgtgcgatttagtgtaaaaacttgtaaaatgagcaaaccggtacataaactttaacaatcacgtgcattttgataaaaacactgttacataccaatgattcatcgtattttattggttgtattgtaaacataactgctagattaattgttggcaatgagaatgttttgtagtgctcatcagcgaatttttttgattagctggatcgctcagaaattttgttagttggcatacacttagttttgataatcattatttttttttcaattttaaataataggttattttagtatgataaccgagcaaacgcaacctatctaaaaccttgttcagaactcaagatgatctaactggctgctttttctttacatggctgaaaaagtatggtttaaaagagagatcttttaaccaaaatgtatgcactaaccaagttattagacccgtataattatttttcaaattcttgcactagatcgtacccacttaccaagttcgtgtactataaacgcaatttactcttaagctaattatgatttttaggtcccaaataactggacagagttctgtttagcttccttatttgatctgaaaattaactgggcataaacagagaagcttcactgcacctcttctacagcctcatttcagtgtcattcactataaaacaagtaaacagggagtataaattcttttacaataatcgtttcaataaaaattcgtgtacaataaaatgagcagtgttatgtgtatgtgcatgtactgcattatgaattcgccgattccttgtaaagaatagagagaatctacaacataagaatagagagaatgcatattaacacttgagatatgtcaggttatcagtgtagtatatactgcatattgacacttgagatatgagaagtagaagggattctcaagccgcatatgtggccctcaggtagtctatgatatcagcgctctcgaacatcttgacccctgtgttaggatcttcgatataaggagcctgccacagcagtaattcatgtcaagcgcaaagaagaaattttacaatttaaggcataacatttgatggttgccaacctggaaaatgccgtatttcttcaaaaattcctgtctcctggggctgccgcgtgcacagctgcagaaattttcagctaccagttactccaagagtgtagtgcttgcaattgcaaggctttgtgatacagggttgtgattttacagcaggaaaaaacactgatgatagctaacagcatatccagcaattttgtcattggtgtaacgttattgagtacctgtgtagcaagtgtggcaactctaattcaacaagggtctctcgtactattttacagaaaggagatccctgatgataaagcatgcaccggtcagattctggatctggcagtaagccacaggaaacggcaaatgcaaacgtatcaatatgcagaggattcagacctcatatgcccatagttctattggctcgggtggaagctttgcaggagtatacttagaaccctgtaaacaataactggtcagccctggatacggttcatgcaaaacaagactatatggcttgttcaatatgtaccttcccactacgtccactcattgcgagccctgctgttatagtctaggaaagaaagagcataaggttatttaaactgcacaactgactgttaactggccaaataaaggttgctgagtaggtgtgaaattcaagaaccatatatcaaataataatcgattagacgttatttcaacaaaggtaaaaggacagaaccagatcataacttactgttaatataccaagtgatagcataattggaactgttccatcacctgaaaagcaagggcaaatgcaggaggttagtaggaggccccagggacagggagatgtacagatgagagatgaaataggcaccatatttgtcggccaggtattttatgatggcatcagattcatacatggcaacccctgtgtttggatccacctgcagcataagagtaccttagatgatgataaaaacaaactgatttcacactacttcttccagacagaaagaacacccaaatatcctaagtgaagggaaaagtggaaaacagacacatcgctgtagcaaagtaaatccatacgacaaataaaaataccattttgcaaggtattcaagactctgcaaacatgaatacatggtaatggtgagattctgagcatgcttgtttgtcaaatatatttccataacatttttttagtaattcatagctgtgtaaaagtagaacagaagtaattgagtatatgacctaagaaactgaagaaattatggaggattacttgcataccatgtaaggaaattgttgctttccgcccatctctaaaacctttggacggaaagtggggccatttttagggcaggggtaaaacaaaacatcaaggtccaagacggccaccatctctctgacctgcaaattttaaaaaaattgttcatacatgacagaaggtaaagtgcaagatgcagatgtcgaaggctaaaaatactaacctttcggcagaatgggcagctgaagttgaggcagaattaatacagcaacaattgaatggacggtacaaattaagttagctatagcatgagagaatacccagaagaagattattgggtctgaacaatacatgtcttttatggaaagagagaaaagatgaagcatatatacccttcaaactcgtaaatctcgataggcttttctggtcgaggacactgccctatctttgatgactccttaaccttccgacctagaataagaaatgacacatatacatgtgttactatgtactggtttgaagtctgatctcagcagttgggctggtaatacagtaacaatatagtgtctgttttacgaagcaattgagaataaactaggtcgttgtatggtgcaaaatgacgaccttgtgtgtgcgttcatcgttggtatttgctttgggaaaataaaataaaaagattgtaccttggaaatccaaagcatattcatctggtgccacctcgtcaggagaaaccagcgataccgaatatctgcacatcaaatgaatccaaggccatgaatatatgaatcgagtaacaataagatttagaaacaaaattcagtaggtattggatcgaataaattcagtagaaatagaaaataaagtacccaagggcgaagacgccggtgccgaggcggaagggaatggcgagggaggcggtgacgatgtcgtcggactggccgggcttcacctcgaaggtcttgggctccggaggcttgaagtcgggaggcggcgcgaaggaggaggcggcggcgggcttatcagaggtggaggtggaggtggaagcagcggcggtgtcgtcgagctgcgcggagaggcgcgtggtcctgcgcgaggtagacgtggaagcggcggcggaggagaagcggaggcggcgcgcgaggaggagtggcgggaggtggagcgcggtggccgccatggtgcgcacagcacaggaggaatcgaagacgacgcaacaaaagaaaagaaaagaaaagaaaatcggtggctcacttcactgcagccggaaatattttgtgctgctgaatgctgatacgatacgataccacacgtgggattattttggatcaccggtccgggagataagtacagacagacaggcactgtacaaggtctctttctctctctgtatgaggcttgacagtgattggcacttgggcttaacgtaagcagacgacagatgaaaaagaaatggacattctatatttctgtcacattgtttagtacaatcataatggagtggccaatataatgtcacttgtttggttcaggcttcagagtgttttgttttttgttagtagcgcatgtatgtgcaccctgtgtgaagttctttggtgttgtcaacaattattatgtgttgagagactagtatttctgatttccttattaaaataaatgtggcagagggtcttcagcctctgatggtcggattgagatcctctttagggtattctcagccgtccgatttgcagcgaatggatgagatcgatcgctacagtacaatatagtaacacgcaaacagtacctttgtacatcatattttcctgcttatcactgttgctacggtaaaccactgcagattactgtttcgtactgtagcacaagacatgctttattgttctcctatgtctttagccctaaagtcacaagagttggatccctaatggtcagctttgagtgctgccactctgaaaccatactatcctcggtagagtactcacttgaaggtctgaggatgaaacttccgtgcccctctttagtggctaaccatcgggccccttctcgtttacaatctcgtcacccttattcttttccctaacactcataacgccccctcccctcctaccaaatctagaggtttacatatagtgaacaagttgacattaattatcgggttgtgatgatgaatgtgatggcattggggatggctacgacagacactggagagacccgatgaactatggggctagatgtgcgccaaattgtgtaggctgcatctccaagacacgatgggcagtggtgtgtatgagggcttggtgaacaatgacaaccacatggctagtggtgcatctagttggcctggcacccgtttcggtcggtttgactccctcatgtgaaaggttggtggacgtggcttcttcttcttcaggatgttttccacccccaaccaacaatgtccacctatggctgccgttgccagcggctacctttcctatgtgcctcctctcttatcctcttttaaccctagatccgtttgcctccccgatgacatctccacataccttcttcatttgccaactcctttcctcttcgttttttctattacggtcgtggaactatggtcaatgcatttctcgtgccattggcccctagaaagtccgcttcactcttccctttcatccttttttgtgtaaactttgtgccaatactggcatgcctccatggttggagtccctagagccattgtttttaccgttgcttcaaccaatttagctctgccccattgtctaggagtgtgtccaatcactttagccttgtcccctcctttggatctgctcaatttagcatgctccatgtttaatagcttgggtctccatgttggttgaggtctagggctctaggctcttccggtggttgtggtgactagcgagttgtgcctttcttctatcagtgtgatctccatttatatccttttgtccagatccgtgttcttctacatctttcttcaatagccctccctcctttttgtctagctccctgctagtttacatcctccttcaacaactcttcctcttgtggggctccttttcccaaaagggcgttggagtttatcacgcttcttgtttgtctacatcttccttcaacagctcttcctcctttttttgtctagtttcctgttcgtctacatcctacttcaatagcccttcctcctttggggcttccttccccgaaaagacgttggagtgtattgaactagatgacaatttgatgaagtttgatcgaagataattggatgtgggaggcctagagaagtaacatttaatggagtgtggacccacaagtgcatcggtgggcattgatctaagcaataacatgataaagtgggattcttgatggcttggtgttggtggcgttaggcaatcacaaccttcgatcaccgggatatcgagctagcttccgagtagcagaaagccctccggtaatattcaatacacgcacatcatatccttgtgagcacctttaaaaggctggacccgacatatcttgagattgacgaagtcgatacggacacattattgttgatgggtacatcgcataacactaaaatgcgagcactcatgtcaagtttaggacttaacctagatgaacaggttctgtagcaagaaacctaaccagttgagttatgctcactttgcttttactatgtctctttgtcctttgggaaggttgtggtgactcccttcttcttttttttttatttctatgtattccttcactttattctttaggactcgtgcgcttgcacagccgaagtaggtcataaggatgtatggtttaaaaataatatatttaaggccgtgtttttttaggtgttgggaatacttcccctctgcatgtaaaatagagtgacaaattaacgcatgattaattaaaaatggattatatgatttttttacattaatttttctatagaaactttttcaaaaaaaacataacatttagtagtttgagaagtgtgcacgtgaaaaacacagtagcacaggttgtgaaccttagttaaaacttaaaagcacagcctaacaaaactccaatccttgattcttaccagtgattcttcggaatcttttcatcgttctccaatccttgattgcggtgttgtatacttgtattaggcatactccgcattagtaaagaaattgcttagatctgtttttgtataactggtggttagattcgcagcgttgaccagcattcatattccgaattccgagccgcgtgaaactaacgcgatgcgacgcgacacgtagaaatatccatggtcggccgggcgatgcgcagtgagccgccgcggaattgaatttggatgagcaacaacacaagacaagacagacttgttcttggttgtgtccatgtaaacttccatcatcaaaccagcacacgtacatattaggagtatttgatacatacgcgccttcacaatttgcaattgccaagaaacgaaacgcaacgcaaagcagatttgaaaggaggagcttacttaggctgctcgctcacgacttgttccttccttatctctctagctgcttcaccactctactaatgctaatttgtcttgtcctgagttagttgttgttgttgttctcttctccctttctgtttgtgctgctggtgaaaccgctcgcttagcaatgaagcaactacgagttacaacaatctcttcttgattactccctccgttttctaaatatttaacaccattgatttttttaaatatgtttgaccgttcgtcttattcaaaaaatttaagtaattattaatttttttctatcatttgatttattgttaaatatacttatatgtatacatatagttttacatatttcataaaagtttttaaataagacgaacagttaaatatgtgtaaaaaatcaacggtgtcaaatatttagaaacgagggaacaattgcttacgactcctaatactaatagtataaccatcaatttcctccctgttgccgtacacctgcagctttggaagcttccagttaatagctccttcactcctctcctcctccttccccgatcgagatcatccaaaaatttcttgccaaaggccgcacctttgcagttctcactgcacaggtataaagaaaaggccacgcctttgcctcgtcagttatctcttcgtttcttcttcttcctccttcgacgagagcaagcaagaagccatggcggactacaaccgctacggctacggcggctacggctccaccccgtcagcgccacccgcctcctcctacggctacaccaccacgccctccgccccaccggcctcctcctcctcgtcctacggctacggacatggcggcggcggttacccgtcctccacctacccaccgccgccgccgtcgtcgtcgcaggcgtatcccatggggatggggggcttcctggtgttcccgccggggacgcacccggacgtggagcgcgccttcagggccgtggaccgcgacggcagcggctccatcgacgagcgggagctgcaggacgcgctctcctccgcctaccaccgcttcagcatccgcaccgtccgcctcctcctcttcctcttcaacaaacctgcctcccattccccctctcgcatgggtaaacctgctactcttcttccctgtgcgccaaatcatatatcctctcttcatcgcttcaatcacgcccagaaaatgaaattttcattttctttgtttgctgttctcatgtgagcattgaattccaacataaggtctatgtttggctggaatttccaattccttcagtgatagattggatgttcctgggagcaatttgttgcaacttactcgtatcatactgctcgctgcatcgaatctgaaacgatagagcacttattactgctattattaccagtttacagtttacacaacctttataactatacttttattgctagtacaactgaaagatagaatcatgcaagtacaattccttttgaagctttcctctccttctactacatgggaaattgggaatgtctgtttctttctgtaaaagcttctaccgtagatcattctcttctgtgcccatggccccttgctcttagattggatattcaccttttatgagtgttaccgcttcaactattgaaattctatatcaggattgcttacaagcattcgtgcattagtttcgtcaatgcagctctgccattttagttgtcaaaataagttactacaaaactgactgatttctcattgccacctgaatttgcaggtccagcagagttcgtgtcactgtggaattgccttgggcaatggcgggtgagtgccaacagtatttctatagttttatctacgaacacaacagacaaattacattcttattattgtaaagcatttagtttttggtgcctttcattgtgttttcatcattgcttcaactggacactaaattgtagacagcagtacagcccatccaacctgtctctcgctgttaagaaatctgcttaataatgcaagtggaggtttttatgtttgtattttttttaacaaaagaaaaacagagagaggaaataacaatgctactggagtggagacccagcaacctgtttctgtctggaagagctggttgcaattatgtctttgatattataattattgtctgttaacttatctaagcaagactttgcaagattatatggtgctcaattaatcaataggtgtcatgttgcctattcttctgttctttcatttagtgttacctattgggctaatttctgttcttggtggcaacatccagggcattttcgacagatacgatagggacgggagtggaaaaattgagaaagatgagttgagagaagctctacgcagtcttggatatgcggttccaccttctgtccttgagcttcttatcgcgaactacaacaatggagtctccagccgtggcgcgttggactttgacaactttgtggagtaagtatatttctcacacaaaacgaactcatcagtcagtttattttctgaatgaaggaatctgactattgtttcgtatgcctctgtaattttaattctgcaggtgtggaatgattgttaaggtatgccacttctcttccatttgcagccctccaattatgattggatcatgcaaagaagcagcaaagaacctaatgactgatttttttatttatttattttttggttccgcgtagggtttaactgaaaaattcaaagagaaggatacacgctacagcggctcggcaactctttcatatgacgggttcttgtcaatggtcattcccttcattgtcccttgacttcttcgggtgtctcaagacccaaagagctttgaatttgtacagcttttcagctatgtttctgcttcctagttggatttgtttgtgcaaataggccttggtgattttattgactctgtgccgtactgtgtacttagtaccattttgttttccctatagcctatatcgactgttacctgtgattgcgtctcggttctgacatgctttgatcttagttatcctcaaatgtaattgccttttgatgctaacagataatatgggagagtaaactcagcatctatgttcagtcaagttcttaaaagtctacttgaattatactgtttctgtatcttcaaaaatggggtcaaacggcgccgcatcatgatttcgatgctgcacgattcttgcgagcagcggcaacatttgctatcgattcaaggtcaaaccagaacgaacggtagttggcacaccaattctccccatgaacgaaactattcataaataacacaagcctcatttgcataaatccgaagtgcactgaataaactactacaaaatatgataacatatctcgatgttctcttgggtaagcacaaaactgatatcagtgcaagcagatctaatgtaaggacaagctcagttcaaccgcccagcatcttatcagcttcaatgtggagcaaaccagcttagaacaccctgtacggtttccccattgtgcttttgatgtacaggcacctcacctgcaaagcacaaaccataacaagttagactgattgtgtttgcttgttgggcttacactatataaatttcattacatgtaaacatcagaaatgtaaactactgatgccatgaagttgagaacagaactcacattctgccagttcttcttcaaaagggacacgaggaagttgacgctcatttggatgttttgctggatctgcttctcctccatcgacaagttacccacagcaacacccatgcacagaaccttcttcagctggaacttgactgtagctttcgtctcattgaccttggattcaagagactcctggtgagtaaccaatgtagggaacttgcctgcagagccaacgacatgacccagttagcagagcggtgctagtagaccatacatggcaaaagtgtgcataatcaagagcacacaacactaacagtactttaaacaagataccagcttaatgtatgtactatggtgtgttcagaaagccaaacagcagccgaaaaatttacttaacatataaagatagtggtccttgcaacacatgcacaataatttgatcaattccattgccgggagcccaaaaaattgaaatgtgcatacaagtacatgaaaaaacaggtattcaaaacaaagatcatgaaaagaagagcaagcatgtcagaaaatggaagacttgcctgccttgtttagaccaggaccaaggagacgggggatctgcttgatgatggcctctgatgctaagaaagcatggtacttcttggcaagcttcttcacaagcttcttgttcttgttcatcttcttaagggcctcaacatccatgtagtcgagcccaatcttctcagcctgtttaaatgccatggtgcagcatgttagtaggaagaaaattagggagaaacagtaccattagacagaataaagacagatattacagagagaaaaatccaaattgcatacaaccaaacacattagatgctaacgaaattgagtataacatatgttgacatgtaaagaaataagcaccagggaaacaaacaaccacattttaagaaatggtaattcagtaacactacatgtgttcaaattgagaaaatactacaataatgtaacctgtaaagtctgaattaaacaaaatggctacaacatcatatcttacctcctcgacatgctgggcatcaccaagcatgcagaccttcatcttggggcgggggatatggggcagcttaacggagccgctgaaacgcttgtccttttgtgggtcatagttcttgagaccaatttgaagctcaacggtctcggtgaacttcctgttcttttccttgcaatcagcaacaacctgggagatggcttccttgagagcctcggtttgtaacttactgcaattgatcgcacaagctcacattcagaatttgttatggaaaagaaagaacatttctgatactcatcaatcagtgcaccatactctggtataatctagaaatcagccatctctactgtttactaggcaaataaaacattctttatgatgcaacccagtgcttagttacataagcaatgctacaaaaaagatatatcaagtagtcacctttgttgataactatatacaactactggatccctctttggctcttgatgccactctgaaggtctatgtatgaaattcggcataaactaaagaccttttcctccaaattataaaactactggatccctctaaggtctatcttagatttattttttttgaaaaataaaagcattcaactgtctaacaagaaacgatctatgacaccagtatcccccaaagcaatgctactaccagactaaatcaacgaaaacaactaatcagtaagcaagttgggaggagtagagtacctcatgtttgcggccgataactcaacaacactctgcagtagaataaaatcagaaaaaaaaaactagtgagaagaagcgaggtacagcgcgtaaagacaatacaatcaaacaatcggaagaggtgaggttgcggatcgaggagggaggcggccggagacggagagagagacctcacctagggtttgggcaggggcggcgccggcggaggagaggcgaagaggggacgaggcagaaatggcgtctctgcttttatcgcctagagctttcggattagacgccacgtggcgatgtcctgagccgttggatctcgctactgggccttttgggccggaaaactatctaggcacatgcttaactgtggcccatgtttagtatgggcttcaacttgagttaattcggcctttggctgccgtacctctgaattctaaccaggactactgtttcgtctgctctcttcagcatttttttttgaagaaatcagaaatgtaactgcaaaaaatgagaaatgcaagtttaatttgtttttttgagttgaaggtgcaggatagacgtgggtagctttagtttacatcgctttgtagtttggactttgtcttagatagaaagtggaatggaagatcactgtcatatgagttgctgtctggattaattatgagtagcaagcttagttagatccaatccacttactaatcgctatatgtacatatcacatgcattattagaagaatatttagaatagtaatatgcctgacagacaccttggatccatcattgatgatttgcaatatagtacatgtactagttcccttggaaacacagacagaggcatgtgttaagcatgatcgctgcttccgtccaattatatatcatcgtaatattcctataatcctatgtctatgtggtggcgatgcccatcgattgaagcgatcacatgatcgatgatcattctgatcacttaattcctgatctcaaactactaatgacaagacaatatagtgtaaaaaattaggaagaaaattaattaaactgcatgaatgcatgcatggatggtcctatatataatacggttgttgcaggatgaggatgaggatgagaacggtgacggagaagctcatcggtaattcggtaggtagctaggttgacaagtattctctccgtaccttaaaaaaataacattgtattaggatgggacacattctaattttatattctacgtctagatttgtattacgatgtattatattttagtattagattatttttttttaacggagcgagtatacactagtacatctatctatccagcacgcacgagcaaaactgaaaccgagacgtacgtagaacaaagcagatcatgcattttcagcatgcattataatattatttcgttatctcaaactgaactcaatagcagaattttaattgcgccacatgcatgcatctccataattcgtccattttctttagatattggaaagattttcggtctttggctacaaacaagttgcaaccacttattacataattctttttttttcggggaaaaggaaatagattactcaggaattaaatcatctcttacaagatttgaaatcaaaagacatgtagctatttccccaccaaacactagacaagccatcgctacggccacttattatacgtaattcagcgaatggagagtataaaaaaacatcgaagcactagacaagaactaataataccaacacaaaatagataaatatttattgaattctatttataaatcttcatatgaagttggcaagtatctgcacgacacgtagcatatattagttccttgtcgtccatagcagaagacacagagcaatttaatttgatcgatcgatcgctagtaggatatatactattattctcaacgtgtatatagaagccgtaattatatactccctccgttttaaaatgtttgacatcattgactttttaagtacatgtttaaccattcatcttatttaaaaaatttaagtaattatttattctttacatatcatttgattcattgttaaatatactttcatgtacacaaatagttttacatatttcataattttttaataagacgaacggttaaatatgtgctaaaaagtcaacagtgccaaatattttgaaacggagggagtatatgcacgtacgatcctgtgtcgtcgttgccgcgtcgagcatcaggtaatagcaatactactgctgcctgtcgggcgctaaaatagaaatgaaagagagaggccatgcatgcatgcaaatgcgatggatgaacacccaccgaatcttcaattctcaacaaatactgcactgcatgcaccatgttttccttctgaattataggtatcggtcaattttgaatagtcactacttgatctgaacttgcgaagatgctcataggggtagagtttacgtacgtgtgtttataggggtgagtgtgcgtgtgttgtgagtctctgcgttgtaatgtatatatattttttttaaaaaaacagccccatccgaagggcaaaacaaaaacaacaagcggcagagatccaaacacgtgggcgccgactccgcatccgcctcatccacgtgtcgtgccactatcccttcatccgacggctctccttcctccggcacgatatcggacggctgtcccgccaccaagctcagacgatgacaccctttccccctccctaaattaaccaaatcaaaccaaaccaaaccatgtttgtcatcgctaatcaatccacgtgcatcgtgttcgaccgacgtcatcttgcctctcctcctcctcgtcgccatcgtcatcgccatcgtcgcggtctatatatggaggcgaggcgaggcgaggagatcggtgtcgtttgttgctgccagaaagaaagcccaagtctgagttggaacttacttggaagggagagtagtagaggttgcgtcctactgctacttcttcctcctcgatcttcctctacttgaggagagagagagagagagagagagagagagagagagagagagagagagttagttttgggtggatttgtgatggggtcgaacgagcagatccaccgggacaagctcatcatcgacacggatcccggcatcggtgagtcccttcctcttcctcttcctcatctcattgcgctcatactagtttcttcctgatttgatttcaattcttgtgtggaaacatctcctctcccaacgacaacaatggagtcatggggatagaaacgagaggccatagatagatagatagatggataagatgaggagagcgaaaaaatttcaatctctttttggtatcttcccctcctgatcccctcctcctcacctcacctactcctccaagaaaggagaagagaggaaggacaaccaactgaaactctctctcacaccactcatgtggtgtggtggggttcctccttctcaatccgccgtttggacggatccccactatccggccttgtccatgaaaacgatggatggatcctgcatgcacaagcaccaaaaagttgcaatcctttagggaaaagttgcaatctttttttcttttcttttttttttttggcttaagcgactggtttgtggttttgtgcttagcgatgcgctagaaactggtaaattgaagagctgctgctgatagttcatgactattgtcgtaattatatcttattagcatcttcagtctaatggtaaagcacctagttagtgccaggactgtgtgctaatgcggccgacaagtgtcaacactacgccatgattcctctcaagtctcacctaggtgtcgttcgtgggggccacctcttcatactttaactacagtgaagaaccgttttgtttcctgatttttgcctagttgatggttaaaaaagagcagctttacgagtgtgtgtgtgtcacactttcaacattttagtgtaaattgagaagttacagattcccctttcacatacattcaccttttcctgatcgtgcaatagaaatgcatgacatctgatgcttgtgctagccaattccaattgaccttcttatgttcaaattctaaatgttctatttaaattggacgcaaaacaattcaaggttaaaagagagatagtttcactcctgttgcaaaactacatccacttcttgagagagagagagaccgatacggcacaaatactagacagataatttgaagaagattttgttgtgaatctattgcctcaaactatgtgctttctgatttctatgtcttcagaaaatacatctgaatttcaaccttctaggaaactacttcttgctaattcttttccttacaaactggttccagatgatagcatgacaatccttatggcgttcagagctccaactgtggagatcatagggctcacaaccatatttggcaacaccaccacaaagaatgcgactcagaatgcgctcttgctggtgagatttgagatggttgaatatcctttgttatgtttcttgctcttggcctcttgttaacagcggcatgtattgaaaatgacagtgtgagagagcaggacatcctgaggttccagtagcagagggcagcgcagagcctctcaaggtacgctggttcacgatatgcttatacagttatatgtaacaatgtaagacttagcgtgtacgacgagcaacatgaatcttgatacatgttctcccgcacaaaccgatcttcatggctgctttcaaatttgatggcttttccttcgtttatgcttgcttacattgtcaaatatcaattttaaatggctcttgagtgctgacttgattagcgtcaatcataaatgtgtagctaatgtgacatcttaaaaataagacgaaacagtcttcctagtttattggatgtacagggcacaaccttcttttttttttgcccgtgggagttaaggcttaatataatattcatttttctatttataatatagattgaacagtttacttttatttgcataagcatcaacattttatatgccaccgattcaattaagaccgcagacttccgatcatactacatttcctattcaattccagtcaacgccccatgcttatctggatgagcttgttaatgatgtgctcttgtactttagggaggagagccacgtgttgctgactttgttcatgggtctgatggcctggggaatttgtttcttcctgcacccactagtaagaaggttgatgaaaatgctgctgagttcatggttaataaggtctctcaatttcctggagaagtttctatactcgcattgggacccctgacaaacgtggcgctggtatgcttccatttacaggataaacctgtttagcatgttgctttatatgccgtgacagaggataagtctgtctgtgttctttcttaggccatcaaaagggacccttcctttgcaagtaaggtgaagaaaatagttgtactgggtggtgctttctttgcggctggaaatgtcagcccagctgctgaagcaaatgtaatgtcattattgcatattagactagtgcttgtacatggacagaaaaaatacattgacacaagtattaagttttcgctgcataactctgcagatatatggagatccagaagcagctgacatagtttttacctcaggagcagatgttgacgtggttggcattaacataacaactcaagtctgttttacaggtttgttccttgatagtgtcatttgcatggttcgagtccagctgtggggtcaattatattcatcaagtaaaatctgtttctttcagatgaggatctcctggagctaagaaactcaaaagggaagcatgcacagttcttatgtgacatgtgccagttctatagagactggcatgccgaatccgatggctttcatggtatatcgaaatcctctcgttttggtattattctgctagttaccattcaaactgaaatatactttagctgattatttctatgtgttcaggaattttcctccatgatcctgtgagcttcactgccctagttcaccctgagtacttcacgttcaagaagggtgttgtgagagtagaaacccagggcatttgcactggtcacactttaatggaccaaggattgaaaaagtatgatattgtacttatttctaagttaatcacaacatatttacctttctagcgtcatgacattttgacaagcacatctatcactgatatatggctactgtaattgttactgattgcttgttccaactatgacgcaggtggaattcagagaatccatggtctggctacaagccaatctcagttgcatggacagttgatgtgccaaatgttctcgcattcgtgaaggaactcctcatggctccatgagcgattttacgcctatttcttgtgcttttggatacacaagcaaatttgacaaatacagagttgtgattagatcctggaaaccggaagctttctattcccctatgaataagaagatatgttgttttgatttcttgagttcaagtctggtggctcaaaacaacctggttccacctaagaacagaataaggactggtttgttctgggctagtaggcatcagacctgaggaccaaaacaatctgttatcttattatatgtaataggaggattagaagtttgcttcctagctacaagcaaaatatatgtagtaaattgaaattctgcatacgaaagacagcattattacaaactgtttcagacatttgtgccacagatatacatttcaaattcggaaatcagtttgccactcgccgtgttactgtgtgctaattgtgtcacaactctctcggttgttggttgcgtttgctcagtaattgcttgaagctaaaaagtatagcagcaccacgcttgagtagagtaactttttgacttgatttcactacatggtgagagagatagcatactggtaaaaataattttcatcgtcagattgcagatgaaacccagagcacaagcaaggacaagtaaagctggtagtacatgacacaagcacaagcacacagtgtattattattgattaagatatggtgattcttctccgatacaagcattacttagtctagtagttgacatatattaaagattaattctttgagcaagcatgcatattcccatacaagctagtatcagcatacttaggtagattgctggcatttgtaacagggaggagcagagccagagtacaatacttaagtcttcttcatccagctgttatacatgatgatataatccatcatcatccatgtgtgttttacttgaggatgtacttgagcacaccgggtatatggatcctgtagaagtagtcctcccaatcgatggtctttgggtcgaagttgaacatttcatcgtcttgagggttcctgctcttccccatcctctgcctcagcctctccaagtttatgtcgtcgaagcttcatatataatccaagcatgcagtaatgattacttgttagtagtaatgtacaggtatttgtatatacgtgtataaaagtagagaaatacgtaggtagtacgtaccatcctttgaagaaggcgaaggggccgtagacgtcgacgaggtgcatgacgtagcggtactggcgggcgaggttagagtagaggcgggagaagaggccacaaaggaggaggttcaccaggtggaggatctccaatggcagcctgtacttcaccagcatgtacacctgcaaaaatcaataccaacttgtaattcttttctatcttttggatctgtttgatcgtgtgcatcgtaattatacagacattaaaatgtttatcgtaattgtatcatcttgacaacacacttcaatgaaaagcttctactccgtcagtttcatatcctttgattttttttattcaaattttttttaactttaactaaatttacagagaaacatgtagtagtattcctcacacaaaacaaatatattatgataatataatcaatgtttacatttaatcgaactaatttggtatcgtagatattgctattttccgataaacttaatcaaactaacaaaaattaactaagaaaaaggccaaagcgacttataatctatagaagagaaataccattaaaaaataaccttgtaattcttttggatcgatctgtgtgtttggtaatgtgcattttaattatatatcatcttgtcgtaatagactgaattcagtaacaaactttcattattaaaaaataaaaaaaaaagaagagtaaattaattaacctggaagctggcgatggtcttgaagaagtgcatctccttggtggggatgacctcgccgcgcttcccaaccctcggcttctccgtgaagtgccgccgcccggcctcgtacagcaccgagtacgccgccgggttccgcagcgacgagctcacgtggtacaccgccggccgctcctgcccggcctcgccggagtgcgccaccgccgccgccatcatcgcgttcaccaccatgtcccccgggatgacgtccatcaccaggtccaggtcgcccaggaagcacgacaggttctgcttcgcgtacccgatgatgagcgtgtcgatcgtccgcgtcccctgcatccaccccggcaccgggtcccgctggatgctcgtgatgatgctcggccgcaccaccaccacgccgccggcgccggtgatcgccggcgccggcgacgagctttgcagcagcatcctggacagcaccatctcgcccatggccttggtgaagacgtaggtgttggaccacccgaagtggcgcgccctggcgagccccagctccttcatcgccttcctccgcgccttgtcgtcgtcgtcttcaacctcccgacgcacgtcggccaccagccgaagctccgcgtccacgtccaggtgcatcccctctcgcagcgcccacccctcctcgaacgccctctcctggattagcccctcctgctcgccgcccgcgtaagctgcatgcaattaacttcaatttaattactaactgcatctatatatatatcgatcgagcttaattaatcagctgatcgatcagtggtgcagtgatcgagtgacttgactgaccagtggagacatggaggaagaccttgaggcccctgcatttcttggccaattggcacagatgcttcactcccagcacattcacatccagcgacacatcatacctgcatgatcatttcatcatttgcaaggcaattccattccattccatttcatcaattaatatataactgaattgaatggatttgtactatatttgaatcgatagtaccgaccgacctgccgtagaagttggtggtggcagcgccattgacgatgacgtcgaggttgtcggcgaggtgttgaagcaacgggggatcgaggcccaggtcgtcgtagatgatgtcgccggcgagggcgaccaccttctcctcgatgaatcgcgagaatcccttgccgtgcttctccttcaccacgctgaacagctccgtctccgtcacctgcacagcacgcatatgttttcctttttcacattaattaatttattaatcgcatcattttaattaatttcctagtgcgtctataagttaatctgcggcatgtagtttcgcagctactagctgtaaccagtagtacaagtgtgcagttatggtagtactaattaactattctttctaggacgtaagtatagtatcgtagagctaatacacagtgcatctgtgcatgcctcctcctgttaaacatgttgtcagtgtcaacatgcatgcaggcctcatgcctgtactcatggcaacaaacacacgatatttttcatttctttttactataatgtaccgggccttgtcagtaaatgttactggcagtagtggagtactaatttccggcgacagatatcggactcgtcttttcgcttatagttatatttattagttaaaatttaaatttttaatttttaagtttattttgtattttttattaaagtttatttttcagcctttacttttagaccaataagaacatataaaaaaaatattattcataaattattttttttataaatatgctgtttggctttttcccgaataagtaaaacgatagagccgtattttttttaagataatgagcagcttcgggcatgtgcattacaaggtgaatgcacaccgcaagtggggccttatatgtctgcatatgcagagtacagctagctctgcattgagtatttgagtaaagtgttgctgtgtaatggatggatagctggatatattggaccatacacatgaaaaatacagtatactagtaatgtgcattattatgcacggtgcaggttgcagcaggatagtacgcacatgctgcagtgaaattatttaagcaaggaatgaattcgactgcaggcaacaagcaataaccaaccatgcatggatatatatcgatcagaacagcatatgcatatgcatgtactatgtgcagctataggtagattacatatcacagtcttgggcgtggattaatttttagttcacgaaaagaaaatttttaggtgtgatattgaacgtttgactggatatcggaagaggttttctgacataaataaaaaaactaattttataactcacctggaaaccgtgagacaaatttattaaacataattaatccgtcattagtacatataggttactgcagcaattatagttaatcatagtctaattaggctcaaaagattcgtctcacgatttcatgtaaactgtgtaaataatttttttatctatatttaatactctacatatgtatgtgtccaatgatttgacgtgatgtttttgaaaaaaaaattaaggactaaacaatgtttcgatcgagaggaaaaaaaaatcgtgggatcgaagagatgaggcaacagctgcaacagcaaacctgccgcatgggccatcacctcattattactactgcataccttactgcttgacactgttaattggtgtgaattcatttttgactatcatttttttaaagaattacaatattgtctttatgaacataactagtatagttatatttagcataaaaagtaagtagtacttaaataacgaacctgtttagattgatgttattttaaactgtatcattgtttgataaaattgataaatatatggtatttagtttattacctagagaattccggcaacaccacatttagtctatcctattaaaaaggcaatatatgctgtcaacttactcaaaattttttagcatagcaaaaatttgaaaatgttcattttagcagtattctgaccatactcaataaattaattttaaaagatttttattcgtttggacgcccacgcctcatcatatgctagcttccaactaataatgcctacattctgctccatctgaaccatcgatcccttctacggatggctcagatcagacaaacttagaccaacctaagattcgtactagtcagaagttaatttttttaagacttcaccgtatgtcactgggatatgatgctctgcttggtagctctacactgatacacacgtcgaactgtttttcattgcggtaaattatcaacattcccatccttgcactctgtcacaactatacccgacactgttatttttcgaggaataaaataacaggataactataatgatttttaaaattcaattatatttatttatgttttccaagcttttaaattgtattttctaaattatatttatttcaaggaatgaaatgacttagtaaatatacgcttcccgagcttctaaatggtagtgtaaactttgttataaatgaatttaaatttgatttgcaattttataatatttaattaatttatttttaccatcgaatgatattatcacgaatcatcaacctattcagcgtaaaaggacatggctgtcacctctcacatagtcacatatcgaatcaatcagtaggcatgagaaagctacacggtttccatgcatctatatattgctaataacgagctgaatttcagctatatatgtactagtactaatacatgtttatttatgttcaaaagattagtcatatcaacacaactatagtatgaattatatataccgttgtagtaacttgtaagttcagcggactacttgatcagagcgagtgcgtgatgactttctatttttctaacattttaacagtaaaattagtagatttgcaacgcagtaggtgagcttattacctactgcttgtaagtgatagtgattggatgtgtcgaggagtacaagataagaagaccatgcagacaagttggtttcttggcagaccggcgaaaaatacagtaacaggccaaccaacacatattattttaacttacagaaactgatggagcaagaaaaaaattgacagcaccaactagccaatcaactgcagccatgtacgtattttaatactaggtgatatacgtctccttttaaattctacctccatttattttcaacagatgacacagttgaccatttttaagtttatttgactattggtccattctacaattaatatttatacaaatagatattatgtatacttaaaatacttttgatgacagatacagtggtactcttttcactttaattgactaaataaatgaatagtattgttagtcgaagtttgaggaaaaagtcagccgtatcatatattaaaaaacgaagataatacgaaattgattaagtacgtataaaaaaataggaagagatgcatggatggatgagatgaatcaacctcagattggacgcgttggtttgcagatgcttggtcgatggcgcgaacgagcaggtagatcttcttgacatcaggctgcaccctcagtatcttctccacaagaactgcactcatatgcagcagcagcagcaatgagctccatcagcaatgagcattcatatccagtccttgcaagaacaagaacaagaacaagaacaagaacaagatctagctagctagctagctactatatatatgcacacacaattaacgtactcttgccaagaaagccagttgctccagtgatgaggatgctcttgcccttgaagtactctatgatcctttctgcatccaacctatcagaagccatcattttaactaatcactgcagatagctagatcagctagcctctccttcctccactcctcctgtgtttagctagctatatggagtatatagcttaattagggatagagagatggcctgtgatatatgtgtgtgctgcttgctagctagctgctggcttatgaatgagaaggagcagcagcaaagctaagctaagctaagcaagcacctgtgactgtgagtgaggcacgcaagagggaggctcatgtgcagatatatataggcaattagataggcaaatcgatctcttgttgcttccaatataagctggaccaattcggtcaaaaaataagtaataaaaaaggagcaggattatcgatcactagtgcttgatcagacgatcacctaacatcctgctaggcgtgtcagagtattactggatcatctgtgcatgtgtgcccggaattactgaagagttaatgcagcaggagggagatagcgctgtccatatgcacagctgcagccgaagggagagttaaatggttcatcagtacacactcctgaaatacgactctctttttttcattaaaaagaaaaaagcctcaataaaatggttggtctttcacatgcggagtagcttctatggatcggtttttaacccgttctttaagacccctgccccatagaacaagaacctacccatagataagaacctacccatagatcgattcttaacatatatttttacgggagtcaacaagtaactttattttttaacttaggtctgaaatttgctcccgcgaggagtgcatcgaggatctagggatgatatttaagcattttaaccgctagattacaagtactttcgctccactgctaaattacatcacatagataactaatatcaatttttaatttgagaaaaaaaatggttacttaattacttcagtatccatcatatataccaaaattcaccggtatgagtttgataaatactaccgttgtcctaaaatgaaactttttctagttaggctgtgtttagttcacactaaaattgaaagtttggttaaaattggaataatgtgacggaaaagttggaaatctgtgtgtacgaaaattttgatgtgatggaaaagttgaaagtttgaagaattattttgaaactaatcacggcgttataaacttggataagttcctgtctatatttataaataaaaatgagtatctctagatttatagctagaaacgactttatttttggacggaggtatctttgggtgtgtttagttcacgttaaaattgaaaatttgattgaaattggaacgatgtgacggaaaagttggaagtttgtgtatgtaggaaagttttgatgtgatggtgttgacgagaaaatcgaacacaccagcctgggagatctgcttatctcctgtgcaggtccaaatcttgattagatgcgagcgtgccagtcagtttgatcctgcaactgacaagatatgcaaatagtagatcaaaacagccgatcggttgacaagccgatggagtagttctagccgatagccgataatagccgatgccgataccagccgatagcgatagggtttaagcaatcggctatatgtccaacgtagataatgatatgaaagcaatcggctgatgaggatgtaataaaataacaataatataatccgatagaaaccaatcggctagaaacaatatataataagcactgatctgaaggttaaagcatacatcggctggaggtccgatgtcattaaatccacaatattagattaaacaatgaaatctatgttgcgatcggctaaatctaacttatatgtatatgcaatccttatgagccgatgcaacgtccagataactcatcggctgaaaccccgatgaaacccttattggcagtcaaaaagcaagctagagattatggttctaagcatgacttagtagatcaaacttaactgatgcagcactaagtatgaaaagaaacacaatatctagacaatcaagccgttgactgattttcagggtggtagatgtctaggctaatctaatatagcaaggcgatttagccgataccggcagaaaccctaaaacgagagacagccgatagagctaaattgagatgctaggactagattaacatagacatatgataaatagccaggcaaatatattatccaaaccagagtaattcagaggtcgaatgtactgatgcagtcttgaacgacgccgacgtagacgatacaattgcctagaccgacggaacattggacttatcccttcgccgaagatcgaacaccgatgcagccccgcgtcaagtgccaagtcccgccggacgataaaataaagtagaaaatgtaaaaggtggcgatacgccgaattgtattgatcgtggagatagattacatagaccttgggtgtacatatttatatccatgggttgatacaagtccttgtcggacaagaaagaaactaacctaaagataaaaggaaaacataaagtccttatcggacactaaacacaccttcctaaagataaaaggaaactaacaaactattcctaattaatagataaactgccatgtcgcatcctctttaaactcggtcacttcgggataagcttcctttagtagattgatttccttaaccgaatatagcaggaatccgactattggcgacttgataactcccatcggctgattccgaaatgctgcagccgataatgattataagctgatgacgtctttgccgattaccaaatttcactgttaacagatggacaagttgaaagtttgaagaattattttggaactaaacacggcgttataaacttggataagttcctgtctatatttataaataaaaatgactatttctatatttatagctagaaacgactttatttttagacggaggtatctttgggtgtgtttagttcacgtcaaaattggaagtttgattgaaataggaacgatgtgacggaaaagttagaagtttgtgtgtgtagaaaagttttaatatgataaaaaagtttaaagtttaaagaaaaaattaggaactaaaccaggcctttgttattttttttttcgccggtcggcggcgtaggaaaaccccgaccaattatattaagaaaatgaggagatgttacataaaacaaccaacatgtttgttgtgaacacatcccaatcctagaacaaggaaaggtttttgccggcaaacgcctaactacatgtatacatggattttatatctcttcaatcgtgatgcctccaaagccagcagctcaccatgcccaccattcttcagaaatgcactaggagacctcggcgacggtctgactgactccttcaaatatcctgccatttctctccttccaaatcatccaagtaatcaagatgtttgtgtatatctttgttatctaaaatatgttgtttgtgtgtatcttctttctattggttgtgaatttctgattggtcaggaaaatcactgttttgcaataagatgaaaccatgaatgccgccagaggaccacattcacatgagcactgcagtcttgcctcctcctgctgctgctgcaatttgcaatgctgtatgtatgtagttgcaacgaaatgatcaaatcttaaccactgcagcaaacaaattaatcacaacgtcttcaatttaacaaaaggagtatgggccaactgaccagttcatacataatggtgctttccattgattctgatctctcagctgcctgccttaatctgcagttgacttcagtccaaccacactgtgttcgacttaactcgagcactttcgggaaggatcatttaatcttattgtacgtgctgcattcttccttcaaggcaatggattaattgaccactgtgttattatctgatttttgtccccactaataatcagaagaacaaaataacgacaaacaaaaggtatctgttacacctacctaatcaaacaaatgtaattctagaacttgttcatttgactagtttgaagttccgtatccgtatatccggattatccgcttcgaactgtatccgtggtttctttttctttgaagcgaacggaaactatccgctctgtttgcttctctagtttgagctatactagctaacaaaagcctggtttagttcccaactttttcttccaacttccaactttttcatcacatcagaactttcccacacacacaaactttcaacttttatgtcacatcgtttcaatttcaatcaaactttcaattttgggcccagcgaaaactttttttgtccagtgaaaactctcaattttggcgtgaactaaacacacccaaaaatggattcggaattcagtatctgcatgtagtactccctattaggacacagaacagtaagtggtaagaatgcatgtagtgatcaatgaacagcagcgtgattactccctactatgtcttgcttatatgataagcaaaattatttgacacatgctaatatgctattcaccctgctgctggttgctggcatgcatgccacagtaacaaagttgggctggattgatcggtaagcagcataaattaaaaaccaagtatatccatgggcaatgccattgggtagattggtgttgtgatatgttctacattaattatttaccatacttgggaggctcataaaattgtccagcattcagcaccctaaaggagaagtgaacactaaactgaacagggctggtactgaaaaactttacccgaccaacaaataatggcaaatcaacatatagctgttcaaccttcagtgtggaatatctatagttaattgatccatatgtaacaatcagttatgggtgtagcatatgcatttctgcacaatgagctaggtaaaccaaaatcatctttttatttggagcttcagttcagagttgggccatgcattatgaaaaacagagttcagagttgatcttaactgaacatggccaatcatgcaaaactgcatttccctcttgctatgttcctggtatttcctgtcacaaggcaggcaggaaatcaggaatgtatccctgggatcatgaaatttcagatagtataacggatcttgaggagtgcacatcgaaagctactgctagggttggtaaagtacaagaggaagaaggtgcagctctttgaatgcctcttgttgttgcccttgccattcttccactcctcatcactgaattcacaacttactattgctatgtcctttttatactactgataattgatctttacactgctttatccatcggtcctgtaataatcttgttcatcatcttaccagcacgatcaccaccgttctatctatctgttggctgcttggcataattctatttgcatttggtgagtagtagagtttaagttgtactgctactcaacaaggctgcaaaagaagaagacagagaatgtatgacaaagggtgttgttgtcaatgagtgattgcacgaaaccaagcatgtcgacacttgcgagcagcagctggattagctaacaacaagaggcagattggttacaacagcagaccctttttcttgatttcagcactggagactgatagttccatcagtaccactcaagaaactttagccaccaactgcatttcatgcatgttggatgtctgcatggatcacatcatcaaaaagattgaatgagtatgttagattgatactaccagtgcaattctgaagatactgttgtagcaagccccagtgtgtggtgccagtgaagcagcagcagcagcaagtaagacggcatgagatgcaaatgctgctagacctactcggcgtgccttgcatttattggcattattaggccggcaggggaaacagatttcctgaaaaataacaaccgcctgccaacaatgtgcatccaacttgcgctcctttagcttcaacattacagtaccatctttttttctttctcgagacatgtatatagcattgcgattcaaggggtgccattggctgtcagttttcacctctctctgcttttcttcctacctactcccctccattaaaaaaaacacttgatttcaggttcaaaatttatccaaaagacaatcgattcctatcatcttatatctatccttaatcgaagttttatcccttcaatacctcttacttaccagagagactatggtatttcccccttactagtaaattttcttaggatgactgaaaatataaatcttttcaggtcaaagggaggagaaaaataacataattccacttaccgggaccctgtttggaacacaagaattttgaaggaatcacgtgcaaattccgacggtaaatgtaaagacaaaaaaaaaatctgaggtccaagaagggaaacaatttgttgtaatcgcctccaaatttagacgtataataataataaatgaaatgatttattccatgacagtagctagcccaacgctattatacatttattctcctaagtaggaacaatgtacgagtatttaggaccacttttcctaagtctagtagtattatagtacatgtatgatgaacgagtccacctaagcttaggtatagccatcaacaagggccagttccaactgttcaagtggcacaatgcatgtgaccttgatttattgctgttctcaatgcctcagcagtgcagcaattgccttaaaataaattcagtgttgtgtgcagctaaacctgaatctgttgtacattgcagggagtaacatgttgatgttggccagctaatgcagaaatgctaccaaacctacaggttccgttcatttgggttcataacaacggacacaactcacccatttttcacctaaactccccagaaccagttgcaaatttgcatgcagtgtttcaggataaatttctggagtagcttgcatcaaccacaagagatataggatatggaaaatcataccagatgatggaaaggctggattgtagatgtgttcttgactgttctggtgcatgtcaatccaaaaataattcaacttgacctgagcaagatgataaacaaggcacggttcacattcatcccacaacacatggtttcaaacagcaattatatcgatattaagtatcgctttgttctcaacaacataccacaagccgccctaatcaaccagcaaaatgcaattttcgcgaaattgcacagctgttgcatttctaaacgaccgaaaaaaactatagctgagacaccagataacaacagatactacaaattgctggaaacggttgtccccatcacagaaactgagagcgactactcagtaatgaaggtgccaaagctagatcagcttgttgctaaacagctacagacatcccagaaacaaatgactccaagataaaagctaaacgagcatgttctacaactccaaaggcacagtagttgtgtaaacatgcagctccactgtcgcgccagtttaatgtttagggtaacaagcttggatttgctgctccagctgcattggaaagcaaaataacagatcagttctataaatggttaaggtaaatttgcatcgtcaggtcataagactagtaagatttgacagcccaagaaatcgaaaaatgcaagccagaattaaatgaccattttccattcagaaatgagaaagggccaaactggggaggtaaaagatcaggtctacccatattatgagaagaaaaatacaagttggggaccaaacaactctaggcctcttggaattatcccatagatatatccacacgcaaggatgggataaaataaaatagttataagacaaacaaggtttttgagtgcgatatctgtaagtcataattattaccacaccaagtggtaccacgtaaaggcttaagtacaaatgtagcactggaaatgacaaagaaaaaaaaccaactttgtaaagaaataaatataccatgttcatcttctgccaactgccattatctcgcatgctatttaatgcttcacagcaactataccactgtactacctcatatatgtgtcatgaaaagactaatgctattcattcagcaaacagactaatcattgttgattgtttttgtgtgttgcacggaaagtaacagtattaattccatcatatccaaccatctctacaatttaatgttccaatcataaagcaaaccttacaaatcacttccaaaccttacacaaaatcacttacttttaagatgtccactccaactcagtgcaacacaacagggagtataggatgtaatttgggaacgcaaggtaatacctgaagcatagcctgaaacttgttacgaagatcatagaattcagtcctcaccaaatccaaagtcttgaggcacctgataatggaaaaggcccaacacaaagaaggggacaattgtcacaaaaataacatattttattttaggctattacataaatgaagatataaagatcaatataatgtagatttagggccgttttggtttgaggccaattcctgccctaccaagtatttggtagccttgaatagtagtacttggtagccatttggattggaaccaacttttgctaaatctatggagttgagataaatctaccctaccaaaaaaattgtagtgccaaaacttgcccaagaattggcactacaaatattttggtaggatttcaaaccaaaatgaccctactttactgaatagctgcacaacatacagagaggatggaacaacttggttccactacaaatatgcatgctaaaatatttgggggcatattggacaacctgcaaaacgcaagagttatccgtcatgttgcaaccaccccaatgaccctactagcaaaaatcaaagaagaagcctcagcctgggtaaaggcaggtgcggtcaagcttaaggagataaaaccctgggaataatcgactagcagagtgtagtgttttttgggctggtgcgcgagcatcacatcccctgtttttccctttcccttttgtaaatgttttttgtcatggcccttctgctttattaatacataagtggcaaagcttttgccctttcttcaaaaaagaaaaaaatactgaaaaatctaccagttctgtataagaatcaaactatttcatttcaaatcaaggcatgcctgccatagagtttacattagtcacaccttttaaagtgattctattatcttggaaattggagtggagcaattacaatcctaagtcaacaggcagagtagaatcagccagttgttgctttccatgaagatatgttacaatagaaaaaataatgcaagaaattacgtcaacattataccacagaaaacactaacaataggaaaatgtaagaaaagagtgcactagatcatcgttaagatatgcatataacgatatgtgcaataatatgataaaaaaatgggaatactgtattaataggtactaacccatctctgctcctctgttggcaaaactcacggaactgaatgcaagtgttcttcactttctgagcaccaacactgcaaacatgcaaggatatacagtcaggaaggctcctcaaatgctttaatggaaagacgagcaacaaatttgattatatcttcaacaatgcaatattatcattgacctactagaaattctgggacgatgatattactatcagatttgcatgtttttattgatcatttccgtctggcttgtgagttgcctactatcaacaagatttaatatttgtagtgatgtgtatgaatgccaattggtagttccagttctaaatatataaggagatctaacatgaagaaccatggtgagttattttcatacataatttgattctgtagaataacactccagtacataaatatacctgaacccaaattgaataggcgaaaggatttgtttgtcaatttcttatttaaatttctgtttcaagaaaaaaaatctaatctggataaactccagacaacctgtttgaataggttcagtgtacccttacaaaatgtaccttaaaacatcattctgaggatatactgataaagagcaggattaaattctaggtactattaagatctggagcaagaagaaaatttgatagcacctgcagatatgaccaagtaaggagatctccaaaattcagtaaacaaatctcaaatggaaacatttttcttttgtagccatcaggaagatatcttcgggtatagggaaattagggatctcgaggaaggaaggtgtaaaggtacaaaaccatgactacaccaaaaggaaaaaaaaaaaaggcatttaaacaggaattttacatgctgtgtcatcctactactgtttgtgcatatggtgcatagaagctctgaaggaccatccatggtgaagtagtttatggtctatacacttaggaataccattagacccttctctcactaatctatgatatattctctagcagtctaccttttaatgaccaactaatctaaaatgtgataacactccgggtttgaaaaataacaaaaaatagaattctaagtaaaattagatacaatattcgtaaatatgaagcatttcaaactataggactctcacgtgtaaaccaagtcattttggaatggaggaaagttcttcgaaccattcaataagtgtgatggaacagaagcatgttttcagatctatgtcaaggaatgctggaacaatgaagcatatgacaatcctccttgaatagatctggagcaccacaaggaacaggagaatatgaatgctactatttgaaccgtctgatcaacatgggagcgggactgaatttgtcatatctacatgatagaatgatacagctatcaaacggacgacaacccatcccaaattgctcagaagggcaattcatatgatagaacaatgtgaaccgctgctcttcgaactgtccaatcactttgggtggaatggaccatttttgtcagattctacgccataaaagatgcaataatcaaacatatgacaatcctcccaaagttgactacatgcttcgcacaacgctttaaattctcccattcgaaagggatctcatacccaatttcgtgcgccaagtgacaataacagcaataattatccataacaacataaatttccatatccagaaaaggacaggggaaaagctcaccttgcgctgctccccttgagctgatgcacatacgagtccaccctgtcaaaatccacatttggcttctccctgcacacacacacacacacacacacacacacacacacacacacacacacacacacacacacacacgcagcaatcaaatctcccaaaccaaaatcaagccaatccccaacacgaacacgaacgatccgatcaaaagcaagcgaaacagttacacgcacagctgcctggagagctcgcagatgatccgctcgccgtcgtcgcagaagagcgtgacgacctcggagacgaagtccggcgcggtggagtcctgcagcatctgcagctgctggaactggtcgtccagcaaaccctaactccccaatacacacaatccaacaataacatcacacatggaaccccaaaaaaatctcgtcatccacacccggaattccgccaaaaatggcgcaaaaaattcgtaaaaagagcgtgtgaagcgcctcactcaccatggcgaacatgttgttgacgagggcgttgagctggctggtcagcgcggcggccgccatggcaagcagcagcggcgagctcctcactccgatcgggaatcggcggggcgagcaagcgagagagcgagagagatggatggaatggaagcgtggggattgggaatcggagcgatgcgacgggtgtgatttatatggggaggagtgggcattggattcccaaaggcaagttttaattttcttttgtgctgttgtgagctgctcttggaatttaattttaatttctacttaatttgaattgatgagcatgagctggagttggaacaataatcgcataaatttggttagattttatttccccagccctttcctataaaggaatgagcccttggtataggaatgattaaatgtgtatatttatttcatgtttaatgccggtataattcgtgtatatctgttcattactgcgatcacacagctatgtgtatgaagtaaattaaggtgatattaaaaaactactacaagtaacaagacacccaaagctgcctttttagttgactttagttcatctcaagcaacagcttggaggttttattgcataattaaaaagtaacaagtggcattttcacttgaaaaaatgtgccaaatctttacaattcgtataatttatgtaattacaaataacaagaaaaatagtagactttacaaattgcaagaaaaatagtagactactctgtcagtctcaaaaacataaatacttgagatttttacggatattaaagagatagtaaaattaaataagggattgttgtcactggttgagataagtaaaataggtgaaaaaaagtgatagatgattgtgtctggttgaggtgaaaaaaagttgctatgccttagcacaaattttaaattgtagaagttttaggaggggtgccaattaaggaactgtataacatcatgtgcactgcagtttagtgaatcgaagagcaaacatgagtgatgttgaagcagcaatctagttggtggatactataccaattagttaaggaactataacatcatgtgagtaccaattattttaccagaatctaacaatatcctatgattgcaaatgcaatgtccacgggtcgtacaatcctagatattcttatgcgtgctaccctgaattgtaaattctagcaataacgtaactataaatattcaaacttactagtaataatccataactccatatatgttttgcggtttagtgcattattgcaaatcaataacaaaagagaagaagcgagtactgataattagcaagctcgtaggtttaactatctgttgctgttagtaaaatccaataatatcccaacaacgtaaatgttatgccaaaggggctgtacaatcccatatattaatattttgtctatgacaattataagttcctacaaaaattataaatcccgatagcaacacaccgcgatagatatgtagaattttagagtgttcaagttaaaatgaattcgtttcgtactaactcaaactcaccaaattaaggcccagtgtaaaataggttattaaccaaaattattgtagtggattatctatacaaattatgaatcaaatatttttgaagtatggagcaaataatccataataagggtttattgatagagctttagctctcacactattctgaagcagaagcccgaccaaacagtttcagcttcaccaaaaatgagaatggagctggatgaactagggaggtggagctagatttagactgctccacaactccactccaaacacggctcttgaagttaaatttaagagttagagtccctaccaaacatgctctaattgagtagctaaaaagaagatggcctaaaactgttctgatttcatttgtcaaatcttcttaagtaactagcaaagaacagcctaatccgtgataaaaaaaaaagaaacacagacgatacacaggtttttttaaaaagaaaacaaccaatcacagaagctacagagtacagacattattgggacctcgccacagtgactacatcacaaattcacaatgagaacaaaacaaatcctccatatataggatcggagctaacaaaatcactacgaagctcagaatcgaaaagatggcagcatcacagcgtccacaaaatgaaatgcgtgtgcatagagaggttcagactttggcagcgaagtcgagtccttccttcttgagagcctcgacgtcggccaccggcggctgagctctggcgaccttggcaatgacctgattctcctccgccgagccgccctcgaggaagacgccgacgaccttgccgtccttgatccagtacgagccgaacttgggcttggccgccgtggggtcgttgtcgccgaacagcacatcctcgccgacgttgtcgccgtagaactgccacgagaggtcgaacgaccgggagtagaagtagggcaggtagtcgtactccggcaccgactcgccggcctccttcgccttgatcgcctgcaagttcattgaagccagtgaatttggttatcacaaagaacttctgaatcctgatcaatggcggcaacgaggatgaagaatcaagaacgaacggatggctcaccttcacggcctgctcggctgatttgcgagcatggtcaacatgctctactctcctaatctcattgtatagcttcatcgggaaggcggccacgtcggcaatggcgtatacaccaggaacgctcgtttcgaagaatgcatcagtctggaagacacatgcagatttgaaatgttcagctaattcgaaggtataagcaagaacaagctcgaaagaaggttcagttgctaattagggtgactcaaatggacaatagcctgaaatacaatcatcacgcaacaaatgtagcagatagagcagaatctgaaagatgaacagaaaccggacaaaccttgattccacccttctcctctgcaacttgacccttgaagagatgagtcagtggcctgccaccgacaccgacaataacaatgtcagcttccagcacgtttccattctttagcttcaccgcagtaacctgccaacagaaaaaaaaaattaacaaggtgaacatttgccttcacagcaagatgatactggactaagtggtaactacagagtgctcacatctccattggcatcagcatcaaaaccaacagccacggttccctttatgatatggattcctttgttagcgtagtatccctcgtagaaagcagcaaggccagaagtgaagagacggggcactacaacagatggcatctccaatatgagatttcattggccaaatacgttacaactataaagatgagaggtatttgtttccttgctgttgagtattcagaaaacacaatttatagtagtaaatctttctggatgcaaagaataaggagacttactgcaccaaggttcagggtacaccatagtgacatcaaaattgttggtcttcaaggctgcgctaagctcaagtcctatgtagccacctccgacaatcacagcctttccatccttcttggcttgcatagccgcgaccaacttgtcagcgtcctcaatatccctcaggtacaatatgtcgttggcctctgctccttgaacaccaaagtcagtgagctttatgacctgatcaagcagacagatgttcatgacatgagcaacatcttaatacaaaaatgcgcgtctcgcgtattcccaaaaaaatgacatgagcaacatagctctggaaaaaccgatatgaataaacaaacattacaagttcacaaccaaaatttactaaaaagaacaccattcctcttttctttgtgggttaaagcttaaaggtacagttgagaactcaccgaggagccagtggcaatgagcaaagtgtcataggtaaaggttgcatcagctgaactggtcaatgtcttggaggcaagatcagccttgacaatttcggtgctcaggatcagctcgatacctgcaacattacaaatggaaacaccgtatactctctcattcagtttgccatcaatctgtcagaaagactgcggtattcagaaaatggtgacttttagcaattttatttatagaggaatatttttggccatttaaattagctggcattcctttgtttactcgaaaaggatcagagatcagaggatagaattaatgaaacgacacttgagttataaaatactactactggtacttttcaagttttttgaaggtttggttagcttccaagttagtactactggcagtctggcactgaaagcctgtgaattaatgtacggcaacgggtttgtgaagtgaccagaagaactcatggataaccatttcaatttgcaatcaacaaagtactctggcatgaagatcgaacagcaactgcagattgcaaattatatggaaaagaaaagagaaaaaaaagcagtaattgtacctttctcggaataccattcaggcaagagcctctctccgccgctcccgacgcaggtgtggaatcccggaagtctggctgcatctgtagagagaaagatggatcggaatgaatcagcagcaagaaatggaagagagtaattagtagtatgttgagaaaataaaataaatatgcagggcaggggaggggaggggagggcgtgacgtactctgaggaaagaggtatcccttgctgagagcaggacgctcgtagggagccacctgcagcagaaacacgaagaggaaaaaaaataattaggaattactagtccagtattcattcaggaaggaatcgatggatggatggatggatggatggtttaccgattccttggagatgatggcgagttccccgggcttgacgccctgcttggcgaactcccgcgcagcgtatccctgcacaaatcaaaatgaaaatgagttcatcgatcgtgtgagtgagatgatgtgatggccatgagaaggcaagcgcgtattgaagagagtagaggaggagggtggcgatgttaccgcggcgacgcctccgccgaggatgacgtaggtgaagtgcttcgcggccgccatgtcggagtcggagtgggacaagaggagggagacgacgatggaggggaaggaggacaggtgtggtggtgggagcaagggaggaaagcgcgcggcggaggcccggctctctcgctcgcttgctttttatacgaccgaaccgacgatggagtgacgaggcattagctcgatcgatcggaggaaggaaaggtttgctgcttccgtctcgtttcctctctctccgttcgtttcccccaccaaaccaactaattttggcgcccacgcggcgcgctcttgttcgtcaaacagcgagaggggcgagggcggctagtctcgccggcctagtcgcatagtacataccggatctacgacccagttgaccgttctcacccccacccgggaaaaaagggcaacaacgaatgcgcacacgccattgctgacgcccgttaattagagcacgattgatcaattattaatactccttcattgcaaaatactatagtaagataaaacacaatctgaaactatgaatgtgaacataagtacattcagattcgtgatcttaagtagtggtgtatttagtcttaggttgtttcattttagaacggaaggagtaaatattacaaactatcccaaaagttatcaaaggttaacatttatgcttgctaattactagtcctcctttcgctttcaacaccacggggacaaccaacgctactctactcctttcattttctaacgcaacgtcacagccaacactaacctccttgtgcaacactattacaataattgtagtacgatcttaacctcagtggacagacagcgtcagatgggaacacctagtagatgctcaggatgcctaacctcctctccgtgtccaggttcacgatgcacatgccccaccactgcagcaacaattctttaacccaattccagcacgcaccggccggccaaacaaacacgggattgggattcccccttccttgtctgtttacacgggcatcatcaccatgtcaacatcacaacgtcgaccgactcatcggttaatcaagactaccgaaaaaaagttagccggcgccaaaacatgacgcccgcgaaaagccatcgttctacacggcagctaaatgacggttactcagctcagtctaattggtatcagcattcagtggctagtcaaaataaaacttacgcccttacacccatgcatggaaaaatcgtccatgtatcctcatctaactggctcgttacattttttccattgttaaattgcaataccaatcccgtgtacagcaaaaatgttacagtcccattgcccttgggttatggatgggaaagctagttaaaactcggaacacatacctcatcaaaggcagtgctttctaataatatggtgctgcctctgggttgaggtttgaaggaccaactcgatgcaccacagcagcacataaagttcagaacatttgtctttcacaggcttgcaaagggtggaagaacctcatgcgtacaatgtcaaacctgcagaaggcacacgaaatgaccacatgagagcactggtgatacaagaaatggaaccgttctccatacagtcaacatgaaactggtgataaagaaatggaaccgttcttcatacagtccacatgaaaaagagagagagagagagagagagagagagagagagagagaacaatcccatggcaaacaggggataacacaaggtaataataaagagcaccactggtcactggatgcttggttttcctacaggttgtctagcaaagatgacctcctaaagtaaatttagaagtatttaggtctaacccaacaaaccattatgaaattagctttgataaccacataagtaaagcaggctatattcttaatgttgttgcaactggcagtattatcttaatgtatgtactatattctttccatccacaaatataatcacttctaggattttaacagaaaataaggtttaggtgaaattaatttgatgcccctgggactctacttgatagggaaaataccatgcctagaaatacaactaagtgagcaataaatgcagcggtggttggattgggaaagtagtactccagaaatgtacaaatttcaaatgctagaaatgcttatatttgtggatggaggtagtaggtaactttagaaaagggaacaatttaaaaaaattaatgttcacaagacatctgtgccagttaaggattagtttgcattgtatgtattttgtaggaaaacaccaagcaaagtcacttgttcaagacaatccccaaaacaaaatgaattatgaggttagattatggtatcaagagcagaaaaactgaccaattgtttgagcttatgtctttggaactgtaacgttcaagatcttcacatcctgatatggtttgtcattcttgtcggtcttgaccttctcgatttgcttttaagtttaaaacaaaacatattaggaagcacaataaaggatatgaaaattcacacacagtcactaagttggtcaaaaaggctggtacctgaacaacatccatccctttcacaactctaccaaacactgtgtgtttgttgtctagccatggagttgccacagttgtgataaagaattgggacccattggtatttggtccagcattggccattgaaagagtaaaaggcctatcatgtctcaagctgcaagatagccgccatagctgtcagttgtcactataagcatattcaaataggattattcatatggattgtgttctcttcaacaacaataagcacagtgcatgcaaaatttacatgactatacagatatctttcctggaccttgcatagacatctgtcatctaaacggtacataagatgaaaaactgcattgttttctgcaaatgagaaaagaaaaacaggaaaaggcatacaacttatataccttttgtgaaattcatcttcgaactcccttccccagattgattgcccaccagtgccatcccccaaagggtctccagtctgaatcataaagcctttaatcacacgatgaaatatgagattatcataataaccattccggcaatgggtagtgaaattctccacagtttttggacactcttctggatataatctcaagtgaatatcacccatagaagtatgcatcacctgaaataggaaatactcatgtaaataaatgcgacctaaaaaggaaaaatgttcaaagactatcccaccaagatatcaaatttccataaaatcaatagtagcaaattaccatttttagaaatgattgagaaaacataccaaattatcagggagtgatgttgtagcagtcttccctaaatctgatacagccaaaagctcttccggtgggggtttttcattgaaaacatccctacccttggttgcgtcttcaggctcctcaggttctctacgactgtataatgaaaaaagaggattgagaagcgggatattaaaatttaagaaaaaccatctggagagaaaggagtctacagaagcagcatgcggaatcagccaatacgacctatccaaagatcattgaattgatgtacctaaagagatatattcgatgcttcttgaaggcacagcatagcagcgttgggtcagataaaggctccttgctgtcattgacattggcagctactgaaggaatttttctaaccttcttattccctttatcaccttggtatagagcaatcctcagaaaacgttcattgttttctaccttccccaggattcttgaaaccttatttgtgtgcaaatttataatctgcatatttatgggaaatcagaattaatcatacagaaatatgttcaacaatagcaacatgccagatatttacatgaactcaacagctagataggagcataatgaatacaaaacaagctgctagaaagctaatacaaaacatgctgtttaactagcagctgatccataagatggaattccacaaggacaaatattttcttgagcaacatttatcattccgaacataaaaaataattatataaataactgaagtacatataatgatatcaaacacatactacataaaagaaaagatgtgcagtaaaaaaatagcatacctttatgcccaaaagggtagcataaataagaaaattgctgctctcatcaaatacagcattaggctgtggaacattttcggtcttttctatttccttctcaacagccattcttcgcccaaaatcaatagcatcaagacgatacatcgggatatcacttttctgcagatcttgtgccacctataattgacagcattcagttggggattataacagaacatatttatctgtaccatgcattgtacagatggaatttcttacctcaagggactcatcatatacacgtcttagtttcccagttttgaaccaaaatacccgtatcctacgatcaggggatgtaacaacaaattgagtgccgtcattgctcatctggacaacacaagctcgtttatcagagtaatcctgtagctctatcaataatgaagcaacaaatgcaaataacttgagaatcaaatagaagaagtacctcaatagcagacacgctagtcttgcattttgcgatttcaaatagatttgtgtctgtttttaaacgaaagttcaccctgcacaaaaaacaaaagcaatatgcattgataagatgatggattgatgcattcaccaagagggacagaacagctgttagcacatataaatatagccattacaaaaggaaccaacccagagcttatacactgccagagtgacaggtgaaatgaaaaaacaatccataaatactaaagtaggataatatgttattataagaaacaaaagtgaatcagaaaagattttaagttaagtgcatcttcaccaaacataatagtacctaactttttttaaaaaaagctggttcgttgattaattagcacctaggattgttccagctgcagacttaacagaaaaggaaatggtaggtgtaatcatggctcaagtacttggtggttcagtgcaatgttttgggaagacaaaaccacaagctacacaaacgttgaaaataactccaagagagaaacaacatacgcgtcttctggaaatttgagggtagacggagaccagtattccaagagtcctttggcatcagcagatatcacaacatcgtgaacatggttatatttcataacctttactgggccagcatgaatctgcataaagaggcagctcatgcagtaagaatcatttagttactttaattcacaagaaatacacatcgacacacagaaagcaacaacagattacctctttggagatgatgggatcgtttgaaccagaatgagtatcatatatgtgaacaaaaggtgtattacgatcactaacagcgagttttggtttaacatctccttgtcgataaacccactcaattgcacccggaacgaatgggagacgcatcatgaacatcatgtcataattcacaacgtcatatatcttgacagaccaatcgctggagatcgtgcagcaaagtaggccatcaacactcacctgcattactgaatcacgctataatttgaggttgttcatagttccataggcaggagctgtgactaagagtagcaactagcaagataaatagactaatatatattgcgaatgcaaatgttttccctggattagggaagtcaatataagaatctgaacactcacagctaggccttcaatgggactgagatgagatcgaaaatgtttagcaaattcgatcccagctggtttcttcttccaaaatttcaaatgtcctgggtagagaggagaaaaggatggtaattaagctcccattacatgaaaatgaatcagcttattattgaatcataccacaggatttgatcaatccatagatctaaaagtttttcaaccaatactattacgcaagtctatcaagcccgtgattatggttcagtgaaggactatcccttatgtagaagggcttgacatttccacaagataccatccgaaatctaacacatgctgccacaagctaacaaactaccacaaaggcacaaaccactagtatcgcacactgaatacggtacgatgcagagacgtgagcgcgagagattaccatctgcgctcccggtgatgaagtagtcagcaggagagacggcgacgtgggtgacgacatcccgatgcatatagctcttctcgtacctgcaaaaccaagccacggccgtcagcctcccagccgacgcaccccctaccaaatccgaacctgaaacggcgaggagaacactcacatggccgcggagggcagggcgtcgaggaaggcctgctcgaactggagcgggcgcttcttcctcggccgcggcggcacgggagccgggccgatcatctcctcctcctcagccgccgcctccttccccacggcggcgggtgcggctgacacggcgccattgccgttgccctggtcgcgctccacctcggcgtcgtccgtggcggtcgttatcgtggagctcgccggcgcatcgctcgccgtcgccatctcgaggtggagctccgctagggttctggggatttgggggagagaagtctcgactcctcgagaccttctgctccggcgacgaggagcaattatttgtgttacgaaactaataatagggggtttccagaaaaacaagtccctactctccgcctcgattctagccgccaatggccgatctgacggacacagtgacacgggggattcaaatgaaaagtaaattcttctcttggggttttttacgcaaatgtttacaacagccagcccacaggccgtaacccacggcccatattaaaacggtccagtaggcccaacccagttagacgaattcctcaaccttatcgatatttttctctcctttttttttccgaggattattagggagttttcggattcaaaagctccagtacaccgaaccatctccgcttccgcggcgcgagccactcgtcgctcgaattgcccccatccacacagcttcccccgcgcacgcgagagggaggagctcgtggcgccggcggccatggccggagcagccgcggcgagctccgccgcctgctcatctccggctccgaacccgacaacgcgatacccggttaggaggcgcgtgccgcggcctccacttgtggcagccagtcgtcactgcaccgcttcaccttttcccactacaatctccatctccagctcgggtctcggccaggctcgtcctcgcgatccgtttctaaaccctcgccttcgatttgcggctgcggcggcggcggcggagggggagatggctgcggaggcgagcgccgcggcggcagagggggcgcaggcgaagcccttctccgtcctcttcgtctgtctcggtaaatcacaccaaccctagcttcttatcgtctcagcgatgggccatgaactgattggggaaccgcttgatagcgccactcgatttgataattgtccatgtggattgaagttgcctgtgattgcttcgtcccgctgattttgggtgcttctgcgactatcagccctagtgtgtccgcaccgtgcgtgcactaattcggggacggcattttatctctccaatttccccatcgcgtttgcctgatttctccattggagtttgtccgtgatagtattatgcacattgggaagtgtgggagtttttctggctgtacgtgatatggttatcaagttttacggatatgctcgcatgtgctagtattagtaagcaccaggatgggttctcacagtttttgttcagctcaattcggagattttggtcagttggaataccaaaatgcattctctcaagggttatgtgtgcactgtataagttgcaatttggtttagggactatctgctttcagttgttgcattattctgatcatttgattacgacaatctgttccgtgtagtgatatatagctcagacttcacagcttcaaatttctagttgcttggtttatcaggacgagctgtataattttgtgtcaggtgcttagtacatgtgaatttcgacatctttccatgtacaagcaatgtagtgtttgctttatcagcgtataagattgtgcgctaccttctttgacatgtttatttgtctgtgtacgtttgcatgttttcacgtgcattggtgcgtctccccctgtttttcagaaaaaggataaattcaccccactgccttatcttacctatgtgtattacagcctgaaacgtgtggtgtttgttgcctgtgttgatgtaaattgtgtatacaggcaacatctgtcggagccctgcagctgaggctgtgttccggaacctcgtgagcaagcgtgggcttgagtccaagtttctcatagactctgctggtacaattggttaccatgaggttgtattctgtaataccatgcttgtttgtacattgctctgttcagcgatgacatcatcattgatgaggtgttgcttggattcagggtaacaaggcagactcaaggatgagatcagcttcaaagaagaggggaattgaggtgacctccatatccaggcctgtcaaaccctccgacttccgagattttgatcttatccttgcaatggataggcagaattatggtactctctcaactcctctcatctgtgtttcggtacctcttttttttattatgttcagctgccttatgtgcttttatttggagcaatgtgcagaagacctactcagttcatttgagagatggagacacagggaacccctcccagacagtggacccaagaaggttagaatgttaatatgttataagagttcttgactcatttataacatgagattatttccccaagttctgtgtgaatttgctgagtccaattaattttccacaaaattcctgtattgcaaacattccattaatgttcatcctgcatatacttgtttgatcatttctatttttaattttgttgtcttaaccccagaacctgaggtcttacagagtttaggcatctatgggaacccaaacagcatgttatatgccgttatatgcacaatctgaagtatccacatttgctttctcctaatacatgttttcccctaaaataatcggtgatatgaccaattgaccatgccctttgtctttcaatatgacatggaaggtgaagaattaatatactgcaattattatttattcccctacttgattttctccaacattccttagcatgtttcacttacagtgaagtgcactttctaagtttgtttcgggcaaatgctgaatcatcaatttctacaaagtagtctcttgcattgctcttgctccagctgatgatggctactttgttctagcaacttgactgattcaccatatctacgagttagatttcttttaccagataggcagatactctcttatttctggtagaggggtgaccacatagctgcttgataatggatagtgtctggcctagcgtttattctctttctgacacccttatacaactttacagtagttagttatctcatactgcaatctggaagtccagttaagcccaaactcaaccaaaccaaaaaaaaaaaatggcaatccaaaaattagtcacccatttggtttgtggccaataaatgggcattgccaaaatatctggcttggttgaattgagtacattgccaaaatgcaacatgggtaggcaagcgaaacaaaagcccaatttttccaaaattttgacaatacctattcctgacattgccaaaaatttggcaaggctaagaatggataagaaccaacatgccatatggttaagcagttaagctgatgttggtattcatgcttgaaaactaacacatgaaatgttctttttacctttactaggttaagttgatgtgttcctattgcaagcgtcatactgagtcagaagtcccagatccgtattatggaggccctcaaggatttgaaaaggtgagatgatgaagtgcacgattgttttgaagtctgcaaattacatgttagatatgttccatttttctgactgaagttagatatgtttcattgtttgacccagtggggatgaacatgagcatccatgtgtgcatgacagcatgaaacaataaaataatgttttctgttcaagcatagtattttatgcatgaaagtgtacctccagtactgacctatgatcttcattagctctgcccaaagtctttgggcctgtttggttggtgccctcactagcatgcttgagaagcatagaagaagttgatgaaaattcttcagcaaggcttctaaaacatagtgtcaaatcgtagacaactttgagccttacttagtcctttgcacaataattaattgctctaaaattttcacctttgactatcaagatcataaacagaataacatagagtgtgatccgtgaagaaattttgaagtgatccttttttagatatatagatgaactcctgggtttaaggcattgttcaaagtaatcccaatggggtagtattagtagctaagtaatattatcagcaaaaatgaaagtcggatttatttaagtttttgccaatgttccttcatttccttcaaataagactgttgctgaatgcctgattaatattctttcatgcatttgacttaatatggttcttcctcaaaaccattaagtgtactcatagttccttacgtgcaagcaacgatgatgttgtctgttgtgccgattatacgaggacaagattttacatgagaaagatatgcgtgatgtacattctccagtagtaacctatctttgcacaatgtttttcaggtgctggatctgctggaagacgcatgcgagtcattacttgacagcatcgtggcagagaatgcaagcgtttctgcttgatctcaatgaagctatctggaggcaatgtaagcatcattttttctatgtaaccatgatcagaatctatctatgccatttgattgcgattcagataaccagaaacactcacatcagcatgcatgtacccatgttcatacaatgtcaggctggagacatatacttatatctttcatgtacaccatgatttacactgtaataaaatcaccaactcgaattagagaagctgattggcacggactagttttgttagtaacacattgcacatacatactgtccagtgacgtcacgtcaccggcggtagcattgcacgtgcaggaagaagccacccctcgccggcggctggtcggccatccacagcctcccctccttctccgccctcgccctcaccatgaactgcgcgccagctccagctccgccgccgccgccgccacggccgaaccaccagtcgtgcacgtcccacatcacgtccaccacctcgccgtcggcgagcacggcggcgcggttgccgcggaacccccaccccaccctcctcacctcagccaccctcttcccgtcgatgctgacccgcacctccccctcaccgccgccgccgccgccgcgggtcgcgtgcaccgccacctcgtgctccgccccgccctcccggaacctgcaccgcgtggtgtgcgccgtcgccgcgccgcgcagctgctctcgccggctgaggacgacggcgccaccgccgtcgtcgccgaaccggcgggagaggtcccgcgccgcgccgccctcgccgaggagcagcgcgagctcggcgtcggcgacgacggcgaggtagtagtcgccggtgggctcgggggacgaacccgacgcgtacgtggcctcggcggtgtcccagtggacgcccacggccgtgccggcggcggtggcgagggaccggctcccgcgcttcttgtgcagcacgtggtgggcgcacctcgacgacggcgagagcgcgtcgtcgaaggcgacggcgaggccggtggctccggcggcgctccgcgtccacgtgacccggatgaggagctccttcccggagtgcagcgacgcaccgtacaccgtcgtggtcgccgcctccagcgagcgatccagcgcgccgccgccgccgccgccggagtcaccggccgcggcggcggcgatgccgaccgagctgtcgccgaagcacgacagctccctcatcgcctccggctttggtttttcttccggcgagattagctgctgctgctgcaataaaatggaatgcactatgtattgcgcacgtatgcgaggggaagaagaagaagaagaagaagagaccaaaaaagaagatggatttgattcgagacgcgttgcgttttgatctgctactctacttgtgatgccaaagtcgatgaatataaatttgttgcgaatttcttccttcttgtttatattggcatggtcgtgtggtgagcttgcagagagaggtggcatccgaggaattgattagtcgattaaagtatgcacgtcaatggccagcggcaaccaatatctgcaggtctggtcgatttaaggatggatctcatcatctcctatagatgtatggttggttggtgatttggacaaactgtacacacccaatgctagctgctttggccatctgattgataatcctcatgccattggtggcactgctacttccagtttttctcttgtatcttaccacacgagatcacatgagatagtgaggtgttaaccttgacatgctgatgcttacatcagttgggaggacatgctttcacggaaatttttaatcaacacgcaatcgctagctgtatatcaaggtccagttcgattatgggcaagtgacaggacgatcgtatcatatattctgagaccgacctgatgctcttgacaccctaacccctaaccatgcaatttaattagtatattccattgagatatattgcactgtttgaagattgctacagcgggatcaccatttagatccctcctaatcaagtggtgatggacagagtaagcatgcatgatgatttcttgcaataatccctgtaacccaactatgctgacagcgtgttcctgcctaccatcgcttcggcacatcatgattctgcatccgtgcaataatctttcctagtcttgttctaacacttttttatgctgatgaagacccccaggaagttggttatgtttggttcttcacaaaatccggtttaatgaaattttgctgtttttctttttaaataagggttatggcatcaatgatgaaaaagaatattaataaccctcgcacgataaaaacgaaagaaaaaataagtcaattttgcctcccttgctattggttgaatctgatttgtatctctcaagtctgaaccgtcgtaaaactaggtatatcaccgtctcctctgatactaaaatcagtttagaatgactcactcggctattttgagattggttttggttgatgtgatgcccaatcaaaaaaaataaaaagtactacctccgttctagaatataacaactattggctatgaatctggacacatagttgtctagattcataggtaaaaatacttatattttaggacggagggagtagacgtgagccctcctcgtgtaagtgactattctatccgtcccaaaaaaagacaaaccctggtttccgtgcctaacatttgaccgtccgtcttatttaaaaaaattatgaaaaaaattaaaaaaacaagtcacgcataaaatattaatcatgttttattatctaacaacaatgaaaatacgaattataaaaaaatttcatataagacggacagtcaaagttgaacacggaaacccagagtttatcttttttttgggacggagggagtacttcccatcttcatagggccacatgtatacatcctctccctctcccctctcttcactacatgactccatctctctctggcagctctcccggagaggactcaaaacagacttttcccaaaataaaactaacaaatatgtggaccgtattatgatgggccgacgctgtgaaaatggaaataggaatgtaggaggaaggaataagttcaccattagtccctcatgttgatgtcgaggttgaatcacatccctaaaccgtaaaactaggtacaacacatccatcatttttcaaaaccaatacaaaatatagtcctaagataatattgaaagcggttttgagtgacatggcgctgatgtggcacaagaagaaaataaaagataacacgaaaccccacatgtaagtgaaacaacgatcttttttttttatcccctttctcactccgtcaggtggcggcggcggagccgcgtggacgacgaggcaaaccatacgggcagtgtggatgttgacatggctggtgacggtgatgctcaagccgaagcacgatcatcgagctgtttcacttacatatgggtcccatgtggttatttatttatttttgcttattgtgccacgttatccaaaaccaccttcaatattgtctcatgactatatttgtaccgattttaaaaaataagggatacgtcatatggtttaaggatatgatttaaactcgacatcaagacgagggacctaaagtttacttatttataggaggaatgaagccactgcagtgattctaacgcctaagcagatgcagatactatttcaattttttctggttgatcttttttattgaaataaaatttctagctgaacattattattactagtacaattttttttttctaaatattactagccatcgattgtgccacgtgatggccggaccaccgcccacttgcacttgctttgtcgttgcctcgccggccatccccggaaacgagcggccggtggacgcggcggatactcttcttcctcctcccctctcctggtcaggtcactggccagtggtcacagctcgccggagaggaagacaagcttgtggtggtcgccggccgattggcaatcattcggcaacgacgaccgatgctggttcagccgccgaacgccgtggcggtccgggcgacggcggcgggcaaggagcccctcttctcgttcggcgtcatcgccgacgtgcagtacgccgacatccccgacggccgctccttcctcggcgtcccccgctactaccgccacagcctcaccatcctgcagagagccgtccgctcctggaacgcccacaaccacaagcatcccgtcgccggcggcggcgtccgcttctgtgtcaacttcggcgacatcgtcgacggcttctgccccaaggacaggtcgctggctgccgtccaggccgtcgtcgccgagttcgaccgcttccatggcccggcctaccacatgctcggcaaccactgcctctacaaccttccccggagcaagctcgtgtcgctgctcaggatgccgtcggggcgcgcctactacgacttctcgccgttcccgggctacaggttcgtcgtcctcgacgcgtacgacttcagcgccgtgggatggccgcgcggccacccggtggcggcggcggcgaggaggttcttggacgagaggaacccgaacgcggacaagaacagcccgagcggcctcgccggcgtggaccggcggttcgtgatgttcaacggcgccgtcggcgaggcgcagctgcggtggctggacggcgtgctgcgcggggcggcgcggcggcgggaggcggcggtggtgtgcagccacctgccgctgcaccccggcgcggcgtcgccgtcggggctgatgtggaactacgaggaggtgatgcgcgtggtgcaccggcacggctgcgtcgcggcgtgcctcgccggccacgaccacaggggcggctacggcgtcgacgcccgcggcgtccaccaccgcaccctggaggcggcgctggagtgcccgcccggcaccgacgccttcggccgcgtcgacgtgtaccccgacggcctgacgctcgtcggcgccggcaggatgggcagcacagacatgcggctccagctccactccccagtgactgagctcagctagctaagctaaatcctctctgctgccgccattgtgctaatgcaactgttgtaatagtggcaatgtgattgacagcacgtttcatgcatccctaaaaaaaaataatctagtgtccaattgatgtctcgtcgtcgtccatgtcgcgcggttagaaatcaaagtcgttccgaggaggaagacgagaggcagcgtgggcccggttcggcatagagggggatgcggtgttgaccagtccaatttatccacgtgtaattttgctatatatttatcaataatttttctctaaaaaaataataaatattgtaaattgcatgtaactataatgtaacttatatataactttcatataattttgaaccgttatatttgtttcaagatttgtgcaacagtgcaagtgaggaattaaaagtcacggcgtgtatacatgtgagatgattcgtctctacgacctccgtttcaccgaaataatatattacggagagagttctaaaagtccctccgtttcacaatgtaagtcattctagtatttcccacattcatattgatgttaatgaatatatcaatatgaatgtggaaaatactataatgacttacattgtgaaacggaggaagtatattgtagttacatgcaagttacagtgtcattacatcacaattgcactaaaattatactccctccgtcccataatacaagagattttaagtttttacttacaatgtttgaccgctcgtcttattcaaaaaaatttgtgcaaatataaaaaacgaaaatttgtgcttaaagtactttggataataaagtgtgtgtgtatatgtgtgtgtgtgtgtgtgtatatatatatatatatatatatgcgcaagcacaccgtactgcggactctagcgacgactagcatcactagcctctccgaggtgtgcatatgcaccatgcgactgcctgggcaaagaagaagataagattgatatgatatacacgacataagaaataattaagtagtactaaccacatgtattctggtgtctcagattgtacacaggatctgatcgatctcgtatggctatcgccgaatgcattgtcgccatcgaaaaggctttgcgcgagatcgacgagtgattgatgccgcctgggttagttcaactattgctgcatcgcaccgtcgactagtcccgtcccgtcgcgccgttgccttggaggacgatgacctgcatttccgccacacgatgttgccgatcggtctacaccgccgccgcgccgcgcgtgcaggccgccgcgccgggatcacgccgtcacctgcaacgcagccatggatcgacgatgaatctcgctgctgttgcggaatcgacgatgaatcgccgccgccttctccgagttctattatatcgcggtctctcctagtgacctgattttcggatccgatgcactggtggaacgaggaattgtactcaggtcattccggtttccgtggctaaattaaggggtacgtaatttttttcttgtcaaaaagttaaacgggtccgctcgttaatccgatatcaggatccatcgaagctaatcacagatcaacggtggatgatagcaggtgtacatactcccatgtgtgtgtgtgtatatatatacacattaacatcaatataaatgtaggaaatactagaatgacttacattgtgaaatggagagagtatgtcacaaagaaaataaataataattctaattttttttgaataggacagagtatcttttttaaatttttaaaactttcgaaaatttgtgaacaaatgtattggtgatcccatccacacatcatacggcggttggctcatttcctttccaagaaatgggccggaacggacagttggacgtggaaggcccaaaatcaattgggcccagtaaggagcccaccctacgttgcgcggcggataaagagggggagggcgacgagcgcctcaagctccaacagtagcgctagcttatcccctcctactcccccccctcatcctcctcctcctcgctcgcccatggccatggccaccacctccgtcacctcgctcgcgatggccatggccgcggccgcctccgccgacgccacccaggccccgcacaagctctccgccctccccttccaccacctcctcttctcccgcgcgccgcccctcctccgcgcctcccgccgcctccccctcgcgcccctcgtcgcctcctccgacgccgccgccgccgccgaggccggcgtcgaatggagcgagacggaggaggccgatgagggttcccaggaggaggaggaggaggaggtggtcgaggagcaggcggaggcggaggaggaggtggtggcctccgtggaggaggaggaggaggaagcggtggaggaggagttcgcggcggagccccccgaggaggccaaggtgtacgtcggtaacctgccgtacgacgtcgacagcgagggcctcgcccagctcttcgagcaggccggcgtcgtcgaggtcgccgaggtgagcctactcgcgcgccagcccacaatcaatttcccccttcttctttttaacagaagaattgcaagatactattgccaattgcataaattctcaaggctcagtatttccaattacccaattattgtttttatttaggtcatttacaacagagagacagggcagagccgtggatttgggttcgttaccatgagtacgattgaggaagccgacaaggccattgagatgcttaaccgctatgtgagtgcatttctgaattgtcgtttcttaatccattgaagtattttattttcacaattttcaccattcgcacatgctgccgttacacataaaattggaagtaccttgataactgaaacaatttatattatctgatcaaagggtaaaattatactgttggtacatctcatttaggttaaccattgtgaaatgttcccatacccgatgaactgcgttcagtaaaactgagctcgaagatatttctgtcatagtgataaaatgatagtacagaagaaattgtataagttgcacagtgttctcagctgctggctgataaatttatgttttacaggatatcaacggaaggcttctgaacgtaaacagggcggctccaaggggctctcgtgtggagagacctccaaggcagtttgctcctgctttcagggcttatgttggcaacctgccatggcaagtggatgactctaggctgctgcaattgttcagcgagcatggagaggtggttaacgcttcggttgtctacgatagagaatctgggcgttctcggggatttggttttgtttccatggcctccaaggaggagctcgatgatgctatttctgcccttgatggacaggtgaggacggcaccatctacattaagcatacacttgaatatcaccattataacgagtatggcaaatatggaggctctataagctaataccgtttcttttatgcttcttttattatgctcaattgttcatgatggattacaggaattggatggccgcccacttcgagtgaatgtggcagctgagcgaccacagcgaggcttttgattccatatggcgttggggagcatgtctgcacgtttgaacaagaatgctaaagtgttatgcgttaaggcggaagctgatggttgtcatttacagagcgcgcgttagcttcctgattttgagtcctcccgtcctttttatgtgtcttccaagctgatgttatgttaaattattctcaaaaatatgagttcaactttccaagtaggatatttataatgatgatgtccttagtattttttttccgtgataatccaaaagttcacttgtcgaccatatatctgagaaaaggagcaaatgcatggcagcagccagtgcttacccctatgcattatgcttattttttctctttcagaaatgttgttctctggatttgcaagaaccaaatactttgataaactattgttcatataatgcacaggaaaccacaatagtcatggacactccaatccctttaatgtcacaaagctgatcaagtctgcaggatacgttacatctaagccaaccgtgttgtgaagataacaaatatgtcatgcacattgtagtggaaacaccattagaggcaaaagagatcaacacaagcacatacttccatgcttcatgacgaaccaacatccaacattgttgacaagcaccaagcgattcacacatacggtaggaccaatttatgtacaataataacatcttgatgtaactgggatcacgcattgaaggttttacattcagcagaatattatggtagtgcattcagttagcctgcagctgcgcatccttgcttgtgaggggcacatagcgcacagccgtctcatctcttatgctgaccttgccatcctggttcttgtccaccactttcagctcctggaacatagtcccaactgggatcaccattctgccaccgggctttagctgctcaatcaacgcctgtggaatctgcggtgcagcagctccgacatggatggcatcatagggtgcgagctctggccaaccttctctgccatctgtatcagttacagagatcgattattgttaggtaaataatgttttggaatatgaagtactgctgaagccaacccggatgcacaatataagtttatgagatggatgggcaaagttgctccaagtctgtgtctagaaagcataagtatcacagatgaagaaccactcactgtttggtatggataaaaagattctctttgaaacctaaaacaacttgttaccacgttagacccgacaaaagtaaccctttaaaacaaattacagaagttcaacatgtttatttaaagtatcatttaacccttgcaactaagcccttgtctacaaaattgtactctacgctgcaattcagttcagaccttggcacttcagcatgtttgtcattactactagtggagaggaaagtgaacaattaaaagctgcaaacttgcgctacttaccggtaatatgtatactgagggatccatcagttaactgtggagccgctgcacttttcttgatgttttcaatagacgaagtaaccaactctgggatatgttcaacaccaactgctcgcccttctggtccaaccataatcgcgaagcaagctgttaggtaccctgtgcctgttgaagttatcaaagatacgtaaataagcaatgcgagttgacaaacatgtatagaaatttgctatctgttgagcatttcagctaggaaatattaaacaggtcggcagtcctgaatcaatatttaattccataaatcagtatgacagaaaaaaagatgaaagaaaccaacattactactgaatctttgtggtatagggtaggggccagcccatcatagaccacatgaatacataccctcacggaaaagctgtgagatgaagctaaatattgttttttccacatatgttggcaaacatttctgcatttcaaagcctaaagtgtgcagtgataagtacatctattagataagatactactccactgacagatcttgggtaatgataaacctatagttgaagttgtaactcaaaaacaaaagcaattctatattttggcacttaagattcataacatagttttgtgaatgagaacatcaaaactcaaaagtgtttctgttgtgatgatacataattgaaatgatattttaggagcatagataaaacgttgaagtgattgagcgaaactgaatatatgagatacgggagacctgatccaacatccagagcacgcatgccaggctgaaggtgcttctccaggagctccaagcaagaggcgtgcatgtgaggcgcagaaatggtggcgttgtaaccgatgggcatcgggctgtcgaaatagggagaagcaccaggaggcacaaacagccccctgtcgatggtctccatcacctgcgcgaccttgctcgacttgataatcccgtacctctggagctgctcaaccattgccttgttcttgtcgctagccccgcttgaccacagtcggtgctgcaacagtatcagcaccaggagcaacatgaaacggttcttcccagagaaaaacagcaacatgagagatgaggcatatgagattgaaatcaatccccttcaacgctctaaatggcactcgacaactatggttggcacatacactgaaatttgttgtagattatcttatcttatgtgaatcaagatcatcatcaaatatcccaaaggtacaaaggaactagtaacaattaacagtcggcataaaattctaattcaattcgttgtaagtccataatcaaatgttggaatcaggctgccggtggtgattagaattaacaataactgacaaggttttagcctaaattatggagaactctccccataatttcgctaattactagtaccacaagaactcagactagcgagtaatatagccttattaggactggatcaacaattaagcacagtaaaatcacaattacgtactagcaattaaagaagatactcacggagcccgcagatgctgaggatgatttggaggaggaggaggagaagcaggaaaagatgtagcggagtacctccatggcgaaagtgagagaacactcgatcgggtggtctctcctggtttaatcttaatcttggggccgattgggagcgcgcgggtgggtcgcggtgcagctgcctttgccggtgcagcggcggagacgtgggggatgtcgccgcgggaaccggattcccgccgcggcagtggctggtggctggcggtggtggtgggggattgggagagagagagagagatggattcttctcaaaccacctagcgagagagaggtgtaggtagcttgtgggccgattttatgggcctaatccatgggccggaagagcgttcccatgggctaggcctccatgtggccgctcgtcatgccaaacctgaaaccggcgccgtttcttcccaacacaatagtctttgttccggtaaaaaaacgcaagagttttgtttgagaaaactaaaattgatagatttttttaaaaaaaatcattacagtctaagggtacgaagtacgaacaaatgaatctttagaccagcactctaagaaaattgttatgtatgaaggacaccatttataaatttaagaagcgtgtgcaattttttctaagagaagggtatttttttactcggcctctatatccaactggatatatgcagcattttttttaaaaaaaatactccctccgtttcgaaatgtttgacgccattgattttttggcacatgtttgaccgtttgtcttattcaaaaaatttaagtaattattaatttttttcctatcatttgattcattgttaaatatatttttatagacatataattttacatattttataaaagtttttgaataagacgaacggtcaaatatgtgctaaaaagtcaatgatgtcaaacattttgaaacggagggagtagaaacttagtttgaaattcactcctatggagatttaaacttaggaccttatgtgctacacagaagtgtgtgcaaatgaaaattgaaaattagaaaatatcggacaaaattcatacttaacaatctttttcaaattaataatcaataatcattacacagcgtaaacataatcgagctagattgcaaaaaatacgagcatgcaatcaaatcaactacaggtgattaaattaacgaactgcttattttgttacgacgtcgatcaatcgcctccaaacggtagccagttactgttgtaaaacacacaattaaatgagcttagagttcgtcgtggtggcggtgctcctcgtcatcatcatcttcgtcgtcgtcggtgaccttcttgatcttcttgggcgccgggttcggcgaggtcttgatggggtaggatgcttccatggcgatgccgcagagtccctccttggcggacacgtcgcgcttcatccggatgtagcccttctcaccccagtctgcgccccacgagttcctgacgatccagtacttggtgccgtccaccgtcgtgccgtagcccaccgccgccacgccatggtcgagctccgtcccgcatttcccggcgaacaccccctccgagtagaactggaagtgcgagccccccgcctcgatcgccaccgacaccggctggttcgccaccgccttcttcagcgccgactccgagttcgccggcacgtcctcgtagccgtcgatggtgacggcgggggacgacgccgcggagctcttgcaggagctctggcgggcgcggtacgggtaggcggaggaggcggcgacgccgccgtgcttggcgatgtactggaacgcgttgtccatgaggccgccgtcgcagccggcgttgccggtcttggtgtcgcagtcgacgagctgctgctccgacagcgcggtgaggttgctggtgcggatggcgttgatcccttccacggcggcgatggtcgagaacgcccagcagctgccgcactggccctggtccttgaccgccccgacggcgcccttctcgcgccagtccaccgccgccggcaggtcgcgggcgccggcgtacatgaagccgctgcgcctctcgcgcggccgcggaacatgcggtggtgggagacgcgggaggaggcgtaggcgcggcggaactcgtcggcggtcatgtcgccgaagcggttgaggcggagcttgtagggctcgtcgcggcggttgaactcgtggatgaggcggacgttgtccttgaacacgttgaaccgccgcgccttctcgccgaggtcccgcgccacccggtgctgcccgcgccaccgctcgtacagctcccacagcgcctcctccgacgccacgtccttgtcgccgaactccatcgcgctcgccgccggcgccgccgcgcccagcagcacgacgacggccacggctaccgccgccgccgccacgacgaccactactctacccatcgcaacaacacttgtgatcacttaattgtcactagctagctagcttagtaggttgaattagcttgtgaggtggtggtggtagccatggaggtcaggggcttcttatatagaggaggatatgatgctggattgctggctgcatatgtgcaaggtagaggctagagccgatcgaatcaaggcgttgcttgccggcaacagtttagtcatcataattaagaggtcaggtactacacttgtaatggttgattgctctcgtgagtgacacacagtgatatagctaattttggattatacttgtgcaccaatgcttattgttgtatgtgcagttttcagaatctagaaggcttgcagcagtgcccaatcaattggtggatgtgatgtgattatgcagttgattataccatcctcagggtttaatcaccagcagagaggtcatgtgattaactcgaacagaaagatactagcatagagtagcatagaatatgttgatatggcactaataccagtgcagtaattattgggaagtggatttttgtctttcgagtgtacattatctcgttttgtgcatgtcattaaaaagttatcaaaaaaattaaaaaaatttatcaagatagatcaatatatgatatattttttttaaacatgcgagttaaaattcgacttatataattaaaaaaaataaatttgaccgtgaattacgcattctattcatagtcaaatttgttatttgtttctacttgtataaattgaaattgaatttgcatgtttgtgaaatgacatatcacatattgatcaatcatactaatttttttaaaaaattttgatgactttttaaatgacatgtaaaaatgaggggatatcctcttaagggatgatttgaatttccctatttattgtaactttggccgtgtttagtttcctccatattctcaactttctatcacatcaaaaacttttctacacacataaactttcaacttttttttccaaactcccaactttcttcaaacttccaacttttttcagaaaacacaccctttacttaattggacggaatagcagttgttggtggccaggtactgactactgaagatgaatttaacactgaatacacgtaggtacttggacatgctcgttttttaattcatcgacagatagaattaagcttaactgcagtagttaattgataaagcagccgattgattagtcgtataaaccaagtgtttctgttagtttcgcagtactaactagtactacctgcgatgctgcgaattaaggggggtgtagattatgcgggaaacgcacaaataaagaattagcgaggcgtttacgcgacggccatgtaaatatacagatcaagcttgtgcgacactatcgatcaccaatccacttactcgaaaattaactcagattctaattctgtcaccacttaataactgaacctgaactaagctatgttaatttacagatataaatatgcagagctgaatttcagggccagatatctgggaaaattttggatcgctcgtcaagcaaagcaagtagcagaaacaaaactgaaaagattaaaaattagagtattgtaatgccccagcttagccagtcaatttaggtcaatcctaatgttccttgattgtggcgtgagatttcttcaacaagtaacctgatcgaagtcgaagaaggaaggaaggaaaggaagcaagcaagcgtgttgatttcctccaggactggttccatcaacagctgatggcgacatggaaattaaagcatttccatcaacagttggaatgttggatgcatatgtggctctgcatgtcttaatgtctttctctctgtgctgaataatgatcaggagatcggaatcgactaattaataccgaaatgccaatctttacgcatgaatctcatttatcatcaggtccgttcgtgtgtttgtgttggatcggcacaactgtattgattgattaattgagcttcctttcagattcagatttcatcagccacgctggtacatgcagcttctaactaactactgtctactaccagtactgcattatgcacaagaaagtgaattacgattttttgtttttgacataaagagctagcattagcaagataaaatcctgaagcaatagaaagattggaagcataagatctatagcttggggaaacaaaattctgcattcatcgttgtcactgaaaatctgggggcaaatgagaatggctggctttcctagctctgctttctcacatggatcgcttcgagtggcacgaaacccattattcaggctacgtttcgatcggttcccagactgagcaggatgaacaagcaacatcatcagcgaggcagcgacattctgcaagtatctggtggcctttggaaagagagagagacaggaaaaaaagaaagcatcgaggctgtatattgagcctgcaaactgatcagatttaatcatctatgtacagtcattactgagcaaacttagcgaggatggcgaa

SEQ ID NO: 63353 - DNA, 1170 bp, Oryza sativa
actgttaatttgcaattcattagaaaatgcttccacggattgtgtacatttgttccaagcaagtgtcaggacccaaaggacttgccagtgtggattggtctttttgttgtgctgattatggaatccaaatctcgtgaaatccataggcgtcattgccatgcaatccttgaggtgatcacaccggagttgggtagagactatgtcaatagttttatcaagaactggagttcaattagtgctcaagtgatggggtccttgacgaatttaacacaccatccacatgactgtggcattgatgtattggttacattggatgatctgattcaggtattttattaccttcatgttgatgcttggaatggaggattgtttgagcatgacagtctcgcaccccctgcgagagagatgaaatggtctccagttgaccccggcgtgggtgatgcaaacataagattacctcaggagccagcattacatggacgtggacacaagcgtatttctgtgccatcggcaaatatgtgttcaaagagagcatgtagtctcttaggagatgggcttgtagaacccccttcagcacaagatttttttgttcgatatgtgcaagtgggagatcaagtaagatctccgttttctctcatcattcgacaggcatgcatgcatcatggatggtgtattgaaatgataggtgtttttctatcgctcattttgcagatgcagaaacaagaatgtgatcacttggtttctcatctagtctcatttggcatcacgtgtaaagaacgccatacgaacacctgcaccaacttccctagtaaagtttggccagcttgaagacattcgacgtgagaacaatgaacaagcgaacagggaagaggcagaggattaagggaaaagagaaaaaaagggagagggggggggggggggtcaggaaggagcagtagcagggttgttgatccttatgctcagaagcttctcaccgaattggcagcatcaggcactaattctcaagggttactttggtggatgggctcatcaaacataaggtcaaagtatgcgttgttgaaaattctgcattgcagactgagtctaatcacagcttatcattctctatgcttttgtgggatgttctggggttcaggctaccttgaagttgcgaatctgctatgcgacatt

SEQ ID NO: 63354 - DNA, 596 bp, Oryza sativa
acagtagtctatcagccactacagtagccgtgccggcccggcacggcccagcaccttcttgggccgtgcttgggccgtggccttggcacgtgggccggcacggcacgggccgctacaggagtcgtgcctaacgggccgtgccctagtgggccgtgcggtcggcgtgccgtgccgtgctgggccgggccgcccgtttggcctgctatacccctgcggcggcagggagagaggagaggaggcagtggcgagagtggaggcaagagggagtaataagttcactttatgtcccttatcattccgtcaaatttaatttgcatccctcaaccgcaatacaacaaatcttaacctccaacttgcaaaaacagtgcaaaagagatcctaatacactagggaggctagttttggttaacgtggtgcctacgtggcatgtggcccacatggcattgacatccatggacaaaaaaaaaacgggccacacttcatggacaagctgtcccagcaaaaaaaaaacacatgatctagcacaaactgcttgagctgcgagacatgaaaaacatggtgaatcaatgaatctttaggaaacctgcagtttgtat

SEQ ID NO: 63355 - DNA, 9242 bp, Oryza sativa
ccccccaacacacacacacaacactcctccccttcctccccttccccttcacctcaactccccctccccccttcactaacggcgacggcgacagcgagcggcggcctggcggcaggcgggcggcggcctcccctccagcggtggcagggccgcggccaccgaagcggcagagatggcgagatgggaggcagcggacggctggcggcctctcctccgctggaaatggcgggaggggaggcagggcggcggaggcgtccgggaggcggcgcacggccgggcggacggcagcggcgtgttttgtgaattttttttatttttggaatgatttgtaaattttgttgtagattattttagatttggggataattttgtgaattacttgtggattgcggatgattttttggatgggcaattgtggatgatttgtggggatttgagggtgacgataatctttagtcccggattgggtgtcccggtttgcacccggggctaaaaggttgcaaatcgggagtaaaagagccattccacgtttgataagtactgctattccataggagagcaaagcgctgaagagttcaaccagttgaaaaatcctcgcacatcttgactcttcttgtctggcgttatttgacatcagtggcttcccggcacgcacggtaaaacagacaggttgtatcgtttgttcgtgagctcgatcacaaagcaggccagctgcctgctgaacaagcatgtcgcccactctgagcagcttccgtcttcttctgattcgacttgttttggtggctcttctgataggcagcggcctccccatgctctcggctcagcaaggcagcccaggagtccgtgagtatcatctttatatattagcaaaacgattttcaacagatttagctttgccagccaatagagtctagagctactgcccgcagtgtttttgtttccccgcccttggattgctgctaatattttctttttgacaccatcgttgcagataatccgcatggtccaccgcagatccatcatacccgttttatctatcacggtgaggcaggcactgtcatcgggaactaattaaacgcgtagatcgtgttgttacctgttctgctctgtattatactcctactccctcagttgaaattctaatgcgtgatttgacttttgttctgttgattatttcggaaaattactccttggctatataattgcaagggctcaactctgttttaccacaaagttaactgcaattataaatttagcagataattgagcagtatgtacatttaatttgccacttatctcatcgtatccctttgattttactttggtctgccttttctgaacttccatattgtggatcaattaatatacccacatgccacatggtacccataagaggaatacacaggaataaagcctctccccattacctccctcgactctattgtgctcgacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttatagggaaccggtttttttacatgggaaacttcaatggtgcggaaggattatagagatataagccacgaccaccaaatgcagcttcgcagctgaatcagcgaattgaagtgggaaaatctccttctctgaaatttacaatattagcaagagcactaatctataggaccattacataatttgtagaactaatgaactgttttcactaaattacataaaaattcagggactaatataaaattgctgctaaaataaaattaaaaactaaaataaaggggtaaatgggtggtgccgaaatcaataggatttggcccaccaccactacagtgcagccggcccatcaagcccatggggaaaagggcgaaggggggcgtggggggggtagggttaccctaaccgcccagcagtttgagccgccgccgccgcacatgacgccaccaagacagcgctgcctcctccacctcgtctgccgccgccgtctatttcggcgcctcctccttcaccacttttgccgccgcctccctaatccaccgccaattccattttcgccgccaccatctccccctattacaccaccgccggcgcctccatttctgccgcccccaccgccacagcagccgaagtccccgtcgtccgccggcgagactaagccgacggctccctctcctcatcggagtaagaggccgatcgggttcggacgctgtccccccctcccccccactccgttcgggagcgtgtagctcggggagccacatgaacggtgcggaaagtagcggggaggccgagcggcgaacgggaaacggtgccggcggcgactgcatctccagtgggagggagcactactcgccggtgggcgtcaccgtagtccatccatggagcctggacctggacgcagcggggcgccggtgcactcgtggtgtgcgcttgtggtggtggagtcggaggtgcgtcagcgacggcaaatgcggcgccgaggatggtggcggtggccaccaaccctagaatggcgcccgacatggcgatggtggtgactccatcgaatcgagggaggaggtgaagaaggtgatgaaagcggtctcagcgatggaggccgagaacggcatcgaggatgaaatcaaggtagacgtacttaggcgatttccttagtttcttctgtttctttcgcttttcttgaaatcaaaagcgatgtttccttctttcacttcgcgatctccttcgcgagagcgaaagtgctgataacgtgttgaatgtggatagaattgattgagcgagagagattgagagagagaatttaaacacaagaatgtagggaatgaatgagtggatcctttattgataacagtgttacaatatatatgggggagagaggcagcaaccggaggcgcgatggtttgggaaccatcacgtctgttgctagaatcgccgtgaggcgagaagaggtgtggggcatgaccaaccgtcgtgtccctgagttggttgttacactatccatatatatggatgagatcacccaaatatttcagaacactcccccttgatcgaatccagctttgatcattgctcatttagtgttcagatatctgtaaagataatcttagaaataattatagttaaatacatcacgtaaaactcctcaaaaacccagtgggaaaaataaggagagaaccatgatatattattgactatttttagatctctatgagtaaagctcatagtatgatccaaaatagtatagtgtctacagttatcatttagtaaaaacacagtggcgaaaagccaaatgataagacatataagcttatgttgatattacctcgttaaaaactttggatgagaaaacctaaagggtaaaactcatacaaaggaaaaagagtataatatgacgaaaataggttattttccaaaggaagatactccccctgaatcctgcaaatttttaagtcgtctcataccaattccttcgacacatttaaagaatgcggagtatggtagagattttgtgaataaatcagcaagattatcacatgacttagtttgcaagatgtttatctctccatgttgctaaagctcatgaggataaaataatttgggagcaatatgcttagtgatgttgctcttaatataaccagtttccatctgaacaacacaagcggcattattttcatagataatggtaggtgattccaatgaaccaataccacaagaagttatatgtggttaaccattctgcgaagccatacacattcacgtgatgcctcatataatgcaattatttcagaataatttgtggaagtggctactagagtctgtttagaagacttccatgaaatagtagttccaccttgtaaaaatacgaattctgtttgtgatctggcgttgtggggatcagatagatagccagcatcagtatacccaattaaagttgaatcctggttctttttaaagaaaagtccaagatctcttgtgccattaagatatcgaaagacattcttaactccagtccaatggcgtttggtaagagcagcgctgtatcttaccaatagatttaccgagaaagcaatatctggcctcgtactatttgcaaggtacataagtgcaccaatagcactaagatatggaaaatctggtccaagcacatcctcaccataggggttttggaaggatatgacttgtccatattaaatttctacaaaattttctaggtatatgcaccttggtgcacaaggattccagaagataaatgctcaagttgtagacctaagcaaaatttggtttgacccaaatccttcatctcaaattccgtctttaaatgatgacgtgcttcattaatatcttgtgtattgccaataatgttgagatcatcgacatataccgagataatacaaaatcctgtggggtctttttgataatgacgcacgggcaatcatcatttttagtgtatccctttagtgaaaggaattcacttaatcggttgtaccacatcctgaccgattgttttaagccataaagtcacttctgcaacttaacacaatacatgttacgatttaccttctgattcgggatgtcgatgccgtcaggaaccttcatgtaaatatcagaatcaagtgacccataaagatatgcagtcactacgtccatcaactgcataaatagacgattttgtactgccagtgatattcaatatcggaaagttataccactcataactggagagtaagtttcgttgaaatcaacgccaggtttttgcgtaaaaccttgtgctacaagccttgctttatgtctcaccaccacgttgttttcattccattttcggacgaaaacccatttgtatcccacaggaaagataccacgaggagtaggcattacagccgagaatacatctcttttgtaaagtgaggctaatactgcgtcaattgcgtccttccatttgttccagtcagagcacttttggcactcttttatagacctaggttctggatcaacttggaggcaatcagcaatttgttcagaaaaattaatgtcgacaattgtagctcttctatcaaaagattctccagtttcagagtagttgatggcaatttcatcaacccttatagactcatcgtgatctcccgaaacaatgtgtctatggtcttccgaattcctagtcttagcattgtgcaccaccgagctaggttgcagactatcatgatctgcttgatatatagtatcaatttggtgtgtaccaactaaaggttggtttgcatttaccgtctttctttgcttattagcaattgtttctcgctgagtggccatacttcctctctttttagtgagtagaagttgagtggttttatttggtacctccactctttttggcgcattctgagcaggaatgaaagatttagtcacacctttataattagtaaatgcatctggcaggttatttgcaagtctttgcaaatgtataattttctgaacttgtagttcaattttagtaatacgtgggtctgaggctggaataccctaggcatcccaatcaatttcctggcattctttcgggtacttgaagtctccccctaatgccgggaaatgttcctcatcaaagatagagtcagcgaaccgggcagtaaatagatcacctgttaagggttctaaatactttatgatcgacggagatttgaatcccacatagatccccactttcctgtgtgggccatagcagtacgatttgatggtgagatcggtatgtatacagcacatccgaacttacgcaaatgggaaatacttggaggatttccacatactaactgcattggggaagtttcatgatatgcagttggttgtagttggacaaggtcagcagcgtgcagaactgcatgaccccaacatgacgaaggtaatttgcaattcatcaataatggtcgagcaataagcttaattcttttgatcaacgattcagccaaaccattttgtgtgtggacatatggaacagagtgctggacctgaattcccaatgccatacaataatcatcgaaagcatgagatgtaaattcggcagcgttgtccatacggattgattgaatcctatgttcagggtaatttgccttcaaccttataatttgagacattagtttggcaaagacatggtttcgtgtcgatagaagacacacatgagaccatctagtagatgcatcaatcaaaaccataaagtacctgaacggtccagatcttggcacaataaggccacagatatctccttgaacgcgttcaagaaatttaagtggttcggctctaattttgagataagatggtctcaaaatcagtttctcagtagcacatgcagtgcatacgtaatcagaggatttgggaaatttatcagtgatcaaatgatgaccaatagagttgccaataatttttctcatcatcccgatactggggtgcccaagtcgatcatgccaagtgtggaatgcatcaacattttgaaaaattactttgtacgcaacatgtgcaatgggcttaatgtatgtatagtacaatcccgatgtgagagatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattgggagtgtaataattgctcgtcctgagccaactatcacagtatcgcacccagcgatagtcaaaactttgccttctctctttttgagagtttgaaagtatttgatctccctaagtatagagtttgtggtactactgtccacaagacataattcctctccaatcggagtgatatccttagacatctatagtaaaagaagaattacttagtgaagaattctttatccacaatatatacatacatacaataatgaaaacataaaatacatagtatgacgtttacatatgttaaaagtacatactctaatgactagcaagtcatacaaccttataatataagggagtttgtacttatctacttattacaaccaatattgtttggcaaacttataggatatcaatataatgtctcaaacacactgagattaaagcagctttatctctaagtgggatgcactgagattacagtaaatctccaagtgggttcgttgagcagtactcgatgagcatgtcatccattgtagaaagtgcagtggtatcttctgggagaagagcgaggttgttctctggttcaataggagcctggtaaaaactttcaacctcaggtctttcttttgtaagattgaagtgagcttcaaatcttagttcctcagaagactttttctcctttagggatttctgatacaggagaaaagatgttgttgggatgcggcaatctttagcaacatgatagtcagatccacacctgttgcaatgcctgttgctattgccactaggttgtggtgccttacccttcccttttcctttccaatcaaccattggatttgcgctgttgttgcatttgcgttttccagtcagattcttagggttattcgaggaatttcccttgaatcctttgagtgcgatactgttggttcagtatcatgtcctctggaaacatagttgatagagttttctctatcttctctgcttccgttggctctttttcgcaaaacttcaacttggagcaaatgttaagaacaacatgattgtattctgccacagtttttaaaatcctgtaggcgtaaatgaatccactcataattagcctcaggccaaatgagttccttttgctgatcataagctttccataggttgagagggctcgtctccaacatgtattcatgtttaagatctttatagatgtagagccttagaagtaaaagggcaatatatagttttctgttctcaactggtagatcccaatcattgggttcctaatttgtatgtgaaatcccactagaagaaaaatttattttgatattggaagcccaaattgggtagttactcccatcgagggcgagttcgtcgaactctatagttgccatgtccctataatcatgataaacattattaatttacagaggtaaattaataaaaagatgatattgtggttgtaatctcaatgcgaaatgtaagacttcatattttgtaatgtttcgaaaaaatgcaggtaatagacctgacaatttgagttagaattcaaaattaggtggcacaatgtggataatctccaagtaattaaacagtgtagtagatctcttaatagtgggcaagttatacttgctgcctaaaacacggtctctaggcaaatatattctggtgaatataccgcagccaatgtttaggactccactaccttgtgctcaaccaaaattccaataatctcattttcaaaacatattctcggaaaaaaacacatgtcggtaatcatcgtgagatgtagacctctgtgagatcggcgagatactcgctgcctaggttacgaccagtgcggccaatttgtagggctccatcgggtaatcatctcaaaatgtagatcacttgttgatgggcgagatactcgctgcctaagttatggtcacgatgaccaaagtataggactccatcgacatgtgattaatttccaagtcaaagtgtgaagtggaacatgcattaaatcatccattaattatgtagtacataattaagagaatttgctaaattaaagtataaaatttataaaattttgtaaattaataaagcaagaaagtagagcatgtcttgaaataatatgcaaaaggcattttattaagacaactaataaatttagtgaaacatggtatttgaaaaaacacctatgttaattaacacataacatcagtagtctataggaccattacataatttgtagaactgatgaactgtttccactaaattaaataaaaatacagggactaatatgaaattgctgctaaaataaaattaaaaactaaaataaaggggtaaaagggtggtgccgaaatcaatttgatttggcccaccaccactacagtgcagccggcccatcaagcccatggggaaaagggcaaaggggggcgtggggggggggtt

SEQ ID NO: 63356 - DNA, 7129 bp, Oryza sativa
tcgccctcccagagggcggtaggcgactatttccgtcaattttcaaaatggaaaattatttttgtaaaacttttaataaaaaaaattataaataaaaaaaattcttcgtttagatggactgctcagatcggctcctaatccattaaaactccggaccgaaccctaatccctaacccttcctttttccccttcctcctcctaccgcaggccactctctccccaccggcaaccgcgcaccttccccacctccgccgtcttccccgcgcccctcccccaccgccgcctctccgcgcccctcccccaccgccgccttcccgcgcccctcttcacctccgctgccttcccgcgctcctcccccaccgctacctctctgcgcccatccccgccgccgccgccttcccgcgcccatcccccaccggcgtcgtctccgcgccccttcccaaccagcgccgcctccgcgcccctccctcaccggcgttgcctctccacgcccctccccaccggcggcgccgctcctcctctccatctcctctcattatctattgattccgatttgtatttgtatttgaatttggattgagattttgtttttgtttggagccgcagcccggatggcgtggggacggccggccggacctcgccgctgccggatctagcggcggcgggggcaggagggggcggcggcccggatgcggcggaggcgggagaggcagctgcccggacggcgtgggggcggcggcggcccggcgtccctgcgtcgacggcggcgacggcggcaccctccccttccggcgtcggcgtttttgtgcttgtgatgttcctgtgttgtcgttgttgttgatgaaatatgatcttgtgatgttcttcttgtagtagtgttttctcttggaatttgtgatgattccgatctgtatttgaattgagattgagattttgtttttaggttggattggatgcgggatttggagaggaggagcgcgtgaggttagagaggagagggacgaaaaaccggtgtgacgaccggaaaaatactaatatttatattagttgtagatatattattatctttatacctattataaaaattaaagatgattttatactcaccttaattttcgtccatcaatcgagttaaacacatataaaacctggatcggactggaaaaaatcatctactggcgatccgtattctcaatcggatgaaaaatgtcttctctagtattataaaaattaaatatgtttttgccgatacttttgtacgtcatcgagttggtttgtaatttcattagcttttagaaatacataaggagtcatgtgagaaatctcttaaaaaaacacttacatattaaagtgagatgatcaaactcctaatcaactcctaatcgcagctcatgatgattttctcatgtgattgaaatcctaagactttacccgttgcaatgcatttttctagttgtatactaaaagtcaattaaactttttcaaattaaacgctctcagaccgtcacgtggtgctctgataaattaagggaataatagaaattatgagaagaaaagtaaaacatccgtccaatgatttttatttaaattgataggtctaatattataaaccgttaatttagattaatcttcaaacggaccgcacaaaacaactacggtctcacctctcctccttccgcgtaggtacgtacatgagcgtacgtacaagaccgaacaagacatccgtttcttctgcttccctcctctcaggaatactcaaatacaaataagtatatagtagtgtgtcttatttctggctaactactttgtaaaggtgaggaaagttaatgcaaaatataaatacactgtgatcatgtgataggtaattatgtatacattcatgtagattatatcgtcatatagctcattccaaatatacgtaactaaattagctatgtaatacttaatatttaaaaataaagtttacaccattatatatttaaccattaactaaattaattatctagttgtgaattaacttacccacaagaggagtacacaggaataagcctctccccattccatttcttaactcgactctcttgagttctacctagtttctaccatactgtatgttatcattttgaatcaagtaaagttgcgttttgttttaatttgggttagctttgttccttgtcgtcgcagtgaccggccaaccttatatcgagcaccttgctcgtgctttctccaggccaggccgtgagagatgggaaccacatcaaaaaatactaaaattacttaagctatctcatttaaaaatgtacccaaaatttatatacgggtcagtgactagggtagattagtctgggaataaaaacaaaacaaaccaaggcccagtctgatttaaattgttgagtggattatagttatagattttctagtgataaattaaatatctattatatactaaaagtcaattaaactttctacgaacgttctcaaaccgccaggtggcatcctaccaacgttcctaactcgctacatcgcattctaataaataacaaaaattcctaagaaattctaaaaaaaaaccaaaacatctgtccatccgttttcattaaaatagttggtcccattatttcaagccaacagatttatctaaaaaatctttccacctccacctccctcctcccacacgtaacatctcttccctttgtacgtagtcacgtaccatgtacaaagaaggttatatatgtacgtgcagcccatatatgtgtcctccttttctctctacaccctattttatagctagaaatttaactaagcatggcgagttaaatggtaatttaatttagaattaaactgataacttaagatcaataaaatccaaaatatttcaagggttaattggatccataccattgcaaatttgcctattccgaaaaatgtcattacaattcgtctattcttaatcgtgccattgaaattttccaaaattaaaaccgtgccactgccatcacgttttccatccatcccctgcattttccgtcttcttccttcattccctcctcaccgccgcacatggtgccgtcgccttcgatcctcaccgacgcaggaggcagcccagagcttggtagcggtgtcaaggtggcggaggacggtggcggcgatggcgccgtccatggagaagaggacaaagccatcaccgccggggaggccgagggtgcgggaggcaggccaaagggaggagcgcggtggcggaggaggatggtcgccgctgtggaggaggtcgcccctgaggccagcggttggatccatgcggcggtggaggagggggaggaggaggagacaggggatttggggatcgggaagaggagggagaggagagtgcgaagctgcattgcgacgccgccagcatggttgggtcgctagtaagctctctctcctcctccgagcttgcctcactacgggagatggcccgcttgacgcctccgtcgtcgccgtacctcttgctgctgccaccgttccaccgatggctacgtggttctcgtcctccacggcgaggtgcgctggaggcatgacgacagagagatggagagagaagatataagatgcagagagaagatggaagagagaaggaagaagatggaaaaagaaggatggaaacgtgacggcaacggcccggttctaattttataaaattttagtggcatggctacaaatagacgaattgtaatgacatttttctgaataggcaaatttgtaatggcatggatccaattaacccttgttaataaatagtcttaacaatcggcacaaataaaataaacttgataacatatattgttccatcatatattacccccacgaacatgcatagatgaattagatcaataataaaaaaacaaaaatatcaaaactcatatcctatccaatcctatatcctataatactatataattgatccccacttagtgtagttattaggaattttcctgagctgtggttaagccacgtcacttcttttattttcagtcattcgatcaaacctcgtgaatggtccaatcgtactccatcacacacacatgcacgtccttttgcctccctccgccaccgatcgaatatgccgccgccgccgggtgcgcttgcttcctctcccacatcgcgcgctgcttccacctaccacccccgcgcgcgccaagacgtgggccctctcctccatcgcccgtggcagtgcgggccctccctccggccgccgcgctcgctcctcctcccatccccagcgcgagccagccgcgagcctgccatcctcgcctcgccgcgctcggttccccatccctcgcgcactctaccgccaaccgcgccgcttctccaaaaccccaccccaccccaacccgcccccccccctcacccacacacacacggcggcaccccaggttgccccacccccagcgcacagtcctgccgcttcgcctccaccccccggtgattctttctccacgcccaccaacgagcagcgcgcgcgccacagaagcgagccgtcaccatcatcagcacatcaatggaatggggatcgccgctgccatagcagggcaagggacggagaaagccagcccagcaggttcccattttctgtctatacatcttcctctgataaccgtcacaattaagttattatttgttaacccaaagttaatatgatgaattcatttatcatgtttattttccttcttatgtactgaggaaacttcataatcagtcccctaattttattttatggacaaatcagtcaataattcatgaatcccattttttcatatgggaattagcattaggccagtcaataggcggaactttttccccctaatttgtatgtatcttaggttactcatgtttgttgcttttagatgtgccgattatctggatacatctataaattacggattggtgactgggcaataagctagcttcgtttcatcataggcctattaactgtatcgaagtattttccagctttgttcttcccattgctccatttatatatttagaacctaacttttggtttatataagttgtatcctgagcttttggttgatataatcatcatgcttgaataagctcctatctctgtaaggacctgaacccatcgcttcgaaagtgggtacatctatgctgcatgctgttgttatgttatctggaatttttgcatggatctttctttcaaacacatatcggtatataatatcccgcggcaacacacggggtatcatctagttactataaagttataacccactaacttttaaagcttagcatgcaaagatgccacatcattatccactaacaagttgacacatcatcatccactagcaatcaatacatttaatattatgcaaacttgttatattatctataatttaaaatttcttacattttagagcttttaaaatgaaagcatgttaaattattatcccacataattcacataatatttcaatatatatcttcattatgttttataatatcttatgtacatacataagttcatcctcacttagttaatgttatctctctcttctctatttgagccatatcacgtcaattgattttagtgcttatgtaagtttatattgttcagctatcttacatattatttttatttattgttatcatactgaactcccacagcaatgtgtggggtttcacctagttacctcatatgttcgtgaataattacttctcgagatcaactctacttattttcagggagaaaattatatttgtactgctaaaatttaatggaccaattaacgccatagacaagtgtcaactctattccataaatggattcaaaactttaaaaaaattatcacttccatcttatctaattatcattccacgaagggcgccaagcatggataacatagtatgctctgctactgtacgaatttgggggggggggagggggcatgcatatgactaagtaaaggtgaccgtagtgagaggctactatttgcaaataaagttcaactaaccttctttctgatgctattctttagctgataatgaattaggcgttaaaattgtgctgcacgctgattttgaggagcacaactatgtagattaaggacacatatttcaaggcataagagaagaaagcctaggtggctacactcggcttcaactattagaggggcatttatatataattttaatggttttatcccatgaattggtaggagcaatacttcaaaatatttatacatatatttaaaaacaagtgagacatgaacaatttagtattaagtagagatgatcttttcttgtattactgacatattaagtttgttttcttgtatggatgtaattccatcataactgataatacaacgataataaataatggtgacaagcaagtttacatatatccggaacaacgttatttctgtttgaatatgaaagatactattgtcatttggtatataaaaatttatggtctagatatttatttttttattaattataagctgatatactgtccttataattaattaatatggtgagataggatttctttagcatcatttttgtaaataataaataagtggttctaattataaggtgaagcatgattttttaacaatcttttataaataagttgcccgcgcatctgcgcgggctttctttctaattcgtaaaaaaaataacaaagaacttatttttagtggtgtaagtaattgattcaataatccggtaaataaggtaaaaaaatagggcatgccccgctaagtatactactggataaatgaaatttgctgggtcacgcaaaaatcacattagtcctggtttgagtaagaaccgtgactaaaaatatctttagtcccggtttgaaaacccacgggtactttttttatcgttaccaaccggaactaaatatcatttgtagttccagttaaaaacatgttagaccctattttaccaaccgggactaacgatgcatctttaatcctggttatttataccaaccgggatcaaaataaaaaaaatcgtgaaaatccctaccccgagtcacgggcgctgccttgtccttatcccctcctcttctcctcctcctaccctcccattttctctcctgcacctactccccccc

SEQ ID NO: 63357 - DNA, 10075 bp, Oryza sativa
  unsure (1)..(10075): unsure at all n locations
gcccacaacatgggtaaggttgtttgtttggggggtgggtgtgtttttgtgtgtgtgtgtgtgtgtgtgtgttttcgtgtttgggggggngggggggggttctggctctgcatagcacattttagaaccattgtcaagtatgtagcctactgcaacttgcataggaccaaagggtgatgtttctgtgtagagaagttagatggcgatgagtcaatgacttgaattagaaatgctctaggtgaaagggaaaggaacagatctagaactacaattggaattaggccaatcaagtacagaccactgaaactgaagacttgaggggctaatctttgctaattaattattcagtcttagaatcatggctaggatcatatataacctaactaattaatctgaactagaaaacaagctgaactaactattcttaggtagctagtttgcttttgccaactctggacgcttgtgcggtttctcctgttgtcctgcatgatgctagactattgatcattgctgattgctcatacagtcgcactggtatattgctgtagtagaccacatatatattataatgtttcatgttcagttacctttcatgttatctccatgtgtgctcataactagttaactcctgtcacagcccaaagtcttcagcttgcaagtgtctacaaaggggaagcagaaaagattcttctggtgaagaaatcagaagcagaggcaaaaatacctttctggtgatggcattgctaaacagaggcaggctgatggcctgagacagtaccacagcaaaagaagtcatggacctaatcatggtcacgcagtactttgacaccataaaagaacttggggatggctcgaagaacacaacggtgttcatacctcaaggcccaggccatgtcaaggatatcagcgagcaaatccggaatggtatgatggaagcgtcaagcaacaatgtgtaaattgtagcgattcacagaacaaggttggggatggttcagatgggaggagcctgttgtttataatgaatatattaccttttgtttatagcctgttgtcaagcaacactagcaccttttgtttgcacacctacctggatgatagaatatgtagttttggaataacaaataatgtttggaaggtataaaaggaacaggatatatattaagttaaggaaactgcatcgatttatacacattaaaagcctgtgcttgattattttgagcatacgcttcttcggtaaagaggaatcaaacgattcaagtggaagtatcaataagattggcaaaatttctctaaacattaaagtatcaataagattggcacctatgtacgtgcaggaatcatccaatacgggcggcaccatgtaccatcagccgattcagcaacgcctttgaaaggatccctcacttcttccgtcctcttcccaagctcatacacgcgcagccgacgatcccccgggttcatccagtagatgctgttgggcagcaacccatggcggcgagccctgcaccacccagctgctcccatgtcgttcctcctgccgccgacgaggatggcgcggtcgccgatgctcccaatcctgacgtgcttccgcttctccaggtccaccctgtacacggccacgtcggcgacgacaccgccaccgctttcgaagatgaacaccaggtggagcttgccgtcgacgtcgacggagaagatggaggccacgaacatgtccgtcgtggtgaacgggctggccggcttcatccgcacggtggtgaacaccggctccggcgagagctcgagcacgccgtacgctgtcgacctgatgaagtggtacaacttgccgccgcacgacgtgatgcagtggatggaccgcttcatccgctgccggccttcgatgtccatcttccgtgtcccgatgtcgtactcgtgcctcacccatgccgccggcgacgacgacgaggagccgacgtggcagaacaatatgaagcagcttcccggcggctcgaccatgaccaccgtgaagccgccgccgccgtcgtcgtcggtgggcttgccggatagcgcgcagaaggagtcggccggcggcggcgtcgtcgtcgtctgcccgaacgacggcaggacgatcctgcggcggccggcggcgtgcgggttccacaggaaggtggcgagagtggtcgggtcccaggtgagcacccagccgtgcgaggtcacccagctccgcttgtcccgcagctcctcgaactcgcagggccggtgcacgccgtcggcgacactgtacagcgtcgtggggcgacgttgctcgccgccatcttcgccgtagtcgaagacgaggcacggcaacgcctccggctgctggcggcttgtcgacgccgccatgttgccaacggcgttttacttacgtacggacacaattcaacgcacggttgactttaaatagattgccgtcttggcggcctatgagagttggtctcggacaccgggccggtttgcatatgcgttacacacacctcaagatgttacccttaatcttaattaattgtaaaattcctattaggattcttgaaaactacccacctggctaatcatcatccgtttcgatctatccatcaagttatttcgtaagcatgtgtcactcaaaattttatagaattaaaacaatgccatcatcgtcatattttccatctccttctccatccgccagtggggcccacacgtcagattccttttttccttctttcttcccaggtagagtagagggaagagagtattggggtgccggtgctccggtggctaggaggaggcaacgcaagcagccgaatgtgttcccgagcttggctcactcgaagaaggtgccggccggtacagggagatggtcagaacggcgggtggaagggcttggccctggtggcaaagaaggtgatggtggtggcaggatggggtggctaaaagagaggggaaactaggggaatatgttctcgtcggcgaggcaaagccgtggtgcgaggggagccgttgagggagatcgaccaatggcaaggtggtggccggacttgaggagcgcgcgtggaaggagctcgtggcaggggcgaagcccagtagaagcccgtgggtgcagatgaacccccccaaaaaatatcttttagttattacctccatatctcggccctatatgcacccccctcagcccaatatagtgcacccacagcccaaacaacagttcagttaacatggtaagcccatgagcaggccagtagggtggaagccagatcgatgttttctcctctcgacttctcgtatcgtgtgccgcgccgccgccagtcttgatgactccgccttgcgtctgtttggcttccacaccgctgctctcaatcagccaatcccagtcagcacttgcccatctcggcatctcgccgtcgccggtcgccctcttctcagttggcgactggctgcacatgcgttgcgcaccgccgcggctagtctcactaatcgtccagccgcaggaaggcaggaagccgacagctaggcaaccaggagctagcgtcacaagccaacaacgacatcagtccatctccaccaactgatcagcacacaaccacactgtgcgttagtagagccaaggtaagaaacatgcttcatctatttctttttcaatcaatttaatttattagatacgaagccctaaaatttttattggttgttaatttttacattgtaggactaggaggccagtaggcttcaatttggggtccttcagaatcggagtaagattgcagattggaggaaaaaattgagaatttgaattgaaggtgcaatttggatgtaagtcatgtcaattttcattctatttctttagttgaatgaatgataaaatctctacacatttacatcttcatgaatcatcttttgctcatgggtcagtagccatttatcaattttattagtggttttcttcattttaaaaaaacaatgtttgccacttctttattttattgatgcatttatgtctttattgttgatgtcaaaaatttatcgatcagcggttgcattgaaaatttagcttgaagttatatatatattgatatacttgtggtacaattatgaaccccctccatttcgctatagcttcgcccctggctcgtggtagccgtcggaggtgttgggggacagcagcgtgtaggggagcctcgccgggcccgtgcaattcctgaggcgcgggtcccggttcatctccgcgatgcgcgccttgatcccgacaaggcggtcgccgaattgccggaatgcctccttcgctgtgtccaaagtccactccggcgtgtcgcgctggccgaggtacacctcgtcgtcggagtgcttggacagtatctcgatcagcgagatgccgcggagcgtgcgccgctggccggcgatggtgcggagctccacgtactcctccgtgtcatcatggtgctgcacgacttgagcagcgccgccacggtggtcatctccggccaccatgcccggtccttggtgtggaccactcgtcctccccagccgtcctcttcaccatgcattgacatgcggccggcacgggatggagcacgagggcacggccgcacgggatggctgtgcgcatgcattgcagagtgagatgcagagagggagacgggagaaaggaagaagatggaaagggaagttatggatggaaaaagtgacgatagtggcacaattctaattttataaaattctagtggcatcgttacgaataaatgaattgtaatggtatttttttaataggtaaatttgcaatggcatggatttaattaacccataatcaaaaggacgtgagtccagcaacactatattccgtacttgggatttgattgatgatcttatgattccacagctaattagggtttaatcgatggcggtttgatgaccttctgattcaatgtttatttgtttcgaaatagagatacaaactgaaggattattttctttttcacaaacatgcaaaagctttgcgtgtttaaggattattttgcttctggtagaaacattgttcagtttgttcattcaatgattcaatcatagatcgaactgatactctgacagaagtaatgtacgctttgactgaagaagtgttatcatcatctacgccttgctctgaccaccaactggcacagccatactactagtcgctttgattttttcttgtaaggtttgttcattcatcttatttaaaaagttaatgtagatataaaaacaaagaagtcatacttacaatattttttgataataaagcaaatcaaaaaaaataataattccataattttttgaataagacgaaagctcaaaagttgaaaaaaaaactcaaaacgataagtattctagaacggaggtattattattattattattattattattattattattattattattattattattattattattatcatcgccgccttcgtcgtcgtcatcatcttcttcttcttaaaatatcccaaagaagttttagatatcgaattaccttacctagtgatatttgacatgtattgtccttatcggttggttgaaccgacaaatgcagaaggtgaagacactaggtccaagtggtcaaggacatctcaattgataagcttcgcatttatttagtttacaacaacagatgaatcaaaattataccttattgggtacaacagaagattacatgtacaatttttttaagatggtgcataatatatttcttatattagtcttcttattggtgaccgacacaagtaatatgtccttatattttctttattattgcccttgtgccgaacagataacagtgatgagctatttaggtcaaaatcgtttttttttgggagaggggaggggggaggagggaatatttgttatcgacgacgacagcaacgccgacacccgggcgccactggccgcgacgacgacgaccttcgcgacgcggcgatggctccctcctctcctcctcgatggcgaccgacgcgctgccggctccctcctcgccgctggctggtctcggggaggggaggggaggggaggggaggggaggcaacgcgcgacgaccgacggcgccgacacaacgatgactgccgcgaggatgacgactgctgtgaccacgatgcgacgacgacgagacgatgcctgtgggggcggcgacggacgaaggaggaggccggcggtggcgatgcgtttttttaatttgctaaaatgctttttacaggcgggtgactctaccgtttgcgaagatgttgccccctgcgaaaatgatttttgcagacgatagcttaccgacggtccttttctccgcctgcgaaaactatttttgccgcctggaaaaatattttttctagtagagtcagctagcgtttgtacggtcttatcttttcgtttatacttatacttatcggccaaaatatgaatttttaaccttaaatttggagttgattttatggtttttggatcgttaagaatacgtatataaaagttttgtttacgaattattttttatttataaatatactgtttagcttattccacgaataaacgaaacgatgggaccgttatttgcaggccgtagcgtagaacaccagcctcatacgcataaagccttccatcatttacgtatgtggtgttgtacaggagggatcatccaaaacgcctgacacgatttacgatcaccagcaattcctttgcagggatcccttatttcttccgttggagcaccaggtggagctcgccgttgacgtcgacggggaagacggagtacaccagcaagtccgccgtcgcgaacaggtgggtcggcctcacccgcacggcggtgaacaccggccgatggtgatccggcgagaactcgagcacgccgtacgacgacccgcccggcttgatgaggtagtacagcttgccgccgcacggcgtgaagctgcagatcgtccgctgccctccgatgtcgtactcgtgcttcgcccacgacgccagcgaggcggcggcgacgccggcgtggcagcatgggcggagctaccatgattcccgggtattcccggaaatacccaacttttttatcgaaaaacaagtatatttctaatatatacatatgtacacatattagtgcacctaaatcctcaattattcgatccaaacatagccctatacacatgtacatatattagtacacctaaatcctcaattcttcgatccaaacacagcccaaccggcctatatgacccatcagacatcagttgatccacttagccaccactcttccagacggccccctctcgctctccctccatgacccatccctccctggctcggctccctcgcgccgctccccatttccaaaccctaggcggcggcgcggcgaggcggcaactggcggcgagaactggaccgcgctaccacggagggggaggctattgccgcggcgggcagcgggtggcgcccgccactccgccaagctcaggcagtcaggccggttgggtggccggcagccgcgaggggtagaagcggccaacggctcaacgcttagacgggaatacccaactttaaaatcctggctccgccactgcgtggcagtaccacagcacgttgctgcccctctcgaccatgaccaccgtgaacccgccggcgccggttggctcgccggttgatatcgcgcagcaggccttgatggccggcggcgcctgcccgaacgacggcagcgcgacgctcgtgacctcgccggcggcggcggcggcttgcgggttccacaggaaggtggcgagggttgccgggtcccaggtcagcacccagctgccatgcgaggtcgcccagctccgcttggtgcggagaagctcgtcgtcgacgtcgcaggggcggtgcacgccgttggcgacgttgtacagcgtcgtcgtgggtcgccctccatcggcgtcgtcgtacgagacgaggaacagagacggcgccgccggccgccggcttgtcgacggcgacatatatggtaggccgagatcactaaacacaattgtcaattgtggcggcggctgatcgacacgatccgattaagaggatcggaggttgatcgtgtcgatcttaagtaggatttcacaccatagtcgatgtcggacaacaaattaaatttgttatcgattcagattcgtgtacttagcagattcagagaggtgacagaacccatgctactctgaatatgtcacgagctggctgattcatctgaggctagtaataaccaccttttgataatttgaaaaaaaactggatttttcaattttctagcatttagtttagtttttttattctagattcttaaaagagagaatcgcttatatgccactgaaaatttgtctgataccttatatgccactgaaaattggctcttctcttatatgtcattagtctaaatttgcgcaccctctcatgccactcccgttagttgactgtgggttgaccattaactcagaaggacaaatacgtcttttttactttagagttaacggtcaacacacagtcaactaatggtagtggcatgaaagagtgcacaaatttggaccaatgaaatatagggaaagagccaaattttagtggcatataaggaatcagaccaattttcaatggcatataagggattctcttattcttaaaatctagataaaaggcttggggttcttccggcggcttacacgcacataaatgatccaaaatgatcctcgtggcagttttcacgaggactttgaaagactcccgcaatttcctcgtgttggtgccttggcggcgatatcacacacgtgcaagcactattgtcatacgggctcaattcgcctccccttcaaacgtaggcacatgtacgtggtactaggactacaaagcccgagtctgatttcctcgtcgccataaaatatataatttgattcatgacgagattattggaatccattaatccatgatcataaatagaaaactttgggcaaaattaaacaatgcgaatggagtggagaaatttttacccccaatggagagtgaggggatgcatctgagttgggtattaggagtggggtgctttcctgtacttggcttagtctttatcgaggtgggcccccctacacggcatgaccgagctgcagggggccctatatggcacgaccccgttgcgttcgaggtggtccagggattatacccgcccgtacagtatacaacggtagcataccatctatacaagaaatacaaatcccaatattctattaaagcaagacagattgaacaatacaacacaaatcttcgtgaatgatccaacggtgatgcctgtaggggatgtccccttagaggacgataacactttcgccaactgcggtaactgttctatatatgttacattggtaagaagaataaataatattgtgggggaaaatatgttgtccacattcagtagatttgacacttctactcacttggtatataatataaattagactatgaaaaaaaggttgtaattaactaattattgtgagtactccagtcattgatgacaacattgtccaaagtttccaactgttcatagcaattttctctatttctttgggaatttttggttcatagcaaatggtgaaacgttaaactccgagtccgagtccgcgaccacgtacacgaacgtaacaagttttgcctacataagacaaaccccgatgcatatgcgtgtccatcgcgaatcatctctcatctgtcgcgcttctgatccgttttgaccgtgtcagatagctgtgtgcgtagcgtgcacatggcgacgtcgacaccgccgccgctgccgtgcctcgtcgtcgacaacggcgaaacggcggcgacgttgtacggcgtctccgacggcgagcaccggccgtgcgaggccgaggagctgcgccgcaaccggtgctgggccacctcgcacggctgggtgctgtgctgcgacccggcgaccctgtccaccttcctgtggaacccgaccggaggcgacgacgacggcggcggcggcggcggcaagatcgcgctgccgccgttcacgcagccgccgccgccgcccaattcccagtgcgcgctgtcacgcgagcccacggac

SEQ ID NO: 63358 - DNA, 13776 bp, Oryza sativa
tggggggggttttgcgtttttgcgggtggatggatgagcgctcggcggcggacggctttgatgatgttggtggcggtggaagcgacgggtgtacgcgtgggggagagacgtggcgggatggctggttgggctcgtggcaggactcaagacgtgttgggtcttgtggattttgtgctcgaagtaggcgatgccgcgagaaggaaagccatgacatgtcatggccggcacggttaagaatagctttggaattctcaagacagggtacagataagcagctagataagcttttggaatgcatctgaaattcactaaaccattttgggaattcactaaactattttgagtagaatatcacggtaaccgtatgattaccgtacagttaccgtaaattttactatggtttcaaaaactgaaaaagttatcgcacatgctgaaaaagttatcgcacatgctaattggctaggctgtgaacactgttgttatatggggttaaattgcgcaagcgcaactgggtttgccgatactggtttcttcaatgatgcacgcctggtttagagactacatcttcagacaaacacgtcaatatgatgcgctgcaatacggggcaggcaccgcgagcatcatcccgtgctgacaatcaactcaaaagtcaaaacacacagcatctgatcacatataggagaaagtattttacatggacccttcggggttccggacaaacacacaagtagagcgaaacgtaggcatttacaagaaccgtgttttcagttttccccatgagcaaaacagcaacgtggtgacagcgtatcatacattcgtgctgctacagatcgaaaggcagcacataccctcgacagcgtttttacagtttccggtacacaatacagattacaccatacagacacacgaggtcgtaggggacactcgggacattcaggaatcaggactattcacctgaacctaattaaattctctggacctgaatcttgctgctttcacaactagcagtttactgattcgatccgtagatgtataagagaaatcctttaggagattggtatgacacgtgatttcggtcgttccccgttccgtctttgatcacggccttgctctcttccaggaagagcccaaccccaagcggattgcctgccacgtccactggtgccacggttacctgtggtgcattcacaaccatgcattagtcgatcagaaaaaaaatgcagacaatgtcaaacgagcataatcatacagatttatttttgaggcaaaagcataatcatacagataggagactacttttgttggatagggaaaaacagcgacaaatgataaaatgtcagcaccacactaagattcaaatagaagagatttcagtttatcagcaagctggtctctagaaaaggttatcgacaagcttaagctggcatcatgttccatcaaactaaccttttgatgttattagctgctaaccacctagaataagcgaaaaagtaaaggttatgttcgcttgtgttcaggaaacccattcatatctatccagtcagaccaggttcgaatactcatcaatgcagaagagcagcaaaagaaacaacactttatcctctcatctggcatcacgaatttcatttaaccttctcaatcatctgaagagttagtatcaaactcagcaaatgttttagtcaacatgttttcatttgtcaagcttcaaatttctattagcaatttcaccaaattggtgaatatgctacttgctgaacactgcgcacaagtcagacgctaaagtttaaggctagattgaacaaacagttattaattcatgctggagatcttcccacaaaaagaggggaaaaacttgagcgctgagaagatcccgtgcaacaatggcagtaacaggtcctaacccattttgtaaaaagtgtgcaaagtacaacatgtctctctgtgttcatttgcatgcatcatgttagtatttgattatctgctaaactattagtacccagagacatttgcactacgactacagtttgagcagcgtacatcatttatccactatggcactatctatccacctattagaaatcaagttcaattaaagaggtgttcatatgaggacactcagtctagtttttctccttgacacatttcagcctaccctctcttgtctaatattcttagttatgctttgatttacactatgctgctccaccaatgaatttgcaatcattaggaaagttttatattagctagtcttcagaaaaacaggatgatatcattcttaacctaaagattgaatgtctgagaacaaacagctcattttttatacaagggcaattttgacccaccgtaagcaaagctaaaaaaaataataaaaaaaatcaagttttatcctaaaaagaaaatgtaatcataaaggttattacaaatctaaaccattcgttacctggttcattattattagatgtaccagcattttggttcaagccagccaagtgatgcctagcattccccttccatgattcctcgaacccagctagttcatctgtatcgcgtgcttgtgtgaaaaatatatccaaaatgcaatcacaatgaagcacccaaagctaaaaacaaaccttcatggagattgtgcaatatctgtgtagtgtccacattgccatccgatttcagcttccttgttagtgaatgtccctaaaatttcaagttcaaagaaaattagtgacggacctaaacaaaactataatgaacttagctttagataagaggaaatctttgatactattgtgctggttcaattaatgagattatagtttatacgatatatttcaacatggcaaggtatctaccttgtcatgaattcctcgagagattctatgagtagcctctttagtcgttgtatcagcttccttgctttcttccacagttatctgcagtaaacataattactgtcacttatgtgtaccaaacagtgaggagtacattagtaggtctctaggatatttgcttactccatcacttcctgtccttcgagtttttgaagcagtgtagtaagctccattgacaccaccataagtcacggaagagctctgatatgtgaatgtacgagcttgtggctgcccttcatttgccctgttgaaatccctccgtggctggagttggcccccttgcatctctataaataagaaaataacaaaaacgacataaacataccattgatacagaatcctagataaactataaaacagaactgattcaaacccaactcctaccatcatctggttcttgaacatacggctcacgatttgcttggcgttgcctccctgagttctctccttcctcctcatcaagctcagtaataataagcttcctgccattacctctgggaggagcttgctcaaggaatccatcattccttatgtctccaaatggtcctcccattggcccaaaaaggctaggaccgtgcatcccgcttccaaatggctgattaaagaacggatcatcgaaaggatccctgcctccaaagacaccagagatcaagctcctctggcgaccaaagccaccgaatccggcatacgggtccctcccaccatagaagtcatctcttccatttcgccctctatccattactaagtgattacgtaagctctgcagggttcagcaattacgctacctcgagtagccggtaacatatgatacagaaatcgttcaaaaattaagacaccattcatttcacaaattaatccgttcaaaggtacaggaaaacgatcgtgtgcacatggtcatatgcaatttcatatttcttacagagctcactgtatctccaattcatttcacaaattaatcccaccgaattccaccatatgatagcaccgcaaccgttgtagaaccaagacttcaatttaggccataggagaaaaacaacacatgaatttcccccaattcgcacttgcagaatgctcatctcaccgattccccccacgaaatacagatgctaccaccgaaaatcacctacaggctccaactacttctaggctacaagctctagcactctctcctcacgtcacgaatcaacgatcctaggaacaacagcaaaaaaaagaaatacaccgaacaagctgattaacatgcatgatttcctagtatttcctaaccgcgcaggcatcaatcaaccaaccttacctgaatctcctcgaggccggagcgcacgcaggatgggtggggggggggggaattgcgcgcgcgctggtggagggagacgggtggggatcagccgccgaggacggggaggaggaggatttgtcctggtttggtggtggtggggagcggcctttatccgtggcgttggcagcctgacgtgacgaggagggaggaagacgaagacaaacgaggcctctcgtctcgcctcgactcgccgggatttcccgaacattctggtggtcgaaggcccacgacgcgatgcgaggaagcgtccagaccagacagggctcacactgggcttggcccaacacagcccatcctggtggcggacgtgtccccgcaaattaaacggagttgataaaaactactcccgtccccccgcattgacctagcaaagtttcctttccccaatcaatcgccaatccccctcctcaatctctcctcctattttctcctctcgccgccgtttcgcctggcaaatctgcatgccaagccgcgatgccatgccatggcaaggccaggatgggtctgaatttgtcgtgtcatatccactcgagtcgcgagttggccggacgccgaggagagtagccgcggatctgactgcatgacgcggtcagcgggcctggattcctacgaaaggagccgcctttgatctataatcggtgagtttcttttggtgcatctagttccctatggtcggatttttgatctagtataaactttctgccttttagttatgcgtgtcctttcttgaataggaggaatatgaaggattaaataccttaacaactgccaaggcaccattgttctctacggtgcagaagcgagcctaaagtgccgctcattttggtttataatcggtgagatcttcacattctatgtccttaaggtttctcaacatgggatatttcatatgatgtgattttattatgttgaattaatctgcaaacttgctgctttgttccattttttgtcctcaacattaatccacaagattagagtttgttggtatgtggaaacaatagtaatgctattctcattttggttgctcacgatcctattaagtcggttctccatttttgcgtaatgcttgctattcaaagtgcactgataggaaacaaattgtattttaaattctttcacaaccctactgcgggcttccgtaggaacaattccttcatgtctaacttctagtgtaactctggggtgatggggtgcgactgcccttcaaacttctggtgtaactctggggtaatgtgggtaacttctggtgttatatgatcttcgattgacaacaaactcctgcggaaaaaggcattactcttagcaaacggtcgataggaagtcagtatgaagaaaacaatagagtaccttaccctttttactgtattaatgatcagatgtttctgtcggtgttagcaggtcttcagatgactgtttctgtcggtgttagcaggttttcagatgactacaaactcttgtggaaaaaaacattagtgttagtagctggctggcaagcactaagtagtcattacaaatacaacaatagagtaatagtaatttgcccgtgctaacgctacggtatatttagtatgtttccccaaaacaaaataattcaaaaatagtatgtttttaaatttttgccaaagggagtagtaaatctagatggagcaactaattgcatcttacagatatgcgcaaaaaaaaggtaaattgtgaatatttgcaaatgtatcaattttgtaacatgaattgtctcatttctttcccaaaaggaaagatctaataatttttttacccacaaattgcacacattacatcttgtcaatctcaaattcctatccataaattttacaatcagaacttcacgtttaacgacctacaaatctctgcccatgtctctctgtcccagatccgcgcataacccatcaacacattttcctagaggatgtggatcactcccacaactcatcacccaagaagtgcacctaggtgacacgcatattgttatcctaggattgttgcagcaacatatttgatagtaacatggtaaatttaatgttatgtgcaacctcatttaacagctcaacttttataatattaacaaaaatcaatattttacggtacattacttattgacatgtttactcatttgtaaaataaatttaaaagcattgtacaatacaatcatgcatttcatcattgcacataatattttaatcagaaaattgcaccagaaagcaacgtacatgacaaagcacaaaaagtcatattattcattattggaccatttgctcaggtgatcaacagcatactaattagctagaaacaacaatagagtaacttacttgtctgacataccatttggtgttaatggtcagatgttcatgatggtgttatatgatcttcgaatgacaacaaaatcctgtggaaaaaggcattaactttagcaaacgctcgataggaagtcagtatgaatacaacaatagagtaccttactgtatttaatgttactgggtattaatgatcaaatgtttctgtcggtgttagcatgtcttcagctgactacaaacttttgtggaaaaaagtattagcgttagtcgccggctggtaagtactaagtagtcagtacaaatacaacaatagagtactactccgtccatttcaggttataagacattttgactttggtcaaagtcaaactgtttcaagtttgactaagtttatagacatattaatatttatagtactaaattagtttcataaaatcaataattgaatatattttcataataaatttgtcttgggttgaaaatgttactatttttttctacaaacataatcaaacttaaaacagtttgacttcgaccaaagtcgaaatgtcttataacctgaaacggagggagtagtaatttgcccgtgctaacgctacggtgataattagtatgttccccaaaacaaaataattcaaaaattgtatgtttttaaatttttgccaaagggagcagtaaatctagatggagcaattaattgcaacttacagatatgcgcaaaaaaggtaaattgtgaatatttgcaaatgtaccaatattataacatgaattgtctcatttctttcccaaaaaggaacatctaataatttttttatccacaaattgcatacattacatctggtcaatctcaaatttctatccgtaaattttacaatcagaacttcacatttaacgacctacaaatctctgcccatgtctctctgtcccagatccccgcataacccatcaacacattttctagaggatgtggatcactcccagaactcatcacccaataagtgcacctaggtttcatgcatattgttatcctaggattgttagtgcacctagttttcacgcatattgttatcctaggattgttgcagcaacatagttgataataacacggtaaatttaatgttatatgcaacctcatttaacggctcaacttttataatattaacaaaaatcaatatttaacggtacattacttattgacatgtttactcatttgtaaaataaatttaaaagcattgtacaatacaatcatgcatttcatcattgcacagaatatcttaatcagaaaattgcaccagaaagcaacgtacatgacaaagcacaaaaaggcatattattcattattggactatttgctcaggtgatcaacagcatactaattagctagaaacaacaatagagtaacttatatgtctggcatagcattgggtgttaatggtcagatgttcatgatggtgttatatgatctttgactgacaaaactcctgcggaaaaagaatttaccttagcaaacggtcgataggaagtttactgggtattggatgaacagatgtttctgtcagtgttagcaggtcttcagctgactacaaactcttgtggaaaaaagtattagcgttagtagctggctgttaagtactaagtagtcagtacaaatacaacaatagagtatgtagagtacgttaccatatttggctgttagattgtgttagctatcaggtgttccaattggtgctagcagattagcgactgtttcctctagtgtctttttaacaggggaactgtgcttgtttgggtattttttagcttgaggtttggctttcttcgcttcactgttggctttcttcgcggccttgctagcctccattgcctttttcgcttgtagttgttgtgctcgaaggcgaagcagattcatcctctctaaattctgtttgcggtgttgtttagcatgtgccttttcttgtacagatggtacccaatcgtcgatcccgcactccttgcagtacacgtactttaatccgtctctgttgtcagccatcctgcagttctgcaatatgtcaaattattgttgcatatctgctggcttctcgtctcacaagtctttaatactcattaatattaagaagttgattacaggttgcaaagatattaggtgccagaatgcttaaggctgtgtttagttcacgccaaaattggaagtttggttgaaattggaatgatgtgatggaaaagttggaagtttatgtgtgtagaaaagttttaatgtgatggaaaagttaaaagtttgaagaaaaactttaaaactaaacacggcctaagtaagcagtccagcaatgcggtatgcgaaattattcacccaagtcataatatagaaagtgacagaatgataagcagttcagcaatgcagtatgtcaaattattatgtcatccaagtcattacaaagaggttacagaatgcagagaaagatagtactaggtgacagattgataagatgttggtggcatatgcgcttataagctagggaattcaggaagcgcataatcgataccacacgttgataggtctgtatcaaatcagatacaggcatcgctgcagcctagtttaatggcatgtaggtagattgtttttttttttttttgacagagaggccacggtggaaaacacatgcgacccttaacaaaagaacatctgggatgcgacaattaagctagggtttgacaattttctaacgaagttgtaataatcccaaagcacgggcaaaatcagatctccacgcgacgccgacgcgaccagaccacgctagagaggcggtggcagcagccgtcgtaatcgaagacgagaggaggttgaactggagaatcatggtgcgggtgcgtggatcaggcgagcgtcgaggcggtggagaagtagggcgcttcgtacgcctcgcggagccgggtctccacctcgtcaaccctttggccggcgagtgcgtcgctggcgctctctctacccgcgtccaatccaatccctcgacgtccgtgtcgagaccaagaccaagaccaaaggtttcttcggcgcccgttcccttctcgataacgctgtctttttgttcgttttttttaactagcaaaaatacccgtgcgttgcaacgggtaaaaaaattctaataataatatacgtttttcatgtataatcatgtcaatgacaatgtttctattttaacgagcggcttgtttttttataaacagtgttttttttcttgcgcgattttctcaaaccatttttcagaaaaggcgcatttctttctaatagttttttcctaccatgttttttttgctttttcacttacgaagaaaaccatatttttctcctttttttgcttttcttttctcgtgtgttttttcttgttttctcccacgtttgtttgcttgtttttttcgaaggatcttttttgcttttttcaaatacaggagaatatatgacaaaataaagccacatagtagatggcaaaaaatcgatggatcctatccgactcaagcgtccatcaatttagcttttttctgacagttttttcagaacgattttttttaatagacggtgtttttttcttgcacggttttttaaaacaattttttagaaatggcgtgttttttcgacagttttttccttgcatgttttttttaaaatattttaccgacaatggaaataatttttctcgcgcgtctttttattttttttattgatgatggagaacctttttagcgtgtttttgcgcttttttctgacttttgcctcacacgttattttaaccgtttttattttctcatgcattttctctttttaaatagttagattagagatagagaagagatatatactggttagaaatcagattttgtttcgccctttccattttttctctcttgcattttttattttatacgaaccagctttttattttttacgaaccattttttcaccattttcttaggaaatcgaacgaacttttttagatgtttttttgcctttataggaatcagacttttattctgtttttaaaggattcgaatctagtttttttttgtcaccactttttttttgccttttatatgaatccgatttttttccgtcggatctacagtttttttggccactcaggaaaaaaaacttttgttgttgttgtttttctttattttcttttttgtgcagcttttcttttttccttttatgcacctatctgtctttgttctctttctcttttattattttttttagcaaaaacaacctcaagtagcttgttgcaagattatagggactcaaatgtaaatataaaaaatacagggactcaaatataaaagtacaaatctaaaaattaaaatcatataaaaatggaatgctctctacatgtagattccgtttttgctaacagatcttcaatccggcacattaatttttttcaccaatctgagtcagacttttttttttttgcttttctttttctttttatgcacctttctgcctttgttctctttctcttttattttttttaacaaaaacgacctcaagtagcttgttgcaagattatagggactcaaatgcaaatataaaaattacagggactcaaatataaaagtacaaatccaaaaattaaaatcatataaaaatggaatgctcttgacatgtagagtccgtttttacaaacagatcttcaatccggcagatcaatttttttcaccaatctgagtcagactttttttttggttgatataggagttggacttatttttttttatcggacaaacatggttttttcgccttttttctgtggatcggactctgtccggttttttttggtttttttcgccttttttttctgtatcggactctgtccgcttttttttggtttttttcgcccttttttctggatcggacttctttttccgttctggttttttattggataaacctggtttctacccggtttttttcacccggtttttttgacggacgatggaagcacctcttattttttaagtagtagagatagagattatagggtagcccctatacgtgttactacgctagatcgatccactaggaaggttcaatcccgctggtgagggatttattagttatcttatctggcgatctgctcttccgattctagatcagtaaaggtttctcggacctgacaagatcccatcatactggatgctagctttggtttctggattctctattgttgaagtttttagctgatgctattttggcatgtttccttgtatatggtgcgtaatgcatggccgaatggtcactggcagcgtattgtgcatgacagattgacaggttactgattcctactttaggcccctgcgtgcttgatccatcgtgtaggttcaatcctagccaggttgtttgaaatatttgtgaagtatcggtgctagattgtcttttaagccttgttcgtttaatccctctcgtgagaattgagagggatttgaatgggatttattcttcaatccccaccaattcctctgtcttcgggattaaacgtacaaggtctgtcttcggattaaatgaacaagaacttaagggaagtggtacatctaatgagctttaagtctgttgatgtctccatgacagtaaaagactgttccgtacttattgtatataaaactaaccctgagaaattaggtttacgaaaaagcatcattgactacatgaatgacttatttgagcagtgaatgttggtttttcttttccccattttctgagagattgttttggtaggctgtccatggtagcccaattaatcacgcattgtaactatgtgattgtctagatctagtgcttttcaatgaagtgaaatattattttcattgatggaacttactgtcatttcttgctttttttcgttacttgatggaacttcaatcttcttttcttctgcaggattagtctttgttcagctgatctgcgcaatccaataccgagtcgtgaaggaacatgctgatgatgcattctatgaattgcagaatccccaacagcaaattcaggcctatgcctttgatggtaaactattaacattgagcaattaaatagttgcccatatcaaattattgactcaaagcttaatcactttcccctcgaacttagtggtcctggccctagttccaagaatgaatcttgatgacctttttgagtaaaagaatgatgtggtgaagactgtacttgaggagcttgaaaaggtaactcaagtgcctgtttttactgagtccagctctctaggattaagttgatcggctgattatgcaaactccagtaaggcaaatcattgtttttccttgtttgcatgtattgcattctgccatggtcccagggacgaagctagcatcaaaacaagggggtgcactaccattgaaaatctaaaaaatttcagtacaacactgtacattctagtgtttttaagtgagaaattagaaatttggggggttcatgtgcaccccccaagcatagtgtagcttcggcactgcatggtccatcattccatgtaccgttgtcatcctgtcaggattctaaatctagtcaaacacatttttgtgttagctgaagtattattctctctttttttttctcttgtgcacctatttgcatgttgaaagagttggaatctttgtttggtatacattttaagcatgttatttcgttacccacaattcatactattcttccaagattggtttacatgcttatgtggaattctagtcccagaatactgtttgatggaacttggctgtatcaaaaggaaatctggcattgggctgtctgcatcgcttatctttcgttggaaacttacgtgcttaccaaattttaaactctgtgattgcttcttcctcaagtgttggatattccattcatgataaccaatgctctctctgttcgttctaagttccattcctaatgtgtagttttgtcctcaaacatttttttatcttagtacttgttagtgataagcagtttattatttgtaccgttatatattatatgccatctttgtaaaaaaagactgttctgtagtctatacatcgaacatattcttatggttgatatcatccctgatacttctgtacgcagagcaatgaatgacataaatgcaggtattattccctttcaagtatatatggtacttctttcagtctgtgcaacctgcatgatgtttattagtctatttaatgttgtaatgttttctgaagtaataatctgtcagacttc

SEQ ID NO: 63359 - DNA, 590 bp, Oryza sativa
atcaatttcaggggaatctacgaactataccagctggacgccctcgacgtttctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcaatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgttttatatgtaatgcatcccacgcacattgcagattccactgggtgcttttactcttcgacctggaggcctgcaccgtcaacgtatatgactcaatggataaaaaaagagctacggttgacaatgttcgaacttatagacaggtccggcataagttcttttgttatttag

SEQ ID NO: 63360 - DNA, 2850 bp, Oryza sativa
ttggcccaatgtgacataggtgacccacagttggtgggctaggttgcgcactctaatataaaaaacaaacgaacaactcttgatcaattagtggaattggcatgtaagggatcaaaagtttggtcaattagtggaattggcaggtaagggatcaaaagttactggaggatatataatggatctagcttggaaatcttaataagagcatttaatttgttgtaataataatagtagaaacaatcctaaatgaggttgatttatgttttatgtggatggttgatcattatttgcggcagtattacctgaaatcatcttattgtactggctgacgtagtcatcaatggataaagtcacctcaaaatcctccttggggatagataaagcaccacgccttttgtaatgggactcagtagcagccccgagtgagtgaaatatacaagtgtctgcaataaattaacatagaattatttactttgtatatatagcttggggaagtaaagcaaacctattcctagtgtaaggacctgtttagatattatacagattgcgtgtaaattgcgagacgaatcttttaaatctaattacaacatgatttgacaatgtgatgctacactaaacatttgctaatgacggattaattaagtttaataaattcgtctcgcagtttacatgtagattatattgtttgttttgttattaatctacgtttaatatttcaaatgtgtatccgtatatccaatgtggcacgacaaaatttttcacccctgaatctaaacacagcctaaataagtcttactcttttccccctggtcatggaccggtggcagtaaggatttcccacgaagctcccttcctcgctagtttaccttcttactcacctcaatggtgtcgacatgaaagaatgccgaaaagatataaaagaacgatgtttcaaaaaaaattgaccattgactaatgaacacgcctttctttcctacaaagactgctacactagtacatgctgagggcacccacaatggttatctataagctctctacaagagatccatgtcagcatattttcctacttggaagagattaaatgaagagagagagcaaagctatctactaacatggagatagtctatagagaaaaatgaggcaatggattagagagctatagatacccatgtagacataccattgaagtggtttactattaatctagtctattgttgaggtgtacatgttttatagatagcaccttactttaccattgcgggtgctctgataatgctgcagttaaccgttttggtgtaaacacttaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaaatagcaaataattaattaatcacgtgctaatggactgcttcgttttccgtaccggagggatgggttcccaactcaaccaaaagaacagagccttacagtgttgttggagatgtagagacagaaaggttgtgcctttctaagaaaagagaggattgctgtacatatatgcatatggcaaatataccacgtcgttctttcaatttatcaagcagcaaaattattcaaatactcagattttgtaccaaggttgcacacacaataaaatttagttgggaagagatctgattacttccagtgattaacaaactagtaagtgaggtgataaagtagtgtagacaaggctagacaatggaagtatagtaaaagggtcaagcatcatgggctcctcctctgtcctgatttactgagctgtaggtgaatgccccgatgaacaaattaatttatcacgacatagtataccactaaaccatgtaataatcaagaattactgactaactgaacaatctacaagtaagtatggcagttcctggttgaggatttgtttcaaagtacgcactgcatcaataaagcttcgtcttttacgtacacaacacatcagaaatgcaattttatgatgtatattagggtgcaaagttgggcctttttacatacttgatgtccgtatgaggtcgggaacagattgatgagcacgatgaggaattgaggaggaggaggaggattatcttggcgccgcgcgcgttgagtggtgtcaagtgtggagctagtgtgcgtgggagcagagacacgatctgaagaaaccaaatgaatcacgatccgatcgatcctgccctgcctgagctcgtccctgcaaacaccgctggtttcttgaggccggatttgattcaaaacacatacacgcggacggacacagaagagaaaaaaaaaagcttcgttttttacgcgcagaacgcatcaaagacgcattttaatcatgtgctagggtgcaaagttgggttcttttacctacttgatgtccggatgatcaggtcaggagcgcctgctcctgctccgtcgaagcgagccgccgtacaccggcgtacgtgaaggagtggtgaccccgtggtcgaccgaggcggcggcggcgccgatgagctcaccgccgccgcgctgggtggacgcagcacagagagaggtggtctctctctctctctctttctctctctctctctctctttgagtctcaggtggtaaagcaacaagcgagaggaagacgacgacgatatatacgcgaggaggaagaagatggtgagctccaagcaatggtgtccgtcggatgagaaaggaaaggccaagatttcttccttcaggttcaggtggccaccacccacggtcccacccgcacccacacaggccacag

SEQ ID NO: 63361 - DNA, 605 bp, Oryza sativa
tgggctatccccacaaccaaggttcgtttacatcgtattttttaaaaataaaagactgaaaagcctcactgcaattcatagcggatggcccaacagaagtatatgaaaatagccaatctgagctatactattttactactaaaacccttacgttttcataattatgctcaagttcttacacttgtattccatatagcaccttaacatttttcaaatttattaactatagttagatactttatttgataccccatagattgataggtaattacgtttgaatctctcaaaggtaattgtgtaaatcatcatgtggttactctcgtaggatcacaactactattcatcctccttggaacattgaaaaattggattacgccaaatagggaatcaacccatacaccaaaaaatatggattatatgtcgaggacgacaagggttacgccaagcagggaatcaacccatacactaccagttgctgtctacgctatcaagatgatagtttacgctgcaaaaggtcaaattccaaggcttatacgcctacgcggccatctcaaggtgccctatatggtacacgcccacgtgtggatctcgggtgtaaacacatc

SEQ ID NO: 63362 - DNA, 12204 bp, Oryza sativa
gctagggtattctcccgactgacgcattgtgtttcagtttgcttttgcacttttacgacccaagcttgttcttgttcttgcaaatttgttctgttcccgatgcaaatgcaactgacccgcgcgttctttgtaccggttttctttcttctttcttctccttgtgtagcagttgatagtatttatctcttgtgtgtcgcctcagatggagaagaataagtacatcggagggggatatcttctttcagaagagggtaacttctcttttctttgagtaaagaaacattgcagtttgagtttttctttcagaagggacatgtagcaatttgagttgcatgctcaaaactcaaaagaggggaatgttgcagagttcttttgaatagcccaatgataggctctaactatacttcactgcgagtgacgatattgtgcatctcaagattccaactcctttcagctaaactaggaacaacagtggtgcttgatagctgttgttcatcaatgcagaagcgatttgaggaggacgagtggacaactatgttattgtatcttctgacaagagagtacaacatgtgaaaagtgatatagttgttaaggatgtgaaactgtgaaagaaagtttgggtttgctcagaggctctaggaggaagtcaattgatagatgaagcaaaagaaatggcaaggaagaaggatctagagctagaagcaggtacatctatttcagtttgctttgctctctacttctaatgatttcttattgtccgtgttagatgtttagaaattaagggtggcagtgggtctcagagtatgcaacctgtggaaatgatgaacatcattgagcaaacaagggtaaacttgtaaatgagtacagttaaacaaccccagcataagcatccctgcgactcagatcaagttgaccttggtactgaaatgtcacagaggagcttattgcagacaatgtagatgatgaaattcaccttgaggaagtaaatgatagtactttgaatgagagcagcttcccctggtaagcaagtaagaaaccaaggggggagggtcaccaggggtgggcccaaagttaaaaaggaaaggaaaaaacagaatataactcataatataccatgaacagtctacttgctacgataacattatgaacatgccaagcatttggggatctagagaaagtgtaaagagaaagaacaacagtaggtagggggttagaatttccattttgtccacaatgtactacacaatatctcttctttgttgcctccaatttgggcctacatggctactccccaccaaactcatgctctcttatattacaagacccatcatgtcccgaattcaaattatcattcttttccactcttgctgtttcctctgtattcttagtttcttactctgaacctgtggctgtctttccatggcttccagcactgccatgacaatttcttggagaactgacaggagaaacttgatcactggttagcagggaaccatagtacatgagttctcttcaactctgcttaaaatgtgaatggcaagatttgcttggcattgagatggtgagtttttgtgattttttttaatcattaaagaagacagtatattgagtgtaacttagtagttgtttatggagcagcttagtaaaatggaaatagaaaattccttactgagttagtccagatatgtaataatacgctgcatccgtagggagtaattttagtattgttagaagtgaagatgagcaaagcctggaagtttgttcagatggacttttcttttaaaattctgctgtagagcctaagattgattatagattggcttttaagtaggagacattttacaccgtctaatagcatttaaccattaggatccttgtatgtagcctgaataggattttgatgcgtcctgtctggaaatatcaattttcatttttagtagttacttcctccgtttcatattataagactttctagcattgcccacattcatatatatgttaatgaatctagacatatgtgtgcctagattcattagcatctatatgaacgtggacaatgctagaaaatcttataacctgaaacggaggtagtagatctttggaaagaaccctcttagatcatgcttcttcactaaattgacactataactcaactgcagttgaatccacattttaaatatgaactttcccaaaacacaattgttttgggaaagttttttatttgattttcagtttatgtcagcctgtctcagggaccagtaatatttgatcaatggcaggcacaactgagaaggcttaaataatgtgtttgtgtaaaaagttatattaatcggtttgaaggaaagtataatgaagtaaaacaaaatttgttaagacaaattgatgttttagacaaacattgtgatgttttagttttgtgtgtatcagtcaggaacagagaggttcatgttgagaaatgtttcgcacagctctcagagaagagagaaagaaagggacaaaatgatccaaagtgaaggtttcattgaggccggtaatacaacatatttacaaatagatgtacgtgggtaggatggaaaggggctggtctgaaacttacgaacctaattaatttgcgactttggggccaagagggcttatttcagtacatccttgaagctcccaaagttcagaaaataccatttccgtatgaactaaatagccacttcagataccatgtttctctggttagtaaccagacatttgtattctcttaaactataatctagttaggagaagtttgcagggcaatgagcattgtcagtattgtgggaatgttgaaatattcaaccatctattttcacaggccctctagcaagttcgtctgttcaatttcatttggcatccctaacttcccagcaaatgctcatgacctgggctggaaagtttttaaatcagaaagagaagagtttgcagtggttggggtggcagctgtattgctgtaatgtgtctctttgaaatgcagcctagcctgtagtggtataaaaaaggctcctgtttttctcagtagtcagtacaaaactgtctgatctcacctcagcaattttcatgtttgtcaatgacttgatttttgggcaattatgcagaatgctttgtcagtgctagcactagcaggatgctgctggtagaggttttcagtggtgaactggtacacatggatggagaattggcagtggctctaaacaatgtaaattatttcataattggcagtggcttcagaggtttgggcaataatatagcttcttctgtttcataatgcaggttctgtcctgggctgtgggcctgtgtccaaatcttattactgctgcattctcctgtttttgcatgtacaaaaaaaaaaaaaaaagaatgtgctatgcggttggccaggtggcagttggctgtatctaacatctttagcagacagattagtttctgttttccttttgttacatgctatgtaaaagtcatatggtttttataaagtgaatacctgtttctccatggctagaaatacaaaatgtgatctgcagtttgcttctctaaattttactagcttaccaattgaaattgtggatgaaggttttggtttgctcataagatctaggagggggtcaattgataaagggagcaacttaggacatacgaaagaccatattccttattgagttggtccagatctgcaataaaaataactaccctgtatctgtaggggtgattttagtattgttagaagtgaagatgaacaaagcacataagtttgttcagatagacttctatttttaaattctattatatagcataggattctttatggattggcttttaagtaggagaactttgtccgatcatttaacattaggatccttgtatgtaacctggagaggattttggtgagtccagtctggaaatgtcagtttttttttgtagtagttagatctttggaaataaccctcttggatcatgcttctttgcaaattgacacgagaactcaactacacttgaatccatgtttaaatatgaaaattgtgttttgagaaagttatgtatttgatttcagactggaatatagaggcccatgttgagaaatggttaacacaattctcgaagaagagagaaagtaaaggaacgaaatgatccaagtgaaggtttcattgaggccaataataacattatttacaaatagaaataaatgttcggaagggaaatagttttgcggtggtcggggtggcagctgtattgctgtgatgtgtctttttgaaaatgcagcctagcctgtagtgctaaaaaaaagctcctgttttttttctcagtaaagaaccgtctgatctcacctcagtaatttttcacatttgccattgattgatttttggcaattatgcagaatgatgtgtcaaggcgctggcactagcaggatgctgctggtgactttagaggttttcaatggtgtaactggtagtggtacacatggatgtaagttactatttcataattggcagtggcttcaaagttttgggctataatagtagctgcttctgtttcataatgcaggttgcctcctgggttgtggtcaaatctaattgctgttgtttcatgatgcagtttgctgtgtccaacatctttagcaaactgatcagtttctgttttccttttgtcgcattgctgtgtaaaaagtcatatggtttctataaagtgaagacctgtttggttcactaaattttactactagtgtatccgttattgttgtgggataagatgatcgtgtttgattcacgtgttacagaaatgcaccctgagctgacttcttacattcatgcacaatgtatgaaacactgacaagaagttccacagtttattacaagtatatcacaccagttaacaaagttctctgtctgttttctatgtaggtatcagtatattatggcctacctattttctaaactatcatgccactgaagaactactctggatatattttgctgtttcagcataaatcaaaatatgcatgatccttacagtcgaatgacttaactattatcaagttaaagaaaaatggatttaagactgttttaagaaatttatgtagaacttttttttttcaaaaatcacactgtttaggagctcagaagcgtgccatcatgccatactcatcagctcatgggatgtccaagaaaaaaaacatttcaaataaaacactacaccattacgaccatccattaagaaccaaagccacggtaggcagaaatggacgacgaggtgtaaggttatatgtcaacgcatacatgagaatttacattccgttactctattctaaaatttgaaactcaaaatttatgtttaaataaacttaagataggttaatagtgtagaaatgtaaagatgcagttccaactcatggcttgaaaactggatcaaaaatatcttctggttcatctgaatcatcaagaccctaatccaatcatgataacaattagtcaacaattgagaaattatatttaaatgcataaaatttaataaagaacacagcaaacctcaatcatccttcttatcctactcgccttcacttcctcttcctcatcctgtggaaatggaaattattgtcattcattaacaatgaaacacaaatttttgtttaactgattatcataaaaaagaaggaaaacaaataatcacacctcatcatcatcagattcagattcagtccaattttcagtttcaaatggcataactatgtccttgtgaccgcccacatatgtatcgctatcatttgggtgcttcatatccagatttcgatcgttcttgcaaccatagcagatacctgaatatgtctatttgtcagataattggctatcaagtcaccagttgggaattaaaaaaaagtaaaagatgctatctaccttaatagaattgagcaatcaaatacacacaacacaaataatccaccaactcaagaaacaacatatgtattacataatgatagtatatggaatgaaaaagacaagtgcacaccatacaattggcaaccatcttaaaagtaattgtatcacttgtatcagtaaattcaattagcatggaacagaaaaatgcactaaaaccaatcttttggttgttaataactcatatgtttgtaaaagtggtctcttcaaatagttattaagggtgtgtttggttgagtggatggggttggatgggacatggctgccaggatttccataggctaaccaaaaatgacacatgacatatgaaatttaacattgttccttataataatatatgcccattaacaggagcatttaatttgtgtaaaaaaaacaggagcatttattttagtacaagtagggcataccattatcagcagatttaatcaagcagcaacaagtcactacccaatcttcctccccttgcgaagacatcacttcagcaaaaaataaattgtcaatatcagctccactggtctttgctgtgaaattgaagtgattgaaccacttaattccctcaacaatcaattgatagtgaacaacatcttgaagctcataagcaagatcctacaacaaacaacaacaggataaaatttacaaagtgttttatctccaagacttgtaatccacgcaatcagaaaaagagtgaggatgagaagataagcaaacctcaacaaggtcatgatcatcattatacttgtctaatagcacttgaaccatttgacgtcttctcttatcaacgttttgactagcttgtgatctggaatatttctttctagtaccatcaggccaataaagtgatttttgtatcatcctctccacaggagaaactccatcttgctccttgaacctaattggaatcacacaaactaatgattaggaagatgtacgtctgaagtgaggcatataaagtactatagttgtcaacaaacaaatgatatcacttctcaaattttgaaactacagggttgaattggctattttctaaacaaatttccatgatcataagttaaagtgtaagaagtcttcatcctttatattttacatcccaactccttttttgcttgtggataggaataggttcttcgcatggcaatgctttttttttacaggaaatgttccaatgttttcatttgcaggatctttttactagctgaccataaaacaagcggggtttatgcttacttggtgaactttcttgttatgtttctagttgtgctaacaaactcaatcagaaatgatggattttggagaccataattttttcagtttctgagctatctataagtgactaagtgaggcacttttgttcagtttgtaattcatcttttactcgtttcgtagggctaattgacctaggactgttaaatagtgtatagcaagtgcagtacacaaaaaagggacaaataataagctagaaccaggtttagaaaaaccttacattggacacttcaggctctcaagatgacgattgatagcatcctcagcttcatataagttcagaaatggtccatctagagcaggatatgtgtgaaaagatcctccacgatccatcctaatgtgatatatccatggccagtcagcagggtctcttgtccaaatggttgattcaggagaagtgtgatggcggagccttgatgatggtgagacctcgctagtgccatgtggtgcggatggtaaggaagaggtagtagcagtaaatggatctcctaatgttgtaggttcaggcgactcctccatggttgcaacttctggttcttcaagcgtttgttctaatgaaagctgagtattgccttcaacatgctcctcacacctaaattagaacaagcccaatattacatataattattttttggatattgaatgcataaagacaattctattaatgccattccagaatgacctgaaagtacataatgctacaacaaaactcaaactaaatcaacacaactcctttaggctagctcacacttttaaaccatcaaaagctcaaagatctttattccttaaccccgtacaccggtacacacatcatgatttttcttttcataaaataaacagtgtgttgcttgatgtgccatctttcactgctcaagcactttgatacactgtaaaactagcaggcatggttctgcaacagaaagatttctcagggcaaccatgatgagtgatgtcgcaacaggtaaattgaggagaatagggcatgtaggtaacagcctgacaggttgagttcatgaactgagaacaataagaggatatctagggaggtacaacaagtgtcatggtcagaacagcagtaatcttaccggatgaaaagactgttaattgggatgcaattaattatggagggtgggggacaagcaaaaaaaaaaaacttttttttaagtgcaagtcattggaatgaccagttttgttgtagcacaatcaaaagcttgggatttgaagtgacatttgtattaccaattgaccacaaatcattggagtagcatacactattatatacctaaaagcacattcactgtgctatgccaagtcagggagaaacatgctaatggctggggctaaaaaacaacatactaccctctgccgtcagtagtgaaatcggcatcagaatacatatgtaaattttccagtgagaaaaataattgttttgaaagcaatgccctggtaagatttgagacacctaacatttgcaatcaataattttgcgctctagagctggacctatttcacgatatgcccatttagccacttgattcacagttctcttttttcccccaacaaaagaacccaaatcccccccgtgcattcgtatgaattggctcagtccctgtccccagaccgaaattgactcatccaagagggttgtccgagcagcaaatagatggtgaggaagacgaactgaactggaagcaataatcaagcaactcctccaaggaggaaattttctggttggttcttgagcaacttcaacacaagtaccagttacagttagaaagagagaacagagtgaggtgagaggaggtgatggccgtactgtggaagcaggggcggcggggctggatcacgggactccctctgggggtgatagtggtcatagattgcgcccaagagctcatgcaagcttgggaacggctcgccgggaagactgtatcccaaggcgaaatacccgcgagaattgcgtgagactagtatttgccgatccatgaagggcagttcgacgtgcagagggggcggggccatccgagccctcctagacacgcggcgttgcctccgtggagggtccatggatgggggttggcgccaccgcccaccggccaccggtggtgagggcgtcgccggcgaaccggggaggaggaggaggaagacgacgggtggcggggaatagggtttcgtggggacaaaatagcccaaaccggcctagtggatgatgctgttaagagttatgggcccagagagcccatttggaggatggcccagtagcccacaactattttcctccctaaaatgcagctcactatttcttccttttctttaaaaaaaaagggtcgtgttttgtttcttgggtttcggattttttttagttttttacttgttttaatccattaaggtatcaaagatcatttaacaatagtatatattaggcgacccctaacaaaccgggatcatgcaattaattattttgtgatattagattaagtttgtaactaatgaacccatctaagtttgtgtttacaatcttcgctttaattcggcccatgctgctagaataaattggcacgctcgctgggtaggttgtctatgtaccaacaattaaaactatatatttaataccgactcttaatgatatttttcaattttcatttttccagtataagctgcaccacatattatttacctgaagaaattcgttgtattttggattaaaaaatccttatagtttgcagttttagatatgtttcttgctgaaaatcatatctaaagcacgtaattaagaagattataccattggataaatcagttcataattaacttgttaggtgtataaaaaaactatgtccttctaatatatcgataaccaagcctgttgcatcttcgaaaagaaaatagaaaggaaaaaaataaataaagttgcaacatgctaggtccatgcagagatcgatcgatcgagtacgtaccggtgttccatgacgatgtttttttgcggcagctagccgaggaatatctcgatctcgatcgcagctaatagtcgaggaattaagacgacaattattaattattaatcaattgaaacgttctgctctgcttgatttattatatacagatgcctcgctagaaaccgtgaaggaatcgtaatcgggctatatatatgaatctaataaactgtacgtatataccgtataacgtagagtaattaacgaaccacatgcatgtcgagtccgatatttatcacaaattcacgagcttgactccataaatgaatcggatcgtttcatcaacttgaaaattcatccgaaagattagcagaatatgtaggggagacgggtagtaggccgattgggcctgatattattgtctgggggtccatggtttcctaattaaaagcccgccaaggtattgtgggcctaaaagagttgaaaataagtccaactttcttccctcacctttacgcggagttaaatcgacattcataaaccataatacagatatcttaaccctttaacttacaaaaacaggttaaattaggtcctatgactatacggatgtatggtttcgctaagggacaatttcgttcatacccctactttcatatccaatattgattttaccctcgttttctagggttttcgtttttctcccacttttttctattgaatgaggcgtttacccctgtaagaatggtaaaatctgataaggcgcactgtaagagttactctctccggattgataatacttgccgttttggacaagggcacggtctccaaaaaataacttcgatcattatttttcattgtaatatgtataaaagcaaagtactttataagattaatctatacatgtagtcaccatatttgaaagacaaatatttttaaaatgattcataatcaaatattctaaagtttgatcttatccttatctaaaacgacaagtattatcagtccggagggagtaaatagactatctattggaaaatagtatatttttaatccttaaatcctctttagagaatcttaaaaaagatttaggaaagagatttttaggaatcttagccatgctctgagcaaatcaaaatttaaaaattggccactgaagtaattaaaagccttagtacttactaaacaatctagaaatagaacagaagagttattttgcttgcacaggaccattccaaaaccactatactttccaagatagccattgaaaaaacatcataatcctcctttaacaggtaaagctaaaattcgaagatcaaccagcacaaccactcaaccaggcgaaggcctggaactcaatagtttcacaccacggtataaacgagcaatggacagcgttagtctgatgctgttgagacacagaagtcacgtaccatatagtattatagtaaaatggcaggttgtactacataataaccaaaactccacaaattcctaaataacatgaaaacgcactactacaacacagacacggtagcataaaaatggttctatactcattaggagtacgtactcccgctcccattccacctcaaccaaaaagttcttcctgtaaacctgtttcctctacatcaccaaaaagtttttcatgcaaacctggttcctcaagatcctaaggaaaaggcaacagcaaacaaacatcaatggaccatcacgagagtaactagcaccatattacatgtgtaacaatatacagtatgaaacatttcatatagtacaaatatacctcgtaaagttttcttatcctctgctcctctttttcttcctgtgaaaggagcatcagaagcatgtcagtatgccactggcaatgaagcatagcatatgcctacatgctatagacagaaaaaaaaaagaggggtggaaagatgggcttatcacacatcttcagactcgctcatctcttcggtgtcataaattccacaaagatactcatgtccaccagcatattggttagtatcatttgggtgcttcaaattaacattctgggctgcaggaat

SEQ ID NO: 63363 - DNA, 9533 bp, Oryza sativa
gggggggggtgtggacttggactcagcaacaggagcgggagcgcgcggctgggaacgggaaagcgtgtttagcctccgcaccgagtagactttcttttttgtttacccggtaacagcgcatgtagctcaacagtgtttcttacctgatgggtgttgttgtcacgttgcgtcctgtgtgtctgtacgtgatctcaagatagcctctgcctacctatagaaacgaaaaacatccgcttgtcaagcattgaaattaatagtcacctctagttgttttatatgtgcaacgtattatctctatcacacttgctccagtacattatcataaatttattttattgttcactcttacggcaggtacaatagaagactataagccagctataaacacatttcaaaaagataaaagggaagagagaagagcagcgagctacatatttatagtcagctgcaatatgaactccaagatacatgtgtgtatgatagatgtaatcagatattaattatgtagtatatgtttatatgtaactattgtatgaattgcctattaaattaactatggatgatttggagctaatagttagctatactattaaacttgctcttaatctattagggcccctttgatttgcatgaaaaacataagaattttgaaagatttcattcctatagaaaaaattcctgtcaaaacctatgaaataaaagatagaatcataccatatcctttgaaaatcatatgaaatggacaaactttggaggaaacttagcaagaactccaacctcttgaaatttttcttccagcctatctctttcatctaattccaacgattttcttacgatcctatcaaatggtcatccttatatttttttatgtgttttgtaatcctttgttttgtacttgcgttccattcagaatcatgtgtttttcctattcctctatttttccattcatgtgatttaaaggggcctagtttatttttcatctcttttagagcttatgcaaaggttgtctcttacacaatggttttagtgtaattttttagttccatcttatatattataaaatgtttttgtcagggttatggataccacataactaatagtagttgactaaatctcggcaggacccaccacataccatgttttatacggaaacaatcttcgggtatagaaggagttccggataaggaaagataaatagagttctgcatggaaacgacaagtactactcggattgtatccatattgatttcactagttctacttggacaaggggacacctataggtataaatacaaagccccctaggaggagaggggacacggaacaatagatcaagacacaagatcaacatacaagccaatatacgccaagacaagccgccggatatcgacatcggagataagcctagttagtccccatacggttcctatgactaccgtcaggagggatctagcgctgtctctgatctcgtcggacacggattcgaggaggaagactactctgttgtcgactacgggatggttttatggccgccaagttgatgacagatagataggctaccccaaatattgtactggtatgattatgatgaataagagcaacgaccggcttcggccaataggattagggttattacctgacaattcaggggcccgaacctgtataaaaatcctcgtccccatctcttttactacaatctcatatattctagtaccaacgatctccatactatgcaaataccagaatcgcgacatcaaacgtcgacagttttgctttcttcaagtaagtttaatcaagtttataaaaaaatctagcaatatctacaatatcatattagttttattagatctaacaatgaatatattttcatagtatgtttatttcgtatttcaaatgttgctatgctttttaaaacttagtctaatttaaaaagtttgacttgaaaaaaaaattgaaagagtcttgtagtatgaaatcaagggagtattgtttaacatgttgcctctcggtagcctctcacgctcaatccagttttttccgttccgtgtaacaggcgaaaacaatgacaagttttcgccctcgtcatatccctctcctaccagcgcaacgaagaggatgtcacacaaaggaaggtggcggcgacgtggatctagtgaggatgttgatatgcgaggacgagatggtgacagaaggcgagcgtagggcgggatggcatggtgacaaggcgaggtggggagctgtcgcggacatgacttcctttttgcgcgggagggctgcgctatagagaggttgtttgcactagtcaccattacgggcttccttgtcgatagccggatgcgcaacggcaggaggctacgacttaggggcgcaattagtggcataggtcgtgcgatccatccctggccacaacaccctcaggcatgtctccttgcttggcctttggtggcttttgttgtcagctgcaagtccgttgctaattgtcgtttgcttgacccgaccgtagtggccatgagcacccaaagactaacatcggtgacgcctttgggcatcaaacacttccctaaaggtgatgatgtctcagcgccccttctgtcatacatgccatgagtggaatcttgtgacatcctagcccaaataggatttagcatgtgtcagccatgagagctgtgtgcgcatgtttagtaccaccttactaatttagtaagggtcggtgtgcgggcatatggtgcatgtgggctctatgtgaggtatatggcatcggcactggacgtacggacttgcattaaggccctgtttctttcagcttgggattattataatctagattattaagtcagattactataagctagattgttataatctgcagtagaatagattgttataagcggttagttgttcccttcctagattattagagcatagattattgggtttgtaagtctaaaaagggagtggggtggcatggtgggtaatttttcatccaataatctggaaaaagctcacctaaatgagcttatcatattataataagctgggctccagattataataagctacttcaataagttatctgtttctttcagcttactcccaataatctggattataataatcccaagctgaaagaaacagggcctaagaagggacatgttactggacatttgcttgtatagttgtatgcttgtgtagctataaaggttcacgaaacgaggacgaaagtgtaagtggaaaggtgtgtaagtggacccgcctatcggatgggatgtctatgcggttttggagggaaagttgtttgcaactctttgagtgaaaacctagcgatgatggtatttaagatgtcgcaagcttcctaaagacattatgttagatgttccttgatggtactgcggtttccctattagattgggttcatttggtggtggtaagatctagactaatgattgatttacaactcagataatctttgatgtttgatgccattcaccagcattgatgggagctgaattcaatgaacaaataattgaccactagttttggaaaatttgtttttctagtttaagaaagataaagtctatgtacaacttgtaagttgtttggtcgtggtaagatctagactaatgattgatttacaacttagataatctttgatatttgatgtcattcgccagcagtgattggaggtgaattcatcgacaaataattgaccactagttttggaaattttgtttttctggtttaagaaagataaggactacgtacaacttgtaagttatttggtggtggtaagctctagactaatgattgatttacaactcggataatcattgatgttcttccacttatgtttgatgccattcaccaacagtgatgggagctgaattcatcgacaaataattgatcactagttttggaaattacgtttttatggtttaagaaagataaggattgcgtacaacttgtaagctgttgctagaaacaactgttacgcacactatgatcaacaatggatagagttctctaaatactttagggtggacttcttagtggtcatcttgtttttaattaagctgtaattttgtaatttgtagtcatttatcatgttgtcgaggagtgatcctctctagcgggaggacgtgaggcccccctttgtgagttcggccaggggatagggcgcgatgatcaagagcgcatcttcgccgtggatttggctagtgtggtggatggcgatcaagagatagaccagggattatttaggttcgggccgctgggaagcgtaataccctactcctgtgtgtggattcatatttatgctattacaagagtgttaacagtgaaatttggtaatcggtaaagacgtcatcggctaagaatcattatcggctgcagcatctcggaatcagccgatgggagttatcaagtcgccaatagtcgaattcctgctatattcggttaagaaaatcaatctactaaaggaagcttatccctaagtgaccgagtttaaagaggatgcggcatgacagtttatctattaattatgaatagtttgttagtttccttttatctttaggaaagtgtgtttagtgtccgataaggactttatatttttcttttatctttaggttagtttctttcttgtccgacaaggacttgtatcaacacatgggtataaatatatacacccggggtctatgtaatctatcgctacgatcaatacaattcagcgcatcgccaccctttttacttctacttttgttttttacgttccggcggaacttggcacccaggcaattgtctcatctacatcggcgtcgttcaaggctgcatcagtacattcgacctcttggattgctctggtttggatgatatatttgcctacctatttattatatgtctctgttaatctagtcttagcatatcaatttagctctatcggctgtctctcgctttagggtttctgccggtatcggctaaatcgccttgctagattagattagcataggtatttaccaccctgaaaatcagtcatcggcttgattgtctagatattatgtttcttttcatacttagtgctgcatcagttaagtttgatctactaagtcgtgcttagaaccataatctctagcctgcttattgattgccaataagggtttcatcggggtttcagccggtgagttatctggacgttgcattggctcatgaggattgcatatacatataagttggatttagccgatgacaacaaaggtttcactgtttaatataatcttgtggatttcatgacatcggacctccatccgatgtgtgctttaaccttcggatcgatgcttatttatcatatcattgctagccgattggtttatattggattatattgttattttattacattatcatcagccgattgcctttatagcattatctacattggacatatagccgattgcttaaaccctatcgctatcggctggtatcgacatcggctattatcgactatcagctggaactactccataggcttgtcagccgattggctgttttgatctactatttgcatatcttgtcagttgcaggatcaaactgactggcacgcccgcatctcattatatttggacctgcactagagctaagcagatctcccaggccagtgtgttcgatttttcgtcaacaaagagatctcaaaccctagagaaacggttgcttgggcaacgcgcgacctgccatgccgctttaaatgcggcggaggtggttggggcgccacccataaatgcgcctggcagcgtcccttcctccgcctactcagctgcgacgtggcagccgagtgagggcctcgtggtgatgtagcccctcgggcccaaggggtgtgacaagacgccccgaggcccctatatagttacgggtgcctcttagctacttattacccgcgcgcccgacctcccatgaggggcccaggccgtgcggccacgtggctaggaggaaggaccctttcccctcagcgtgggtactccgggcccatatcaccgacacatgtgaactctataataattagttataacttgttttacttaagtaatggctggaataaattcgattatgaaaaatgaaatgaaacatgaatagtggagggttcctctgaccgttttaatgtttactgtttttatttagaatttcataaaaaaaacgatgtaatactgacatcccttaaaatataaaagaaatgctacgttttgtcggtgctgatgccacatcatcgttactaagtaatcaaaatagttacctcctactttgaatttgtaaaaaatattgtatatggtgtaaatatactgtaaatacgattgaattgctcgccattgtaatacgtatgttcgaggttttgttctaaatttctaatagttatgtttctgatattctctctattcccactctacagtcatatttaccattgtcatgcccgtgcattacaacgtgattaaaattatggagttcagtttttttttatcagtttttgggttgattttcacgtgaaaacacttttttaagtgatggtttattggttgttaatgtgggatgtacgatcgaatcataagaactaagccaaccagagaggggtgaatggttggtatacccaaaaaccgaaaacttttagcggaaaataaaagttaccctcgaattcgacggaagtcggtctgaccgagaatgatctgccgagattgatctgccggtctgactgaagcatagccgctggtctgaccggtgttgatcttccggttggaccgccctagaatccctgccgcgtctgatgtcgccgccggtttgaccgccgcttgccgccggtctgaccgccggtgagttgtaagttagaccgccgaaaaccggtgaaacacaaatcgaagaactcttaaagtagatgacgactttattgattctatctgtgtttacaaagtgcaccaacagcactatttgcaaaaatttcgactaaactcgaaaccctaactcaaaactcaactcaattgctctctaaagcgatacagggaagcctcatgctccccctctatttatacatgtggtaggcagcctaaagccacgaaccaaactcatactaagagtactaaacaccttaggaaaccctctagtacaagaaagaaactttacataaccaatcgtaccaaatttggactccttccaaattcgactccgcatcccatacgcacacaatacctccatcgtatgccatatggaatctccatcaaccacgtgcatcaactctagcctaagtatcccgcatgattatcccgcatgatctctgaccaccacggacgtcgtcttatccccaagtcgactcccggtccatcactgcaaatactctcccgagacatcgagtcacctacacatgaaataaacaaagaaactatatttcgagaccaagctatctccaacttgactcattagtagcaaacaatattattacattcgtatagtatccatctagaagccttaatcatgaaataatcacggatatccaaacaaacaacccgaaaccgaaaccgacacagcgtcggccggtcagaccgcgggctagccagtctgaccgagcaaaacacgcaggtctaaccggctaccagcgcccagtctgaccggtcacatgaaataacaaatcctgcgatcacctgtgaaatccaatcctgtccaaaaccgcttcgtgaataaattccaaatatcaaaatcaataatctccaatgcccaattgttcatcacagaataataatcaaaaacacctttgattttacaatctcccccttgatgaacacattggcaaacccatcaaaattgttttggtgtttggaaaaataaaaacaaaagtagtaaaaagcacacttcgtacaaacgtacacatcgtgctcaaaaatccaaaagaaaacttctaaaatccaaaagaaaatttcttcccctttttaaaagaaagaaattcccaattgaaccaaaaacatgctcttctcaacaactctccaaaaatccaaaaattttcacattacttcttccccttttgacaatgatttcatcaagcatatgaattacgttcattaatgttcaagtgcttagcatacatatagcatatcaagtcatgtgttgcaataaaaagaagatgaacctatctataatatacaagcatgtattaaagtataatcatgaaccaaagattttacaattaagcttgaatcaacaatcaaaattgatgatttcatatgatttataatggaacatcttaacaagcacataggttgaagaataaacactaaatacatatacctattgcatttatcactctttctcaaataacctttagcacaaaataaccaagagaatgtctttaactttttcttttcttgagcctttttgctcatatttttctcttttattccgggtacgtccctgtcgtcaagactgtttccagagattcggcacccattattttgctcacatcgaatacgtccttgtcgtcaagactatttacaaggattcggtattcatttttttcatattttttattctctttttcacaatgagcaattaaagctatttgaggaataacaagtcaataaagcatatatatagagcatttacaaatcaaaccgtatgctagcatcaacattgcatatttgcttaattcaagtagaatttaagtgtcatgcttcatctcccttaaaagcaaaatctaaatctcatgaaaagattagaataaatacaagctatgctagagacaaataaaccttcaaagtattgttagtatgcacaagaaaataccatatgcataaacaaagctctcttttctcaattttttcattgtcatattattgcttgataaaaccatgaggtacaaactccccctcaaaccatgccaaaaggatgaattatgcccaattcaccacgaagaaaagcaaagtgattagaatccaaaggtttagtgaaaatatcagcaatttgcaactttgtgtccaaaaactggaactcaacatctcccttctcaacatgatcccttagaaagtaaaaacgaatatcaatgtgcttcgtgcgtgagtgttgaacaagattcttatcaatgttaatagcactagtattatcacaaaagagaggtactttctcaaaagtaagaccataatctttcaaagtagataaaagtcaaagaatctgtgaacaacaactagcagcagcaacatattcagattcagcagttgattaaacaacactatattatttcctagaagaccatgcaatcaatgatgtaccaagaaaatgacatgttccactagtacttttcctatcaattctacaacccccaaaatcagcaccggaatatccacttaagcatatagaagatgaagtagaataccaaattccaaacttaagtgtatgattcaaatacctcattattcgcttgactgcttgacgatgtgaagcacgaggagaagcttgaaagcatgcacacaaacacacagcaaattgtatgtctggcctagaagcagttagatacaaca

SEQ ID NO: 63364 - DNA, 37701 bp, Oryza sativa
aagtttttgcttctgaaaccggctaactcaatgttctcaatactgcccagaggaggtcctggtagattgagtagccgatccatcattagagtggatgtgatttggcctcgacattgaatcttgtcggcaaagaataagccgattgggagttggcctaatccaagttgcctggctgagctcattggatgataaaattcataagacacctggtgtttcttccttgatggatgccgacggggtggatgcaagggctgattgcagctataaggatttctctggatttctggaatttctcgtgatttatgtcttcgaacctgaaatctgatgggattcaaggtctgttgagtcttcatatgggaaccagatccgagcatctttcttgaaaccttcgtagaagctacagaaccagtccttgagcagctcagccgatagctttgctccagcgtcggtaggtgtggatgcatattccccgtatgatgtgcacctgcgatgtgtgcgttcttctccatcatcacctgtaattggctctggcagtggaattcagcttttgtcacaggaggccgattgacaaccttcataaccattaggtttaaccaggtctgcagtaaccagcagggtccacctgctccaactgttgagccgacagcaattttagctgatgcattgtttagcatttggtacaggtagccgagaagaatttttcctagggggaattctttctttgattccagggcttcggctacaaattgccagttggttgtggggccacaactggatccacagaaaagaaatttttccagccacatgagcggaaaggctacatgctctcggggggtgacagatccttgacccatgtatgatgctacatagccagaccaaccacctatgtttttggtcttgaaatcaaatttattccgggtgtttttgctcatggggttggccgatgaagtcacatttaatccggtgatcatggtgatatcgattagggttggagtcattggcccttggttgaataggaaagcattgatggtgtttgaccaaaagtaagtggcggcagctattaatagttcatctttggcagagttggctatagttaaggcaagtgcttggccgattccgatctcgtcctagtgaactttcttgctagccgatacacgctgataccaagtggaccagctcctgtcaggcgaaagtttctccaaagatggccaggacttaaaggtgttcttccaatgacctaggttgggattggctagcctgaagggaatccggttggtttcaccagtaatgaaatcggtggggtcgaggctgccgattggccgaggaaatagtggtttcgatgcgaaagacttggattgcgacttgatgagaaaggtgctataaatccagaagcaatggaaaagggagaagcggtatgagacgaaagaaaatcaatgtattgctgaagaaggagggatttagccgattggaacttacctcagcgtactcagttgttggcgcaccagaagggctggcggaagaagacatagctgagggcagagatctcgtcgagaggggaatcgccggggagtcgcctttgcgtcggagaagtcgccggagaagaaaggggattggatttgcttaagcggtggaaacggaagttacggtgtgaggtttctcgggggtgacggttaaatatttaaagcacggcggtaacggtcggaaacggtaaaatgcgaaacttactcggagtcggcttatagcaaatccggaacattatcgaatatcccggacttggggggcatgtgttaacaaccaaatttggtcagtattcgtatcaggaaaagggacttaatcggagaagagttggagacgaagatcaagttctagaacagagcaaggatcggctagagtctggatcggctacggctaggatcggctaaggttgagctaggctaagtaggctggtatagccgattctgataatacgacttatgcgcgacgtcgggctcaggttgatgtgcttcaagatgattgccatgtctggatagagtcctgagaaggcaattgtatctattaattagattatttatgtaaattccttatagataagtgtgggcaagagtctgccgcaaagactcgtgatattttagagtttgttagagataatggtcgtggccggtacgggcatatcttgtaatcctcgggtataagtagaccccgaaccctatgtaacgaaatacacacattcaatacaattccggcgcatcgccacctttcgtttttgttttatttcgacgagttcttgcttccgggttgagctgcatcggtttcgatcttcaacaagaggtaaagctcgttatgacgaattatgttcttagggattagtgcttacatcttcatgatactctaatctcatttatataattcgccgagttatcacatatcttacataatcttcaacaatatctctatctaatctattatcggctaacatttgcatgcaaaagacagccgattaggttagatctcgatgttgatttggattatataagatatctaccattctatgaatcttccagtggcttgattgtctagatattgttcttcttttcatacttaatgctgcatcagttgagtttgatccattaagtcatgcttagaatagcaatctctagcctgctttctggttgttaattaggatagtatcggggtttcagccgatcttatctgatttaactatattcgctttatatgtcgcactgatatgttaaatctgcctttcatgtcaagatattattgcatttacatacattaagcttttgtttggtatattctgcttgttataatatcttaacatagaattgcatcggagtattagccgatgcatgctagatttatttgatcggctatgctgtaaacgtatatagttctgttattaacatatctttcagtacaagtgatttatactgtctcggcatgatggccgatctatcccaatcacttaacttaagtatatgtcgatataagaattatgtattgttaatatctacagccgatcgaatagatttagttctttattatctattttccattgccgatcgatctatatatgacatcggctcaaacgtaaatgatatgtcatcggcacctggccgatcggatatcatttatagatttaaccacggttcttttgtctctatttcttgttgattgtaggatcaaatcaactggcacgctcacgtatccgaaggcgagttttggacctgcactggagttaagcagatctcccaggcctcgtgttttctgtcaacatggtgtcgaagaggtgaagcgcaaagtgagagcataaagccataagcaggcctgtggtaaaaatggaagggggggagagaagcggtaacccggggtggggttatataacctcatcgcgacggttcagcttccatccaaccatatcatgacacgtgttcggggctagacgaaatggtaaattcccatcggaccggaccggggcagaacagtaaaaggcagaatgcaaggatgggaaggcccacggggcccattactattcatagtagtttaaagaataagccaaccttttcaccacttgctggcgaacatagcaaggaaatcccccccaagaattttttgtatgaacatggaagcgaattatatatatattctacaggtgtgcagcataggtttcgacaggaacatcggccaaaagggggcgcctcgtggtacacctttcaatttgcacagtctcggccgaggctccctactcacccttgcccgtgaggggcttgttggaggtataccacggaaggcctttggccggacctgccgaaaccaaggacctgggtaacaggctcggaccggcagtaagcggcgaaggatgaaagagaaaccacatgggcgaaggccacaaggcgaaagccgaagacttagagtacgccagcttcgtcagcgaggtcgacctcgttagagggccgcaaggacggagatggtgaggtgaaggcctcggcgtcaaggcacgggtttcaccaaaagtgccgaactacgccgccaggaggcccaacaggccgccatgccctcggggggacttcagcaaatagatgggcctagtcatttaagcccaatagaggcccttacatgtaaaggacacggtgtgccctcaataatgtcactattataagggtaactatgtaaattcccctgtaaaacctaaaccctaataggggaacatgtaatagagctataaaaggccccctagggccatgtaataagggatccaaaaaaaatttcactaagtaatacaattattctttatttctaaccttatttctaaccactgttgagagaaccaagactttcgatgtgacgcagttgtctattcgacaacataaggcgtaactgctttttcaccaaattccctaatacaaggcggcaacatctcggctaccgtttgtgcatgcaagcattgatgagtcatgtactggtgcatgcagaataaaccaactcttgatgatgtgcatgctggtcattcgcttggaaagtgcaggtgtcgggtggatgctgcatggtggttattgctggcgaaactaccgaaacatcacacatgggaagaagagaaattatcggtgcaactgctgttaagggcacccacaatagttatctataggctctctacaagatatacatgtcagcatattttcctacttagaagatattaaataaagagatagagcaaagctatctactaacttagagatagtctatagagaaaaacaaggcaatgcatacgagagctatagatatccatgtagatatactattgaggtggtttactattaatctagtctattgctgagatgtacatgttttatagagagcacattactttaccattgcgggtgctcttagaacgattttattggtttttgtgttgtcaacaggtgcgccctacattaagtaactgagggagtatggatcactcaagagacagcactgccaactgccaacgcataaagagaaagtacaatagcaagctagtataatcacgtatcgagaagaaaagagaagagagaaaagaaagcggactacagatttatcgccagttgtaacacggactctaaaatattatctgtgtataagaggtgggactgaatattaatggtgtagtatatttctatagttaactattatatgaataggctattagattagctatagataacttagagatagcagctggctaaactattaaacttgctctaatgtaatcaccctcaggacctcaacgtacatacgatgatgagcaagtttaatagtgtagcccactactagctccagattatctataaccaatgtaatagccaattcatataatagttgcttactatactattaatatctagtcacatctgtcatacatacattatattttggagttcgtgctgcagctggctacagatatgtagtccgctgctcttccccctcttactttatctttttaaaatatttttatagctggcttatagcctattattgtatctgctctaatcgtgtttgctttaaaagatggtaaaggaggtttccatgattgcgtcgagtggccattattctcgatggcagcaaagaaaatatatgtaaacatcactaactttggtgcgtttgcgtgaaagttaccacagcaaatcaataaaataagtaccatctgtttgtttttaaatagaggacgtcggttaattgttaaatacatatttaatcattcaacttgtttaaaatttttatcttagaggtcattcttgaaagtacgtacctgtggtgataaaataactcacaataaaattattaacaattatatattttttaataagacgaatggttaaacgtgtgactaaaaattaactgcatcaattattacaaatgtggtatattattagagtggctactattatatgaaaaatataactattttttatcatagccgctgcaggtgtataacaaacagggctatacttttcaaaggcaaagacaaactttattttctaagaatactataaagcccatgagcatgaaaaacaaattaaagctattgtcttcaacagaatattgctattgaaaaacagagagtggttggtcatgaccactatactagggtttgatttctggtgtaataccagcaatttactggcctttatatttttagcctatggttaggcaaaggtacatgcagctgtttggtgggtagtgatgtttgcacgtcttttgtatattaatcgagaaaaaaatatgaatggcctagcttttctgaaatgccagcaatttgttgggcttgagcagatgactcgagttgcgagcttgcaaaagtaccattgattcggcccattatcatggttcgttgccagcagatgaacagaacctagtttgaataagttcaccttatgtctctcatctcgacgtcagtttgaatcacattcttagatcacaatatcagatataacgtgtgttagtgatatgccctaaaggcaatcatagagatgattgaatcacacactatgtttacatatttatccgactttgtttcttgaaatagataaactcattattggttaatgaatatgtgattttttcatgagactctttatgttatgtgttgctatttctaaaggatccctgatcaaatatcatatgttgaacaatatgtttagataatcagcacatgtattaattgatgatcatgtctcatgtatcatggtatagagataccaaattaataatgtagacatatgttagtgaacatgttgttggatagacccaacatgagacactgcaagagccatatgtgttgtgtcatcagtgatctcatttagtattggtgttgaatcctcagacttgtgattatcatgattcccaacatgtgtagtagcttacttagggactgctaaactctactccgtaattgggtagttataaaagtagttttcggatatgctatgaaacatgtagtgggatatgaataatcaagatgggatttgcctctcctatggagagatatctctgggcccctcgatattgtagattatggaagtgcatggccatgccaaaggtgattgaggagtcaatcacaagttatataatctatcaatatgttcgagtgaatgattgagctattagaggatggcacatatctagccttgagctaaatcgatatcgtgaggcaaaggagttcatacaagtatacactagagattcagccgatatgatctttatgtatgcccggtgggtcaatacgttctgctaggggccgctgttgacgcgtggaccgaaaaggagttttcggcttagagctgagtatacatgaacctacagcatcgcacgcttaatgggccgaaataaggggattggatggagatccaatatgagcttgattcggatagggatccgaataggagtcctacgggccttggaggcccgagtgatggatcctatatattcgtgaggggtgtgaccggcggaggcatcgcatcacgtgagaaaccctagccgtcacttccctccccgagcaaaaccctagccgcgcgcgggtgctagcacatctgcgcgtggcattccgtccctgtacgtgtggataccggtagaggcgtcgctggtttgtggtgctgatcggcgtgagagtacggcgaggagaatgcacgaggaggagaaggtcgagccggtgcgatcgactacttcctctacatcgacgcacgctacttcgcgagagttccttcgacttctcagcgtcttcttccgctgcgcagcgtgtcgagtggtaacgatttatgatctaatacttgcatggttcctggttgggatccaccgtagttgttagttgtgtagcggtggttttcagccggttttcctgtaataaaccatgcaattgtatggttttcgggcccggttttccttataaactgggtcaattctcttcttctaaatataaaagtggaacaaagttccgccttaggtttcaaaaaaaaaaatattatgctaagaacttaatttttcacctgaaagaaaaccataacaattcagttacataggtatatttgaccaacatggcaaactacttagatttttcaattcactttctcttatgacccaaacagggcaagcatacatgccttacgggggacaaacatgatcatggtacattgctccaactaaaaattcgttttcattattttacactaaagccataaattctgtatgccgcgagcacaaaacgctaaagctagtactatatagttgtttactgcattaattttactggtttcagaagaatcttcccttacggcgatggaattagggaacacaaaatgcactggtatccttatacagagaaattggaagttgcaaaacaaatgatctcttgttcatggatcatccactcagcaccatccattgtgagacgttggaggctatgagagaccacagggaagagagagataggtggccgtattgtacctgcttggagaaaggacctagggaggtgagggcgtcgtggatgaggtcgccggtgggttccgctaccgcctgctctcgccgaggcccgccaagcctctccgcgtccacggaggcctccaccgtcgtgcatgctctagtcccaggggaggatcgagcgatggcgatggcagcgcaacgggtggagggcactgcgaggaggcacgatggtcggctcgaacagcgcgacagcaacatagcggcggtgaatcggtggtgccgcgagggtgacggcgacgatagggagataggggagagaggagggagtggcggcggcgattagggtttggccggggagggagattggcgattcggcgcgacgacgagttggcggtggggcatcgaccgcagccggaagagaggaggaggtggcgccggcgactaggttttgaccagggtagtaggggcggcgcttgtggcggcagaggagaggagaaggtggcggcggcaggggaatggcggagcgatctaggcgtcgattgtgcgaggtcgagagggggagcaattgggggaaggagaacgtgaggcggagacgatcgtgaggcgagacgactgatgcgacgacgacagagcggcggcagtcgagggatcctggacgacgtcggatgcgacgacggcgatggggatcgggttgagggcaagccggcgacggggatcggtggcggcgagacgactgatgcgacgacggcggagcggcggcagtcgagggcggcggcggcggcagtggcgtcgcatgaaagggagcgattagggttggggaggggaggcggcgcgtgagagtgattgagaaggggtggagaagagcggcgcaatcgagggatcgatctggaccgggagatccagatatatatatggtagcgctaaaccgcacctggggtgcgtactaactaaaatgctcccctcatgttttggtgacgatttgtgaatgattatttgtgatgtcaatcgattttggtgacgatctgtggatgatttggggatttcaatttgatttgggcacatggcgacggtggtgctcagtgaggtcggctccattcgagccggctctctcttttttttttctcgagcaaagcaaaaggtgccggtttaataattgtcataggttctggtttctattatcagtgccgaccaataggtgtcggttgggaaatcggcacttgtaggcggttcccaaccggcacctatgcccctttttttaagtagtagttgtcagtatcccgattcgtatcctactatgatacgatattacgatcctattaagccgaaacgataccgatcccatctagtatcttaattctcatagtatctcgatcctactattcattactacacgatcctacgaaatcttagatggtatcccgattctacaatccctattatactataaaatattatttaaaatatcatggtttgaaaataatgtaaataaatacactcaaatttatataaaaacagttaaatatatcaaaaccaacgtggtttctcttgataaatgtctctatttgcatgacatatatcattactatatttttatatagaatgtctatatataattaatataaatattaattaaacttaaaaaaaaatctcatagcatacgatatgatattacttttatcaaaactatactgcatggtatcccgatcatgacattgctcttgtcgtccccctcgaatcatcgatggcgccgtcgcagctgccgcgctctagcgtttgccggtcgttcagcttccccctcaactcatccagacatccacgtgcaaaagctggcaaaccgcacattgtcagcatgcgcgtgcacgtatatactccctccgtcctgaaaaaagataaaccctgggtttccgtgtccaactttaactatccgtcttatatgaaatttttttataatttgtattttcattgttgttagatgataaaacatgattaatattttatgcgtgacttgtctttttaatttttttcataatttttttaaataaaacggacgatcaaacgttggacacggaaaccagggttggtctttttttgagacgaagggagtatgcagcaggtaactgattggtcggcaatggcggatatgcacacgtacctgcgtcgcgactcgacgcgatcgagcgtgtggtggagggtgtccaactcttgcggcagaaggtggttactgggaggagctctccggccgtgggcttgcacaggaatcggaactcccgccgccgccggccagcgagagagaacaggaaagagagagatgggagaaatgggcgagaaaaaagaaaaagatgagatttgaatgattgacatgtgggctgttatttttttattatttttctgactgacatgtggccccataagcgtctcgtaggacgaaaccgctatcacagcttagagactcgatctgctctggtttttaagatgtaggaggcattatattggtatctctaatatcgaaatccgtgcacaactcttgcaggggctcatgccacgtggctcaacaggtttcgccggaaagctctcctgcctggcgcttgcgaattgagatggtgtgatggtgtgacgctcgttaaaaaaaaaaaccctatatatgggccctgcaaaattaacagccctggacgattctagacaaatcgaaaagattccatatttaggtggtgtttaaatattctgaagatgaatacgaagataaagattaagtgtttcacgcaaaatgaggtagtaataacgtgtgattaattgagttttaattattacaaacttaaaaaatggattagtcttatgttttacaacaactttcatatataaagtttttgcacaaaacgcaccacttagcagtttgaaaagcgtgccacttttatctaaaagtttatccagtatttgttggagaaaagaacatagcctaatcttataacatgaattttgtgcaacttaatccttggcacacgtccttactcacggaattggtctccacgcaaaatcatgggtatccatgtaaaatatttgaccgtccgtcttatttaaaaaattagtcatacataaagtattatttatgttttatcatctaataacaataaaaatactaatcataaaaaaattaaataagacaaacggttaaatgttggacatgcacagtacaaaactgcacttatttcggaacagagaggacaaatttaattgaaaatcaagacggtacataaacaagtaacaccaagaattttcctaccatgttgaaaaatatctagataaatacaaataagagaaataccattgccatgttcatatcttatatttatagaaaattgaaaccaattgctaggtagaaataaacaagttaacagtaaaacacaggtaatacacacggggctatcaatttattggcgtgccagcaggcacgctggctttctagttatggttaagggatgtggttcaatctataacaagagttgtgagaggcaaaatagacttattcatttctgtaatgccagcaattagttgggcctgagcaactgactcgagttgcgagcttgcaaaaggacccttgattcggcccattatcatggttcgttgccagcagatgagcagagaccctagtttgaattagtccactttaggtatctcattttaacgtctaatttgaatctagtcgttagatcacaatatcatatataacatgtccatcaactccgaaaataagtgtaaacaaggcacagtttgagcgacggtttcgattgacatagcacctacatagttggtttgtcatggtcctcattctacgtgatattgatgtggcactagaagcaagattcaaaatattcaaaattaaaataaaatacgtgagattcatatgtgaagataaaataaaatacgtgaggacccgtgtgttagtcgatcccacttcctcctcactctccctttagtggaaaagcaggagagaaaaagggagataggaggaaagggggagagaggagtgacgtagacggagaagggcaaggaggagagagggtgaggtggaggaactttgacccacttgctagtgggttccactatattttttatctttttattttactggtatataagtgtcgacaggggatacccgtagaccggatatagagggtgttggggtacgttggtacgagggtctacgtagtacgacatcaagtaaacaaaagacgagagttatactgattcaggccacttggtatgtaatagccctaatccagttggtatgggattatatgatggaaaccacatattacaaaaggaatagtagaactcgatgataccgacgagaccgtagtcgagttggttcgactagatcacccggcgacttggctcctgtaggctccgatttcgtaggctgtggtggatgtgttggcggtgagattctatgccttaggtcctgcccaggggctcccttttatactgcgggtcagttgatctctaagtaggactcggagatatcggacccctcacgatattgtaaagacccagtctcgtccgagtaggactccttccatccgtggattctgtttctatcacgtgatagatttccttaacgcatataggaactatccgtatacccgtatacgcgtaggtataccatatcagtactcatcgtatatccaaggatagagggtgtaccttatccgtaaccctgacaataaggtcctacatattttgtttcaacttttttatttttaatctttgcttttagtgccacgttaacatcacgtggaacgatgactaaatcaaaccagccacgtagcgtcacgtcagctaaaaccatagtccaaaccacctagtgatctcacttacactggtttaaaatgttgaggaatacactatattctgtactgcgatttgagaacgtcttttaatctcgacgttttgatgagcgatctaaaatcaaacttattgcatatatattatgtactccgaataattagtttgggtttggcccaaactgttcctttgctgctaggccgtaagtcggcccaatctaaataactgaaaggtaaaacccttctcgcaaaattactttgccacgtcatcaactgaatatacaccattagattgtcactccggacattacagaccgttgggtctgtcgatttgcaaaatatcttcgtgatccttcacgaatcttctattaatttctggtccttccccttacatgaaaggattacgttatgttttcattttgtcccctccccttaccgcgcgagtgttcaacccctcagtcctcacagtgcaccgcaagcccacagcggacgcctcccactcccgcgccaccgaagccgagtaggtctttgtcaccgctgtcacccaaacatcctcctgctccgccgccgccaccgcaacctaaggttagggttaggggttagggattttctcctcggtggtgtgtggcgacgaaagtgatcgactccgtttcgaccgcacctagtcggtatagatggtgacacagggacaatctgggcattacgaaaaaattatcacaattttcaactgggaaatgataaaataatgggtccgatgtcctatggcaaatttcacaatttttgtacagtgtcctggggcaatatcacatttccgcggtgtcccttagctaattaattacacgatttttgcgttttctgtagcaaatttttcctaaaaaaataaggaatattgaaagacagatctaaagtccatataataatacaatttagaaatatctaaaatttgataaataattaataactatcacatatataccatacaatataaatattacacattggtagtttggttaagttggtataaaattaaaattatgttatcattttaatatattttaatgataaaattgagaaaatatatatgctattatatgagagaaaaatataatcatgctagccgcgtaatatgcgtaggccaccatgctagttcacatcagctcgatcactaggtgatcgtgtatagaccaaggtcagtttaatgttagcaactattaatgggtcgtaacaatataaaacagtgaaagataaactgaacttagtatgcattatcttcactatttttcttttccttcattgaacaccgatctatttatgaacaacttgcttaatcgctgcttcttttcattcatcggccacagccagccaaccaattccacacagcaatgagcatcctcaagaccaccaaattaacctccctcctttttttaccttgccagataattaaacagttaaccctgcattacagattgatcatcatcccttgatgaccccggcgtttctgtacttgtaccggatggcccagaacaagaagaagaggtagttgagcgtgctgagcacacacatcacccagtagaacctctccaggtggtagtggttcaggttctccccctgcagccacgcccgccgcccgccgcgccccgtcgcgctgttcaccaccgtcaccagcaccgagctcaggtagtaccccagcgccagcgacgcccacgacagcgacgtcgccagcgaccgcatcctcgccggcgcctcgctgaagaagaactcgagcagccccgccagcgtgaacaggtcggcggaccccaggaacaggtactggaacgcgatccagaagaaggtgatgggcagcggcgccgccgcgtcgagcattccggcgttggacgccacgttcttgcgcttcacctccaccacggcggcgacggccatggcgacgatggagaggacgagccccgtgccgatgcgctgcaggtgggtgatccccatctccgtgcccgtggcgcgtcgcgcgaacgggatgatgatgtggtcgtagaccggggcgaggaggatgatgaaggtgaccgggaacaccggcagcgacgccggcggcaccttgagccccccgacgcgggtgtccatcgtcgccgcctgctccacggagaaggtggacagctgcgccaggcagctgttgagcatgatggtggagaagaagatcgggagcaccatgagcacgatcttgacgtcctccacctcctgcaccgtgcacgacagcgccccgcaccgcggctgccgctgcaccgcccggttcaggaacaccagctcctgcgacggctcggtagccacctcggcggcgccgtcggcgacgccgcagatgtcgccgggcttgcagtactccttcatgtccgtgctccccgtggggctgggcgcgcggtcgatgacagcgccgttgctggcgctctgcgcgccgccgcggcgagcgagcgcggcggcgaggacgaccttggcgatggtggtgagcgggctccccgtgggcaccttgttgcggtacagcctcgagccggcgacgaacaccgggatggagagcaggatggcgatggtggagatgccgaacccccactgccaccccttgttgtcctccacccagacggcgaacgtgacggcgatgagcgcgccgacggagaggcagaagacgaagtagttgaagaaggtggagcgccccttccgcccccgcggcgcgtgctcgtcgaactgctcggcgccgtgcgacgggagggagcccttgatgccgccgatgcccagcgccgtcacgtacagccccgcgaacagcattgccttcttcggccccgacactggctcgcacgccgcgccggcaaccttggcgcaccccggcggcatcagcgacggcgtcctcgcctggatcgtcaggaccaccagcccctgcaacacattcgcgccatgcttgacatcaacaaaagttcaaaaaaaaaaaaaagagagagaatcatatgcaggcccatataaaatcctaaaatctgcagacgagaaaagcttccaggcccatgtactgtccaggcccaaatacatgcaactacgtacactactagcatcaattttctgctgcaattttccgttgcaaatttgcactgccatgttgcaacagagcataccaacccgatcagaactgtgacgccaatgtctagtggtttggttggggggaaagagatatcaggtgacagcgagaaaagtttcgtggggggaggcaagtggtcggcgtgctgcatgtgccgccgcggccgcgcgcccgtgcgcgacgtcgctttggccttcgccgtggtccgtgagccggttaaagcggaggaggaggacgagaccgacaggggcccgtcgatgggttcgtagtaacttttgtcagcgctgaccggcaaacgtaaatacagttgggctaaaaaaactcgaggcagctttttgaagctggtaagtcaaacgtacggcgatcgtttttgtggcgctcaggtgagatcaccaaggtcagcaagcgacttggaagtactccctgcagattaatactacctccttgcacaaatgtacgacgttggttagttcaattttaagctaaccaacgtcaaacaaaaaaaattagagggagtaatacttatcgttttagataaaaacatgatcataaaaagtaactttgatcattattttctattataatatataaaaagcatcaacaaatatatgattttattaaagtagtttttaagactaatctatatatctagtctccaattttctaagataaatatttaaaaaattattcatagttaaagattttaatatttgatctcaccattatccaaaatgataagtactatcagtctagagatcagtctggaggctgtgtttagtttcttaaattggagagaagtttagggaaaactggtagtttgaaaaaaaaagttgggagtttacgtgagtaggaaagttttggatgtgatgtgatgtgatagaaagttgagagtttggaaaaagtttggtgtgaactaaacatggcctaacttagtagaacggacagccaactagcagtactactgtacttgtcatatcttaattagcccatcaaatcgggtgtgcagaaaagatgtttacaagtggtggtggtgctcctgtacttggtacgatcggtgcgtacataggagtaacattattgagtaccattgtgtatttgtgtattcagtggctattctatcaggatccacgtggcgcaatgtgcaacactccgaaagggaaacgaaggaaaacaacaaatgctcctacggtctatcctatccattcgtttccgatttccacaccatattgcaacttgtttggtggcgtacctatactatactctctatcaaaaaagtgttaaacttattacttttatcatcagtatcagaaaaaaataactcattctgtatgtaacgaataccaaaagagatatatatatatatatatatatatatatatatatatatatatatatatatatatatgcagtggcgaagccagaatttagagatggggggtgccatttacgagacgtggtaacttacttaaggttcggtgaacagtgatattgtagcgttgatgtatgatcactaactcgacatcatacatgttatagcgattagctagaagagagaatgagaacccatagatcataatttgccaatttaaacagtttgttccatgattttaattggagtcttgtaatcatttttaaaatgataaatcagttaactaagtcatttcataagtcatatatagctaggcagttatcctatatagttagtctcatctgcaactaatgatgtaattaatggtagattataagggctaattatccttgggagaagagatgggaggggaggtcacataggggttaggggggtgttggccctccctggcccctacggtggcttcgccactgtatatatgtgcatgtaagtgtaactaatgaatattaaaatgatcgtttgtgtttcagacaatcatctaagttatctattcgtttaagtcttagataaattgagactatgaataatgactattttatttggaaacacgataatctttccagaattatggctggactgaatagcttgcttccccggcctataaaattttacgcgcgaataactcaggtgctcacaagtcaaacaagtgggtaagaagaaaaaaaaatacgagtaccaccaaaacgatgattaatattctccgggagggaatagcaaaagcaagctaagcacaggcacagccaaagaatgaaagaaaccctgcaggcaaatcccgaaaccaaataaactccccacttgatccacttgcaccgccccagcggcgcgctagctagcagccgcaggtttcgttacgccgaggaggcaggagtagggcaacgcgaattgacgcggcgcgcgcgcacgcacgcacgcacggtcgccttctcctccagggctgcgcactcgcggctttagccggccgtggccgcgccgcgcgcgcgcgcggttgccccacccccacccacacccaccctgcgaggctgcgacaacacgcgtcggtccgtacgtctctctcgacgtacgcgaggaaggccgcgcgccgcgcgggcggtggccaagattggttttgtgcgactctctcgtcgcgcgcgttgacgacgagtgtgtggtgtgatgtggtgtgtggcggtgttcggtttgcacgtacgcacgctagtggacaccgtacgtcgtacgtgtgtgttggtggaatgggagaactggctggatcacagtgatgagttgtgtgattcgatctggggctaggggggtggggataagataagagatggtggtcggtctcggatcggatcggatcgcgggaggtggtgagagaaatgcctcgagaatgttccacagtggctcttgttcctgcacgttgataagatccgtgcctatccgtaattccgtgtcctacatggtactgtattcgacgatcactaatccatcgtaaatttgcagccgtctctcttaatcatcatagcccgtttttcgctttttctggtgatggaccaactcataataaattaaccaatcgacgacttatcgatcgatccatcaaccgatcgttcatgaaggggcgacccagaaaggtcaccgtgtaccagatcaaaaaagatcgatcccgaccggtcaggatatatccaggggtgcgcgcgtcgtaaacacgtacatttcgtgcgagcgactgcgcgagaggagtggtggtgacccgggcgagcgcgtgacggggcggccagggcgccgggctccgcgacggttttggccgcgcgcgccgatggaattggcggtggatatatgaatggattattattgccccatcccgaagggtactcacactcacacactgacactactcaggcggcggcgacggcgaccgtaatacggccctgtcccactcgtggtgtgaccgtatgagatgtagcatttggtatagctaaggtcgtgtctagtccatcctcaactaccccaaattttcaactttccattatatcatatcatattcaaaacttttctacacacataaactttcaactttttttttaactcccaacttttctcaaatttttaacttttttcatgaactaaacacagcctaagatgtaggctacctatgataggatgggcgctataccataccagaacgtacgctgcccatgcgcctgtcgacgacggtggcgacgtagtcatgtcaagtaactagctgattgatctgaatttgggttatcgtccgttccttccatatatgtctctgagcccgacgatatgagccctacagtacacgactgttgatgtgcacagtaactgtatttttttggtcaagaacaatcatgttcacctcgccggtatggcactcgacagatatatacggttactgcgcccacgtgatccaccgcaaccgcaccgcacacgtctctatacccttatacgccgtatacatccacttccatcctacgtacgtactcatcctacgactagctctagtgctctacgtacccacacaatcataaaaatacacgacatttttgggctaaaaatacagcgcacacataaaaaaaactcatactaaccactctaaatttgaatgtataatgttgctgatttctaagtgatgtttaaccatttgttttatgtaaaaatttagtgcaaatatgaaaataaatataagttacgctaaaatacttttaacaagtgaaaaaaataatatttacataattattttttctaaaaaatgagctaccaaacgttatgttcagaaatcaataatatttatatatctaaaaaatgaaggcagtatgaacaaagcagaacacttcaacgcgcaattggttgcaaacacatatttatccaaatatctcgtagaaatagaaagataaagtatttcaaagaaagtctaaaagctaaaagcttgttgttgttttctccccatcgctaaaagcgagcagtagccatctatgatccatcagtggaccatcacagttgcaatccaaccaagctagcctagccaggccaaacttgaggaccatgaatcgatcgatcgattgtcccaagcccatgcataaaagcatgcctttgtgatagatactcctacttagatagatatcctagcacctagctagtgcagtcacgatacataggggccgtgatcagtagttcagtacagggttccctttgacccaggctatctctgcttgcttctagcgaataaagtgatggttacaatttaatcattggcctaattaatctctagatgtgaatatgtatgtgatctcatgtaacccaaatcacagggaattgcgagctccgtttagccaattaattccaggcaattgtcagatggaacccgtggagaaaaagaggtttcagtgtagggccgggatcacaaaatctttggtcaaatagtggtggtcatctagcgggaactagagccgttcgatcctgcctcgagattagcatcctgtttggctaatctttgacaggtgtcattttttgaccttgtccacgaatcttgtggggtctgttctaattggacggtcaggatgccatcatgggagcggctctgattactgacaggtcactttacgacatgcagctaaattctagagaccggtcaacaaaacatgttatgatggtaatagccaacgggtccagaagatagaaaggaagtcaacgatgacgtggcagcctagctggacatgatcatcccggtatattccttccacgtcagcatggagatacgatgagcaccatgcatgcatatatatctcactaaaatatacactcctacatatgtgatatgtgtctatccggaaacatcttatcatcttattattatcggtatatctacgattgcgtaagctggcatatggtttccttttttcctaggcttatgacggcaaacaattataaaggaaattaagtgagtaactaacttgcagactaacttaagttggatcaattactctcaactaaaaacacacaaaaatggtagtagtactacaactacgaacaaatttagatgtgctgttacttaccaggaattccacaaaggcgctgatgaggtagatggcgtaggtggtgaagaaggcgtcggagaggaagccgccaaggagggcgaggaggaaggcggtgcccatgaagttggtcaccgtcgtcgccgactgcgacggcgagtagtgcatgaaattcatcaggtaggtcaccaggttgctcgcgttcgccaggaacgccaggttctcgagcacctccaccactgcacacacaacaaagccaatattctcaatccaaattcgatcttgaaaaaaaaacaaaatctctatcctaatcagtatatattaaattaagttatactgttctccattggtaggattttccattgaaattaagctatgaaattgagctaccgtgtgccactgaaaaacttcagatggagatgtaaagttgtattttaatcggaggcgtttgaaaaattggaagtactagcatgcatgtgcggtggtaactgatataaccgccccagcataatgtgtgcggttcccagtgcatgccggccaattttctttgttctccctgaccgtttcggccttgcgattcgtgcccgaattcaatgctcgcgtagcgacaattttggacagggtcaaattataatggcaaatttttctccccaaaatccatggctggttctctctctcacactcacaaccgtcagggcaaaaaaaaaaaggaaaaaaaaaagtccttcacacatgcaaggaagcaaaaggcagtcattttccaactgaacattcgggatcggatcaacgggagagatatcgaaaccgaagccgccatggtgcccaccagtcaaccaccaccaccatcagcagcagcagcgcaagattgcaagaagaggtcgccgtcgatcgagagcagggacaccgtctttttctcaggtggatgcaatgcatttgatggagggaaggtacagaggacactcaaggaaggacgccaatgtttggatcgtacaaaagcttctccccactgatgataacgacgacgatgcgcaattgcaagaggggggggtcaagttggggaacccaacccaacttgcaagaacaggggggagaggagagatgggagattaacctcgttggaagagaagagcacagtggtgtactggtgtgaaagggaaaggaagaaacaggggagagagagatagagagaaatggagcccaacggcgaccagtggggaggagggcgaaaaaaaggggagaaaaggcaacttgtttcgcgagcgaaagcggccaaatccggcgggaaaagggtgcggtctgatcaggaaaaggaggaggaggcgtaaagggtggtgatgatggccgatcgatctgaccacggtgctgtgcctttcagtctccagaaaagagagagaggagaggtgcagggaacgggaggaggaagaagaagaaggtggaggaggagatggtccatggctgagtatcctattcgagctttctttctttcgtgcttgcatgctgctgctgctggtgatagctagctagctgcaacagtgcaatgatatgatcgatcttaattaattctgggcttatccatcgtccctgtgggttccagaagaatctagaaagaaagaaagcaagaaagcaagaaagaaagggaagaggaggtgcgtgtgtacttaccaagaacgaaggaggcggcgagcatgccgccgtgccggccgcgcaccgccggccggttcctccagtcgacgtacccctcccacctctccgcctcccgcgccgccgcaccgtcctcctgcaacgccgccatggaaaaacaaaacccattcatcaccgtcaacacaagaaccgctccagggacagagacagagaagaacccgcgccacacgacgactactcggcactcaccatggccgccgccggtaggcggtgcaacttgcaccgggagcgagcgagctcggtcgcgctaatggcgggtgaacagggaagcagcagcggagcagaggcgaggagtctctgtgcctgaggaggaagagggaggaggtggtggtgtatttaaaagagtggaagggaagggaggggggagggggcacaaaaggcagcagacgagggcgccacaaacaaacatcacacacaaaccccagcacacagggggtgatcgacatggacgtgaccgcatccacaagggagatgcaagcaggcacgtcgatctcaagatgcccttccccttcctcctcttgtgaatgaaaagaagagaaaaaaacagagaggggaaattaggatgagaaaagagaggtttagtgtttcttgtttgtttttcgttttggatttgagagaaattcattagaagttctgttgttatttgttacctcccatcgatcggttgaccaagagttgattataagctgtaagggcttattagcggaaaaaatttgggagtaaaacttttataggtgtttcttttgtgacttaaaagtcaatctgaaaaaaagataattaagtttcaaattttatattctaacaatggcttattctttatatggtaaacaataagaccctatctcctatgggttgtacaacaacaactattagatagcttatgaaactgccaactaaactaatttgctgagtgtatagcaacaattgacagctggctcgccaaattgcaacctatatctatctactaatgtggataagagagagaaatcggtgttaatcttaaagcaagaaaagagaaaactttgctagataaggatatagcattagtggaaagagcatttattgtctcaactatagaagaggatactatctctgtgtagaaggctaaactattctacttgtcctaagggcttatattgttttatctttccacaattaccatttaattagatgaggttatgcgtgaaggatctatcttaagttgcgctcttttacgtggctaaaaggggccactgccttatttatcatgagtatatttatcgaacagctaaatggtacgtttttctttttttaaaaaaaaaattctatattaaagttatttagaaaaactaaataaatttattttttaagtttgtaacggttaatacttaattaataatctgtaacgtttctcgtgcttggagtaggtaagccaaacaacaacatagaacgcaaccttataaggccactcacacttttgaagttatattgttactgtctaataaaacggattaaaaattgtcactacgatggaagcgtaaaaaatgtttgatggaaattaattcaatcatttttaatgtaaaactcgaatgctattaatctttcccccctttgtgcggaaaaaagactagattaagatgaatcattggagagtgttatctgatcattactgtctaaatcatttttacaaatgcctgaaatgttagatcctgtggatcatcatggagaatctatattaatggtaaaatggaacaaccaaatgagctcatctatctctctcctcttctttccctttggtttaagatcagaataatattaacatgcatatgagctaatctattatattattaaaacagctttgaaatgagtcaccacgttcgctgtgggggctagaaattcccacattaatcggagaaaaagaaaaaaaaaagaaaaggagagtccaagtagaaatacaatctaaaaatagctgaaattcggaattaaaaataagcaatattgaaagaagttcccatataagaacctaatacgagattaatcaaaattagaaataaaaataaaataaaatccaaaattagaaaaggaaaggagagtccaagttgaaatacaatttaaaaatagctgaaattcggaattaaaaataagaaatattggaagaagtttccatataagaacccaatgcgagattaatcaaaaattgaaataaaaataaaataaaatccaaattagaaaaggaaacgagagtccaagtagaaatacaatctaaaaatagctgaaattcggaattaaaaataagcaatattgaaagaagttcccatataagaacctattacgagattaatcaaaattagaaataaaaataaaataaaatccaaaattagaaaaggaaaggagagtccaagttgaaatacaatttaaaaatagctgaaattcggaattaaaaataagaaatattggaagaagtttccatataagaacccaatgcgagattaatcaaaatttgaaataaaaataaaataaaatccaaattagaaaaggaaacgagagtccaagtagaaatacaatttaaaaatagctgaaattcggaattaaaaataagaaatattaaaagaagagtccatctaaaaacccaatacgagattaattaaaattcggaataaaaataaaaataaatctgaaattagcaaaagaaaataaagaagtgttcaagtaggaaatcaatttaaaattagcttaaattcggaattagaaatagcaatattgaaagaagaatccatataagaatccactacgagattaattaaaatttagaataaaaatataataatatcccaaattagaaaaactaaaacagagttcaagtaggaatacaattttgaaacaactgaaattcagaataaaaaataaaaacattaaaagaacacaatatggtattaactaatttttttagaaaaaaataaattctgaaattagaaaaaaggatttcaattaggaataaaatttataaataactaaaatttatgataaaaataaagactattgaaagaaaagaccatctaaaacacatgacgagataaattaagtaacatacctataaagtagtagagttggtggcagttaatacagcatataaaaattgttaataaaacaacaaatagaatcctaatgacgattaaaaggagggatatcaggcaggccgtaaagtaaacaagtaaagcggttgccgggacttctagaaagtataaagaaaaaaaaccacattgataatcattttcgatttttaaaatctcaatgacaataaaaaggagaagcagcgagcggggtgtataagagtatagttgcagagcctccgacggttgacgggacttctagaaaataaaaaatgaattgcaacgatagttatgttcgatttttagaatcacaatgacaataaagagtaggcagcggacgggctgcagaggggcatagtggcatcgtttgatgagacttctaaaaattataaaaaataaaactacaagtccaatttttaaagattcagaacttctaaaaagtaaaaaaaaaaccaatgataatcatgttctattttaaatctcaatgacaataaaaaagggaggcagcgagcgagccgtaaaggaatacaatggcaaaaccgctgatggtttggcgggacttctggaaagtaaaaataaacccaaactataattatgttcgatttttaaaatctcaatgacaataaaagagaagagatagtggacgggctgtagaggagtataatggcaacgtttgacgggacatctagaaattataaaaacgaaacccaacgtgacaattaactctaaaaactataaaatccaatttttaaaggttccaagatgaatgaatagaaacagtgatagatcgagtaagcaaataaagaagatgacataaggggtagcaattggtgtgatttttaaaactatataattagaaacacaaggatgataaggtttgatctttcaaagtcttaacaatgagatagctatttaataaattttaagtaaaattatacttaaaaaaatatatgatttttttatgctagccgcgcaattgcgcgggcaacccagctagttatacttaagtgaggagttatttcccgctgttgacatgatcacgcatgcatgcatatccttgttaattagttgcgaaaaataaagtatatatatatccttgttgacttaatgcatggttgttttacacttttccaaatgatcacgtgtttttcttttttccatttcctttgcggttgaagataagtgattgggccctgcactcatatatcgggcgtaactgacgaactgatagcacgatcaagagtgtgacgcacaatttgcagtattaccgtttttccattatttgtgcggtgtgccgatgagggtagggcagtatataattaagcggttaattttacgtacgtatcagggttgtaacctgcactagtctagccagtacgagtacgtgtacgacgactagcttgttaatgttatgccaattgattgaacacgacgactttgtttgctatctgcaccgtacgtacgtacgtatcgctaccatagagtactctatatttattggttatgattaactaacatcatgcaaaatagggatgtgtgcagtagacatgattcaaacatcaggatttgtcctccatgtacgtgaagctcattgttaacgctttttgttaccaacacaatatcacctaacaatagcaagataaactaaatagaagacgaattacaccacaaacacccaagtaccttctcatctatttattagtaataccattggagtataaatgtttcttcctttggtccatttttttaatcttttgatgaatacttataattatatggtctcaaaagaaaaagtatcaactatatcaagtagtaatttaacaaatatatgtgacaacaccaagtagtaacagatatatgttgttgagacattaacttttaactttcatagaagtttagctccatatatacaacccattgtataaaattatgaatatcaaaatattagatattctactattatcatgcagtttataataagaaacaacagtgatagcatgaacagtgtaacgaacaatacttgatcactgtcgcatcacgatttcctttttatccctaaactcctctatcgctaccctctgtacaataattttccacaacaccccatttccctataaaagcagttaaataggaacatgttggtacaaatagtgaaggaggtgtaaggttatggaccacttctaaaaattgatgcccagaggcggccgcttgggtcaattttcgtaggtagcccacttagatgaccacctctaaaaatgggtactcctaggactggtgtctaagcagatcacctatgaaaacatcaggtgatcttgatatgaataattttacgtcaaatgtatgcaccctagggccctaacaacatcgcctatcctccttcctctctcctttctccctcatccaaacttcccactccctcttcatctccctccctctcctccctctaggtcaagaacagagtgaagccatggtggatccggtgaagcagtggtagggtggtatcaacgtttcaaattttgttttgaaatttccgatatttgcacccctcccccaccggcaagctcatatctcttttatatttttttttgtgaatttggtcaaattttatttaaattcatacaaaatttcaaacaatttaggccaattcaaaatttctgggaaatttcgccccccccccccgcgcagaaaaagcaatttcgatattgaaaaccctgggtggtataaatctgacagccgttgggtcggtataactctgtagctgtgatccgagctgctaggtgagggggtgagtggtgactctagttgtgaatagagagggagacgaaaggggccagccatggattggtgggagggcaggggtagggagcgcttatcctgagtgtcttccttccacgcttgttgcctaccgtcacaccgtatctacccgtcatatctggcgatataagactaagtgcccgtatgtgaaaataaagcttcattttcacatgaagccatgtgtccagccgtctgcggaaaaattattttagttttgccgtgtgcaaaaatggttttcataaaatagtagtgataggtaaagaattgaccgtgataagaggggttgaattatttttttatatagtaacttagtggctttactatttggtctgcacatttcagtgcttcatgttgacatggactaccctggccggcacgcatgcttgggactccatttggttggtcgatgcgtgcacccggcctttggatggaaacctcatctcctctgagcgacatgtacactttgcatgtcattcatggccctcctagctagctgaatcatcatcaacccagctaattctgcatatccatgggggctgttttgtgtggccatggtagtttccatcaggctgcgaattggaagaggataaataatgcaaaggggaccgtggaaatcgacgaggttattctggagggatcctctttgctacttgcttagtggcgatcgattgtatcctccgggatcttaagagacgcgacgacttcgttttagttaattcatttcttcgatctcgtcgcattttttacgcgtcagttctttctttatctgggtgttcagttccatcagctgttgggatatatatgaccggagaggcaaaaagttaatttggtagaatcatgctttagaggaaacggaatgtgaatatatgaaaggtttgattgtgcaagtttgagatgcagaataattaatgacctatagacgcgaactttctagttttgctacacagtttgagttcacattttataggtgctagctaggcgttaaacggtttgtaggaagttgttgagcggtatagctatagctcttttgttagtctagcggtggtcgataatgcttagtgacagctagtcggattgtagtggtggtgttttctttttccatagcttttcatggttataatgccataatttttttttcttgctatatgtgataaaatatcgcacatatgttattcatttgttttagaaaaatatgtttttattgagtaccctctaatgcgtgccaccctgaaatcattaaagtgataatgtgttaattttcgctttattctcaatttgcatttggctgtcgtgatcagtcaccagctagctgcagtgtcgttgcatttgctcaaattagccttatcaaggctacatgcatccttcgattctccaacgtgatcaaatctcttctcgatctgcattcctacacaagccattctatgcttagctagctagcttgttcagtgtaccaaggttgttacatctcaggtaccaattcaaagacaaagggattatatatatcactcgtacatagacagcaattgcttaattcactgacagtttctattctgtagtagtgtacacaaatgtcgtcctcttctatcgatgtggtacatcagatggttctagaagaaaccgaaatggccatacacatacacagtacttaacttgtcgtgctcgatcgcacaacactgcaccaattaatctttttttctccgttaattgtgatcaacaaaacatggaatatgcttcacatgcaagagagctacgtgaatatgatttttttttgcccctgtttgtgatgtgctagggaccaaaaaagaagcatgaaaggagtggtcataatacaatgttactgcttgtggaaatgtcatagcctcctagacgaatcacgtctcttgtccctacgtactgattattttgggtcacatcgagatttatgaatgaagtatattatgtggggttatatctatcgcatcagaagattattttgattaaaaaaatggaagttcttgaatatatgtaatcaaagagttttatttgaaaaaacagagactatttaatataagtacattggtggtgtttgaaactcatgaagatgaagattaagttttagcgcacgtaaaatgagaaagctattaatattcctcgcaaaaaaaaagagaaagctattaatatataattaattaagttttaattattataaactcaacagataaatatatttgatatttgaaagcaactttcatatagaaagtttttaaacaaaacgcggtgcatgaggccgcggtggcatagacagcggcgggcggcggctccctccccttcgacaacggcgacagcaactgtggaggcggcaggcaggccgcgatgggaggcggtagggcggaattggccgccgcggtgcacgaggccgtggcggtgcagacggcggctccctccccttcgacgacggcgacagcggtggaggaggcggtaggtcggccgtggcggcaggcggcggcctcgcctccgccagattcagcgagaggggaagccgggcggtggcccgacggaaggagggaggccgggcggccggcggccaatggattttttttatcttgtgaatgatttgtatattttttttagatttttgttgatttggggatgattttgtgattgatttgtggattgtggatggacatttattgtggatgatgatttgtggatgatttctagggatttgggtgtgacggcgtttgtggtcgaaatcagtagatgcaagcagctaaaaaacaattaaagaaaaagaaaaaagaaaaaaatatggtagcgccagccacgtggcgctatcatctttagtcccggatttggggtcctagtttgcaacctggaattaagggggttgcaaaccgggagtaaagataggtttttccagcagtgcgagctagttcattaagataataaaccaagcttggcacattagttcaccctattatcatgtagagtcttcacttacggtgctctctactggtagtagaaagtaatataaatcgttgatctcatttgatcgaagggttcacatttatttataataccatcttagttagcggcaatagaaacgtggaggggtattattgtctgaaaaataggtgcggaggggaatcatcatttagtagtgggtaaaccttgttttgatatttttcatggaatatgagtgatgccagtgcgatggatgatcatagatcaattatatttaaccaggaaaaaaaaatgatagttcctcctaatcatggtattatagtaaattactaaattatgcctaattgtggtattaaataaattactaattaatctctaataatattggtagtatattaataccggtagagagcaccggaatatcgctcaccaaaatataaaaatgaacaaataagttaagcaacatactttaacacaaattgcccgacaagatatatgtactatagttagcgtgacagcaacatagtatatggcactgcgatgctctaacgcggtcattggctagtacggagtacgttgtaagcgcaatttcagattcaaaatatccagcttttggcacggccatataacaagcctcatgcatgcatgcatgcatgcatgcatgcatgttcatcctaaaagccaaagtggccgattaggtactagcaaatattctttgtgtcctatattatctattgcaagacctacaacgtatgtcaacaaattaagataagcaaaccaaaggccatcaactttaacttttctaacattttaaaggggtgtttttccatgaataaaatcatattagtcaagtactagaaatttccatgcgtcctcttttcatgcatgcatgccgccttcatttatatatactttttgcaggaatataacaagagaagcttaactgaccttggtcaaattaaacacaatatatcagatgagatcaatggtttagattactttctactaccagtagattacgttatagtggagctcttagaagtagctacacaaattaagcagcccacatattacaaaaaatcgtccactaattcgcatcttcattagatgggggccatttcccatatgcaggatgaacacatttctatgttgctgcactctgtctcggtggtatgggtcagatgcccactttatcttaggaatgtggttctcacagtcacaggcatgcggttttctcatcacccacatgcatgctccctagctctcttttcctttcgacaactagatcgctagaggatatgcctcactgctaccctgtcgttgttcaattttaccatacgttctgaaatgtagtatatataaatttaaaaatggagaattgattaaatcaggagcctacaacaaactaccttcttcctctctaatttactgttggcaactccagaatcaccgtcatgtaacatgttccatatcaagaatactccctcctttcggatttatgtgtgacatttctgacggctaaataatattatgtgcaaggcatttacatctatctatcttctattatatactaaaagttcattaaactccctgtaaacgctcctaaaccgtcatgtgtcatcctataaacactctcgagttgccacgtggcactctaataaaatatagaatatcataaaaaatctaataaacatctagccattgattttccgttaaattggtggacccacatattttaaccattagaccacttgagaaacaaaaaatccggtagccctcatctccatggtgcatatatgcggcatgtgcaggtacgtgctatacctagctccctccctccggcctctctctttctctcctattttctcggtaactcctactttttagctaacacctctatctatcttcagattttctaactatgtttacctatgaaagatttgcacgtacaaaaaaaaagttccactgttccacatacgtgcacgtacatacatacatactctcttttttttccttttcttcccttcttcttggttagatgagatagaaaaccaaattaataatttaatacacatattaactgttaatattttaagttctaaaatgcactttaatagattagaaaaaaattcaagaaaatctgaggaaaaaaagtaaaacatctagtcatcgattttcatttaaattagtagatatgttatctcagatcattaaattaaatctattaataacctcacacctaatctctctcagcgcaccaacgagagaaaggtacttatatactgctcataaaaaaacaaaaaaaacaactgtaatgcaacgtacgattaaaaacaaataatgatatattatatatatcattaaaaattacatccgcttccgtatcctcccctcttttctctatgcatgtatagatgagatcgtaactataattagtgatattaaattttaaagaactataactttataaaaatagattatatatatcacaatatatacgtaaataaattagatccataatctttggaaataaaatttttaggattctattattttacccattatattaacaatataatataattttatatagaaccattattttaaaaaacacaccgtttaaaataaaggttacacaactatattttataccattaattatcaatttatgatctatgttaactaatttatactcccttcatttctaaatatttgacgccgttgacttttttaaatatgtttgactgttcgtcttattcaaaatatttaagtaattattaattcttttcctatcatttgattcattgttaaatatacttatatgtatacatatagttttacatatttcacaaaagtttttgaaaaagacgaacggtcaaacgtgtgctaaagagtatactatttttaataaaaatattttgccatcgattttcacttaaactgacggacctattaattaattaattaggaaatcattatatctttcataaaaagtaaaaaaagcttctaaagacctcttttcagtcctctgcacaacacgtgttcatatttgccttttacacatatgacaaaaagcattgtacctgaggcagctaaaagtgattaccaaagttatcatgactatcaataaacactacacatactaattaaatttatataatttctctcttatttcaaacaaatattatttcgaagaaaacaattgaacatgtgaaaaacaaaaaaaaaaggctttaaacaagcaattgtgtagatgatttgtgtcctaacataaaaagtcttcaattctttaaaagtgtggaaaaatatgaacattttgaactgctacgaatggaggaacaatccaaccattaatctatccttaatttggttgttactaaatcatgcatcttcataaggcgattcagtcacaataactttgaatttcttactatcacaatttgtgcttatagcaatattgtacataatatttacttacttgatccaaaagtcgaactcatatgaccttgatttatcatctaacatgaatgatatttagatatgcccaccctatagtttatccttatgagatgcaatttctgaaaaaaaaaatataatctcatgttttaataatgcggatgcccacgcattgcgtgggccacccttctagttatcctaaaagtcaaataatttcgtccggaggaagtactatgttactgtgccaaattatatgcaactctttgggctgaactcatgcaaactacgaattgacatgttgtatctgttctccaaatctcttttatccgttcttctgcttctactctaatacattatcaaacttgtacgacttttattttgttcgataaaagcatgcattcaattggcgaaggacccctcccactcccctgactttttattctcaaaagatcttaaaatcttaactcactaacatataaaactattaattaatatcaacatgcaaaaattaaaatatatagatatgaaaatgacatcatagcagatttgccacttcttccgtgcaaatttatatttttaaaggttctcatggaaaaacaatgataaaatgtatgcactaaaaactatgtgaagtaatatcctaaacacgtaaaaaaataacgaattaaattaatataacctgccttcaatatcagtattagatcccatatatatgtaacaggcccacgtacgcatagcattctacttatactttcacatcattctaacgtggttaatttgatgcactgtgattagggagccaagaattttaagataattttcatccacctaaattttcaatatgcatgcaacgtaacactataaaaatcacttctaggtaacataggtctcagttacatcactagctactacatgctgtaaatagcttgatatatgatgctacaattaatcaccctttcaagcaggcagctcaacgcatgcatacacaactgaagcccatcaccctgctgaccttggtggcatatggtatacgcaagtagtttcttattaagtgggggactgaatagtttggtccgtgtacttatatacatgcattctgcacgtacgtgtagggggatcaatgaggtccctgtagctcactgtgtacatatggctgaggctgcctgggtgatgaccatgcatgaccccatggtatacaagtcattacattctaaagcttcatatgtaaacatattatcatcattcactagcaattattatatttttagatacaaacacgtgcaaatctgtaaattattgcattcaagagcttaacatgtaagcatatcaaataatcctcacattattttcacaatattttaacataaatccaactatcactaataaaaaactatttttttagacgcccaaaactagatttttgcgtgtggatcgaagacccttatgcaccaagaggtatgcaaaaaattatcatttcttcatgcgggtgacgcacccgcacgcaaaaatccaatttttgcgtgcgggcgcataagctgcccatctgctatataaaaaaatataagtctaaaaatccaaaccctagtcccgaaacctagatccgctgccatgcagtctaccgccactccgttagcgatagaggtcatcattgtcgagagggccacagccgctagatcaacaggtggatagggatgggagggggaatggccaccgctgccagattcgcagggggagggcggctcctgctggatccatgctggggacgaccgccaccaccaaatccgtgcttgggatagccgccgtgcagccgagccctccaccaccggag

SEQ ID NO: 63365 - DNA, 48120 bp, Oryza sativa
ttatatttctcaacttgtataccaggtctatttacctatacaaatatgtaaagctaaatccatctacaaaggtacgaaaaaatctgtctctgaatgaagctcttttttgttactatatatctccgtcttataatggatcctaaaattttatacccactccgtcccaaaatataacaacttttagcacttacgatttgtcccaaatataacaacattaccaccaacattcccttcccaactaatcacaatcctccacctttcacttttctcacctacctctacttctcaacccaacataacatctccctatttaattctacctactttcttaataactgtgtccaactctaaaacttcttatattctgggacggagggagtagaaatcaaggaggaatgaaaaaaaatactaagatacccatcattaaataaggctcattaaataaggagatggttagtgtaaataaaaattaaaagaagaatggctggatgaaacgagtagtattaataattacttatattttaggatataaaatttaaatccttcgatttatggatggaggtagtagaagtaaatagaagtacatgagtatttgtttaattagataaagatgtcatattatcatatttttaatagaaaatttcttatattaatatatcgtaaaatctacgaagaaatatttagtatacaagaaaaaaataaagtttaaattaagatgctaaatatttttaaaaataaaaacatgtagtataaaaatgatattttcatatgaaccaacttcattattgtgacatatttttctcataaatttaagacgacatgatgcaagtaattttagtttacaatttgtaacaacccgtccttcagaagaaggcagcccagcctccatccaactggcacgcttacttataaatatcacctcacttacacttttattctcgcttcgcataaaatagtcaaaccaaaaataatatggttggagggacaatgcattacaggttggctacactcttgcttaaatagcaagatagtactactactcatgtgcacacaatgcttatagacaacacatgtcaaattctttaaataaaaaaatatagaccacatcctaattgcactaggatgtctaagacaccctctcaaaggatccgacgttcccgtcggtccaacttatctccatagtcacatatgcatatagacaaatatccaaaaacatgtcacctcttaatgcacgtccgtacgtctagtgatcgaaacaagcttccaaaacaatcccaaaaaatattgataaacacagatttagaagagtaaaaaaataatttttttttgaaaaaaaatcttatacataaatattcatcacaaaatttcaaacatcattaaataaggtgcccgcgcatttgcacgggctaccttcctagttgatttaaattccataactgggtaggcgttgtttagcataagtaacactcctcagtcaccaacccgctcctgttcccctcctaatttaagaaaaaaaaaactctcacctttgttctatcgctaggatcttcacctatcacccaccctcccccgcgtcctctctactgtctcactcgcctctcatcccctctactctcccacttccttgttagcctcacccttttctttttttactttgggagagcaagaaactagtgagagaaccaattttcgggtaaataaattgtcgagatatttttttcttgaggttaacttttttatcacgagagagcctaccaagataattgattgatgcttcatacgccaagaggggtgagagttttttttttctttattaggaagatgagagggattagggaagggagttaccaatataaaaaaatttaactagaagggtgtgagcaatttttcttcatcaggaggagaggaagtggggtagagtataaagataaatctcttaagccaaaaagggtgatagttttttttcccattagggtatgggtcgagagcttagaaatagaacatgtacatgtgagaggagaggagcaggataggtgtggctacgaggcgtgtagtttcgaacaaccattcaatttcaataatatttctaaaatccaactctatagttagtactatcttcgtccataaatctaactaattttcagcatttaaatttatctcacgatatacctacttctccacttatcttcttatctgaatcaattacaaccatgtaaatatagctacttccctacctattttctcatctcaactaatcagaactatctctaatttaatttattcatctactttctcatcccaaccaacctcaaccataccatttctcacttaaccttaattccacgaaatactgagggaactatgttattccattttcttatagtttaatagttttagaagtcctaactggcgacgggagttataagttacttttttataatttaatattttgaaattttgaaattaataaatacgagtattgagctgtacctgtctcaatgtctcaatctattattccttaatttaataatttttaaatttgatattaattatcacaaagttgtactccctccatccacaaaagttatatctatttcacatttgagtttttccaaataagttgttcctatctgtagtctttatgtatttaaaacttaaatgaagagataaattaaatgttttattagaacccaaggagtcatctaaatactcattggttgcatgcttgcattcactctttgattttataacatctaagatgatttaatttctccttggttttggtgtcagaagtaatatgtgtaacttttatagatgtagggagtaactgccttggacgtcaacaaattaaagaggcagaaactgtagcgtgtctcaggggtcaagatcgatggatcatcaagacgggaaaaatgtacaacccaaacgtgacagatcgatgcagatatctccttatccttttctttttcctttgtcttctttttttttcttcttctctttcagaagaagaagaagaagataatttgcatcgagatatttagcagcagctagctttacatcgaccctgacctgacgattctgctgctgagacggccagtcaaattattcctctcccatctctagctttttaaccacacaaattaaaagctggcgagacacaaagacatgacacacttaaagcaaagtaacagtactgaatcagatgtgtacgttaagaatagttatagactcgacaggagatctgctcatctccaaattaatccggcagctagtactagctgcgtactccctccgtactccgtactcataaaggtaatcgtttggaacaatgtttaaattaaatcttaggaatataaatcatgaataactctcaagttgttgggtttaaaatgtaaaaaatatatgaatagatgtgtcttaaaaaaatactatcatacacttttcaatatttttatagaaacaagaagtcaaagttgtgtttcagagaccgagtcagctgtccaaaattgacttcctttacgagtagggggagtagttaactaagctgtgttccctcctccgacacgtaaaatgaagctcgtattactgcatgattaattaagtattaactattttttaaaaaaataaattaatataattttttaaaacaatatttatatagaaagtttttttataaatcacaccatttagtaatttgaaaagcgtgcgcgcgaaaaacgagaaaggtgagttggaaaaatgggggaagaacacagccctagtgagttgaccgttgatttcccgtcaacagctactctccctccattaaaaggaaaaagaatttctatgtatttcgtaaataaatctggtcaaaagaatatccgacacctagaaattcatatattttaacggagagagtagaacataccactcacacgtactacctgcattttaaagtatagaacatattttattttattaagacaagactttaaataacaaatatttcactaatatatcgttcatatcacataatgatgtatattagtgaagtaattatttataaccttgttcgaattaccaaaaaaatatatttgaagatacaaccacttttgaagacaaacgctggtacgagaccctctatccgatttagcggcacatttggccaagtgccggctttaaatttatcgatattatcggatacgttaattttttttataaaccatatcataatagagtacctgttgatcaaaatgttatataagaaaataaaaatatgcaatatatattttaaaatggatggagtacgtacctaccggcatcctgttccgtgtacacgtacggtccgatcctcttgtgatctggtcggtcggtccacgcacggaatgattgggtcggtcacgtaagcaggatgagcttttgtgcggattccggctcgtacgtacggccgagagttatcgagatcgccagatcggtttatatagatatggcgtcgataaaaaggtaagtatacttaagtgccttttcgttgtatattgctaatcaaaccataattaattcgtattttgctggggtgggggggggggattttctagcgagtagccgatcgagtagtacctaacttggatgacacgcgtgatgcgtgatcgatgccatgcaaaagcgatgcaaagccatgcaggattgcagtgcacaactggcgtgatcagatgaactgcggcgtttggagctgtggcggcaggccggcatctgtggtgatattgattgaatatagtgacattaaaaatagttttgcaacactgtgacacagatatttctaaaagaaattgcaccgaaagagatttatcacatcttaattgcaaagggaactggaataatagtcttgtcctcgctggtggagaagtggtttttacttccgattgataacttttgtagtcctggtttttcaaccgggactacaaattgatctttagtcccgggtaaaataaccgggagtaaaaatcaaattttagtcacggttggtgttactaaccgggaataaagatagagccgggctaggtccggttgctcctttatttttttttcttcattgtttttaatatattgatttcactccatccctgtccccgaatcgtcaaatcccaaatcaatcatccctgaatcgtaaaatctcaaatcgatcatctccaaatacatcacaaaatcttaaaaaaaattacatcacaagttttgcaaaattcatcaaaaatacatcacatattcacatcacatacatatcaaatacatctcagatccaaaccacaaattctcaaaaaataacatatctagccgctgctgcgccgccgccggcggcaggcgagcagagcggccgccggtgcgccgcccgccgccgcgcaggccgccgccgagtaggccgcctccttccgcgagctgcccggccctccgccgccgcgtgcagagaagtggggtgtggggaggagggggaatgggaggagaaggagaaggaagagatagaggagttaaaggagaaatagatctttagttccaggactaaagaaaatataggggtctaacactgcctgccctcttttgaaccgggactaaaaatgttctttagtcccagttgatgttaccaaccgagactaaagatcaaaaagtacccctaagcttttaaaccggaactaaagatatttttagtcctggtttttaatacaaccgggactattatgaaatttggccaaccgatcaaagatggtttctctagccgtgcctgtttttgttgagactggataggacatccataagatagcttaactactaaattagggtaaaggaaaattttaaatgtgcataaattgtgcacactactgtttattaatgtttcctgagagtattcctataatactttagtactaattataattacttcacatatataataagcaaaacaaacactaatattcattaaaaaggctaattttctaaccaaagctaatttgactataaggagaatatttccctaaatgtgacaagccgctatcatgcatgctacgttattcttgttcgtcccaccaaccaaatatatggacaaaacctagtcatgagacgttcctttcctattcccttggtcgcactaaccaaagactagctataattgtgcaagtagtgattcgtgtacgtacacataagaacctcatggtgcttgattttgtctgttaacgtaacggtgtggtacgttaaatttttttttgccaagatttaattagtttatctaattaatgtatcgattactcttaaatttaaccatttcatcgacacctaacgatccatttttttaaaatttgtgtgaaacaaatattgttctaatttaaaacaaaattgtacgtactttcgtgaacccacagtccatatacgcaataatatcaaatatatattgaaaaaacatatctaagaaatttcagccgactaccaaaaatgctatttttcataggaatgttggaccaggaatcagccactgcaagttggattaatggcagccaacaagaagccaatcactaacgtagctgtttcccagaggatcaaggctccattttgtgctcggaatattaaacatatagctaggtaactggtaagcgcgcactgccaagtaaaaaatgtcgataaaaactgcaagcattctccacgtggaattaaccgtcaaaattgctagaaattaattaccaaaagttaagctggaaattgaccgtgcatttgtttgcttttatcaccgcgttagtccatgttgtcctcttcaggcgttctaatttgattgtttttttcaggagttctttaattaattatttccagttgcatgcattttttaataaaggaatatattattccggcctctacataagacatgcactcaaccattcattattacaaggatttccaatttcaaaataaataacactaacaaaatagcacgtttataaaatttgagcttgaatgagaatgcttaagcacaaaacctactagtaaacatccacccatgcttgcacatatttacagttgcatgtatatataaaattacaaattaaatttgcaatgttgcatgacacgtttttccaaggaccgttatttctccacatcattgcgataagaacaagcaaaaaactttcgcactaagtgttcatatgcatgatagtgggttagctgcaaagaatgatccgtttaaattctctttgatttcaaggttgatctggtcgctgccgtgacaatttgctgcatgactccatgaggattgaggatggtcgcaccgtcctttgatgttgcttttctctgtaccgggtatcgattccgtatagaccatcttgtcaattaaaattcggtggcaccacaaaaaactaccaacagcgataccttctgcatttgtcgtagtccaacttgtaaagtgtgttattggtcgtgattcgaatactgacagaacttggttcctccaaagcacatgaaagctctgaggaatttcccaatgcaagtttatatctcttccaatcagcggcggattgatagctcccgggcaggttgggcgcgcggccgcccgacctccgccgctgctatctccatcgccgttagccattgacgtgtataaaaatcagtcggtcaccgaaaaatcactattactcgtccgggtttcacggtggtgctggttccgccactgcttccaaacgtatacagcttgatcgattgtttcgaacatatccgctctacaatttatatgaacttctgtacgtatggataggccgttccaagtggtggaaaaaaaagaacaaacaattagttaaacacaagtacctttatgacagtctctattgagtacatagtattactagtaggtactttcaatattattacaagtatattatatcttaattgtttaatcatgaattctactactagtataaaaaaattattctactaccgtacaattagtatatatgtaaaacgtctatttgaaaaagtgaaagcaaataattagtatacatgtataaaagtattcggtgatcagaacattggatttgcccttcttttcctatacttacgagagtagaatgatacggggcgccatttggctcgagataaagttttgtttcgccagggcatccacaatgtggcgtaaaagtagtccataagcaatagaatattctattcagccacctattctcattgtgcaactagtccatataaaaaaaatagcaaaagacacccatatgcatatagactaccaatatggaataaattatattatctatctctactcctctctcttcttctaatgatatcttgtatctatatacattgtgaacattgtcatagggataaactatttatgtgggttccatctatatggattactttgccatatacattggtgatgccctaaagatgctttaacattttttttgttttagttagtgtttatccacctatatatatcatcctatctttattttttaataaataatgctgttaactttttatcacacatttgatcattcgtgttattaaaaaaaattacgtaattataatttgttttgttggatcgagttgtttcgttacttaaagtactttaatcatgatttatatctcacatattttcatagaatttttgaataagacgaatagttaaatatatgttaaaagtcaacggtattctctattaaaaaacagagggaatatatgactaaattttaatacttagtaaccttagctagctagttgacaaattaatcattctacatctccgtacgtgcatatatatatatatataacggaaatatcgcctagctagttccccctagtgtaggcaatcttgtctaagatccacatatctaactaaactcaattagattttagaacactggagaaacatggatcttgttcccactgtccatacataggaggaatataatctctctccttcttttcgggaagcctgtaaatggaacgcataggagcatgcggttctattcccacatatactactcttttattaaggattgacatccacatacagagatgtggcttactcctgcagataaataattagaccatgtggaggcctcctcctgcctagactttctttttgcctatccatcatattcatatactccttccgtttcaaaatgtttgataccgttgactttctagcacatgtttaaccgttcgtcttattcaaaaacttttgtgaaatatgtaaaattatatgcctacataaaaatatatttaacaatgaatcaaatgatagaaaaataattaataattacttaatttttttaataaaacgaatggtcaaacatgttttaaaaaatcaacggcgtcaatcattttaaaacggagggagtatattgaaccaaccttactaccaccttgcctcacctaggtcattcttttaaccaattatgtatatagtgtaatatatatagtccttttagtttagtttattaccacttaatcagttttggatatgaatgttctgtgacttatcgatcgcgattatatgcatttggataaaagttttagttagtgtaactggcaataattcaactaatttctcgactaaaacaaatgatccctaaagggaaaaaaaatactctgttgggtcaccattttcacgggagaaaaattcaatacaaatggaagaattgtggactatactactatttgaagtgaaaaaaaatgtgattagtatgaatattggctgattttggctacggtaactgagctgcataaaaaactcctatcttttaattgtccgatgaattatatataataaaaaatagacttaaccgggatattttataataatctttactggtagtagaaatcagtctaaaccgtttattgtttctaatccaatgtaccgtttctgtttttactaccatatcaactaccgatattacaatagatttttctattgttacaagtcataaataaattattggaacttgtactgtgataatgctaatagtacgttctactacttgtagagatcaacttccggttgttataacagattatttaatcttgtatggaatctaatctctgtcgtttataagagaatcttgtgttctgattcttatttggtcactatccatggggtcaccgtcttttcttgtttgttcaagtggaatatctcttatgaattattgtaagaatatattgctaatgccttttcttccactgatcgattcactttattttttgacatccttttaactgtcttgtggtcgaaaacttctacagactgcaggcaatttgaacttgaggtcgcttgtcgatcgtccataatttatagccgcattttaaccatgttaattagccaccagcaattgtcggggaattcttcaacacatcatttggatcactaatcttttatataactttgttttaacccattattaattgcaagcagcttgctagccacaacaatatgacacagtaggatagtacttcctaatttggtagcaggacagagcaaggatgaactagtgatagttttttgtcctacatctgaactgcgaattccctttggaataaacaaacgtaaaggctgttcttgggagaggcaggccaaccaagctacgattgttagtggcatccaatgtacacacaacaagatctctcctcgaattgctttcgtgagcattagaagtgtggagaagcattgctttttatgctattggctgcaagaacttaacgaagaagtttcagaaatcatgttgagatgttttctttctttatcttgaaagcaatggcgaggctttatcaaagatctcaatcggttgtggtgacaaaaactagtacagatgacagttgtttgtttctgtgcttaaaaaaaaattgtaccaaacatatgatttgttatgcgatgtgttcgaattatgtaactgaagaaagaagttgactgatgtatagtttaagtgacgagcttccatcatgtcgcaaaataaaatatgagaccttgtaaaaaaagtacaggtacgatgagatgatcctcctctcaaacttggttgtatatgtttcaatctgatcatgactttaaactatctgttaattttttattagtaattttataatgatcgatcatgttcaggacggctccagaaatttaggtcgcctgaactaactgcagcacatgatagtgattagtgtgtaacctacttcagagctgcatcatgtcaaggaaacataagaaaatcaaaggacaagactaatacctagagcatccaagagcacatcaagtggttgactttagatttaatgaacttattaatacgcttactttgtctatcaatgaagttagcagccacaataataaagacctggtcccagatcaggagtacgatgcatcagaagaaaatttgctctgctttgctggttcattctgattccaccagctgtttgctatgatgaaacctctctagtattttctgaaacttcacatgtcagaccgtttactttggagtaacataagaattaagaaacgcagagtatgaaattgaaagcgagattaaagaaaaggaagaaacaatataatacttttagtggtccaatcgtcggttaattaagttattatccatgttcagccatgttatgggcgaaattcagacgtttttaattaaccccataaaagttgatagattctgcaagagcgatatgacattacacgtatctttcacacgcaggcagggctgcgcacacgtgtgatcgctctctagcctattttgctgaattgaagaaagatagtactccctccgttacgaaatgtttgacgccgttgactttttaacacatgtttgaccgttcgtcttattcaaaaattttaagtaattattaattcttttcctatcatttgattcattgttaaatatatttttatgtaggcatataattttacatatttcacaaaaatttttgaataagacgaacggtcaaatgtgtgctaaaaagtcaacggtgtcaaatattttgaaacggagggagtacatagtcatgcttcgtcggcagggtagctcgatcgatgtctgcaggctgcaatgtcgtcagctagctcagcggctatatatgcgtctccttccttatctgatctacacaagatagcccaagattggaacgaaatgtcactcgatccatgcttatctttttcctgcatgcatggatgcgtatgcatctctgcctgccaagccaatgccacctctcacgcagacaacccgatgcatggccggccggctgctgctgatatatagctggagctagcgcgtcatcgctgctgatacagatatacttgctccgtgtcaaaatgttgctatctaatatatgatcggatattttctagtacaacaaatttaaactgaaacctattttgatttgttatactataaagtatctaatcattagctaggttagtagtaatatttcgggacgaatatagtacaatggatcagtgacgaaagcagcggtttcggatgcagataccttggccatcgcgacgagcaatcaatcgatcgatcgatcaaggcggatttttctgacggattgatggtgttgcggcggttgggtccatcactccgaggcgcgggcgtcgtacgtcagggcggctggcttggctgcggagattgggccgggtagccggccggccgaccaatttactgactctctccgccgtcgtctagccatttactgcagctgctgctgctgctgctgctgcggctgtcacggcgttgtgactgaacgccgaggcaaaaccgtcccggagctgacgaaatttgttcggtgatgagatgccagtggttcttgtctgcaaacgtcgtgacaatttacatcattgccggaggtctgcgagtcatttgatggaagagaagaaaaagatgtctcggctatgtttgaagcaaaggtttgagaaccgtttttcctcgacatgcaaaatggagggttgagttagcacatagttaattaagtattaacttaaaaaacttaaaaaataaattaatacgattctttaaagtaattttcctataatattttttttatttaaaaaaacaacagtttagtagtttgtggagaaagagtagtaaaagttaagggtggatcactgcctggtcttttaactgaccaagtggccatgtttggagagaaacattggagatgtataccttagtgaaattgtgaggttaattctatttggatttgaataattgggaatcatcacagtccgtatgcaaacaattaatccaaagttttctgtagggaaaaaaattcataaactgcaatattcattcagtgaactgaggccaaaatcagttggacatgatgtgtgttgccaaagaacaagattatatttctgatgatgggcccttaaacttcaatttaaagcaaaatgaagcctgcttcacagattgacccaatttgctttgggccttaaaaagaaaggcctaacggtaacttttaggtccaatcagatccagcccatagcctaaccagcccattgaacccgtctcttctacccttcgccgacatcgccggagccgcgcggcgcgcggcggccggcggcgagctcggatccccacctccacccctcccgactcccacgccttcctcctccactgcgacctacggtgtaggcgcattccgcctacgtggcctcgcctccgcctccggttcctccgccacgacgtgtccgcgtcccgtccactcgcccgatgaggaaatttcccttctgtactgtttcgcacgactcttccgccgacgaattcccccgcttccccatttcgtctcgcggtgagtttttggtagtttagtttgatacaccacttcgtttgataccctcggcgaccgcgcggcggccagcgggcgcatccatggcggcggcgggatccataggcgtgtacagggcggtgttcgcggcgctgggcgctctcatgctgggcaccctggtgtacacctgcgtcaccgacggctcgccgtttcgcctcgagctgctcaccccgtgagtgcgttgatacaccacttcgttttccttccccctccatggaagaggattgggtgctagttactgccgcgaattttggtagtgctggctaatttcagatgtgctagttactgattgttagtcagctattgctttttttactaaagtagaccatttcaagcttttggatttttgttttaaatttaggcgtaatgattagcaaatgttgggagtcactagtactattttaagtattattccaatgttattgtctgtgacctgcacaatggtgctgcagaaagacaggaagtataggtagttctcgatggatgcaactttggataattaagtgcaccaattatgctctagacctctaggtttgtagtttgtgcccaaggctttgagagagtttgtatgttcttaacgaatgaactatgtgttgcatcagagtagggaggtcagaactattgtccaaaagcgccttaacttgaagttgtaatttttctctgtgtaggtggttggtggcaacactgattgatttttatgtcaatgtgactgcgatttcggtaattcatttatctctgtgctgtactttgcgccctcttcaccaactagttattttgttacgaaggaagtgtttacaagcagtatgattagaaggaattattttctggagcgtgaagtgaaagcggcagcagtcaattgtttgcatgcattgtacaaaagtgcaatatgttctaccattttttaaatctgttatttacgaataaattcaatgttgccaaaacatatttcataggagatataatgcttggagttagaccttttttttttctgtgtgtactcaattgataaaatgtttgctaaatttgcgaatctggtgaaattttgatttccaccaaacatagttcctgatctgtatgagggaatggtatctaactggttgaagctttaactaaattgcatgacgattgatctcagatatgaaatgatagtagagaagttttgttgtattatctctcttaacatgtattttttttttgtgtgtgtgtgtgtgaagtttggagcttttgctgatatttctgctccaactccaatctgtgtaccactgaaaaactaacagagaattcttttgtgtgtcttatcctaattagctcctttcccctgattaagacaaacaatttctagattccaccttaaatatatacacaaactaaaggatatttggatctgcaagggttgaccactcaaatgctttgctctacatgatataaataatgtaaaagaaaatcattatttatttgtccgcttcatgtatggagatacaattttaaatattatttcatcttgatgtgagctagagatgttcttgcatgttgcagacttgggttatctacaaggaagtaaattggattagttctttcttttgggtagttctgttgtactgttttggcaggtactcatttccttcttgataatatttgtggcttgtcaaactttcataattctgtttgaatggagatattcattttacctaatgtgatcatccttttttcctgttatcttttcagtattgctacatgtgcttatgttgttgtgaagctttttgaaataaaaacttccggaccttcacaagatccacttgatcttttattcctcaggtacagattcaaatttttcctagcgtatgcaggatgaaaagattttagtttgatgcttttgacagcataatttggcaaatcaagtaaaaaaaagttttttttttacatgctgatattgaaaacagaaatggatttggcaattttgttctttttctgggctgggggcactgatggtctggtggacatggactataagaagcttatattggttcatggttacgctatgttctctttcaactttggggggacctgtgaaatgtgttatcctgtagatttcaacacctacaacaagaaacttttgctttcacagtttttgcatcttttgggtctagatccctcatatgttgagtaatatacctaacactccaaattccatagttccatagtgcatgctctcaccaatgtggtgaccttgtgtcacattctggatgtctaaggaatattgttgttcatatatcaattgttattcttatcttctgtgttttgaggtgtttctcaacttcttttcaggcaaggagatctatccgaaagaaagtcctcttttgtcataattgggagaattattttcagcattttgggggcaatgatggctgcagtcgtaatttatactgtcatcactgatggactacctttcaggaaggacttgttgaccccgtaagtgaaccatatttgctcagattatttaagaaaccttattttctttaagtacattctaagtccagttgaatgcagcaagcaaaatggataaatcccagtgattgaatgaaagatcacagaggcatagattgataatacagctaaaggaaattttgaaaataatatatttaataagcaagacaaatgtgtatttacaagtgctataagcaccctatgctgaatttacattcaagagttaaactagtaactgtcttgttaggagcacttagcacttaccatagttgtgtacaggcaaggagaacattttacttgtgttctggacttatcttctaaaaatttgactgcaaatagtcataaaaaattctgaaataacttagcagtatagatcattatctataaaaacaatgtgtaaaaattcaactgcaaatgtggcttgtattgggagaaacaaaaaaacaaatatcagtgaatagtagctttccctttttctttttgccattccactttccgttgaatttttcctttctatttcttcatgtccacatcaaatttagatttgaaattttctatcatgatagttgatagatttattttgtatcaccactaccaaattatttgagaaattttcatgactattttcaccataagagtaggaagcacaggaagtccatgcagagttaaaaaaagaattttggaggccagccctaagtaatgctctggaagtacattttcgattagtatagtgttgtatatgttttcacatgatttgttaaatttatcagtacatgcttcaaacatgctaactctgtagatgttgtctggcactttttattttcttttttccttattatacttgtgttatcaattagaaaaatatcaaatttaatattttcctttgcattcaggtggatggcggcaaccttaattgacttctatataaatgtcttcgcaatatcggtaaattacattctttggtttttagaaattgttccaagtaattttgtgcgacacactagtttgcctgcatgaatgcatctgcatcttggaaattgttgttcatatttttgtgcaaacggtgggaaacgatttttatttgctaaaactacttttgcatgactctattgttatttggaacagttgtcttaagctcagctctaatcatgccatggcacccacagttttctgctaatagttttttggtatttgttatgaaaatatattccattaaaatctacaacacattaatccttatgtccagtatattttatcatttttttctttcctctttgaaaatatgtgaagataatcttattttttaaaaataaaaacataagcgctaattagcaatgctagcacaacctcccacctactgaaaaggtgtttccatgaagtaattaatacgtcctgcaactataaaatggcagggcactgctggctggtagagtggtagcgtcctaggcactgcatgtagtggctatatcttctatcagtaaattaaaaagaaaaccatcatagtggctatatcttctatcagtaaatttttggtgatatgtctgcaggtatgggttgctcacaaggagtcaaactggatatctactgccatctggatatgcttgttaatatgctttggaaggtacacaattttttgttgaggattataaaggaaacatctcattggatatctactgccatctgggttgctttcgaaggattatattgctacattgcattggggttatatttgtccttgtgacttggattttactgcatgaactttgtagaatattttttgtttgcacttcttaatcataaggtgcaactagtagttactgccacctatcaaatactgtagataaaatattctacagattttggcaacaaattagtcaaattcccaagtatagataatatacaaaaattataccaatagattgacatttcaaagtgcgttcatacaatataagtttgataactactgatatatattttttgagaaatcaattatcgaagtttaatcttgaagacttttaaatcaagtatgccttataaaaatcaatgaaggttgtgccatgttagctgtatgatgcatacatttttcctgccacttgtattttctagtgcttctccttatgagtagtgtctagattatgtttatttgtatatgggaggcactttcctgctcaagaatagttagtcacgtaatatgaacatctatagtaaattcatcagtgagttatgcgcatcatgatgtatttatttgtaaggaacttattgaccctttccactttttttcatttgatctagcatcacgacatgtggctacattgtcatacaacttttccaagtgtcgtaccgagacccaatctatcatgtgctattgaactctcataacaagtatggcattgttccctcccactaatccctgatcttctccaagccttgttagcttgtggttgtctaaactttgcttgacatatggtcatttatctggtatttatatgtctgaaatgtaggaagatttgaaaatatcattgaagagttatgttattcttggtatacaataatattacctcaataaatggtgtatcgtctagacaaatagggaattctcggtgtaattacatatcattctcagtgtaatgacataactttggcaatttctctacaaaaggaccagactatatgcagtttgcagctcctttatctgtcgtgttttttaattaaccctttatttgtatatctgatttagtcgatttgcaaaagttttcttcattgtagttgttatcaaaattgtaaggtcatgtaacacaaagggttactaaagtgaagtaaagaaaatgtgactgtcttgtttaactgggaaattatttgaattgccaaataagtttgcagtcttgctgaaatcgggctcgcaagactcttttgatttgatacatctctatcttgagtgtgtgaaggagcctcaacgcagagcagggaagacttccaagcattataccccctagctctgccaaagtatgaagaatatgtaagccatcttttgccagttcttttgcagacagaattccaatatgcagggattcagatcattctcattttgttctttctgttggagttagaaaaatctttgcttcggcatactctcaaatataatagctttgaattctggacccctggaaccaattcttggtcacactgtcaatattttaacaaggtttcgatgtgtaacacttgtaaaactcacattctgtaggaaagctttgagatgcctattgttgatgtatcctgtaggttgaatagcttcacggcaaggttaccagaagcaaaccatgcttgccgtatgcgttgctgggccaatccatagtttcaactgatgcattcattcatgcgtgacaaagctcagcgtgatgtgctcgtgaaaagattttaggttgtttaaaatgcaaaaataacaaatatacctagttgaaagtaattaactagtgctccaaaatacaaaaataacgaatatatcagtagaaaccacatctcgccatcgtcttctcctgcttaaggcgcctgcgcgtgtcctgtcctcttaatcaagacgagaaagcgaaagcaaaaccaaattcgtaatcttagactacaaccagcctcaccagctgagctcaccatgaaatcacaccattgcttcctttcatctgtatctatccagcagccatgatgtcggatcgagtttggcctagacgatggcaagctaaagaacctcctctgggtagctcgagcgcacaccgccgctctcttccgctgccaagcccacaccaacaacatatctcgatcccattctccgttctcctgacttctcatcgcaacaactcgctggagcctatcatgaaagaagggaacgagaagatcgaattgatggctgggaagtgggaaccaatggatgagaaggataagaaaaacaatttggtagtagaacccaccaacggtcagtgattgaggaatgaaaaaagtattactccttcccaccgaaagtatgattctagatttaaattttatctcaaaataaatgtaattctaccatactatttgtaatatcaatcatatatactagccacccagtcacgcttcgcatgactctgagcgccggcataacttgtgtataggagttgacgacggatcttgataattacgggataatttttgtgagactattatctctattttttaaatataaggatttccatattgtttaacaaagattatgtttaatcatataaaatttttatatccctttacggaggaatgataggagttgagaaaatagttaagagtaagataaaataaattgaatgggaggtgagattgaagataaatccttatattttttaataaattttaaacatttgtgatgcttatatttgcagttagagagtctacctttatgtttttttgaagggattagggagagggcaataaaattaaatgggagggttgtgttttatttttgtttctgatagaaagtatatgaagaaattaaatagaaaatggttgtagttggttgagatgatggaatagaagtaggataagttttatatattaaaagtagctatatttttagatgaagggagtaatataattggcactatggtggatggatttctgtagttgtgggtcaatgaggcgagctgctgctgctctccatctatactaaactatctgtatatgcaccgatcgatgcacaggacctattcatctggaactctccctatgtgtgattggtatacacacaaatggatccaacggtccaattttgttcctactctcatcctaaggctattattattcacatgacgtggcttattagtttatgagaaagctggttgctttcacatatgtagatactagacaatcatactttaatggatctttgtaataatgtgccataggtcattgagcaaaagctgaaattttattttattatctaaaaaatcaatcacatattattcaaatttctcttaatcttatactctatcctccctctgctaaaatgagagagtacttgatcatattaaataaaagatattactactcataaaataattctttgttatcgcccaagagttctcccataaatttcctatattttcaaatcctgcaatcttattttaatcccaaaattttctactaatgtatctttttttttcaatcctataatccaaatatgtttttttccctcttctatctccatttattattaacatgtgtatgaatcgcaatataatcatttagtagtaatttatgattaaagtgagacgttgtaatcaacaataacagttattcgagaatggagtagtatttagctgctgtgaagagcccttgtgtgagagagttgtttttaaaagatcaaccttaaatatctcatagcattcaactacgattttttccctatccattttcgttttacgtgttttcttaattcaaaatacggccgcccctgttaattcgttcgatttttgagagatgacaaaatttattcacgcaagcattaatttggatgtaaatagattttacccgttgcaacaaacggatatttttctagtttagtccaaagtaaacagtttagataaaagatgatcaaaagtaaaactttaataataaaagatccaaagtacattcacactatatatttgcaacactaggcaacccacacgtcacggcctcagggcaagttttatgaaataggtggatcttgcatctaatcttgaccacatcatcaactaataaatgtagaggtaacatgtacaatactcacatctacactaattctaatatactagccccaatgtttgtttgtccaatctactcttcccctctttccttttgtcttgaattttgtgtagcggttatctcttgcatgagaggtggctgcttatctctctcatctcttctctcctccacttcactattttaacttatgtgacatctaggagattgtgcttggatgcccatagtacgtgccctcagggcagtcccaacccataacactagacatggtttctataaactccacgtcatcaagaaactagtactagacactattcttccaatgcaaacaccactattccatactccaatttaatgctacttatctcacatgatgtcttggatgttatgtaggaaccatgtctcatacaagacatggtttccttctctttcctcatttattcacttgccacatcattttttgtcttaagtggcaacttatttaatgctatggataccatcctagttattgggttgggaatgccctcacaaactcacagtaaataccggccttcattaatttttttcacaccggctagtctattcgaaccatcaagcgcaagcacattatctaacaaaaagctgcaaggagtagattggtatcttcatccgtgcaatttcattgttagtttgttggcttgtggcccatcacttttcaccatgaaacagccggtgcatggcatagttaactattattctctctaaaaaaataaaaaaaaaacttcttaaaacgaatctggagattatatacaattactcagctcgagaaaagctcaaagcttgaacgttctgagcccaaaataaagcttgagatctggtgaggctcgactcgagcttggctcattgacagctcaaatataggcaactatcaatctaattcgcaatactagtatcttcaaccctcaattattaaaactagtgcaaaataaccccttggtggttttaaggatgttcttttgctgacgtggcttgttaacttaatctaacctttgagtcatcatgttggacccacatgtcatcctccctctccttcccttctcactactttcctctccctcctctctttccccttctccacagaagcaagaaagtgggaggacgaggagagcgggagcggtgacggcggtggcgggaggacgaggagagcgcacgctgcccgcgagtgctaggagcacgttggagaggtcctcaaccagccgccggatactgacaaactagagaggtccttgaccggccgctggcaaccaaatctggaggtcaccacctcccatcgcccttcacccgccgtcctcaccactgcagcagccgtaggcgccgtcgcacgtcgctgccgccagcgctagggcagaaggggccgagaaccatcacccttcacccattgtctgcaccgcctcagtagccgcaagtgacgcccccgccgtcgggccctcgccgttggacgccgccgctccacgtcatcatcgttagccactgtgtgccgagaagaaaggaggagagagagagggagagagggggagaggttagtagaggaaggggatgacaagtaggaccaacttatttttttaatttatttgatgactagggtgtcacgtggataccacattagcgaaaaccgcttttaaaacaaccaaggtagttgttttaaacggttttaatagttggggaagtcattatatctggtcttgtggtttaggatatgaattagattcgatctttatttaagggagtcaaattggacttttttttacgtaggcgcatatgttatacttgtatgttaatggaccggtataagtccacctgccgtccctcaactttacatgagtttgattgacctttttaatttcaaataccataaatctttacctttagactgtataaaactgtgcaatatgtcccattttcactgtttttacttacgtgccaggtgtctgggccggtgggcccacttatcagcatcatcatgtgagttccgtgcttcggtgcttgtgcccgttggtgtgccagagcccgagtcggtggcacagggggtcacgggttgaacggcaacctgccgccgccgtcggtgaacgtggctcatctgagccagatgttcgatcggcgccaagcagggggtcacccaggcggagatggtggcgctgtcgggctcgcacaccatcggccggtgtgtcgccctccagctccttcagcaaccggctctagtagtcgtccggccccaacgccgggcaggaccccagctacgtggcagcgctggcgacgcagtggcgcagtgcccgcagcaggaggaggccgggagctggtgcccatggactggacgccgtcacgcccaataccttcgacaccaactaccatgccgccatcgtcgccaactggggattgccaatagtcccgactcgttccagaccgacttcgcggccgacaacgtcaagatgggctccatcggcgtgctcaccggcaacgccgccggcggcaccatcaggaccaactgcagggtggccagctgatcgatcgatctcattccataagcaatgtatagtataagcatgtgtgggttgggatcgtattgatatcaaattgagcttccggtccaaactattgggatccaagttgaggagaacgtgtagactatgcatattattggaccggaaaggtacgcagttaacgtgcggtccatgatagttagggcggcatggaaattgttcacgtgaggtccatttttttgggccgaggccggtagtaggagggcctggcgctcgattcctctgcttctgcttctgcgtggagagggaggaccaattcctcgcgccgccgccgccgccgtgacggacacatcttcgacggcccccgcgctccaccaggggggtagtttccgccaggtctgcttcactgtctcctctgcggcgtcgtttgttccatcgggcgattcgcgtcgtccgcgggctctgctctctcccggcctccccggaatcgctctctgcccccgtcatgcggtcgcagctcgagagtgatggggggggggggggggggggtctccctgctgctagcctgctagtgaagtgcctgctgtgatactactgatcatgcctaccggtaggtaccagaattggcagatttctcaatacttttttccttcaccagtttaaattgtgtggttaatactagatgacgaagtagtaccctatataataattcattgattcattccacacgacagaaaagtaaacgagacagatagaagagctcaatactgaattttaattatttgttacaaactggcatagttatcagacattattacacacataaatattcactagtaagactgaagaggagaaaatgacatatcacaagctcaaacaagaaaaatgtactagtagcatgtgcgacataaaagaaataatcctttggcttaaccatgcagtgctgaaaattcttctttgattgcagcgacttccttgtaaacgctttgcattgtcggccgatctttaggtgccactgcagagcacaagaggccaagcttaaccagcttcgtgacacagttcagcattccatccatcaaacaattatcatggtctagatcattgtttgcatcattgtcttcgttctcataatctggcatgatgctcggatctagaatttgaccaatcttcagaggaaatgcctccttggcaaattggtgaaggttcaagccatcattaaacatctcatctgttggacgcttccctgtcaacatttctaagatgataaccccatagctgtaaacatcaccctctgttgatattttactcccgaagccatattctgcaacgcagtttataattaatatgacaaaaaaaatgaactcataaaacttgaaagaaaggagtttataagagcaaatcagaataaaacacagtcagaagaaacatgcaaattattttacagaaaagacatatactatcttttttgtgcattaagaaattctcacctggtgcaatgtatccaatagaccctcttggccccagtaagcttgtagacctatcacttgtcgaagaaatattgctgtgaaggaacttagctaatccaaagtcgctaacacgtgcacccatggcattatccagaaggacattgcttggcttcagatcacaatggacaataggtggcatgcaacggttatggagataatccaaagcagcagccatgtccaatgctatttctattcttgtagataacctcactggattcctcggacgattcttgtaggatgttggatgcagccaacattctaggttgccattaaccatgtattcaagaacaagagctttgaactcatgtcctgtcggatcaaatgttgagcatgcggtgatcacccttacgagattgcgatggcgggtgttcctcaaggcctcacactctgctatgaagctttttggtgctccaagttgatcaagtttgaaaactttgatagcaactgcatgtgcttcggcgtcaaatttaccaacatatactgatccatatttccccgaaccaattaagttggttggagaaaagttgttcgttactttgactaaatcagcatatgtgagtttctccaatttcttatatgatgggtctgttggatttttagctttttttctcttcagaaaaaacactgctaaacatgacaaaaataccaaacagaaaacgctgagccctactacctttgcaatataggaagtgtggttgtttttagaagcagatatctgacaaagtggcaatttcagtagtggtgagatggcacacaactccttgttcccttggagaaaaaccttgcttgcattttggaagatcccattggatggtatgggtccctctaggttgttgaatgacaaattaagaagcaccatagagctcagagtctcaaaaaactctggaatttgaccagataagttgttccgagaaagatccatctgaatgatgcctctcagtgcagaaaaagatttaggaatttgcccattaagaacattcccctccatgttgagatactcaagacggacacaatcacctagagctgagggaatttctcctgacaatttgttgtttgaaatattgagggggccaagattaatcaaactaccaacttccactggtataggtccagagagtctgttgtgtgagaggtccagaccttcagaaagtgtggaaatagtaaataattcctttggtattgttccttccaaggagttacaagaaagatttagtatatctagtttttggcattgtcctaaggccttggggatgagtccactgaaagagttatcttgcaggtaaagctcagttaactgatttagtttaccaattgaaagtgggattttcccataaaaactgttttgtgctaagcttagaatgagtaagtttgaaagatttccaagtgagtcaggaaggttgcctgtcagcaaattatggtcaatttgaagcagtacgaggtttctgagttgttctatctcctgtggtatggtgccagagatgaaattggatgtcaaaactaatattttcatgctttgtggaagatcaccagtggaacttggcaggcttccttgaaggttatttgcatctaaatataattcggccagctgtgtatgtgctaatgctgggaggaaagtccaatctccagcttcaagctggttcttacctagatcgagaatggtcaagttgggtaaggacccaaaataaggaataatacctttgaatgcattttctctgagattaatcaattgaagatttgttgctttggccaatgatttgggaatttgaccatggaatttgtttccttgcagaatgaacatttcgatgcttttaagagtatacccaatattttgtggtaattctcctatcagattattttctgccatgccaaggaatgtgagtgttgacatattgtagagagggagtggaactgttcctgtcaagttgttcccagtgaattccagttcttctaagtacggaattctacttaaactcgatggaatacttccttgcaattcattccatgcaagcagaagtgagtaaagtgaagtggagttgcctagagaagatggtatgctacctgagagattattgtaggacagataaagaaattgaattgatgagaggtctgacaaaggtggaatggacccaaaaaagttgttttctgccaaatttatggcctgtagtgaggagctattgaatagagcgggtggtatctctccaccgatgtgattcttccttaagtcaagccactgaagtgatgaacaatttgctagcacagggggtatacctccagtaagactattgtttgcgagaacgacataggtgagtgacgagacgcttccaagtgaatgaggaatgttacctgacaagttgttgctatgggcaaacaaaaccgaaagtttgtcgagcgcggtgaacccatcaggaatgccaccgtgaagcatgttttcatggaggacgattcttttgagatttgaacagttgctcagaccaaggggtatctccccttggaggaagttgttcccaagattaagtatttcaaggctagagcaagaagatagagagtttggtatcacaccagtaagattgtttgaagaaaggtttatgtaaactagacggcgtaggtggcctacttcaattgggatctcaccattcaacctattattcgataggtgaattcgtgtgaggaaagtgagattgccaatacaggggggtaaatggccattgaggtctaaggactctaggtgcagtgctgtgacacgagattcatgtctctttccgcaggtgataccgggccaagtgcaaaattggagagactcgttccatgaggctagggatcttgcattgttagagagacgagacttgagacaaaggagggcctggagatccttgttggattcatcatcgagtgcggtgctacttagtgacggaattaatgggagggtcaagaaagcatacaggacagcaaaagtgagaagtgagggagtgagagttcctataggaatcatctatccgctactatggatgttgttgctgttatgtttgtggaagactagctgtagcttgggttgtgttttttttcagtagcagggttatgtgcatttataggttgccggaggatagcggctagccatttgttgaatttgttccaacctcacagatgcatatctacagtcaaagattcaaaagaaaaagaaagagttggttcgtagtccatctttgctgtcgtgcagactattcaaacaatggacagtcctctatatacggcaaagcattgtaccgagtacaaattttgtgcctgaactcagtttatccattttcctgagagtgctccccagttctacttgatagccattaatgcctttcatgttaaaacattctataacgttttatttggtttgaggaaagaggaacgactctcttttaaaaccgtttgaccctcatcctgtgcactcatacactccagcaatcaggtccttcgcatctcaatccgatggctaggatctggtagggtgggtaattttataaaaacccacccgcctcctatcttctacctttgcataaatcccctaaccagttcatcctcccattactctgtcagagcacaacgctgcgacaaatccaaagattccttctaaaccaccattccatatttccatatagcagagaggaattaaagatttctttttatttttttagagaaggataactttttctctgtctctacaatccaaccggatacccgtggattcgggtatccacggatacccggcccgatgggcacggcatggcgcgtgggcaccttttcttttttccgtgggcacgcccgagctgttaccgagtctctttaagttatttgctcctatgaagatttgaactcatatccatggagtgctactctggttactgcaaccactgaactacatgcccttttgcagagaggaattaaagatttaggttttggatagaacgaataggagaaagaagaattttaggaatctaagagtggatatctagcacttgattccttatatctatggcctaagtcatcgcttcgtatcagccttcttgtgggtgggtgctgccatcgccctcatcgagcagcttcacgtccccgtcattcgtgggagagacaaagtgatttgggggtagctacagccaaagaacaggaaacccatgccagggggatttttttttaacaaatatggcagattttattcatttaggatagttacatcgtttgctaacaaatcaagaataaagctagggggctcatcgtcccgagtacagttttgttttacctgcatcgctctctttgctaacttatacgccacttgattcgcttacaaaggtacaaggtgggaagtgggtggtttattttttctttttgtaaaattaccctaccaagatcctagctatccgattgagattggaaggaccttattttactactggatgagtacacgtgatgtgctgagtgcacctgatacattgccataatggaatagaagcatcagacatctggatctacttatctatcctacaaatagttggccttctatattagtgtacgccagaacttgtattgaagttcttaaaataaattgagtaaattttacaaacctacatatacttccatagatttaaggtgttctacaataaatttagtgatgccgtatctgtaattttgttatacgcatccttaaatttatagtcttgcaataagttggtcaaagtacatgtcgttttgtgaaatttatttaaataaataacatgtgataaagtttaaaaagacaataacgttatattatttgtttctgttttttttttcatttgtgtgcttatttcagttttggagacacgtgtaggcatttgattttaactaagtattttttaattgattgcataaagaacaaaaggtgtattagagaaaagtgtctaaaattgtcttccttgtttaatgcattgtctagagttcgaagaatctctctaggatgaaaacttaaaagtgtctaaaagtgacttatggtctagtctttgctgattggatcatggcaagttgataacaacggggtgtacatatgcattgttcaccttttggaggcgttattttacgagtctttatcatagttgaggcgtcgctcgctttggtggagcatgagaatgaagtttgtttgtggctgtagcttgttgtggcatgatatttgttttttcttaaataatgctaggctgtgtggttcttcttcttcttcttcttcttcttctttttttgtgagtggaggttgtgtgcatcttaggtaatggcaggagtcgtattagagtggttgtatccttaaaacagaacttaattatgtcacaccatatctattttttttcggggaaagggagatatattacgaagctatagagtcagcaccgacaaggtgtgagatgaaattacaagaatcatcaggccaaaaggccgttaaggactcacacctccctctattagctaagatatggctaatgcgattctgatcacgatagattttcgacaccaccacctccctatttccagccatgaggcatttaacctccttgactagaaatgtaagctcagacctgatctctattaacagttcatggtctctagtgatattctaaatatagctgctgggtcatattgaatcgccgtacggatatacgactatagttatagataggttatcttgttaattagattctcatgaacaacgtgcttccaagaacaatgttttgtttatgcaaactactgcaaatctaaataagtgaaaggtggaaactttcttgcaagattacatgtccatgtcatctttaaaatacggaccatttgatttttcctccagacattgctagccattagatccttagattggcgaaatatcttcgttccccttcaagaaacttcttttgtaaagaggtcctcccacgtccctaaccaaaaaaataaattgtttctcctcgttgtctccactcccaaatcgtgaaaacgtgcactcttcgctgccgtcagctcctcctccatgccaccaccacctcctcctcctcctcctcctacctaccccatctgccgttgctcctccactccatcctcatgcgcggtcgccaggcaacacctccaatccctccacctcccaggtgaccacgcagcggagcttggctgtgtgtcccctcaacatccacaaactcagaggcgatggattttgattggccggcgacgaagaaggggattcgacaacgagccgcttcttcgtccctacgagttcacatgcctccgcatactaatgatcccacaccgcttctgccatcggcgtcgtcctccccaattttcctccggggcaactggtgtgtaatactgaaacacaactgaatgcaaattcttgaagatctggaaatttgatatggaggaaagagttgaagccccggaagtaaaagatggatctttaatcccggttattttaaccgattcgtagggggttcccaattgggagtacaaagcctttctccagcagtgtttctgagccactacagaaattctatttgtattaactttagtgaaaattttgaaactgacattaagtaaataaataggcctatattgttgaattttcaaagcctgtttgcgcttgggcagtaaaataaaaataccaaagttaagagagtaattaaagaggtaaattaccactataaaaattattaaataaatcaactaaattgggcctaataacattccagaaaacctaataaaactcataagtgaatacatcccgacccagagctttattatattccgtttaaaaaatagcatcttgaatttccttctactaaattttctaattgagaaacctagagaatattacttatttggctttgatctaacgtgtggcatctggctggggtgcttttacgaaacaccaaccccataatttgtcgagccaaacgagcttcttgccagtctgcttatactcggctcgtttcactcacgagctgtattgtaggcttgggctcgctcgttccatacatgccgagctaagcctatgcaaagactgagtgaaacgagcgagcccacattacttggttaatatgttcaggaatgttttctactctattttgaatttcgtctcagttgtctagttagggcgggttaattagtcaggtactagatcctggtccaaatgttcatccctctctcaaccatgaacaaacaatttcgagttcgaacaaggcagcagccacgtacaagcattgctgaagaaaccatctttagtcccggttggtaacccttttagtcttgggttttcaaccgggagatgaaattcgggaccccggttaaaataatcgggactaaagatggacctttagtcccggttgataacatgaaccgggactaaaaatgtggtcccggttgttattaccaaccggaactaaagatttgtttttctattcctttcatccggttggtctttttccttttttattgttcttttgctctatgcatatcacccaaatcgtcatggatcggatcgaaggaataaaatcaacaacaaagcccaaatcatagatcgaatgaataaaatcaacaacaaagcatccatattctttacacttattcacatatacaacatcttcagaacaacaagcattcatcacagagaatagagaaaagaaaaaaaagttcacatctacaacatcttcagcattcatcaaagagcacagataagagaagaaaaaaaaatgttcgtccgccagccgccgcctcccgaccggcgtcggccgcccccgacgtagccggccgccgccttcccgaccagcgccagccacccctgacgcagctggctgccgccctctcgcgtccgccgcctgcgctgcccgccgttgctcgcctgtgtcggaggggaggaggaggagagaggggaggagcagagaaatgtggagaagatgagaggtgaggatgagatggagaagataagatgtggagaaaaaactgagaggggaggaggagatgtggagatcgaggactttatcgcgcgggaggacgaggcggtagggcatgtgacgcgagggattttttttcccggttgttgtaatcaaccgggactaaaaatagatctttagtcccaccaacgggactaaaaataacattggtctgacaacgtctgccatttattgaaccgggactaataatgatctttagtcccggttggtgccaaaaacttttaaaccgggatttttagtcttagtttgttagactattgtaaaatttttaatcgggactattgtaaaatttgatcgaccgataaagatggtttctccataagcgaagtttggcttcatggcgcgtgcaaaccacctttagctatgccgtgtatccaaaaggtactaatttgtatagtttcatacgcagaaattgagttttttttttctaaaacagagtagtcgtagccaccggttttctcctttagttacctcgctcattgtctgagattaagcggaccaattaaaggtactggaagttgtactggaattgacaatgtgttgtgaattgacaagacagcctgagattaagcagaccatgccatgtgcaaaatatcaatgtcgggcaaatgataggccattaggaaggtctaaatgcaaaatagtactccctccattccaaaaaacaagggattttaacattttatttgtactatttgaccattcgtattatttaaaaaattttagaattattatttattttatttgtgacttactttattatccaaaatactttaagcataacttttcgttttttatatttgcataaattttttgaataacacgaatagttaaacagtgcaaacaaaatgttaaaatcccttatagtagagggcgaaggcagtattacctccatcataaaatataatatttttttgaatgaaatatatctaactactataaatttgaatgattctttgtctagatttatatagtataatatgttccacctatctaaaaattgttctactttaggataaaaaaagtatggatgttagaatttatggctatggtgagaaaggaaaatttccgaggtgtgtgtgtgcgcgtgttggggcttgggagagggaaatatatatattatatgcacacaaattttccgtgcatactccatatacatcaactagcaaatgttattaaaaattctagaaaaaaatggacacatagttccaataatattacacttacctgtgaaatcttatcttcaaaatcattatattttagcccgtaacaaaaaagacaaaattctgatacatttttatccttaaaactgtcagatttttcattttttgttatggctaaaatataatgattttgaatatgacactttgtaaatatgtgtaatactgttatgagtaaatgttcaatttttgtggaatttttgtgatattttgtagttagtgtgtacgccgtacggtagaccagaagcttgtttgtataggagagagataacatacatgacaattcggacataattattacaacgatggtcgtagattcccggaaagaaaagaacaaacaagtatgacttaatgtttgtcttttccaatcatacatgttttaccgcgtccggaattgtgccagattacaaaagatttatatttaatgaaatgcttggatgagcgacgcgccatggatatgctttggtatatcttgagttcttgggtcagtcgtccctcgctcttcgacgtgcttaggagggcaagttttcatttagagctcgtgtacaattcttctttttttttttttgaagaaaagggttgtggacaattctaggtatagcgataatatagtagtgtaattgcgcagataatattgtagagaaagtgcttttttttccagaatataataatttttaggattgaacatgaatgttaatttaataagtaggtagaatttaatgggagaaaactgttattggttgggaagtaaaggcaagtagaaaatttaatggtggatgattataattgattagcaagaatatattgatggattaaattttaggacaaatttgaagtctagaagttattatattttggaacggagagattacatcctatatgactaagtaggtgaaatagcaaaagaaatcttgccatggatttaagcattaacaaagttcttaacgtaagactccaagaacaaactaataatacttaaagtttgattttgaagaataatttaggtagatttcttttacttttctggttagaatttattaaaaaagatcaggcaacaaaggtgaaaagaaagcacttaagtcaaatttatagtgtgttaaaatctgctctagattaatttttttttaagaattacacagtacaacgcagacactcacccctataaacgcacacacgcaaaccctaccccaaaccctaaccctatgagcatatttaaagacttgggtggcaaatccttgagaaagtcaccacagacgcctcgctgtcgaggggtacgtcgcctaccactgaaagcacgaagccgttaaatcctgaaaaatttgctcccgtgaggagtcgaacccaagacctaaggttctactcaccactaggctagaggccctttcgcaaatctgctctagattatgactcaatgagaaacatagttggttcgtagttctactaatgaaattttgtcttactttttttaaaaaaaatacataaaacttcaaacaaatttaaatgcaaaacaaatagctagttaagtaacttattcgaatgaatatgttaccgtgctcagcctgtccagtcttgatgaacccatcccagccctcccaggccccagccgttgataccttatctatcacgggaggtttgtgaccgcacgagctgtttctctccgtatctatttttctttattttcttttaacctttttgattgttattttcgaagataaactctctcctaaaccgatttccaagtcattcttttagccttaacactactacacaaaagctaatatgtgctggttgggagccggcactaggtgctggttttcccaacggacaccaccgagaccgcactaatcactgaaagtcataaaccggcacatttaaggctgcaggaacgaaaaaaaagccggcttgatgcatcgagcaatttcacttcaagaacatcaagaacatgagatgaacacacaagatgaacacaataacacacatgaacactcctgagtccccctcccgccgggccatcgccttccctcccgccatcgcccaccgctgccatccccgcctcccctcctgccaggtcatcgctcccagccagatctggcagaggggaggcgccgccgctacctctgctgtcgggccgccgtcttccctccaaccatcgcccgccaccgccatccccgcctcccctcttgccaggtcatcgctcccagccagatctggcagaggggaggcgccgccgctacctatgctgtcgggccgccgccttccctccaaccatcgcccgccaccgccgccgcccctgcctcccctcctgttgggctgccgctcccggtcagatctcgtgaaggggaggcaccgcgccgcagccgccaccgcctcccctctcgtcaccgcccgcagccgccacccccacctcccctcctaccgggctgccgctgtcttccctccgacgacgcgagactgtgagagaggcgaggtgagagctgagggaaaagagataaggagagagagagagcgtggtggggatggatggataagaatgggtgggtggtgacttggtggataagaatgagaagcggtgactcggctcacagctcggtttttaaaggtgtcgattttaaaaaaaaaacgatatctttaatttattatactatcagttctttaaaaaaccgacacctataattaatttaaggtgtcggtttttatttaaaaactgacacctgtagtattagtatcgtttttttttttacagaaccgacacctataataaggtgtcggtttttcctgttttgggccatggaggtggggaaatgtattataggtgccggttttagctgttccggcacctatagtggtgatacctgttttgtctttttttagtggtgtaagcttgcatggttacaaataagatattaattatgacatgtataaatatagagtctgatatataagccccttgttccttgtataatgatcagagtcaatataggctagctttgttccttgtgtcgtggttgctaaccaacctttatcacgtactgccagctccttgctcatacttcctccaggtcaggctaaggaccacatcaaataaatactaaaaattacttaaactatctcatttaaaaatattacccggaatttatacatgggtcagtgactaatctagcttaatttgggaataaaaacaaaacaaaggtctatttaatttagattactgagcgaatcattggcatgattatcaattcaactatctaaatctgatttgtatttttctattcgtcacctcactttcggattattttcgttcgttttccgatcgagatttcgtccggattaatttttatccgtctacgtatcgagggttcgtctgatcgctttcatcattcaatcatatccgcttccccgcgctgatacaggcctgcacatgcgtgttactggcccgtgtccgtgtgataaggaaaacggaccgggcccatgtaagattttttctaactgtaaaaaatatcacgtgtcttccctactgttgtacgaagaaaagtgacattaccgtattaattagcataagtgaactaatccaatcgcaatatcgattgtggatcccctcaaatgatccaagtgtggttctaagtacagtatagcaaattacaaattcatccctagatagaatttagtaaaaaaaaacctgaaaatacacatgatattgctaaatgaatacagtgtttatgatattgctaaacagacgcatgatattttacctgtttgattaaaaatctatatctatatctatacctatataataaaaaaaaatatgtaaggtttccggcatattttttcgtccgtctctttttttttcctttttttttttgctattttcacctttttttctttcttttttctgttgtccactttttttttcaccgccttttttctgtccgccttttttttctccgttttccgttattttttttcttttttttgaccacctatacatttgtcgacaaattttcttataaaaatttgacacatgtaattatagtacaatcgtagtgtaattacactgtaacttgtatataattacactgtaacttgcatgtaactacagtgtaacttgtatataagtttcacgtaattttgaatcgttagatctattacaaaatttgttctggtgaggaagaaaaaattcacatcatacacatatgtgaaagaatttgttctcacaacctccattttaccgaaataaatgttatggagatatttttgaaagttacatacatgttatattataagttacagtgtaattacactacgattgtactataattacatctgtcaaatttttggtggaaaatttgtcgacaaatatatagcaaattcgtctttttttgtccgtctcttttttcgccccccccccccttttcttttcttttttccctttttttctttttgtccgttccttttttttttttttttgccaggccgaaccctagcgccgctgccataacgatcacctcccatgcgttctcttctacaattgattgtaaaagttgattacccactactctctcattattttcccatgatttttcctttcaattctgctctaatttaccggatctaatacacatttaaaaatcaccgtatctgagttttatgtattcgctcatattttggtaaaaacggaaagagtagatcgagtgtatcaaaagccctcaaccaactttgggagtatgggctaggtcaaagagaggcaagcaaaacagaggaagataacgggttgggctaagactgaaaaggaaggaataaatgaggttttggccgcaaaacagaggaagataacgggttgggctaagactgaaaaggaaggaataaatgaggttttggcccaaaaccaaagagtatctctactattataaaaattgaaaatgtttttgtcggtactttcgtagatcatctgtatttgagtcggtttctaagttcgttcgcttttggaaatatagatccatgtttgagtcttattttaagtctgatcacttttagaaatacagaaagagtcatataataaatctctttaaaaaaaactcgcacgctaactagggatgcttttggaaatacagaaggagtcgtataagaaatactttaaaaaaactcgcatgctaatttaagatgagagttagactcctaatagtagcttataattttctaaaagaaatatccaagcaaatttctacagtaattttcaccctaactgaaccgtataacaacaacaataataataataataagtctaaaatagccttcacccattgcaacgcacgggtattttttctagttattgaaaagatacatagtgcttccatcgtccgtcgctaatcgatcaaaagtgatatgttgtccaaatatattcaactaataaaagtcgtaatggtttatttcattcatcatcccgatccaacgaccttgattattcggtggtcatgctcatagtttgtatttccgaattgtgacaaaaattacccatatgccacgaacaaaaccccaacacaccctaaagctcgatctaatcgttccctcacatcgcaattctcgttccctcacatcgcaattctctcctactcccttgctccctataattacaagtgtctagtcgagctagcacctgagctggccaggatttgggcggccacccaacctccatcattagaaccaccactgttgaatgactttggtgtaagtggcccatcaccggaaaaacctactctctccgtttcacaatgtaagactttctaacattgctcacatatatatagatattaatgaatataaacacatgcatatgtctagattcattaacatttaaatgaatgtgagcaatgctagaaagtcttacattttgaaacggagggagtattagatggtgactttggaaccgtcacttcctaccatcgcggttctcttcttccatgtctgctcctctcctctcctctcactctttctggttagggtttagcatgttgttttttttccctctactgtctttcaacgacctcaactgtccttccacttcatcttctcacccaactatttataaaccgtactttctctttcttttcttaacttctttaacatgatgagatctctgtgaatggagctaaggtgccaaaacagtcccaacaataaataggggtaaatatgtacaataaatattatcctactagacccttttcccgttgcaacgcacgggcaattcttctagtatataattagatataataaaaataaatttaacaaataacatacaatctaaacaatgatgtagaaacggaatagaataatcttttaaaaaatatatattttaaaaaaaacatggaggaaataatccgttccaatacttcggcgaataagaaaaaaaaaaaagaacagggcaggtcccgctaagaacgtttgataggtactccacgaccgtaggagtgcagagcgcagaagaattcaaacatgtccacatttgacatcttgtctggtgttattggaagatgaaaccatttttaagtggcgagtgttgcttcccggcacggacggtaaaacagacaggttgtatcgtttgttcgtgagctcacaaagcagctagctggcctgctgaacaaagcatgtcgcccactctgagcagcttccgtcttcttctgattcgacttgttttgctggctctcctgataggcagcggcgtccccatgccctcggctcagcaaggcagcgcacgagtccgtgagtatcatctgtatatatttgcaacagatttagctttggcaatcactagagtctagagctacggcgcgcagtactgtttttgttcccccgcccttggattgctgctaatattttctttttgacgcatcgttgcagataatccgcatggtccaccgcagacccatggtactggttttagctacgacattattcgtgctaatggtgcaataggctaacccacgaaactcacctataagccaaataagtagcgaacctatttattttgatctatatggattagcggcttactcacttatacccttgattcgtgctggataaatatgtagatcgtgttgttaccgctctatattatactcctactccctccgttgaaattgtaatgcctggtttttattgattatttcggaaaatcgctccttggctatataatagcaatgcctccaactctgttttaccacaaagttaagtgtaattacaaatttagtatataattgagcagtatgtacatttagtttgccacttatctcatcgtatcccttctattttcgtttccactttcttttccttctgaacttacatatctattactccctccgtcccataatataagggattttgagtttttgcttacagtgtttgaccactcgtcttattcaaaaagttttgtaattattatttacttttttttacttactttactatccaaaatactttacacacaactattcgttttttatatttgcataaattttttaaataagatgagtggtcaaacactacaagcaaaaacttaaaatcccttatattatgggacggagggagtatctattatatattaaaaatcaattaaactttctcaaattaaatgctctcagaccatcacgtggtgctctaataagttagagaaaaataatagaaattatgagaacaaaaagtaaaacatccatccattaatttttatttaaattggtaggtccacgaaaaaaagggcgcggcaaaaaaaagtgataaaaaaagctccctgataaaaaagaaggatgaaaaaaaccggtttcgattctaaacatcgcctgcaaaaagaaaatcgaaaaaaaaaaagaaaacgccgtccctgatatagagccataaggcctgaggcccgaaggcccggcccacggcacggctttttggcccggcccaagcacggcacggaccgacttgggtcgggcccgtgccggcccggcctgaccgccgggctgtgcctgggcctctccaccggcacgctgggttggcccggcacgatgggccggtaggccaggcccggcacacaaagtatagagactaaaaatagacatataaatgttactgtccaaataatagggaccttaaatagacttatttcagctattcatataccacagcccaaagataagggacgtaaaatagactttttagctatatatatgtcacagcccaataggagggagggaaattagacttattctgaggaaatgcacaatggcccatcgtgccttcggaccggcccggcacggcccgagacgtgttgggccgtgcctgggccgtgagtacgacacggcccggtgcgtcggtcgggccgtgccggcccaacatgcctcggcccaggcacggccgggcctaggccgtaccgtgccgggcagtccacatggccatctatagtccctgagaaaacggccaaaaaaaaacaaaaaagacgccggaaaaaaaaaagaggcaaaactccgttcaaagaaaatggctaaaaaaacgcgtctattaaaaagcccacaaatagggcgaaaaaccaaaaaaaaaaagccaaaacaccgtgagaaagaaaagacagctaaaaacgcaaaaagggaaaaaacgccatcccatgaaagcccccaaaagggaaaaaaactgtccgactactatatgttttatagattactagcaaaagtgcccgtgcgttgcaacgggaattgtaaagactaaaaaattgaggaaaagttgagaaatatttacattatgtaattcattgaaatacaaatttcgatattttttaagtaggtaggtgtataattaaattagtttacaagtaaagtaagtgcgagaaataaaatggtatagttaaaattaattttattaaattctccgtgattaattatgctagttggaattttattggaatttgcgtagcttaattgctaattttcataatactaacatccttgcaatatttatttgaatagaaatcttccactctctcgttggggcattttcagcccatttttatacagcccgcagccaagctggcccgctttcctcccttctcctctcctccgcctcaaccgcacacttgtccggcccaaaaataagtctaatgaactccccctacttcatctctcactgccgcgtgggccctaaccgaaagtctaagttaaatttttttgttcgaccggtcgacctgctgcggcccatgaagcgcacgcgacccaatagtgattcggcctaacgcgggatcgatctgagccattcgtttagagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagccggccgttcgctctcgggcgacggccgtcaacgaaatttgcaggtggcccccttgccgccctccgctagggcgattttatactgtgcggggggccgcctgcaaatgggcggcgagggggggcatggaattttgcaggcggaccccttgccgccctccgctagggcgattttctactgtggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattattttttagggcatatttggattgttaccgtacaaatattttgttagtgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataacttgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgacctgcctgtactggtgtgacctctggctgctcctgagtgtgcgcctctggagctcctccaagctgagaggagcctagtacgtcctggtggtctgcaccgtgcaagtcgtcgtcatagaactggctagtaggaccagtcctaccggcgtgagacgaagaggccccagtaccgaagatcccggctgcatatcctgctggacaaggaccatcagttttgtacaagtatttaacagtagtaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggtcctgcgatgaggaaacgtgcagttaaaacatggtgacacattcgtgcaaaagctgaaacaaaaatgaactaatatctgggctgaattgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccacggcgctgcgacaggagaagacgcgcatgaccgcacgcatcttctcctgcatccggtcgaaggtcgccctctgctcaacgtcagtcaagtgcaaacctctgttcaacctcacctggactgcggtgatatcggcactgatatcccgtgcggcatcagcctatgcaagatggaaataaaaaattcagtagttgtcctatattatgcaagataaatgaaataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtagagcccaaagtgcgcctgctagctgtccccgtcgagtcaacctgtgaagagaggtaaattatatggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtgaccttacttgacattgtgcctgatgaaaacattaactgcgttaacctcgcatttctgtactacgccctaagttacattctctacaatattgtcctctaaatttctaaaagtacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacctgtgatgaagtgagcgaaccagcagggcttcgccgctccccttttgctgccctcccctctctctcttttgttttttttggatttttagtgaatataatgaaatttcacagaggagggactgggttttatagggggggcaaaaatcgccctcccccagggcggcaagggggccgcctgcaaaattccatgccccctcgccgcccatttgcaggcggccccccgcacagtgcaaaatcgccctagcagagggcggcaagggggccgcctgcaaaattccatgccccccctcgccgcccatttgcaggcggccccccgcacagtacaaaatcgccctcgcggagggcggcaagggggccgactgcaaatttcgttgacggccgtcgcccgaaagcgaacggccgtctgccacgttattttcgccgccctctgggagggcgatttttaaaaatcgccctcccagagggcggtaggcgactatttccgtcaattttcaaaatggaaaattatttttgtaaaacttttaataaaaaaaattataaataaaaaaaattcttcgtttagatggactgctcagatcggctcctaatccattaaaactccggaccgaaccctaatccctaa

SEQ ID NO: 63366 - DNA, 24418 bp, Oryza sativa
tatgactccccaggtcgctcttggaacctaactcagatcagatcagactatatcattagtacaaggcacaatgaatatagtacaatgtgggggttgcaaaggcattgttagagaatgtgtaccagcaatttagttcaatgtttagagaatgtgtaaatgttatctaatagaaagttcaacatgcatatgatttgaaacaacaaaacactagcataatttcgcagttatcaacatagaagaagcacaaaacttcataatttgaaaggtatacgtaagtgccgtggaatcacacttagcctctggcacatcaaagctagctgggaaacaagctatctattcctagataggaactagaataatgtgatccaactggaaccgccattattcactatggatcatataaaaacaggacctaatataaattcagaaatagttcagctcaagtggaggcaggtgaagaagagggctcatcccatgatcaactgctgcaagcgtctaaagaggtgaatgcaactgcagcaaatgaggcgaaggaggagcaccctgtgtctgcttgagaaatgaggtaagctacaggatttgacccacactcttgtagtcttgttacaaagttctataatgcagtttaagtccgaactgcatgtgaaataacgctatgtgaatggttaagttgtataatgcagttttgaccagaaatgctgtaaagacttgtctggatgctgctttgacaaaacagatcacttctatgtatctgtgaggataagaaataaccaaactacaattttgatatgaaccaccatggtttgggaatcaattgcaacattttaacctgaggggaacatataaaatatatgcgtttcagtaatttaaatgggaaaggtttttttctctctttctcaaaaaacaaaaaaaaaactgaggggaacatgcctaaatgatgcttaccaagcaacaactagcttaggccttatcaacttctgaacttcataatatctttttgttgcagtcatttgtgcttaacaacctcttaaaaacatagttacctaaaactgttcgcttgctcaattgctttcatcacttagcaaaatatttctttttatcagccagtgaacagtacaaactacaagttaggtcctacagttacattttgtgattcatgatctgaacaccatccaagcacaggggaaataaacagcgttagctacaatagagtgtaagaaccttactttactggtggataaatcctgttaagatggctgctgatagcatcttgagcttcattcaagctctgaaatggaccacccagatcaggatacatgtggaatgacccactacgatccatccgaatgtggtataccccaaggcggtcttcaggaggttcccgaacccaaatgattgacccaggggaggaaaggcaacggactgatggtgaagagttgatggtgtcttttgatacggcctgcggggaggaagagggactgcaagtgattgattctttcaatgttgtagcatcaagaagctttcccaaggacaaaacatctggttcttgcagtgcatgtgcagattcaggataagagcacctacagtagcaagatcaatgagtcaaacaatttatcttaaaaagttgatattcagtcaaacagtttatcttacaaagctgatattctagaaggatcattgtgcaaatccgaggataacacactaggaaatgtatagtctttaaccaagttacaacatttggtttgtagaaatgcacatatgttacacaccaatttatccgaaaaattgacaatttgacctttttgtaaaacttgtcaaaattgacaaccctccctcccctctcttccctacccttccccagatatcaagttctactgatcaatattctcctagtcctggtttccccttctgggagaagcaatcttcacaaaaaaaagcaatcgattgaatcgaaatccactaactttcacaaacctccacagggaaaatatatgccctcgagatataataagaaacagataagcgaagggaggtgttcgtactgtgaagaaagcggcggcgggactggatcactgggcgtcgtccgggggcgatagtggtggtagagttcatcggaggttgggaatggcccggcatcatcatcgcgccccccggaggagaaatacccacgagaatcgctgtacactcgtacgtcctcatccgtgaagggggatcgggataccccatccgcacatgggtcccgctcccgccctgctctcctggacgccatggatggggatggcgcctccggccggcggtgggggcgtcgccggcggacggtggcgtggcggggactagggcttggtggaatcgaaatggcgcaaggcgaagtggccaacacaacacaggtgatatttttttattttttagacattttatgttttaattttattaataaccatttctaaaagtattttcaaatctaccatgatcaaataactctatcgcattaacaaccacaccacgctcttgttacgccaccactgctcgtgtgaccagccacttaggtggcattaccgaaagattcagttttcgaaaatatttttagaaatagtctattaataaaattagaacatgaaaagatcttaaaaaaataaaaaaaattccacacgtgactaggtgaggacgaggagtgaactattggaccggaaacactccgttccgggattgggctcggcccatggtaaattttgcgtatggaccattgcccctcatgcgtaaggcccataattgtttctcctttttcttaaaaaactacattagtgtttatgactgaatcgcagaaaagaaaaaaaacaacgttagttctgttgggttttcagttgttttattatatccaattaaaattttgatttttctgtttttgagtgtactcttgaacaattcaccaggcgaattgcaagatagcaaaaaaaaaaaaaactcgctagaaaaattaagctagccagatgcgtgcacgatactccctctgttttagataataagacattttgactttgattaaagtcaaactactttaagtttgaataaatttgtagaaaataataataatatttttaactcaatataaatttattatgaaaatatattcaattgttaatttaatgaaactaatttggtattataaatattactacatctgtacataaacttagccaaatttaaaatagtagtcaaaacgtattataaaaaaaaacagaggagtatatcagatggagttatgtaggatgacggcgatatggtctctgcaattacatgggagagatgtctatcgatggtctttaattggtcgttgcttatgtggcttgagccgcttgattgctacagtatatttgctaagggcgttcgcgaaaataaaatttttgaatgtcacattagatgtttaatcggatatcggaaggattttttttgacacaaatgaaaaaactaatctcataactcgcttggaaaccgcgagacaaatattttgagcctaattaattcgtcattagcacatatggattactgtagcacttatgactaatcatggactaattaggcttaaaagattcgtcttgcgattttccccttaactgtgtaattagtttttcttttaatttatatttaatgctacatgtatatgtccaaagattcgatgtgatgtttttgtgaaatttttttggataactaaactaggcctaaattgacctaactagctgcagcatggctgcagatcgtgactaaatgcagtttgaagatggaggacttacttaggatgaagatccgtgctctggtgatccatgataagttgatactctggtgatccgggctcgagccgttttagcagctggagcctggaggagacacaaattaagacggtgtatttcgttaaaaaattagtttaagcgggcacgggccgggattgggggcgatttatatgagaaaattgtaattataggactccaaacagtacgcttcgcagttatatgactccaatcgtcgacttcgctaaaacaaataaggcctcgcaaaaaacaaatcaaaggcatttgcaaatctgttttgtaatcggaatcgacgtgcacatggtacgtacagtttgctcagaacacgcactttcccagcgaagatgtactggagtatataaattgactacaaatcttatgtccgcttaaattaatttttgttattcaaaggccgtcctaattttgtccccacaagatacctacgtttagcggcttgagccatatacttcctccgtctctaaatatatttgacgccgttgactattttaaacatatttaatcatttattttattcaaaaacttttgtgaatataattcaaaaacttgagtagtagtagtatatttagcaataaatcaaatgataggaaaagaattaataattatttaaattttttgaataagacgaacggtcaaatatatttaaaaaagtcaacagcattaaatatttagggacggagggagtatatacttacaagtagtaatatactccatttcctaatagataacatgtttgacttttgattatatttaataattattcgaaaaatttaagatgtttatcatacttaaagtgttcttttattaagtaataaaacaactcatagcaaaataaataataatcatgtaatttgttcttttaataagactagaaaaatgcccgtgcgttgcaacgggtaaatgctattttaattttattattgctatacagtttagctaagataaaattcagtgtgagaattcacttgaatatatatttttaaaaaaatcatgagctccaattaggagtctaacttttacctcaagttagcatgcagagttttttaaaagagatttcttgtacgacttatttgtatttccaaaaacaagcaagcttaaaaactgactcagatatggatctgtatttccaaaagcaaacgaacttaaaaaccgggttaaatacggaatgacgtaccaaagtaccggcaaaaacatcttcaatttttataatagaaaaaatgcccgtgcgttgcaatgggtgaatgctaattttaatcttattattgttatacggcttagctaggatgaaattcactgtgggaattcgcttggatatttttttagaaaatcatgagctgcaattaagaatctgactttcatctcaaattagcatgcaagtttttaaaaggaaattacttatacgacttgttttgtatttccaaaagttaacgaactcaaaatccaattcatacacagatctgtattttcaaaagcaaacgagcttaaaaattggctcaaatacaatacagatgacgtaacaaaatatcggtaaaaatgtcttcaatttttataataacagagatatggtgttggaagcaccatccatgtcataatggattcatggaacaaatggcatcttagtatagttgctctacatatattaaatggatagttgatatatattaacatgcatgggactgatttaggttcactttccatagtttatgcgggaacctgccagaaccaatctggataatcccgtgcctcgccgttcgattccaaccaggtcctccgcatggctcaatgagaaattactgaaaattaatctattgcctccgtgacggtgtgacaccgatacggatgcaacgcggagggagcgaaatgtaaccgtgcgagacttacaatgacggacgaaaatcccagacaaaaacatcttaaatttttataatagataaagataaatggtcaaacgtggtcgatcggatatagcatacacacgactcattctcaatcaaaagcttctcaaaaaacagtatatacaggactagatggaaagcacaaggtttaaggaacgtattacggtttaaattgagaggacacacaagtcacgacgtcgacgtgtgatgattgcaacaagagttagagcgcaggtagtacgcgagaacgaaaccccaacaattcataatcaagatcaaagataactaaataaaactacagctccacaacatggttgcatgacatatgctaattataaatccgttacagttgcaactgacatgatctcaatcaaagagctcttcacatacacctggatcatcaagaccctaagaaaaacacgagagcaattaccaattgagagagaaaaaaaaaagacaccatactgcatgcataataacgttcggtctgaagcatgtcacatacctgatacatttttcttagcctctgctcctctgcatcctcatcctgtcaatccaagggcagaaaaatgtgtcactaacattgtaataatgaatcttaatatatgcatgaatgtcttacaaaaactaaatgggggaaaagatagatcatcagacctcttcagagtcactcgacactatagtgtcatatattcctttgatataacagtgaccaccaacatatgaattgacatcacttgggtgcttcatacttttattcccaatcttgcaggtatagcagttacctgagaaagaaataggttgttcgtgaaatgacagacacacaatcagttaagcaccaattatatgtaaatatcataaattctagttgagctaatgaaggtaaaaaggaaaaaaaatgcaagaaccgatgaaaaacagattaactagacatgcaaaaccgatgcttctcccaggtgcatgagtatatacaaattatgaagtctcccaggtgcatgagtatatacaaattatgaagtatgaatccaagtctataaaagttaagatgggtatagcttaccattgtcatcagaacttatcaaagagcagcaagtgaccacataatctttttctcctttcaaagacatcgcttcagcgaaaaatagatggtcactgtccaacccatttagtcctttagtagtcgcagtgaaattaatatgatcaaaccacctacgactttcaataattggttcatagttaatgacacctttgagctcaaaagcaagatcctgcaataagaaatacaataagatcagaaagtgtggaatcaattagacatcatcacagtgcagaaagaatgagacagacaacgagggcgataacaaacctccaaaagattgtggtcatcgttatacatgtctaatatcaccttagccagttgattcatattattattgacattctgaaatgcttctgctttggaacatttcttcctagtgccatcaggccaataaagtgctttccttataatcatgtccacgtaagattccccagctcgttcctcgaacctaactcaaatcagatcagtccataccattagtataaggcagaatgtagatagtacaatgcaggggttgcaaaggcactggtaagaagtttgttatagagattacattccaataagttaagagtttcaggataagaaaagtttgagtaaatgttgtcaaattgaaatttagcactcatattagttcaaactaaaacagtagtatggttttttgcagttatcaaagaagcacgaaaatgcataattcaaaaggcatgcgtaactgaatttgcttgtttctagatatataagggcatggctatcgtcttgtagtttatcaatctatagaaagtatcatagtttcaaggtttagatcctaaactcatcctggtttttccgtcctatttttacctgcgattagactaagttctgtgtgatcactcgtgtttacctctgacacattaaagctagctgagcagcaatataattgtaaacgctgcaaatgaaattgaaaattcctaggtaaaaactagtgaaatgtagcttatttgtgaacttcgtgttatcttatggtttgcagtcattttgtgcttaacaactccatgcccccatatatacaaagttacctaaaactgctcgtttgctcaactgatctcgtcactatcagctactttaaattacaagttacagcccacaattctgttcatgactcatgccctgaatatcataccaaacacatgggaaataaatggagtagttgcaagctacaacagagtgtaggaaccttacttaactggtggatacagcttgttaatatggctactgataacatcttcagcttcattcaagctctgaaatggaccacccagatcaggatacgtatggaaagaccccaaacgatcctttctaatgtggtatacgccaggtcggccatgaggaggtttctgaacccaaatgattgagccaagggatgaggaaaggcagtgccctgactgcggagcatcaatggtgtcatctggtactgcctgtagggaggaagtgggactggaagcggttgattctttcaatgttgtagcaccaggaaagtcccctaaggatgaaacatctgcaagaccagaggtacctcccacatgatcctcacacctgcagtgaacaagatcagtgagtacaaacaattcatcttatgaaatcaatacttcgttgtacaatgcaggttaatagacccagaaatatatatataactatgattcatggaaatgcatatttttatgagataacctatttgacacttgacagaagacaaccccaaaaatcttgtgaattgtggacacgttggatcgttttgagattcatgcaaccagccctaaccccttgttcctccctccctcagtcctgccgccattctgcggatcgcctgcctcctcctctgccaccggcccagcacgccgccgctggaaagcacaacggcgaggtgcccccacaacctaaccactcgaccagtagatgccttgtccactccggcctacctctaaactcaggaacctcccccctgttccccctctgcccaccaccatcgtcgccggagatcaacgagctcaccagagcaggaggtgatcatgttgcatgaatctcggagcagaccagaaggtcaaaaatctgtaagatcggggcttcgattttctatcaaatggaggtcctcaagccttcttcctctcctcaaagatcaacagtcgcaactcgtctcctccttattagggaatagccatgaccacaagtaattaaaataattcgatttaatcgaaattaaccaatcctagattcctagttccttcaggtattctatctatcaaaacaaaactctctctaagataccaattagaaacagagaaaggatcgagggaggtggaaggggagaggtggtggtcgtactgtgccggcagcagcggcggcggggatggatcgcgtcctgaggcgaaatgcccacgagaatcgctgcacgctcgtgcgtcctcatcggtgaagcggggtcggaacaccgcatccgcacaggggagccgccgtgatctcatggacgtgcggccgcgcgtcggtggaggggcgatggatggatggggttggcctcctccggcggtgggggcgtcgccggcggccggcggacggtggcgtggcggggactagggcttggttcgtcgtggtcgccggcgaacgcgggtgagcgaggtgaggaaggatggctattgggcctagcagaattgggcccactttcctttggactatcccctcgtgtgcaaggcccataattacttctgtttggtttcaagttatttttttcagattttcctttttatgtttttttcccctgattttgagcaaatcctccaggtgaattgtgatgaactgatgataaaacaaaacaatagtagtgtaatagaaaacaaaaaataaaactcgcaagaaaaattaatgcgtggacaaagcaatattgcatatagacaggtggacttacgtagtatgacgatctggccggctgatctgctgctcctcctccatgtcgatgattatttttttctctcgatagtttcacgattggtctaattattggtggagatgaacaaatttagacaggtaaacatggattagcggctaagtgcgagttatgtacgtactacctaaccgaatttttatcgtgttctgaacaaaccgtgcatactacatgtacgctgagtcctacaaatacacagattcgcaaacgcaacatcacgatcagattggtaattggattgcatagatacccaactgagaaacagatcagaagcgagggagaatcggtggagatatgtacgggatgatcaacggagggcggctagatggagaccggctccgtccgatctccggtggggcttcgccggagatgactgatgaggtagacgatgcgtagcggggccgagggcttcgtggggcctcatttggaagaccactgggccaaaattaccggcccattactgttaaaaggccggggattatgggcttcaaaagcaggactccttccgacaaagagcctggaggagcaaaaatatccataattatgaagcaaaatttttatctatgtactccctctgtccaaaaaaccctaggactggaagtgatatattctagtacaacgaatcggtacaaatgtatatccagattcattgtactcagatgtgtcacatccagtactaagttggtttttttatggaacggagagaatactcttagagcaggtacaatagtagcctataagctagctataaacatattttaaggagataagagaagatagagaagagcagttggctacagatttgtagccgatgtgcgtatggcatgtgggatcagatattaataggtaactattgtatgaattagctattaaattgactataaatgatttggagctgatagttggctacactattaaacttgttcttataggagtagcagtttttaaaagtaaatattgaaaaataaaccataataagagaaaccttagattggactttaaattaacttttacaatttaaattgtagttgtggctggtaagctatcaagcaaaccatgtacaccatgtttcaaagtcttctgttagacggattttcattccaagtttagagaggtaaattgatttgcttgcttattcttgttatgccattttcatgttgttaaacctgtctttaagagaaaacaaccaacttgcatttatccctggtttagtttcctaatttttttccaaaaacatcatatcgaatctttggacacatgcatggagcattaaatatagattaaaaaactaattgtacagttaaggggaaatcacgagagggatcttttgagcctaattagtccatgattagccataagtgctatagtaaccccacatatgctaatgacggattaattagtcttaaaagattcatctcgcgattttcaggcgagttataaaaatatttttttcattcatgtctgaaaaccctttccaatagccagtcaaacatccgatgtgacacccaaaaatttttcttttcgcgaagtaaacaggccttaggcaaggcctggtttagttcccaactttttctttaaacttccaacttttccatcacatcaaaactttcctacacacataaacttctaacttttccgtcacatcgggtttgtttggtttagtgccctaccaaagtattgatagcgccaaaatttaggcatgttttggcactaccaatattttggtagggtagtatttaaagtgaatgagtttggattatactaattgaaagccaaattttatattatagttaagaaagttttagaattatgccaaattaactatgggcattaccatttacttgcctccaaaccaaaccattaaattcactatttaagctaccaaaaaattggtagggcacattttagcatcaatccaaaatgacccatcgttttaatttcaattaaacttccaattttagcgtgaactaaacatacccttaagagcaagtttaatagtatagcccactactagctccaattcatctatagccagtctaatagccaattcatacaatagatgcttactatactattaatatatggtcttacctgtcatacacacactgtgtcttggagtctgtgctgcagctggctacagatctgtagcccgctgctcttctctctcatcttttatctcattaaaatatgtttgtagctggctaatagtctgctattgtacctgctctaagcacaattgaaaaatcttggaagtagggaacggcttcttctccctcaccacaaaatgaacattgaacaaaccaagaaaaaaaataatgaaatgacccatttgccctgcattccaaagcactcacattcattgccttttgagcttgacccacaccactctgagggccctttgaatagcagggtagaaaaaacggagaaatagcaaaaacataggattctgacagggattgaagtgtaaaacagaggattgcaaaacacaggaaaaacataggaattgtcgtttgattggagcgcaggaaaaacgcaggaatcggatgaaagagatagacttaaaggaaattttccaagaggttggagctcttgctaaatttcctccaaaatccacatgtaatgtgccattccataggaatttcataggatttaaaagctttaatcctttgaatcaaagggctaaataggaaaatttcctatagaatttgaatcctataaaatttctgcattaaggccccctttgaatcacaggaatgaaaaaacgggagaatgggaaaaacataggattctgataggaatacaagtgtaaaacagaggattgcaaaacacaggaaaaacataggaatgaccgtttgattgagccgcaggaaaaacacaggaatttgaggagaaacacaggaatttgaggagagagaaagactcgaaggattcttaacatgaggtagaacctcatgttaaatttccttcaaaatttgtatgggaagaggtattccataggaattttataggatttcataggattcattcctttgattcaaagggctatataggaaaaattcctataggaattaaatcctttaaaatttctatgaatttcctttaaatcaaatggggcctaaaagggggccatgaatctttcactccactctgctcaaatatagcactccactccctggtcagtgctacttcactctcccacttcgaggctacaagcttttcttgcttgctgcaatggccgcctcctccgcgcagctcatcttcctcctcctcctcgccgttcttgccgccgcctcatcgcgcaacgacgaggaggcccgcgcgctgatggcgctcaaggagagcctggacccggcggggcgggtgctgggctcgtgggcccgctccggcgagccctgcgggggctcgttcgtcggcgtgacgtgcgacagcggcggccgcgtgacggccatctcgctgcagggccgcgggctctccgggaccctccctccggcgatcgccgggctccggcggctcaccgggctgtacctccactacaacggcatcaagggggctatacccagggagattgggagcctctcggagctcaccgacctttacctcgacgtcaaccacctgaccgggccactgcccgtggagattgccgccatggagaatctccaaggtgaggtttctatgctgcgttcttcagttcttgtactatttcgtctccaagattgcatttcttgggttgaaccttcgttttttttgttgggtagatggggtttgcatttgatttatggttctttgttttcttaaagattgttcggtacttcttcttgtttcttgtgatgcttttcaaataaaactggcataaaaatgtcgcttaggagaatggagcagtgaagccttccattttccacggtttcaaaaaccaatgatgtactagtagtctactagttccaactactccttggtttggtatataaatgctccatttttgtattccatttttcgtcagtttgtggcgggattttggcatgaatcggtacttttagttttgggttcatttattaagcatcagtacaatggttgatttttgaaatggggcagtttatctgttatcaaatccgatttgtatgtttctattccgattcttctcttggagcattgcgacagtcacgtgttcatccattttgatttgatttatcctgactgaactgctgcttggtttattagaaccccacttgtctctggtttagatttttgtggtaacttcaggttgaatcttggtacaaaacactttacagtgcattatgaacttctttgatttgatttactactcggctgtttctgtccaatgtttgtgccttttctgtaaataaatccagtaaagaacaagtgacattttgttcttctgctgccttggctccttccttcagatttcagaatctgcacatatatctcatacttgttgattaggccttcgtcgagcatgtgatgcttctgttcatgttttggaagtctacgtaccagtgcctgctgttccctagttgttaaagagtcaaatattattttctgccactagatctgtttcaaagattcaataatatgatacatagacttcgcaatggctcattgagaatcaaaagtatgatatgatgtggtgcagattttttatgtagcatttctttctcttttttgcagttttgcagctgggttacaatcagttgacaggcagcataccaccccagttaggcaagctcaacaagcttgctgttcttgcacttcagtccaaccagctgactggggccattccagcaacactcggcgacctaacacagcttgcacggcttgatttgagcttcaacagtctttttggttccatcccttcaaagattgctgaggttccattgctcgaggtctttgatgttcgcaataattccctttctgggagtgtcccagcaggtaatatacccttttattacctttcttgagtaaaacttttgctatgtttatatttatcactgtaacttgttgtctggatgctaggattgagaagactgaatggtgggttccagtatgtgaacaacaaaggtctttgtggagttggcttcagtttgcttgatctttgtttgtcatcggaggatggcttgaaacctagtaaacccgagccttttggcccagatggtactgtcaagacaaggcaagttcctcaatcagcgaatacggacaatcactgtgagggatctggttgctcgaaatcttcgaatgcatctgtgggagtgcttgttgttggtgtggttgcagtggtgattggcgccgcattctgcggaatatttgcattctcatattaccgccggcaaaagcagaagattggcagctcactggaggtttctgatagcaggctcagcactgaccattaccaacagaaggaagtttgccgaagaagtgcttccccacttatcagtgttgagtactcgaatggatgggaccctttgtctggtggaggcgttgggtcatccggcgaggttggtgatagctttaggttcaaccttgaggaggttgaatgtgcaactcagtacttttctgaggttaatttgctgggtaaaagtggctttgctgcgacatacaagggaattctacgagatggatctgttgtcgctgttaagagtctcaacaagacaagctgcaagcaagaagagtcagatttcttgcgtggcctcaagatgctcaccgtgctgcgacatgagaaccttgttggcttgaggggtttctgctgctccagggggaggggagagtgcttccttgtctatgattacatggttaatggttgcttgtcacagtatctggatgttaaggagggttctggtgctaatgtccttgattggccaacaagagtttccataatcagaggcattgcaaaaggtatttcccactcaagcattatcttttccagctttatcttcatttacctctgactgatatggccattcaagtattgtcggtgtcggtggtgttctaatgcttaatctgatgcacatttgcaggagttgagtacatgcacagtaagaaagctaacaagccatcagtagtgcaccagaacatatcggccgagaagatccttctcgaccaccacttaacgccacgcttgtcggtcccagggctgcacaagctccttgctgatgatgttgtcttctcgaccctgaaggccagcgcagcaatgggataccttgcccctgagtacgccactacgggccgattcactgagaagagtgatgttttcgcatttggtatcgtcgttctccaagtcatcacaggcaggagggctgtctcacagctgaaggtcagcacagttgccaatgaccttgatagcctgatcgatgagaacctcaatggtgtcttctcaagaactgaggcagctaagcttgctgccattgctgcactttgcacaagcgagacggcgagccagcgtccaacaatggaagctgtggttcagcaactcagcaactgccactgaagaactgaagctagctgatgatgggatatcttttggaaaccttcacctgaggtattttgtaagggtagtgaaagggtaatgatccagttgccactgacatgctagtgctgaacattttagtagtactgattaactagtcactctttttctaatgatctcaccatttcatggttagtgtatcactatcctttcaacattagaatgttgaaaactactgatgtgttagatgttgaacctttggttcggttgatcagtatgcaatggatgctgatttgtgaagccatcaggttcagagagaaattcagcatttctaatgtagcagctctggccagctttgtaacggcattacttgcattgaaatgctttaccgtaattcagtttaatgcctttaacaaactcacgaagaatacgtgatcagatgttgaattacggatgagaattttattgaccctgacatgtcattcatcattccgttgtcctataaatctgcatccgctttgtactgtactactactagaggatttctaatttagctgtgatcagctttgtagagaatttgcttgcattgaaatgatgtaccataattcagttaatgcttctaacaaactcacaacgaatgcgtgatcaaatttagaattacggatgcgaattgatatctgggcgttattgaccctagttggcaattcatcattccattgtcctgcaaatctgcatcttgctacatactccctccttcctaaaataaagagaataaaccctcttctgggtatgaatgttgattaaataaagagaataaaccctcttctgggtatgaatgttgatttagtgtctattcagagtgaaatgcaccattaataccttaactcacgaggtgggtgcaatttagtcacccattttgtaaaatgctcaaacaaacaagtcactcatcttgtttcgtgggtgcaaatcacataaaacatgtgtcgtatggagtgttcgcaatgaagttatatgctatgttaatttgtttacaaacatggtcacacgattcataaataatccaatgtgcagtactaccggtagtaaaattcaattaaagatgaattttgttattgatagccaagcataatatggtaatgttcattgaaagcaggagtagtagcatatacatggaaatataagtgttaatatgtaattttaatgcttatcctgtccacattggtaaaaaaatacatgatgctaggtcaatatggactccaatttaaaaacaaacaatccgtgtgaaaatgtatttggtaacatttgcaccatcgaagcaagatgagtaacttgtttgagcaatttgcaagatgagtgactaaattgcacccacatcgcaagttgtgataccaccggtgcattttactcgtctattcatattcatatttagaagtttttttttacggaaggagtggtagtgtttaccttaatgccttgtacttttcaatattggtaatttctggccttgtagaaatttttaagagcagtttttttaaggagtacagtttgacagaattgcaagatattgggagtagcttcaaaatttgaatctctaagcaagaaaaggacagttccacacatttatataccctgctctgcattttctgcacaagaagcatgggaatggcttttttctccttaccaacactaccagactgcccttgccgttggccattggccactgttcttctcctgtgccactgtactgctctgttcctcgtttcccttttctcttcagaagttgaataacctgtcacaaaaaaaaaagagaaacaaaaatcactactagtggtttgacaaaagcatgccaacactgttaatgcacaagtttacagggctaaaatgcaaacttttaaacatggagtacaaaaagccttgaaacatgtactagtactgtactactactcctatgcatcacttgcacatgacttgaaaattcaaataatattctttcttcgacaggggaaaaaaatcaattgtactcctactgaattgtcacaaaaaggcgaaattcagccaagttccaacagcacgagcagcagcagaatctgcccgttcatcggggagcacaacactgcaaagatttgtttaagcaagccaagaacaaaaggactctaaacatttctaaaacaaaaaaagagaaactaaacacaacctaatcaaaggctcaatcaccaaccactcccgcatttaatcacagggccattatgccataatcttgtctgctcagttattaggacaaagacaaccaatctttattgaactgagcagccattaacaatcagcagtccttgtttcttgaaacgagacggtctctcatcagccgcgtgctttgctgcaatgatgtttgcattgagcattgctgcattggcatttgaaatgtgtcccccaaagcttctcttctgtttgcatctcacactgtctcacaaacacactgtagatttgcagcgctcaaacaagacagcacagaagcaatagagtgtggcagcctagagagaagcagtactactcctcctccaggtctacagtgattttggtagaggagctgcgtattctttcgaggctgcaactgcaatggccaatggcaatggcaatccatacttttgtgcgtgtccaaagcggtatttgggatttcaattctctctttgagacttgagagttgagagagtaaagggccacggcgtgcaatctgatctgcctggctgtccgccatttggtggttcagttcagggttcaggctctagccagaattgacttctgccctgtttggtgtttctctctggaatcatgaccactctactgttctggttggtctaaggttgccgttgcattcgtcagtgttagtgaaatcccaacgtgagaatgcagcaccagcaatttgaatctcctcttcggccgagtttagttacaaactttttctttaaactttcaacttttccattacatcaaaactttcctacacacacaaacttccaacttttccgtcacatcgttccaattttaatcaaactttcaattttcgtgtgaattattgtttgaaatattatctggcaagaaaaagaactgatagaaagataggacatgcctgaatgagatgttcaattttgtttacatgctcacaaatcaagttgatgagaagtttcctgctgaatttcttgtcttgcttgctggcgctgaagggatttgcaactttgtcaatctctgagaaagtgtcttcttgggagaaggatggattgatactataataacactagtaaaatggtttctcttgctttgatggttaccagtgaagtgaagcatagggcgaaaatactggagcagtagtactttagtgtcacgtgtgcacatggtccctccattttagtttagcacttctgcctatcactcgcacgctgttgtatgtaagctacagctactatgagtaccacaggtccacagtagcactagcaaaaatatttattgccctgtcaatggtggtcagttttgtcacccacatttgaagcttttttcttaggaaaaaaaatcacgttttaagctatagtttctactactattagttagggtttgtttggttttaaggaaaaacaaaggatgcttcataaatattaatccctatatgttatttgatttgtaggaataagatataggaaaataaaagaaacatttatttcttacatgttgtaaagagaaaacatagaaaagcttccatccactcagagctcttgaaaaaaattcctattttttattcctatgaattgaaatttatccaaaccaaaaagcccttaacatgtttctttttctagtattactaactcacattttccagtttagcaagcagtaatatacgaccttgtcagtactaattcacacaaaacctgtgtattccaaatagtacaccaccagtgtacactactgcatgagttctacatgagacacagtagcctcttccatacaagagatgctgtactctttagtctctactatacagacgtcaaaaactgaaacacctgcatttgttgtccagtggaacaacagtagcaccagtgtttagattttgggaggcaaatcaaatgcagtctcgtttcgcttcacacattggcactttggcagcaacagcaaaggaccaaaaaaagatatagggaatccaaagcattctccctctccgtggtcatgcatggcttcatccatggaccatggtcaaggactccttggtgagctgtggccttcaagggaaatgtccttttgccccagtgctgtgatcactctgcattttgtaccagcggcagcaaaggttcccccagtgtggtccttcggttcaaggtcaaaactcataatatgtgcacaattcctctactactccatagtttttttatttgagggtcataggatctgcataataatagattcaataagactgacattgatttttttttacactttctactattctaattttgaagaaagaggaccacataatcttatttttagcgtgacatgcttgagggaaaaacagtacatgagacctgactgttttgttcgccttccgtcatccgacacagaattactgtttgaaaacaatgcagatttgcagttttgcaatcagataacagtatattacagaaaacaatgtccaggagagaaacaccgtagaggcaagactgaaggagtatcatcatgagtctgatggaccgtctgaaataaacagtttagtatagtactacaggatcatcagtattgctggcaaggcaaactgttgacaagagtaatttattgaaatgagtgtttcagggttgctggcaaggcaaactgttgacaagagtaatttattgaaatgagtgtttcagggtttggtcatgtacagtcacttatttatggtcgatacaagtggagaggacagagaaaacaaaacagtctctgccttcatacatcagacaacatgatcaagtaactgtgtcaattgttaaactgagaacataagcaaaagctgctaaactgaaattgctctgattgcctctgaattctgaaaggtccgtaacggaatcctgtattagttttcggctttaaactctccaaaacttcactggatatttcaagtgaggaactgaacattctgaacttatgatgtcaagcaacagcactttgctgctcaagcatctgtgtccactcaaccggccaccagtctggtttgatcgccttaactctcacatccctattatccttgatggcaaggcttgaattttgcttcagggcttcttcaagtctcagcaggcccataccacggctgccaagagcagtgttaactgtaccgattttcttgccagactccttgtccacgacttctgagcctggagcaacagcctgcttgagttctaaacaacagagttcgaataatgaattaatgagtctcacaaaataaacatgaaacactttgctaaattatttagcacacaatccataccttgcccattttcatcttcaaatattaatggcattaggcgtttcctaatgacaccacgatggtgtgtacgtgcaataagttcctgtccgatatagcagcccttctcaaatgaaattgcattcaagccagcaaaattgtactcaagcggaattgcttcacctgatttaaagcaagacaatttcaattaatgaaactaaacaacttcatatctgattagaaaaaatatcacaaaagttgagcaatgaccaaagtgatgtcatattacccccagaatcaaatattggcaacagaacagacgctctttacgtacttcaacatatgaataaggtcatttgtgcaagtttatcattgtgctacaagggaaccaggaaagctgctgtctgagaataaaagactctatacagtctatgcttctaagctatctcccatggaatacagaatgatggtaaataatccaccactgacaccagccaacaacaataccctcgtgtcatagctatacagatcataacgtcacctgaatccagtcgccttcaagttgttaaccttgtttgcaggatgcacacgctttctgggataatacttgttaaatgcgctaaagtagattatggaacctttgaaagaggttacaggagatactacttggttactatcaagttcatcgacttcaatagataattgaacttggagcagaatggttttgaccaaattggagacagtgaactagaaaactgtaatgcagtcaacagacatttatgcattgtagagacatcttcattgttatcaacatcatctctagacttggaaccataacaaaattaattaaaaaaggtataaatgtgaatccaacctttcgggatctcagttgagccttctgcaactccattctctatccgccagagcaagtaatggcgctcatcggcttctttgtcagactcaactagcggtgctgtggaaaacagaagagatcaagtgttcagatggatcttgctagatattgaatatcatgccacaaacagtaggaaacatcaggaacagattacttacgtatagtattagctggaaagattcctctgtaaccaaggcaatccaatctcgggtctttgaaccactcccaaccatggccattaccttgtgcagctgactcggcagcatggtcaacaccttgcccccatccaatggattgggcctcaggttcttgagtagaaggtccggtatgctccacattgcgtccaaatctttgccaacacaggaattccttactaacattgtctatctcaaccttggatcttaaccgatatctgaatgggcaaaatatcatcaggccataagatacttgaacggataaaatggttattaaggacaagagggatagatcactgattccaccgcaaaactgtaacacaatgtctctttttttggaactaggagagccaagctccccccccatttccattaatagaaatgagaattaccagtttacagaccaaaagaatccaaattcccagcttgcaggacacactacagttcatgacagaaaaagctataacacaatgtgatctcatgtgtcattatattcctcagctacaagaagatcctaattctcacgttctccttcctactggatcttaacaaatcaatcttatccaccacaactttagtccaaggggagctgcttcataggtgagtttgctgccaatggtcctacttgaaagttgaaactaaagtcgctaattagttagttcacgatattcttcagtttggaattagtagccttaagctgaacgcctaaaactttcaatactaaccaactgactccacacgagagcatgaaatgtccaaccaaactgtcatcgaatgttttaccaaatcagtcaaaattccaacatgacaataaatatctaagcaaagtcccaataataattaagccacccatcatgatcacagttaagttcagttttcagacttgagttctcgaactagcaattagattagttaatgaacttgcagggttctttctcaaattaatcctaactgtcaactcacggtctgaatttaatccacaatctctcagaaatggagaatatacactagaagttccgcattggagtaacagctttggggatttcacctcttgaagcaagcgagtagctcgtcgacctcggcggcgtcgacgtccgcgagcacctcgccgggctcgtcctccccctcatcctcctggttccccttgggcctctccccggtcagcggcgcggagcccgtgcggtcgagcagctgcgacggtgggggcgggcggtagaggaagaggtcgtagaggaacctcccctgcggcgtcagcagcgccgcgtacgccggcggcggcgcccgcgcgggcgcgttgggcgtgggcgcgtacctctgctgcgacgacgacgagaggaggaggtcgttggtgaggagcgagcggaggaagcggcccgcctctggccccgcgaagcggaccaccgcgcgggaggcgaggcggcaggccagcacccccggctcgcctccggcggcggcgggtgagctcgcgtgcagcaggcggcgggcgagcggcgtcatggccgccgggattgcgcgttttttgcggggttttggttggtttttttggggggcgaaatcatggggggggggggggggggggg

SEQ ID NO: 63367 - DNA, 599 bp, Oryza sativa
attggggacagaggaagataagcaacctgaggccgcgtctccagatcgcaaacaagattatcttccaactggatgtagcacaaggaaacaggtccctgttgtcgcaagagctgcgattcagggctggactcaaagggcaggctctacctgacgcttgcctccctagaaaggataagcgtatggcaaagggcaagaataaagtttttaaagagggggatgcaaacacatatttcttccacatgaaagctaaggcgtgagtgtgtgacggcacaagttgattatcggcccttagcatgaatcatgatggtcacatggcaaggggatatattgattcggtgatgggggttgccgacaaggaaaacagagtgatggatcttcaagcactaggtttggtaacagcagatctgtctgacctagaaccgcaattcacagaagagggagtgtggagtgtaatcaaggaattatccagtaaaaaggcaccaaggccagacggtttcacaggtcttttctatatatcatgctgggccatgatcaaacgagaagtcaagctatacaatggcaacaaacacaggtgcatgaactactgtacatctgataag

SEQ ID NO: 63368 - DNA, 14764 bp, Oryza sativa
atgactggtaatactagtattcgtacagtactggtaatatatattgcgaggaattaattgaaagcccatatatgaacaatgagattctctctcatcgttctgccttttactggcggtagctacgtgaaagggatagacattgactgtagtactagtatctatatgtatcttgactgcaaacagcagctattagtacgtataccggtctagaatgtaccataaaagtactcaagctatatggtcaataatcactcaattggactagtatctgatcctggatatgcgtttgcttaattagtcaattatgaatcgacaatgcatgcatctggattcctgattgcttttgtcctcgatcagcaatcgatcgattgatctagtctaggcatgcattaggcacataagtatgatctgcatctgcatgctagctacctgggaattttatcgatcaccaaaaactatatatcctgatcagtcgcacgcgcgtgcgcacggatgttgaaatgtacgagcgccttgggtccgtgtgaatgagacaatttatcgatcgatctcaaggaatataattaatcgatcggcaggtcaaactcaaaacgaatggatgattttctagctctgaatttctcaagtctttaaaaaatagtagcaggctagcacacccaccttcttcaattcgtcgtcgagcggttgcgatgccatcgtcgatgacggtcatcactgacgatcaatgctgcgctggatgattttgctttcaaagaatccaaatataatatatatactcgaaaacgacttcattttttgactgaagagaataacttgtgtttacctgctagccaattggctagagactgactggagagagcgaatagccgtgagacagctagctagctagcaatctggttttaccgttcatctttttacctagataacttcttgtttgtagatagatgaaacacatcctatgaatctggactttgaatgggttatctcagttaattccaacctatcctttgggtaagagtacttgactgggtgacctccctctaactcgaaccaacaagtctcttgtcttgtcttccttccttccatgcgtgaatttttctatggttaaaattaataactacagtagctagctggtacaaatctccaactaaattttataggcaggattttttcaaggtagcatagcatactagctcagattctgaacttaactacaaatgtgtgataaggataaaagatttatacatactgcatgttggaatttgaagtccattaatgtagatattggcttaactttggatgaaagtttacacataggattgaataagatttctccttttgttgttcgaacttactctctcatcatctttggtcattacgttcaaaattttgtaataagtggtttctatcttaattgaagaaaatgccagttcttttttttttaaaaaaaaggccagaatattcatcatataaaaaaaaacttaactggcacaataatatctactcctgtctctcaccccagccgcccaatgaaaatgctctgatccaattctcccaaaatttccactgtttcgtctgttactgcagaaaattaccactgtttcgtctgttactgcaggatatcgttccgaaacagggctactgtttctataaaggcacgcacattgcacgtacggctgcacaccacgctcacaaaaagctctagataacatgctcggggtgcagcagcatggccggcagcggcacggcatctcgaagccaccgccggcgaagaaggggaaggcggcggcgaggaagtacaagccgccgcaatgccctggcgccgtgagggtggtgtacatagccagccccatgaagctgacggcgagccccgaggagttccgcgccgtcgtgcaggagctcaccggccgccactccaacatcgccgaccgtcactacgttgactccaccattgatctcccgccgccgccgccgccgcctccagcatactgtgccagttatgctgcgtcggccacggcggcggcgcctcccgtcgcagctgtaccaccgccggtgctgactccgccgttgccgccgcaaacatttcagtcgtatgatcacggcggacaagggcaccgctggtagacaacactattactcctaattagtagatgaataataatgtatatatatggaggttaaattatattattatctaggaaatcaattgaattcactcatagtgaaataattaagttttgtctagttgaaactgcagggctgtaaaattattgtatatgaaggtttgcaaattattatattagtattattttttcggtcaggccggtgtgaagaaaagccccaaccaattttatgaaaaaaaacacttatgagaggtttttaaattatcaattagaattcaaattatattatccatttccactctattttattagctggttttgtatgagaaaccaacatccaccttttcatttattcttatgcttatttgtaccgcttatattagtaaaactagcatgtggctagcatcattatattctttctcatataatagcatatatgttttctcattatattattaaaatatattacaatgacaacataattttaaattttgcaataactttaagaaactactaatgtgtaatattcatattgtattttatatacgtgttagttattaattatttttaatatcaaattttagttatttgtaaattatatatattcctatatggactctagactcgtcttttaatatttctttttttaattctgaatttttattatttctaattgtacttgtatgtggactctaaacttatctttcaatattctttaatttttaatttcaaatttctattacttctaaattgtattcctatattgactttaaactcttcttctcgtgtttttcttaatttcgaattttagttatttgtaaattgtatttttatacggactctaaacactatttttcattttattatgtttattctgaattttagttagttttaaattcttatatggactctatactctacttctaatattccttattttttaattctgaatttctattttttttcttaattgtatttctatatggactctatactctacttctaatattcgttatttttaattccgaatttttattatttcttaattgtatttctatatggattctatactctacttctaatatttcttatttttaattctaaatttcagtaatttcctaattgtatttctatatggactctagtctcctcttctaatattccttattttttacttccgaacttcaactatccctaaattgtatttctatgtggactctagtcgcctcttctaatattccttattttgtaattccgaatttcagctatttctaaattgtatttctatataaactcatatttcaatattctttaatttttaatttcaaatttcagttacttctaaattgtattcctatattgactttaaactcttcttcccatgtttttcttaattttgaattttagttacttgtaaattgtatttttatacagactctaaactctacttttaattttattacatttattccaaattttagttagttttaaattcctatatgtactctatactctgcttctaatattccttattttttaattccgaatttctattatttcctaatggtatttatatatggattctagctcctcttctaatattccttattttttaattccgaatttcagttatttcctaattgtatttctatatgggctctagtctcctcttctaatatttcttattttttaattccgaattttaactatttctaaattgcatttctatatgaactctagtcttctcttctaatattccttattttttaattctgaatttcagctatttctaaattgtatttctatatggactctgctttttctttttctccgattaatgtgagaatttctagaccatgagagcgaacgtggaggctcctttttttaattccaaatttcagctattactaaattgtatttctatgtggactttgctttttctttttctccgattaatgtgagaatttctagaccatgagagcgaacgtggaagctcctttttttattcctttaataatataatagataataatttataggtaaaattttatatgtgttcttagtgataaaaacaaatattattaaattaaccacgattaaaaaacataaaatcagtttaagttttaaaatgtaaatcttgacttataaagaccaacaagcttcctcaagcccaaactgcagagccacattttcggcccaacagatatttgggcccataagtgaaaaaatgggcttaggcccattcctctcctcctcttccgcgtgtgtgtatataatcttggtaaggtggtgcggcgccggtggccggagatgggcaacgcgagcggcaggctggacgacatcgccgacgccgaaatggatgacggcggcggaggcggcaaccgcgccggcgctggggactactcctcctcgctgcgccccatggaccgtgctggcctcccgccgtacggcggcgccgggggaagcggcggactggtgcggcccccgtcgtcggcagcggggtactccggcggcggagggtcgtcgtccccgccggggacccccccgcggccgcactccccgcgcatgttcgtgccgcaggtcagatcacgctaaactcaattcgatctcgatttcaattccacccatccatgtgcaatatacatcctcttgatcgatcagtgcatgtgacgcgcgtcgcacttgtaatgtgcatgccacaatttcatcggcgttgcattttggggactcctcgctgattctatgatttattttggttgctaacaatttgttttttttaaaaaaacatgatctgaaatatatgttctttagaaagttcataatatgaaatatattcgttacaactttgacaattaaaattgtagaataatgtactgttgttttatcagatttatctagaataatactccctcctttttcctttttagtatatgatgttgttgactgtttgagatacatttaaccattcgtcttataaaaaattaatataattatcatttattatgttgtgacttgatttatcagttccttagacatgattttttatatatatttgaaaaaaataagacgtctcatgtattaaacagaggtagtacaggcatacaactttgctcagttgctctactagcgaacatgtttaatcttacggtcgcttcagatgatctaattaccttgtttcttgccaagtcagtctacctcttcccaaatgtcattgttctaagttttgtgtttttaatgcactgatataaatgtactgcagagtcctgtaactccattgcatagagctgtagatggacctcctccagtatttaaccagatattaacgagtgaacaagaggaggatcacgatggtccccctgacaagctgattcctactctgcttgtgtggactcttggagggaagaatgtctatatagaaggatcatgggataactggaaatcaaagtacatttttattttttggagagatagcatatagtatttcccttttgtttctagtacctaaactgaagcttaaggatagaactgattttgttctgacattgttagtgtgtatcacaggcaactcgtccataaatgtggaaaggatcactgcgtcatgttagggcttgcatctggagtttaccgttatagattcattgttgatggagaaagaagatttcagcctgatcgtccccgtgaagctgacattatgggcaccatttcaaatcttattgatgttcatgtgagtatttttttttcattcaacttttttccccgttgcacgtacgattgtttgtgcgaacttgatcagcaaaacttactcttgaccatgattatttaaacccaagaaaatgtgctagggagattcccactcaagtacttgatgatgattaagaaagggaccaagctcagatatctgaaaattatatttctcgcctagtaagaatcaattgaatgatgcaaataatcgttgcactagtataaccaattgtccccttgtttcgttataatcaataaaattatgttcttcattgtgtcttgcaagagtctaacttggaggcacatatatatgagagaaacaattctaatgtaattaggattagactacaactcaaagcaccaaagaaggagcacaaagcctgggcattgcacagatcattcccacacatcatgatttatctgctagcatttgaaacacacactacgaatgcatcacctatctctgcttcttgaaaattcagtgtttgcgtattgcctgaatgtataactggtgtgcatatgcttgcaggattatgtcccggatagcgtggacagtgtgtcagagctgatggctcctccatcgccggactccagctacggtttcctggctcctgacgacaaggagttcaccaaggagcctcccgctctgccgccgcagctccacctgggcgtgctcaactcgcgaggaggctccggcgggaaggagggagagtgcgccatgcccaagcacaacgtcctcggccatgtcttcatcggcaagggcaccccacccatggtcgctgccctcggcaccaccttcaggttccagtccaagtttgtcaccaaagtcctctacaaggccatccaaagagaggacagatagctttattagctggcaatgctagaacaaattagtcatgcattctgttcattcattgttttggaatagtaataataatggtaatcttgagggcgtggaccgtgatgatttcatcagtgttaggaacaaaaacagacccattgatgtgcttttcagtcaccaatttgtttgctgacgccatattaaggatctaccagaagaataaagatggtgatcgatactctttcatacatttttgtgtgtgtgtgtgtcagggttggtcagttttgtagttgtgttcgtttgctcacatctcttatcttgttgcgttccaagatttgttatccctttgttatatttcggtttctctaatatgtatattttgtagggagaaagaggatttctaatcaaagggcataccaatcccttttcagtttgtcatgatacgatgatatcagaaagcttaaattgagcccacataaaggcgatgggcccaaagcccagtacgagcatccaaccaggaaaaaggcccaagttgtagtaacacgtttcatatggcccacaaggccataacacgaaagcttggaaagtcgggggactttactgataaaatgcactccgcgtccaaaccgcgtcgagggtacatacgtcattctgctcatttaaaaatgtcaagaaagcatccatcatcggaaaattccaccgttttacaggcccacatgccgtaaagtcacagaggcttgtccttgacggaacattcaagattacacaaatgccctcacacacatgctgtactttgacgtttgggatgagttttacgtaaattctgaaagaataaaactgtttttatgtgaaaatcctgtagaatttgcttttgtgcatacatagagaatcaatggaacatgtacaatagtacttcctctattttaaataaaaagatagttgctctctccgtctcattttaaggctctgttcgtttgggcaggtttccaacttctattcctcgttttccgcgcacacgtttttcaaactgctaaacgatgcgttttttgcaaaaagtttctatacgaaagttgcttaaaaatcaaattaatctatttttgaaaaaaagcaaatacttaattaatcacacactaatggattgctccgttttccgtgcaggggagttgggttccgaactgcctgaaacgaacagagcctaagtgcagacatgatttttcgtgcccaacttgatcatctgtctcatttgaaaaaataaagaatttaaaaacataagtcacgggtaaagtactattcatattttatcatctcataacaacaaaaaatactaattataaaaaattttcaaataagacggacggttaaaattagacgcgaaaactcatggttacacttaaaatgggacagaggaagtatatttttaagcgaaaggactgagggaatagctaggtagaatcccgccaatccagggactgatttttttttatcctaccaattgagggattggctcaaagcaaactcatgccaccacaaatataggatgatttggacattgacaagctaaagaaaatgcaactttaccaaataagtaagtaaattttactttggaccattttatcttcttatatactatatattttagatcatttcaactctcttctgaaacatatgagagcgattttgagtatgtcggttccttaataaactatcatgattatatgttttttgacatatgacaatttaggtgtagatggataaaagagttcggggtggtttaaagtgtaaaaaaatgttaataaaaatatgatcctgtaataaaatgaaactattttcatgtctatgttttgaaaaacattatacccattactaatgaggaggggtagtttgggaaaagcaggtggtcgaaggtaaagcggaggtgacggaagacgcggtataaatcgggggtgggaaacttccaccggacgccacgccacacaagtctctcctcctcccatctccgcttcccttcttcttcttcttcgttgatccactcacccgccgcgcgcagaggaggccatggcggatcagctcaccgacgaccagatcgccgagttcaaggaggccttcagcctcttcgacaaggacggcgatggtaacaacaacaaccaccaccaccaccttgttctctctttctccatctctatctgttcgttggatcgatctctctcgtttgcacacgctggcgtctcgcgcctgtggcattgcctccaccgcgcgggtgcccttccttcctcgcgtcgtcgggtggcagatccgatccgggcacggatctggacggaaaccggtcgctgtcatcgtcctgtgtgtccagtggcgaattgtccgacatggacgcaacgcttatctgctgtgctgacttgaccatttcctgactgcgccacctccctcgacttcactatcgcaatcgtgtctcgctgcctgtttggttcgggaacacttactctacatcataataacttttcaacttatattaggccctgtttgattcagctagtttgcttagttactccctcatttttctttttcgtgcaaaaacttcggatatataattttctttttaaaaaattaattttcaagtttacagtagttaattaatcatgccgttaataagctcagcaaagaataatatactttcattacaatgatttttatgtacgaaaaggtttattacatagtcgaaaacagagaggagtgtatgtgttggatgtagcttagctatcaactgctccctttcgcatgcaactttggtcattttcttaggttagtgcatttggtagcttcaacctttttatggtgggctgtagttgtatcaataacttgatcgctactgaaagctgttcagtttaggtaattggattcctagcccttggaataccttctccgttagaaatttgtccacagggaaatcctgtataaatttcatgggggcacgttgaaaaaattatacagcaagtacatgcaaataattttgtggtttaccttggaccttgttaaagaccataaccctgcaattaccttggtggaaattgtcttcgactggtttctcgttaacctggtaatattttagctcactgattcactaagtacggctttaaggttgaacaacacccaccttgaaattttgagctgaaatgttcgtggaaattgtcttggactagttattgttgaacagctaacattttagctcactgattgattaagtatggctttaaagttgatcgatacccaccttgaaactttgtgctgaaatgttttgactgcagcaatcccttcttgatattactgtcagggtgaatcacccagttaaaagcatccaaatatgcaaatatcactcagccttgtaacttttaacggaatactctcagcatattcaaatagacataatcgtactatttcaaactctttacaactggtgatgagccaataaggagtcccttttctttttcttttttaagttaatatcccctaatggcctgtttggttaggataatcatcctacaatgatttggttattgttgagtcatcccctgattttgttgggatgatcccattcttcaattttcttcttagcatgcccttctgaggatgcaattgctatgtaccaacacattccattcttcaaaccaaacaagtaattacgtttggacttcagtgttaggatcagacagtccattccgtatggatccaattagacgcatgttgacattattattagttattaggaagtgtagtgtgtgcctagtttttctgttagtatctagttataatgactacactgttcagcaattgattgtacaattggttgcttgtgaactttacaggttgcatcacaaccaaggagttgggaactgtcatgcgttcactagggcagaacccaacggaagctgagctccaggacatgatcaacgaggttgatgctgatggcaatggaaccattgattttcctgagtttctcaatctgatggctcgcaagatgaaggacactgattcagaggaagaactcaaggaggccttccgggtgtttgacaaggaccaaaatggcttcatctccgctgctgagctccgccatgtgatgacaaatcttggcgagaagctaactgacgaggaggtggatgagatgatccgtgaggctgatgttgatggtgatggtcagataaactatgaggagtttgtgaaggtcatgatggccaagtgagccatggaaccatactctaaggcagaggagattgtgtgttgcatagtcctagttaagatgcaacacttgttttatcaatttccagtgaagcatcctactagctgtagtcgctaaaaaggattttcctgctatgttcctctgaagtgtgttttcagatctcttgtgttttatgtgaaccagtaattcttgtccttggtatgtccagattgcagttgggcctgtatgtagttatatattttttcatcaatttatgctcgagtctagtatcaattggatatctggtattttttttattccattggtctcttcttcgatctacatatgtttcttctgcttgtatgcagaagaatttgttcaattgcagagaaggatcttttggggtttgaattggatttgaattgagcaaatgggaaaggcaggcatgcctttcaaagagggttgcctggcaggttgcaacaactactagtaattataagtgttgaatgatagactgatagctgcgtgcagcctctgagagtatggcagtaggtagcaactaccacatgctcctggccttcttaaggcctttttctgaatgtattctgtgcttgtaagagtcatacacgattgcgcatggagctggacaagaaatttaaggtgctttgcctgcacggcttccggacaagtgggagttttctgaagaagcaaatcagcaaatggaatccttccatcttccaacaatttgacatggtactacgctggatccaaagatcaggtttttgtattgctttgttgattgtttacatgattttcctggttttcaggtcttccctgatggcatattcccagctggagggaaatcagagatagaaggcatatttcccccaccctactttgagtggtttcagttcaacaaggttaaatgcttcagatggaacccaaactgaaacaacacttgcaatagcgttgtcagatcttactttgtactatagtttcagttttgttgctatactatacagtgtgccttggctcaaaccaaagatagacaaacatttatttactgttgcatgttcctacacaggacttcactgaatacacaaatctggatgagtgcatttcatacctgtgtgattacatggtgaaaaatggaccttttgatggcctgcttggattctcccaggtaaaaatggaacctagctatgaaacgtatttgacccacttggtacttgagtgttattattatgtgcatgctagagatcttgggccaagaatttgcatatgaaattccagataagtgcattcaccatttaaattgtcaacttttgaggtgctgtaatttatgagttcagttccgacacactgagcaacactagattatctgaagcttctgctgtatatagataatcactcactccttgcagtcgatctcttattttatttctatatccaagttgcaaaaactttcgcatttttttttacagaatcctgtgtactcacgtttttctattggaccagacactcacataggaaagccaaaagacatgggttgtggtcagacctttagattttttaatcagtactgacttactgaacaatatcataattcagttttgaccgaaatcccttactgtttgtttaacatcttgtttacaactgctcatgtccttcagctcatctgttaatttctttttcattccagggtgcaactctttctgctcttttgataggttaccaagcacaggtacacttgtactcttaattttgcagaaggtttcaattttggttgtagtttgaaggaacagagggcaataatgtgtgaatattcatgaaacgactgtgacatcaaggtcccatatttgaacctagcagtttccatgagctattcagttgttggtgatgtgttttggcttcaaattgttaaatgctagtacaaatataaagtcccactcctataggctatggtaaatactgaatagtatcgtttagctaggtgctagcttttgtaagctgcaccaacatttcattcactagaacatggacttgagcagggtacttcttttatgggataagtcctttatatgagagatgttattcaaagtctgcagtatctagttccatctggattcttacttaagctgaatgacttagggcaaagtactgaatgatcatccaccaatcaagttcatggtctcaatagctgggagcaagttcagggacccaagcatatgcaatgtagcctataaggatccgatcaaggtgaaatcagtgcatttcattggagagaaggattggctcaaagtgccttccgaggagctggccgctgcctttgaggaccctgtcatcataagacatccccagggccacactgtccctaggcttggtatgcatgcaccctacccagcacttgcattccatcttgtttttcttttcactcctcttaaaactgttcaccaacattgcttgcttgttaagtattaatgagtggaaattgttcattcacagatgaggcaagtgtgaagcagctttctgagtggagctcaagcatcctggaagacatcaagaatgcagatgatgttgccaaggcttcaattgtggagaagccatctgagggtaataccgtggcagagtccggtgaaaacctggtggagcaaattgcagcttgagtatggtaactgacagtcttgacactgtctggaggctggagctgattgctgcttcaaattaaaccggattagtccgtcatgaaactcgatctatccaaatgtttaagtctttaagagctttcttttttagcgaagatgtttaaaaactttgttaccacaaatatatttgcctgggtactgcttgtattctctgggggaactaattgaatcgactcataaccggaccaaatggattcagggattcatcactgtagctccagctacttgagagagtaattggtgtaaaatgtccacaaaacattctgaggttcaaactgagatgattttcaattcagaggctgagtgaattccattatcagaaacaaaaacaaaaaaggcaaaaaaacaaaaacaaaagtgaaatgatttcaatcctgattctgccgcccatccaactttgggccgcgagttaagatccaagttgggcagtttggccacacgaacgatccaacttcagccgctagatccaatttaaacaggaaccaatcgaagcagaaaaggaggaaaagtatctggacgccgtgcgccggagacggagaaggtgagccacatctccgtcgagtggcggcggcttacggcgaagctgttctcgatgcaagcgcccaccatccatcctttgcttttggggataattttactatcctttagaaggtatctatatattttctagtataaaatttggtacatctaagcactaagtatcttaagatactaaattacctcaagctactttctcaaggaccataaaattcctcgcttctgacctgcatttcatctaccttcaattccattccagaagatcctgttaaataaccctctcaatacaatactttcatttcacaatgttttttgatacagtagtatactattacagtgccaaaaacaacgatactacaaattacacatggtggaaatattcagagcatatcactgatcatggttatactgatcctatgtcaacctacatctgtggaagataaaattgagtagattttctgctctaaaaggaacaaatcaaatggtgagcagtgaagccgtgacctgctgttgcctaatcctgttgggtacttatatgaatctatccatacatgggtaacaaaaggatttactgcaactcggaaattttgatatgtacagagaaatc

SEQ ID NO: 63369 - DNA, 661 bp, Oryza sativa
tgtcttttggactatttgctgtaaactttgataggtttgacgaactgtacttccatgtgaccgatgaccatgcctggcttggtttaataaaaaaaacaaatttaagcctgaaactcgagtggtgtaaaaacattgtcattacgattcttgccgtttcaccaaacgttactaccatcggcatatattattacaaatggttatctgacggtcttaggtgcttaaacatgggagtaaacataaaaaaagtagccaaacttgtttattttatttaccgaaaacttgaaatcaatctctggaagaaaatccaaataataatataatgcatttttggatacattaatataactagaaaggagctcgtccatcatgcgtacgtattgataaaagcgaggtattaaccagagaatattgttcatgatttcttcataaatggcctttgtcagcattaattaattgtttaataatattttatcccattagctttatgttatatcatatatatatatatatataggtaatatctataagcaattatttataatcttctttgtcatttgaaaagaaagtagatttattttctttagaaatagatttattttctttagaaaaaatgtcaccgaaagtaatttaagtgtaaaataaaaaaaaggggttttaaatg

SEQ ID NO: 63370 - DNA, 16972 bp, Oryza sativa
gcaactaggcgttaattactctcgtttttagatgggaaatacgttaatttatggcgtgttactgcatgatcgcaaagatgatcactctgaataatctgcactgtacgtggcaagtgtgcatgcatgggttgtggtgcagactatttacatgagtggatcagatctgtgcactgttggatcttccgtgttcgatctgtgtgtgttctcatgcaactcaaaactattatggtccgagctgagcgaaagcaactgccgagtaacaactaagctacctgcatgtagctatatatacttctgtagtctgtaccgtaccacgtacgcacgtacaactacgataatatctctcggagggcgtatcagcgcatagccaatatgaggtgctaattaatatccgtgcttgtatacttcctctgcctcgttaatttgtccagtttcatcgctcgaaataaatttgcgtacagttacaccagaaatctaaggtatatactcctcatttctaaaatgtagggccagttcggtttggttccaaattgtgccctatcaattcattggtaattttcaatagtgtttctagttgtttggattggtgccaaattttaacaatacatctctttagataaaaaagttttgccgtctaaatttggtagtgccaaaaattgcttaaactttggcactaccaaaattttggtatggcaccaatccaaactgacccgtaattattttttaaatctaaaatagaaatgtagctatattttaatacgaacagagcaattactggcatcaaattgacgcagtacgttaagtaacatgaggtccttccgtcctttgctagtggctacaaactacaagttatacaaaaacaactagttatataagctgcctgtcagtcagtggtggtcactactacaagcacacggcgatagccaatatgaatggccagaaaattaggctagctctctgcattcacatacgtactgacgtacatatcccaatcaatacaccacgttgagaggctttcggccggcaattaagcccgaaagatatctgcaggctaattactgatcatatacatatcacacagggatattgcacaatcactgcatgccagatgccacattatattgccacatatacacccgggctagctagatgcttgctagctagctaccttttcaacctcatcgtcattaactattatcacgactactctttccattaatcaaaatgtatacatatcaagaacacatgcatggttgcattttggatatctcgatctctagctatatagctagctagctagcttcttaattagccggccggtcattcattaccttaatttgcatgtacaacgagaccaaaaaaataatgagtaaatgatgattcagttcgttcgaactcatcactcaccaaaaaaaaaaaaaacagcatacatgcaacgacaccagctaagctagctagctatagctccaaattaattaaacttcgccttcgttttcgtctacctctagctagggcgcgcgctaatctgcgcatgcgccgttagctagctccgacgatcaaaatgatcaatcgatgaatctcgatccggccggggtggttcatatttacacggtagtatccattgctagatcgagctaagctagctgatcttgccggagcaatggaagaaggaattaatatagctagtgtacagatgcgcggcggcgggttcagcgggtgcaggagtattggagggaggaggtgagggagcggaaggctacctcctcgcaggggaggacgaggaggccgccggcgccggcgccggcgaagccgaactcctcctcggcgcggcggagcagggagcggaactccggccggtcgagaagcgcgaggggcaccacgaaccgccgccgccgctcgccgacgtacaccgggaagtggcccctcggcacgtcggacggcaagccggacgccttcttcttcctcttcccactcgctgacctgcttctgctcctgctgccgccgccccaggctcgagcaccgcttcagtatctgctcagccccgccgcgccgcccttcttgatcgccacggccgccggtgagctcaagcttgctgtagttggtggttggtgatggtggtgacgaggaggcggccatggcgagggggtatatatagggagaggtgggcgaggtcgtgaggtctcgccgtggttggtgctggtggtggatgggcccgcggcgcccgtgggcttgccgggcctgggcctggtacagggtgtgggacccacatcgcaggtccctgtgtttttcaccttagacctagtaattagttgctagttgctactacctccctcccaaactaattacattttgagagaattaaagatagattagcaacaaacacaatttaacacaataacccaatttaatgaccacacattacctacataaacttgattaaaaggaaggtcgagacaataagcccacttaattaccattcttaaacttgattaaaaggaatatttggatcctttgtcagcagaaatttttttgggataaaatttaaatgatagaaatgtaattatttaagacggagataatactagatagtaatggtagagttgcaatggttgtgattagtgaatctgatctgataatggtagtccataatgtggtaccttggggagctccttgttttttcatttttcctttttatacaggagtttttgttgagtgctagtacgggcccattctttgaagatgaaaattgatggatgatcgccttaattacagggatggattaaatactatatattataaatctaataaataacttagaacaatttatttaagcaattctgatttatgaagttttcggacaaattatagttatcaaagcgtggcaatgcatatacaatctatcagggttaatccaaaaagagcgaggccttagatttagagttaaatgatgtaatgtctcattttaaatatgtaagttcagaatttcccacctttttttacttgtatgaaacatggtgattttctggcctttcgaattggacctgtttggaatatggtaatcttccaaccttcaattccgaataagtcaattttcatatccacatcaaaatgaaatatttccttcctacgttcgaggcgggccttcatagaatgttctagaagaaggttgttcgaagttatccaagaaggttgttctaagttttcgaaagtgaaaagataaaaaggaggagaaaaagttgtgatggggggctagctaaaatcctcgatatttccctactcttgcaatttgcatggtagagacaaggtcaacacactatagttagctagtatattgtaggatctaagtatcaatcaagtggcagtgaacataaaagagagaaagaggagctcaagtagtggggaagcaacttcaaggggttgacatttgacaaaatgacagtggaaaaattccaagtctcacatcaaagtgagtgatcaaaaccaccctttaatttcttctgctttttcaatgccctgcagccagtgttgttgcagacacgttcaataatggtccatgatccatatctttcaggtatctctgaccactgtacgtctgtaccggccgttgccgctgctgcatcctctacgcatcacaaaagatgcctagatagttttttacaacagtttctacttgcatttcatcagaaaaaaaaaagaagaagattcatctgtgtttctgaaagagaactacaacaagatttctctcctagttcaggttaatcaggttcaggagtcaagacttcaggtagcaattttcaactattgataatatttgaataaattattttattttattttatttaaaaaaatataaaactattaaccatgttaatttaacatatgaagtataaatttcgcatggatttgagatctcgagccgtgtcaaatagggagatggtaaagattacatagtgaactcacatcctctagagccgaagtattgcaagaaccaatagttcacatgttaattaactcaaaatctagtgcagcaatatccctcaaactgatgtaattaagtatcctcctagctaagtagctaggcttggctacttcagaactaattaatcttatctttattcagttaactaatctttgaatgatagttgatcaatcacagatagtatgtattatcagctggtagatctgcagggcaaaatataatcaagggccgccatgcacttgccactggcacttgtgtggttgcatctcatgataggtgatgttgctatgacatggctactgggcgtacggatgggtggccacccgtttaagcttggaccatcaaagatggggcactaactggcacactatgtcaggataaaaaggaaaataaaataatcatataattctagctatgtatttacatggcatgtaggagaaaagaaaaatactgtcctttgaaatcttcagaaagtgtcctttgaagtcttcagaagcctagctagctagctcgcttgcacacttgacctcatgctaatccatgggtttaattaattttggaatttaaaacccagtaaggaaattcagaaacaaagccatgcattccaagacaagaatgctagtcgcattcacaccttttaattagttagtagtaattaattaatcaattaactgataaatatcacactgcctgcttggctatcagcatcatgcgattattttgatgtaacatattgagataattaatcaccagacaattcttttcaattttctgactgaatgtcatattgtcatgcatggtgtggtggtatacaagcaggtcagcactaattatctgctttcctgcttgtgttatgtccctctgctgttgaacaagtttgtatgggctctcaaccaactggaaacattatgttggcaatctcatcacaaatcaccattgtatattatgctgaaaattctattattgttggaccgctatagtgtcaactcagtaatgatccatttatctgaaatctgattggaataatgaagtggcagggtcgttgctagattcttatcacctgacatgacattggtcgcggctagctgtgtgtttcgtatctaagacggctttgaaatagaattccacattggccatgtgagatgctacaaattcagacactgattggaggaaagagaaaaagatgatcatccatgccacttcttgattaaattatcttattcagaaatcagagttctggaatgaatactgttgaagcacatgcatgcatcatccattttaactttcccatcacatattcagattaaccttttctttataaaaaaatcactttaacattttgatttgatttagattattgagcagattatccatttgattgtagagataaaacaaacttaacaaatagcttaaaataagtgctctcagcaatacaatagaggtattttcttttgagaaaacatatttttttaaaacatggagctgtttcaataatccagtgaataagttgaaaagaaatgggcggcaacatggatggtaaaatctaagcgtggatctccatttgtctctggtcccttcatcaaacatgaatgcagcctgattgcttgtctgcattagcaaacaaaggcgagcgagcgagcgtgcgtgtgcaaccaccacactcacacgtacgcccgcacgtacgaacgtacgcagccttcaaggcctttgccccgaattatatcatggccaaacagtgcgacgcttcagtgatcaccagcaggtgcagtcaatgcagataccaaacaagcaatcagaaaattcagggttcagacaggctcacctaactgaccaagctttttagccaaacagaagggttgcatcatgcgtacttgaactaattaatcttgcagactctctggtcgatttctgaattaattaattaccagaagttagctagaacacctgttcgatctttcagaaattcagacttgagatgagagacaggaaaggaaactgaaggttaagctgtacaaatcaaactagaccgttctaacgaactgtcagaatttgaatgttcgaggagtactactgatggcagtagggtcgtcttcttggagaaaaacggtagctgctgctagctaggacaatgacattcttgatggatacatgatcagatgaaaatccaaaatcaattaatcagatggtagtatcatcatggtaggagtacaccaatacaccaagaattgaaagactcgatcgatcgacatcaatcgatcatggatcgttaatcaacgcatcaatcgatcgccatgcatgtttatggagatgctccaaacatgtcagtgttctgctccagttgaaaaactcttaagctccaaattaaaaagcgtactcaaactcttgatcttagctaatggcgatcgagccgtgcaaatctgagcaacaaaccgattccactgacgacgatgagtacgtctgtacgtgtacattgtgctgtcgccgtcgtcaactgggacggcgtacgtggccggccggagaggtcgccggccggccggccggcgacggcgacgtctgagcttccacatggcgaactggatcgtccggtggctcgtcgccggccgatggatgttgacgcgaatcattgggccgggagacagcgcccaaacagcaagttgcaagtgtttgtattgtacctacgcccccccgtgtgcatgccatgcacagcatgcatgcaaagcactcctgctgccatataatctcctcaacattatctcattatccatcgactttactaaacgaaatgaaagcttaatacgttttttgaagattatgtgaagattctgagaaactgttggtaagaatctaaaaaggctgagtttatccagcttcgagcttcaagttattgtagtttgtttttatattttgtaactaccgagacatgtaacttggaggaaggatgtggactgtttaagggaaattaagattctgagagtagctgtagctgctagaagctcctcgcatagagccatacacacgtctcaaatcaaatcaaggcttggttaattaattggggagaaagcggaactgcattatattaggcttgagctaatcatgagggttttgtcagcttcagcaattgaaagtgacttgtaaaagggcaggtatgattgaagcaaagcagcaagggacataggaaatcttgtgaaggttcttctggtccttgcaaaccagcctgtaagatttggaccatcgatcgatcaatcgatcagccatgatcagtggtagattgtcccacaccttgtaccatgtatatatatccatcatagattcataggctggtggttgaacccctgtaaagcaaccccatttaatcaatctcttactgtttgcaatttagtaatagtataaatgttgaatagtggcaagagagtaattccatttcagactttcagtgcagacattcagtcagtactctgtccggctatatatatccaaggacgatattaacaccatttcgttccagttgtctggttataaacatacatacaagttggcatacaagctaggaaagtcgatttgagtacaccttgttttcagttaaatttggaaccacatgatttttcgcaagtaccgtcattagaagaaaattcaagcattatagtggaggtggatggttctgtaaaatggtaagcgagacgaacaagtgtcctttttcccgcttatatatcacaattctattttattttccttcccaacttcatactagcatgtagaaaatggttagttcccaataaggagggattcgaggagatcgagggaaaataattctatgcctaattctaattcctcttgtgggtaggattaaccgaacaagttgtggataggattaacggaacaaggcctaaaccagttttatacagctaacaagattatccctacttgcagtcaagagacacaagaagtcaggaattgctaggtaggatctttttttgtggcaacaatggctatggactgtctaaattttgtcggcagctctaactttgagtgagcagcatcgctcatggccagtagcaaagcaatgcacattgcagacactcaactaatcttgcacagttgcactacgatgcctacccccttaggggactgtagcagcttgtgaatatataccagcacgggtaccattccccatttttcactcactcctagcacctgcttgaaaaagaatatggaacacactgctacatttcattaacgcaatgaccccagtagaaaacgcgccattgatttcattctaattgttcacatgaatcaaaacacatggcaagacatagtgagaaagatatcttgattgcaagattccagaacatttaatcagaatgcatgaaacaaaaaagattccagcaagaactgaatcggtcgttcagcacagtttttaactgttacccacactaagcgcgttaatagatgctccatgtcacagaatcaagaaacatagcacgtttttgagccaagaagatcagcattcagcactatttgcagagtcaaaaggagttaaactaagcaatcgtacttgttctagaatgtccatcatatagcagggcaaaaattaacagcttagatgagccctttcagtatggagtaaaagggccaatcagagaagtaggtgttctcataagatgaatgaaatcatagtagaatatatgcacaatgacactgcttgttagtacattaattgcaagcccaagggctaaggcaacagctacaatggaaatacagtgatacacttgttatcatctagttagagcgttgttatcagatcccaacatcttccttatgacagcacttgtagcaaattagccgtgcccaaattgttggccttgaactgaatgtacgacagcgaaattcatcgtcagattaaactctggcattatttacctacgcaacaatgctaatcagaaatacaagtaattttactgaccagaaacagctttggattgctgaggcattccatctatcatgcttaattgccttctcagcttagctatgtgagcttgcacctggagcaacaagagagttacaatgtcagagaagtggacattgttttaccccattcaactgttcatgcacaagcaattcctgttactattaggtactccctccgtcccacaaagaaaccatccctagattcccaatgcaagtttagtactgatgtgaaatgacctaaatgcccttcttcaagtacaaccactcattagtcatcagcacttacccacgaaaaaaaaaggaaagttaaaaatccctccatcgtcgtttgcatctgagccaccgacgacgaccctgtatgccggcgcgccaccgccggcctgcacgtctccgtccgccgcaagcttcagatccaccgcctcacaaacctctgttgttgccacccccgccgcatctgatacacgacgccgtggaaggtcgcaggcacagagagaaagggagcttccaagccgcatccatccaccggagctgcctcccacatcggatgatggggatccgccggcttgcaaccctccaccgccttccgagctgctgcgtccgggtggacgcggaatgtcgcacggaggagtgggagagaggagaagagagagggagcagggagtgggcaggacgaagcaggaacatgagcgaggggtgaagcaaggatggaggtcgctggagatcgacgaacaagagagacgagcagtagtattgaatgtttctggttctggacggagagaacaagagagacgagtagtactagtattgtgtgtttctagacggagaggacgagcagtagtattgaatatttctgggttttcgcgcaggagtcgattctttccgggacaaactctcactggtagaaattgattttttgtgaggcagagggagtaagtcagaattattctatgcaacatcccctatactggcatgctatgtaattttatttatagctcgaaaatatgtctatggttatatataagtcagtctaggcaagtgatccccaatgcgaaattttaccattttgttgcccttaaaagattattatgctaatatagtcctttagtagtgttatcattgggagatacagaacttaccctggaaagcgctttccagttgaattaatttggggaaaaaaagactcaacaaaagggacaactactagtttacaactgcttgcatgaatagcttaattatatgcaagggaaattaaaaaagaccttcttgaaattgatacgggatgtacaacttagccaaaaagacatttaccaactgaaattgatataagataactctctcatggaaatatctacggattgaatgcatgttacaacagactaagtagatgagaaagcaggaatacttcttgcagtattgacaagcatagtaatatatctcagagaataaggacaattgaatctcacctgttgccgagcagcagccagttttaatagttcatcagcttcagagaaatttgagaaccactggctcaaaggatgatccttagtgtcaccacgcttcttttcatgtggcacaagttccatagggcctagacgatggataattttgtattgccatttttatttttcccccaatgaaatataggtacaagtcatggtgccaagaaaaaaggagtacctggaggaggcaaggttataccaggaggcaacctaggcacagtagcagctggatgattttgtactcgttggaaaaaggcctcagtgggctcagggaagacaatttcatcgtacgtttccacgacaacaggctttttagttgattgtggtccagtgtcctcttctggatacagtttaagttgatgaaacctgcatcatttatgtagttaactaaatgcttcccccaaagaaatatgatgtttgaaacaagatctctgcaacttacaaatccagacgcttttcacacacgtcactgtggaaataaagggttattgcaatttcaaattctccccagccagattcagacaactcgaaaggtggttgctctacaactcttgttggattagtgaaactcgggtgaagttgaaacaccacacgcttaactatcacacttaaatcctcatttgttgcagagcgaacatacacagtccatttgtgagagttgtacctagaaaaaaagaacatattcatgccctttagataatattcactataggtagcaaactgagtacttgaggaaatttaacaataagaactgttcacagaaaaaaaaatacttactcgcttgccttcttgccaagccagaaagaaatggttccatagacaattgggaaactgatctccacatccttgagttttttattctgtgcgaaaaaatcagtaaaacaccatgtcaagtaaaaaattgattaaagcttattattaatccataaagtataccaactaactaaaatgaagcatatggtgtaacaaaatcaccctggatgattcacttaggcttcccaaaaaaacagagggtgaagtttgttggatgcttatttatttccttgttttcatacttcaagaaggtgactgtatgtttgatatcatatactagacgactaagcaattaattggtgtgaagaataagacatggtatgatgatgcaaaggaatgtatataaaccacaagctagtaatcagttaaacaatagatattctggtccactgtttctcaattctaactctaaaaatgacaaacagcagagtccgatgcagcttagctaatcggttagataagtcttggattgaatcgtatcctagtcatttactcgattgcacaattgaacattcataagatgttcactgcttactaacgaatgggcgtgatgtctacttcctttgattcacccgaggcaccgagcatagctactggtgtgccacccaaaaccctagtagcacccccacccctcaacgcaaaatcacaagagaagaatcggacgagcacgccactgcaaagggaggtaaaccttcttgtcggagtcttcgggcggcctcgtcggcttggagcggagcgccttctgcgcggcggtcagcacggcctccggctgcgcctgcggcggcggcgccggcgtctgcgggtccagcgcctcctccgaagctggcacagccgacggagaagggtccgccgcaggctgcggcggaggcggcgccgccgccgtcgccggcgaggaggaggaggcttgcggcatcggcgcggcgcgcggcgagggctcggtcggtcggtgtcgggtcgggtcgggaagaaggcgaggcgacgcgaggaagaagatggttgggtcggatcggtccgatgggcgagtgggcccagattggccggcccactcgaagcggcgtgggttgcacgcttgcacggataagttgggctgtaaacctgtaaagtgtgtgtagggttttggatgggcccggcccataaagtgagcggtgggctcaacgggtgtggggtatttttggccgttcagcccatttagacaaccacaggcccacgcttttggattatctgtagattgaggcccacagcttttcgcatacatgattaaccattttaacacggaataaggtcaccggaggtccctcaacttaacagtgagattttttaagatcccttaactacaaaaccagaaatgtgtacccctaaactctctcaaaccgttcaccggaggtccctcagcagtatttttgtccggttttgctgacgtggcatcctagtcagcaaaaaaattaaaaaaatgcgtggggcccacatgtcagctgcacatattttttttttctctattttgttcttctcctcttctctcttctctcttcagcgagcgcggcagccacaggcggaacagcgtgatggggttctcctccgtggaggcgatgagcacggccgcggctgtgacagcaggttcccagacccggagccaatgcgttcagccggagcagcggctgctacaccgacgccgcattctccgccgtgcgctcctcgccgccgcctagatgctgctgctgcgcctgcgtcgccgccgggctcaccgtcagcttctccttgatcgctcccgtcaataaaaatgtggacatcattattgattgctaggagcactacgtgcttgcagacggcgaacgacacgacggtgccggcgaagcccgccggggccgggccgcagctgaagctgctggtggacaagcgctcgcgtcgcgtgctgtacgcgaaggcgcgcaaggacgcggtggacttcctcatcggcctcctccacgttcgtctcgttcgtcgaggccgacgccgacgtctcgctggaggagttcggtgactcgctgtgcccgtcgatcccttgcgctggcgaactcttgaccctgctggatagcgacttcgccgtcgtcaccgaccggccactactctacgtgcaggtacgtacgtcgtcataaaacttgaataaactttgcaaattttgcaccatttgtattgtacgtgatttacgtgttcatgatgccatgcatctcgtctgaggtgtggcggcttcgtgttgcatcataggtgacgaggctgaggtgtggcggcttcgtgttgcatcataggtgacgagactgaggtgtggcggcttcgtgttcagcacccagatctgccacaacctcgtcgacgcggcggggatcacgcagttcttgcaggctgtcggtgagctcgcggaaggcgcagaccgtctggccggtgtgagcgagggagcccctcgacgcacgccacccgccgcattcggcgtacgaccaccccgagtacgagccggcgtccgacgaggccagcgacaagctccgtccaggcgacgagctcgtgcaccgcaggttcctcttcggccccgacgacgtcgccgcgttgcgcgaccagctccccacgcacctcggccccggtgctcgcgtttccttctcctcgagtccccgggcccagaccgccgcttttcgccgcctacagccgccgatgctgcccttccgcctgctccggccgcgtgccgccgcccgctgccgctcgcccgccgcttgccgccgttgcagccgtgctctcccactgaccaccacccctccacctgctccagccgcgctcgcccgctacttgccgcgtcggcgtcggcaaccgctagctccgagtcttggaacctgccgtcgccaccgcggccgtgctcgtcgcctccacggaggagaaccccgtcatgccgctccgcctgtggctgccgcgcttgctgaagagagaatcagagaagagagtacagaaggagaagaaaagaaaagggaaaaaaagtgcagctgacatgtgggccccacgtaatttttaatttttttctgaataggatgccacgtcagcaaaactaggcaaaaatactgccaagggaccttcggtgaatggtttgaaagagtttaggggtacacattttttgttttctagttaaggtaccttagaaaatctcactgtttagttgagggacctccggtgaccttattccttttaacaccgaatttactgatgcatctgaattcaacttctaccggtgatgattcttaagagattatttagatccgttctttaggacggatgactatcacggtcacggtctataaaagttactgtgtaattaggatttgttcatgttttgcttggttctctgtttatctttggagacgctcataggcaaaaaagagaaaaaaaaaactacagcttcctaaaacgaagaatataattttagacgaatggaactaattcccataaaaattccgtgaaaatttacccccttcaagagtagtagttgaactaccatgtgaactgtgaatttgtgatcgagcaagcattgtgcccgggctatcctagctagcaggcagatggacagagagatactagctagttctaaagtcgccgtggtggtggcagctatcatatcatacacgcacgtaccgttgcccccttccctcatcgccggccgccggcccggaaagtgacctcctgtacgctggaatgccggccgatatccgctggccactaagtagaagattcaactggatcgacccatgaattcatttatttatagatcaaataagtaaataatctatatgttctacatcatgattcggcttaagatgcaagtgactcaactcgtgaacccacttataacccaaattagtatgtaacccgcagtccgcagatcaattcataggttacatactaattttatttataagtggattcgcggatcgatccacttcaatctctagccccactgctgtgcttcgacggcgaggcaagccaccccgacaagccacgccccgcgcaacgtgctccctcccttccgcgtcagcaagacagcaatcgcgctaatggaagaagctgctgcattgctgatatgaggcggatggaggagaggagagatcatgcagaaagcgactctcatactcactttaatcaatcaactgccgtcgtctatcactgtagtacgcaccaactgttcctgcacttgcccctgtgcactgtcagctagctgctcttcatttctcatgccagttcttctcttcaaaacaattatgttttcatgtgcatgcacttcgtgtttcgattctcaattttggtctttatttatttttagataagtacaagcttttacgtactaattccagaagatacaattgtaccgagaacactcccggtctatatatagctaggataccattgtggtttgatatgcttgccatgtacatatgctcatatgagcagtactgcagtacttgacttgtaccagcagattcatatttcaaatcacgctcattgtcaagcggtccacggtacaatacaacaacgtcctttcaaattgctttcgtgaaatgccagttttatgactattaactaacagtgcattatacgagcaaaaccaatcatccgatcgagtctgcctggagcaggatacggaattggacgattgccctctcgatcttgcgttgccgttatggctacagttttcgtgacgattggatcaagtagccaggcagggaatgtcatgctcaaagctagatctgaagctaaccaggagctcagatcacaggcccacaatgatgctgcctcttgtttatgtgacctgaatatatacttcattgctgatctagctttagccaactgccaatgccatatgctaagctaaaaattcatttttgattctgtatattcggtgtgctgtgtgtgctggtccctagctcccatcctctgttcatgtgaccaactcaagtatctcaacttatcaaagtagtagacaagtactagtagtagtagctttgaatctctaatagagtagtgtatgtttatgttcaggatagcagccagatcttcttgctctaatcgcctttttctagatccgaccgtgcgtgtgcagaagcgcatgtgtgccccttttggagctcttgcgatcacccttcataatcatatctgcaaacgtgttcagagttttttttattcatgtaatcttgtagtactacgacattagcaatgaggtaaagcttcttcaattgctaccctctctcaagtgatttacatctttgtatcactgtatgcacagctagttaatttgttctggactttatcactgtatgcctctgaaactctgaatcttgatctgaagagacaaagttacaacacagtatcgacagtaatttgtccaacagtggtattgattggccttattaggaaaactgaaaaaggtcagactaggtcaaatcttgttctgtgttgctgtgcaagctagatgacatgctataagctacaaagtatcgagcagtggaccaacaaaaatccaaataaaatcgaataatctgcgtgctgcatgcactgcttggtgctccactcatcacgtctgcggattgtatgtaggaatattatcaaaagagctttgccttgtcctggtgttgccctgaaaacaccaaagaacaggggaacaaaataatgggcatatttttctgctgtatctctgaacatatattcccttgtttac

SEQ ID NO: 63371 - DNA, 581 bp, Oryza sativa
tcgtctcactttgctgcactttgtttggcggcgattccgacgccgatctcccagatccgctcctgtcgggggaaacgcccgcggatcaacgggctacccaccatggtggaaaaaccgaacctgggaggctgggactgatcagtgagctttcaccggttcactgcttggaccgccggttcatcggttggaccacgatttatggctaattattttttatcataattaacgcttaaactgctaaacagaatagttattcagtcctcgccaacaaatttttcttacacagttggttaggtggaaagtacaaggcatgcagctcatcaagtctgaggtttaactccccatttgctcaaggttttttttgcatatttgttttaatagttttaagacaattcaccagaaaaccagctggttcgatggttttttttcatatttgttttaatagttttaagacaattcaccagaaaaacagttgattcgatggtttttttcaatatttgtttaatactattaagacaattcaacataaaaccagcttggttgaagggttttttttcatatttgttttaatagtattaagg

SEQ ID NO: 63372 - DNA, 1327 bp, Oryza sativa
gaaaataggtacgataaattgtatataaaatattgcgtacctttgtagatacatgccgaatatatctacggaattagtagatcaatttaattaatctactaattaccttaattagccttggtagccgatctgaattgtcttctgtgcatgtacatgtcgtcaaatcaatgcacacctaggcatgtattgagtccatgcatatgtaggtgcacatgtcaggagcaaatagtacgtgatggtcttgaataatgatgtattcggtctcctcgccacgacttgtcgggatggacgttctcactatgtgttaggggtgaggataatccaggtcccaacagaatcaaaattaattgacgatgtcacttcccgggcagtcgactcgaacggaggcttcctggtcaagtcattgatctctgcgggggacatactccggtcgggttagatcttcctatagccgaagtcatcgagtattttgttgtcggagaatccatccctcgaacccatctcgtcaaaaccttgaagcaccaaaatccccctacctagcacgccactgttaacgtttgatattgcgactacgttatttagatggtatggggatcgttggtaccagggtatatgccagattgaggtaaaagagatggagacagggatttttatacaggtttgggccccttatctgacaggtaatagccctacatcctgttggccgcagctggtgttgctcctttattcatctgaatcacaccagtacaatatttagggtagcctatctaactattgtagacttggcggtctgaaattctaactcgtatcgacaacagggtagtcttcctcctcgaatccgtgcccggcgagatcagagatagcgctttcgtctctcctgacagtatccggagacaccgtaggggactagccgtgcttatccctgaagccgctttcgtctctcctgacagtatccggagacaccgtaggggactagccgtgcttatccctgaagccgctttcgtctctcctgacagtatccggagacaccgtaggggactagccgtgcttatccctgaagtcgatatccggcgtcttgtcttggcttatgttggcttgtatgttgtggcttctgttgttccgtctccactctcctcttaggaggtcttatatttatacccataggtgtccccttgtccaagtagaactagggaaaccaatatggatacaatccgagtagtccttgtcgttttcatgtggaactctattcatccttccttatgcggaactcctcttatatatgaaggttgtttccgtataagagtatgtggtgggtcctgtcgagatt

SEQ ID NO: 63373 - DNA, 15657 bp, Oryza sativa
cttgccgccgaatcttccgatcaaccttaagtgtaggatctttcaaatatctaaccaaagaatactccaatcctcttctgtttcctgggcaaaaatgtccgaatttacaattaattcggcctttgaatcaattgcggcgtgcccctagctctctgtccagaaacggtcagaccggctgtgcaaggccagtcagatcgcccctagtctgtgattttgccaatttcgctcaaagatctaaaatcaagcaccagctcttctaatatcaaaaatactccctcttcacattatagccagatgcttgctgtgctaaatcatttgccctaggattatcatgcctaccaatatgtctaatagcaaaattatcaaaactggcaataatatccaagcattgatcaagataactatttagtgatccgtccaaacagtaagctccggcaacttgttgcaccaccaattccgaatcaccaaacgcttccacgtgtttagcgccaaccatctccatcacttgtaaaccaaataataaagcattgtattcggcttgattatttgtacaataatattccaaatgaaccgatgcctcataacacatgccattaggtgaaaataaaactaccccgatgccttgaccctctttgcaagaagaaccataaaaataaatcttccaaggtataacttcaattaagattcctcataagcaatatccacatgatggtctactataaaatcaactacaatttggcctttcaaagatttcaatggtacaagttggtatcagagccgaccttgaccgtaggacaagccaactggaaaacctaagagccctctgaaccctttttcatatgcacatgcctttttcacttggatttgtttcgggaaactttggggtttgatcttttgattttgggagaaaatcttggtcgcctatttaatcggatctcttgactagggacagtccagggttttagcaaaactttatttggaatttatttggcagccagtcgggaattgttaggtggtatgcattaagttgtgtctagattcgatgggatgcagtctttatgcgcatcattattatcatgcatttatttcatgcattaagttattgtttagtcagttgcattagtgtcttttgtctgggttcatgaaaaatgttccatgcataaaaatcatcatgcttggctagttgcttgggccatttgttgctttgtttaaatttggatttgagcatgcattgattcctatcccttgtctaccttagaagtcaaacctgttcttcgatcgcaagcgccgctccgagcttcagagtcgccgcccttagctttatcgtcttcttagtctgtttgcgtgctagtttttgtgtttaggtttgttgcttgtgggttagtcggcggtcgatatcatgtgtgagtggtatgacacccttaattaggaattgcgtgcctctttttcagtgttttaatcaagattaagataactgcacttaattttataagaaagattagtttccgagccatctgttttcttcctttctcttatttctacctatcctcatccagatggtgaagacaaggaatgatccccgtgactccaacgacgccagtggcagcgaagagcagacagatgaagctcataccagtggtgcacctggcagcagttcatctccgccgcccgagaacccaacagtcactcagatgatgacaatgatgatgcaacagatgcagcaacattaccatcagatgttgcagcaggcgcaacagaaccagcagtttggtcctccaccatcacacgtgtccaaactgttagactttctccgtatccagccacccactttctcaagcaccaccaacccaatggaggccaacgactggctccgtgctattgagaagaagctgaccctactgcaatgcaacgaccaagagaaagttgcttttgctacacaccagttgcaaggtcccgcttctgcctggtgggataactacgtggtgacccgtccagatgcaacgaaggttacttgggtagagttttgtcaaaactttaggaaggcatagattcctgaagggattatggcacaacagaagagagagttccgtgcattgcaacaaggaaccagaacggttacagagtacctgcacgagttcaaccgcctcgcgcgctacgctcctgaggacgtgcgcaccgatgctgagaagcaggagaagtttttgtttgggctcgacgatgaattgaccaaccagctaatctccggagtctatgaggactttgagaagcttgtggacaaggctatccgccaggaagatctgacttatgtggagaagccgatttgtatccttgagaccagtgagagaaggaccagaaacaaggtgatcaggttttgcaaagttcagtggagccaccactcagaagaagaggccacctcggaaagagaagatgaattgaaggccgctcatccgcacctcttcgccagctcttccgaatctcggggtcgagattccgtttaaggggggtaggtttgtcacgccctgaagttcccctcccttgctctaaattcataaaataaatcgtccgaagaaattgtttaatttaacctagagttgaatccttaattaataaatgcaaataatcatcggaatcggcatgtggaatttttcttggattctacatgtcaaaatatgctaacaggatttttagtggaattttcagagccttggaaataattttaaccaattaaaataagcaaaatgcaatattaaatccctggaaaaatcctttcttctttttctttttctttcctccttttttctctcttcttgggacgtcggcccggcccatttcttcccgcgccagcccgctcctccgtcccactcccgaagttcacccggcctccctctccctctcgggcgctgacaggtggggcccacctatcagtcctttccctaacctccggctgcccacgcccgctccaaccgccgccgaaaccaccgcccacgccgccgcgtatcccgctactcccgcgcccactccgcgccccgcgcccacgtcgctgcgacgccgcccacgccttcccgcccgcgccgcgagcccacaaggggtggattcaaattttgaatcccctcccactctctctccacctcccacgtcgccggcgaaatcgggagcaccccggccacgtccgtctctcccgagccccaataaagcttccccgcactcccctccacctttttcctctttccgccgctctctcccgtgccctccatcactcccgcgccgctacacccatcaccgccgccctcctgccgtgctccggccgccgctagccgtcgctagccaccgcgccgagcctcaccgtcgacgccgccgcgttcaccatcccgtgagccgtcgcgtccgccatccgcccggccaaatccaccgtcggggcccgcttctccccgcgcgccggtgagtaccaccattgccgccgccttcggccatggtttccgcccgtcgtggacaacccctctccctctaatccttcccattttgatccctaggaggtcccggagatcgtccgcccgtcaccgtcgtcctcccgtcgctcgtcgtcgtcgttcgccgtcgtctccactcgcgccggccaacctcggtgaaaaactccccctccccccctctttccctctctcccgtgtgcgccgccgtcctccgcgcgcgcaccgtcgtcttcggccgccgccgccgctttttgcgccgtctgccgtcgccgtccgcgccaccggttgccgtcgccagcgaccgcgcgtgccgccgtcgctcgccacgcttggcctgccggctttgaagccgagccgagccaccagacgcgcccctcccgccttgtgccactgccagtggggcccacatgccggcgcccctccctctctctcttgagccgctgactcatggggcccgcatgccggcgcctccccttccttgctgacgtcagccctggggcaatattgcgcaataaatacattaaggcttttctttaatagtaaaaacacaaagaatcttctaaaaatcataactaattcatccgagctccgtttaagcccattcaagtctcagtaaattcataaaaatgtatagaatccattaaaaatggttttgtttcctgtttcagtagtcttatagcatgttttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcactgttttacaatatcatgtgggatgggtcctattactcagctatatgttgtttcccttacgccattgataacttgggtatcaaaatgactagatgttggtttaggagatgcttagccatgcttagttcaactaatgcacaaaaggggatcacactaaagcatagactttgattattggcaatagctttggattagtgccaccgcaatggtgttggttaattaaagtacactacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcaccaaagggggggctgcccgttgcctgctggggacgggggcgaaccctaaggtgtggtgcgatcggttagagagggttatgcgaagggtcctgtcacagcctctttccggtatgtcgtggtggcatgtcggcgcacgggaacgtgtcgtggggctgtgtcttgtgggtatagttgtacacctctgatcagagtaaaactattcgaatagccgtgcccgcggttatgggcggtcgaccagattcaccgtaattagtctcacccctagtttagcttaatgaactggtgtagttcaggtggttggttgggcctgttgcaatgtggcgtagcgttggacagtgactggttaatattgcttaattactacaactgtttttactgttttcaactactggttttaaatgcctgctctatgcaaatgaaccccgtagcctcttttggttatatcctgcatcatacctcctcatccggtatgacttgctgagtacagtgggtagtactcagtcttgctcttttcccccacaccagagttgaagttcttctcagttgaagatgtctcgaagaggttggtttcgtcgctgccgtcaaggatgcctgtggaatggagtcgcccgctgcaggagtcaagtcttcaggcttagctcgcttttacctttttcgctgcatttgtaatctttcatatttttgtaagacgtggatctgtatgtcaacaattgtcgtttgtgtaccctggctggtcctggacaggggtttaatacacattcagcttagaaattctggttcgtgaatttctgggcgtgacaataagccaaatcatattcaatcaaagcatatgcccacttgccaattctcccacttagaattggcctttgcatcatatgtttaataacatcggcttgccaattctcccacttagaattggcctttgcatcatatgtttaataacatcggcttgacaagcaactatgcatctactagataacaagtaatgccgcaatttggtacaagcatagtaaaggcataaacaaagtctctctatgaagacatacctcgtttcagcatccaaaagacggcgggtcaaatatgtaatgatatactccttgccatcttcctcttgtgtcaaaacggcaccaatgaccttgtcttcggaggcaatatctaaccgaaacggcattccggctttaggcgctcgcaccacgggtggagtatacaaatactacttcaacccctcaaacgcctcttgttgttttgccccccaagtaaaatcggcttcttttttcaagcgaagtataggaacaaaagcatcgatttttacccgctaggttagaaataaatctactcaaataattcaccatacctaacaacttttgaacttctttcttgcatgtcggtgctttgaaatcacgaatcttttctatcttcttaggatcaatctcaactcctctttcatgcaccataaaccctaagaacttccccaccgacacaccaaaagcacacttgagtggattcatcttcaaaccataccggcgcatcctctcaaaagctaacctcaaatcggctatatgtccctccataccatctgatttgacaacaatatcatcaacatagatttctaagataatacctagcaaatcatggaagatcaaattcattgtcctttgatatgttgcaccggcgttcttcaatccaaaagtcatgacaacccactgaaataaaccaataaatcccgggcacctaaacgccgtcttgtacatatcctcctccgccataaagatttgattgtagccggcattaccatccaagaaacaaatcactttatgacccgaggcatcattaatcatcatgtcggctataggcataggatattcatcttttggagtagctttatttaaatctctaaagtctatgcaaactctaatcttaccactcctcttcttctccaccgggacaatactagatacccactctgcataacgacataacctaataaaccccgccttcaataaccgatcaatctcctctttgacccggtcatatagcaaaggattaaaacgacgaggtagctatttataaggcctaaaacccggtttaattagaaaccgatgtataacaagttcacggctaagatctggcatctcatgatactctcatgcgaagcaatcaacatactccttaagtagctcgattattttaaccttataatcggctctcatttttttgtttacaaaagtcggccttggtttagttccatcacctatgtctacttcctccaacggatcggccgatgtaaacccttgaccaagcttttctactttatcaaaatcttcaatagtttcaccaatatcgttttttgtagaccgatatttttgcaccctcttttgcaaccactctaaattagcttatttactcattgcacaaagtgatatggcctagccgtgtgtaacaacccaaaaattagccgtctgctaattttgcatcatgctgattcttatgttcttaataaccttctaaacctaggaaaatataattagcgggacctcctaaaaatgacttgtacgaaagcctctatggtatttaatctcttttgtgtttttcatttaaaaatatgttttggttaaattgaggtatttcttgatttcgttcaaaaccttcttttgactaaaattccttttagtcaattttgcttgaaaacccctttttattatttttatgaattgtggtccaagaaaccttcccaattttgcccttgaacctaaaccaaaataattccaatctcattagaattatttgttaatccatcctttgattttaaacctatcctttgattctcaatccaaatatccaaattcctcctttttgatctagccactaatttaatttctgtggtttgatttccttctcggcacaagaataaaattattacgaatattgtgaataattgctcttgtgctaagaaaatagattatatctttgtcatccaaatttactattagcctcaaacaattctctgaaacccatgccatatattttgaggctaaaaccctatttatccttctccaattatctttttcccaccttcctatttacatattaaattttattcatatatctctcaccctttcatttgagtgcaccaaataaattccattatatactacttctaaaatattgcactcaaataattaggaaatctctctttgaaattatctccaaaataaattcatctcaaaggttagccacttaaatttcttccaaatattaatttggattcaaactccatccgtcaattccctacacaaattagaaagcctttctattcatttgggccgaattctccctctcttccttcggcccagaccggcccaattcagccgagccgccttcctccaggtgcgcgtgccgtgcacggcgcacgccgccgccaaccgtcgtcgctaagaaatcggcgacgtgcttgtcttctccacgtcgccgcagccgtgtcttcgtcgaccttctcctccgaaccgcctctctccaccgccttcgatccctataaatagacggcaaacctttccttttctcccccacaaaccaagctctctctctcttctaccatggcagccaccaccggctattgccgatctccctcaccggagcattgccggacaaaccctcgcgccaccgggcttgccttgatgaggtgaacccatttttctagtttcccctctcccttagccgtcctataagccactatagccacttcttttaccggccggagcaagcttttgccgccgccgttccggcttcatatctcacttccactgccgacctctgccgtccccggatgcgcgtcgacggggaacatgttatgttgccgacgtcgccgcgtttcggccaccggagggccggcgccccgctcgtcctctcttctccctctctcgctgccaacggaagaggagaagaaagaagacgggaggaaggagaagaaaaagaaaaagaaacactgacaggtgggcccctgcacagttcactttcataattttcctatttaattcaaaacccaatctttagaagctcatatctcctaaaccgtagatccgaatctagtgaaacttggacctaaattcatctaaattcaaaccctatattttgataccaaatttgctattttataattttatttgaatttattcaaataccgtttgaatttataattgccttttcaaatatttccttttaatccaaaataccctttagccactaaaaagccgctggttgaaactttacgcctttcatggagacgtttgcggtcacctaggccccgacgtcgaaccattggctgtaaagcccggcaaaactcaaacccaaggtcgaagtgctgctcctagcaccctacgccttgatgcgtataatgatcggagcttcactatcccctcgacctccacagcacgccgcacagttagctctctggctctgtgtgatcctagccgctccgccgccactcacggttgtcggagtaacacttccaccccactaaacctacacaaatctcctattcctctagtcgttatcctttttgttgacaccggctagaaaagataccaaatctagctgttatactgcccgactctagcaatgactagcaaacaaccaaaccctagccgatgccttcctaattaaattccagtcatcatccaaattccatacccacccatcgagcatactctctgcctaccagaacctatacataaactatagagcctagttgatacgctatcctattccataatcaacttaactataaccaaaccctagatattatactacctaaacctaccaccagccaatactagccacatactcacttaaccagttatatcctttattctccaagcaaccaaaacccacacatgaaatatagcgacattagttgcttgatcccttctctaccttagcctccaaccctcgagaacctccacacaaaatattagcccaataatccctatacccaataaaaaggagatatttacacccccaaacccagcctttctcgctctttattgttttcttgctatttcatgatttttattgaatttggttcttcgtctttcttagtagagtctattttattttggatggcaacctgtattatttcgaggatcggataatcaggttgcctatcacggatttatttgcattggagcaaggcaagttattattcctctcctttgaacataaatgccctatattctatacctttattctatgcattagtcattcatgatttcgaatgcataaactgaatatagcaaaccagatatgctagcttttgcttagccatgccagttagactgcataaaatataatgaacttagattggaacagtacggtaaaaaatggttgatttccgggtggctagtactattccaaccgacataagactgcccaagtacttgtgaagaacgaacgagtacgaccgcagcttctagaatggggacagacctagatattatgttaattaacaatgtggtacctctgtacagtggttccttttgtaagtcctcgcgcaggaggcaaatttacgccgcgaagggcgattgtaatatttactgaggcgcaggtaaatatttgagataaattatgatgactagtctgtttgtgaaccctgattgcgatgacatggtgtcatacgatcagttctctctaaagaccccgggaacgccagaactcctctcgctgctgataacgttacgttcagagcgcatggggactagagttcatggaacaagtgccacaattgttaataacctaataataggccatgactaacctaatgaattggcaagtcgtggactgcgggtaaagcgtacatctactgcagtagaatattcatgaaactattcgaatagtcgtgctcacggaattgagtaccgggactcatatggtatttgattagaaacctaattcaagattttactaaatactgttgcattaaagtcattacaggctttcttcttctacatcctctgctttctgcaattaaatctagccctacttaaatgctactatttcatacattcatattgaatataatagcttgctgagtacgttgtactcacccttgcttcaaccccacctttttcagagtcattttggagttcttgccaaagctgggagttcaatcacataagttagtttcattctaacttaattctcaagtctagattagatagatggtttaggtctatagccaaacattagagttaagtcattctatagcttttgctgtattagttagccacaagtttttaaatacccatatattttgtaataatatatcctttggagtcttattcaaacgtatgcaatgaagatccagattgttgaacatgtaccaatttactaatccagggcttgatacagtttaaacatgtcggtttccgaatcattagtttcaggacctgacaccgtgctacactagctggctttacagagataggtacaaatttgccatcgaaaatactaataaaatcatagctagaaagatccatccccgataagcattgaatattcccatgacgccactctaatgtcgcattggccattgcaactttggccgacatatccgcttgaacaatttcaatatcatcaccgtcccatcgaattaaacattgatgcaaggtagaaggcacacaacaattggcatggatccaacaatgacccaaaataacattgtagttaccttgcacatcgacgatgaagaaagcggttggcaacgtcttgtttcacacggtaagctccatcaaaaagatacctttcgcctccgtaggttcaccattgaaaccattgagaatcatgttagtcttcttcaactcatcatctccatgtcccaacttcttgaacaatgagtacggcatcaaattcacggcggcacctccatccaccaacatcctagagaccggcttcccatcaatatgatctttgagataaagaggcttcatatgacgatttgattcatcgggcttctcaaaaaccgcatctttaggacctactaaaaattgagcaacttcggctttatccatagcacaaaactccatatgcaacatacacaccatgtcaacgtccatgtcgtcctttggagatgattcgtccttagtaaccggttgttcttccttccccatttgcacaacaaccaattcttctccccctatggatttacgcctccacacctttgtaggcggtggtcgcaactcattgaatcttctatctctttgctcttcggcctctctctctctctcttttaattcttgggcccaaagacattgcaaccttcttttttgagtagccgttaaatccttaggcatctaccttggtttcggctttgttccaggagagaaataatgccccctgttgattctacctgaagacgatgaagcccccgagctatcctttgtaaacctctcatcaaaccggcgctggagcccggtcagaccggacgtaggccgtcagtcagaccagccagagacgccaatcaaaccggcatgtggccggcggtcagaccggccgtagggctgtggtcaaaccggccgactgcgatgaactgatcccggcttcggatttgttacttgaagactcccaacctcatctccagaacgtattggcacattatgagaccctactttgatagtaatcacctccgaagtccttgtctccaccttaacatgctttcattccctctttccttcatcaacgaggtttttagcacaaaaccggccattatttggtgaagacaaatgctcatgagctggcctccttggtcctccctatccttgattgtattgcattggaggcatatgattgaacattagtggtgttgcccccatggcatgtaataaggaaagggataacccggcggtggcattggataagaccctcatgacatgtcttgagaacaatgatatgtaggtgatcccgactgtcttggtgaatgaccaaatcgctccctaggaggtgatcttggtctttttcctttattgcgagctttctcaccaccttgcttctcatgcttatccaaaagcatatcgaaggtcaccgccgctgtaggtgccgccgatgcagctcgttgcctgctgcctcccatcttgccaccgctgactgtgcctctgccaggacgccgcccaaccgccgagacgagagagagagagagacgagacgagaagcaagagagaggaggcgagaaaagacgagaggcaagagagagagatagagataaagactcggcgatattgactcatataggctgacgcgtcagcctggatcggctcggctcggcttggataggtgctggtttttttaaaaaaaaacgatacctatagtttattattggtgccggttctaaagaagaaccgacacctataatatcgttgtcggtttttctttagaaaactggtacctatattatattataggtgtcggttcttctttagaatcagcacctatagttgtttaaaggtgtcggttttatgtgttttcagtccacggaggagataaaagcattataggtgccggctttagctgatccggcacctatagtgccgatctctatgagcttttttgtagtagtgcattctcattggtgtgggttcgtcacttaatgtgcaattgaatgctctagtactaggactctagataatgaaggaagttcatgcgtaaggctagagtagtaactaataacttagacgtagtgtctaggttagaaattaccttcgtttgttgtgtgctccatggaaagtgaggtaggcagcaggtggtgacagctctatttgtccttcgtattcctccacattcgggtacatcatagagcttaaggcaggacacaacttggcagaccagggaagagtcggttcctgaagcattcgaatagaacaatatgtgttacccaaaagtttcgcaacgtgactaacagtactgaagtacagtacgcatctgaaagttttacattttggtcctttttgaaaacttattttataaatagacccctagaaaaacttaatccaggaatagtcctttttggtgcaccagagaggctggcgccgttaccgtgccacctcgggagaagggcaaacctggctgggctgacgtggcgaaggggggcgtcagccacactggcgtcgtcccacataccatggcgccagcatggttggtgcactctccctgggtgggccgcgcctttaacccgcgcggggcctacccctttctcctcccccactcattttcgcccagtgctagccccaagcccgagtgcagttcttctccctctctctctctctctctctgccccctcacctctccatctcaaatccactcaatttgaaggtgtttttcacgggatttttttggaaatcaacgagaaaggtatactcctccatcccccccctctttttttggttttaatcagttgaatttgtagatcgaagggtaatcccagaacccctttttaaccaaatttgtgattttcaatattttttcttgggatttgcttattatagtgatacatgtgtgcaatgtattcggtagtgccatgattttttgaattatatatgtggtaatgtgaatttttagatggtttggttggacagatggatgaaaaaataaacttgaggcaacgttgaattattaatttgatggaccagaggctttaggttaaatttgtaggtatgaattatatgaatgggagccgaattcggtagcattatagaaatttattattgttaattagaagttggttgggttgtatgacggagtatttgtaatattttgatgtttaatgcactagttaacttgttggtacttttggatgtggattaaatacttttcgtgaagtagtagctttgggacaatttaagttatgcattggttataatatgtcagtttggactacgtttaggaaggaagatgtgattttagttataaagtcacaattttttttggtgtagatggatagacttgttcgtgtttagtacagtggtagagtggtggaaccttacgttggtgcacatgttgagtttgagatatgtcattcaagaccattttgtttcccgcccgcccaactctagatgaactaaggtcacaagtgaaagaagctcttgaatggaccgaggataatgtggagattcgtttttatgggcgatacgatgttggtaaagggcataagtatatattgaatgtgctaggtcagttggaatgggaaatttactttgatttggtaaaagagtctcagtttggatccctataggtgctatttgatttccctcgcttcgttttgtaattgttttgttaattggtttttcaaatgtatgtacactctaggctggcaggctcttcggtgtcaatgcaagaagtaatttctacgaagttcaactatttctcatgtgttaacttgtttaatggacctgtggacttgtgaacttatggactatgtgatggacttgtggacttatttgtcaacttagttaacttgtggactacgtgatgtttgatgtggaacttgttttgttttgtatgtttactgtgaaatggtccaaatatttgcattgtatgtttactgtgaattgtcaacgcttgccacctaggcgccgtgttggaaggggcggcgccaaccagcaggcagagacagaaggaccaggaggtcgaggggttgggggggttagcgccagccaccctagcgcggcggttgagtgggtggcgccagatggcggcccgaggcattaggtcttggggggagggggtggcaccaccaccgtgcttgggggggtggcgccagtcggtagcccgatgcataaggttctagggagtgaagggtagcgccagccaccctggcaccgtggtttgggggggc

SEQ ID NO: 63374 - DNA, 19976 bp, Oryza sativa
gcacgcgcgggcgtggtctacgtggcccggaggaggcgaaggcgtggacgcgacggcggttgcgggcgaggcggttgcgggcgcggcgtcggctggaggagggagacgggcccgacaggtgggccccacctgtcggcgaccccgagagaggagggaggcgggacggcctggatgggcctcggcctgcggccggcccaacagggaggagggggaggaaaggagagaatgggccgacggcccattcgaaaaaaaaggaaaaagagagggaaaaaaaaagaaaaaggaaaaaggattttccctggaattaaaatattgcttgctcaattttaattggttaaaattatttttaaagctctgaaaattccactaaaaatcctgttagtgaatttcgacatgtagaactcaagaaaaattccacatgccaaatccgattattatttgcattactttcttagggtttactcttgctttgcacctgtattttcttggggtcatttataaattaaatttaggcttgggaggagaacttcggggtgtgacaggacactacacaagtcggcccataggtcccatatttcctttcggcccaataacgcccaaaagttactgttcttcttttccacacactttttttttgcgaggattcttctccatgcacttgcattcacgaagaaaaatttgcgtcgttctgctgctgctcggggaggaagaatgatgcctcaggaaaatagggatggggatatttgtgatgccgcgcagctatggcaaccacctcatgcgaggcccacatgtcggtctctcttctctcccttcttcttcctcccttctttctctcatccgtggcaccgtagagcttgaagcggtaggtacatggcagttacggatgactttctgactttccagagaatatgaagaacgatgtggtagcagaatgaggaggtcccatttttgccactttcggcggagaactgcatggttgagggctttctatgaggtgggaagcgaggaaatggggaaggagtaggcggcctatatgcaagggcaaggggcagatgacgggatgaggagcggcaccgcacgactaaggtcgcagtggctggcggaggaggtcgatcacgatagatgaaagagagcatgcgacgtgaatgaggatgagcgatgcgctacttgagctgagcaacgatctgtacattatgggtgggcattgtttgtggggtggggggggggcggatctggggcgcggggttggcatgagattagcaagagaggcgcgcaacaccgagtccggaccaaaattgttgtgcgctggcggaattgatttgatggcgggacgaggcggacgaaacctagatccgacgaacagaaaattacagattttttaagtaggttagatttgtaacaagtgcagagtttaaaagaggcgtcatagtggaacagtcgtactctgcggtttttcctttctcttcgggggcgcaggtcccggctagcgtccctctcgacagtataatgtcgatcgtgtaaaagttgtaataccctctttcttcttaataaaatttggcgactcatccttcggccgtcctggcaaaaataaaggaattaatgcaagtgctaccaggaagaggcatcgatgataaacagattgaaggctgcagcctacttctccctactccgacctcttcctccttcctgctgatttcttctctccaactatgttctttgatttcccgttctctacttctcttcctaatctacttgcttgttccccttaattgtattcaatacttgagcagtactctctggatcggttattggtgcttctccttctggtgttgattttttgaggatgaattgagaacataacactaggcagctgacgtgttagatccacgtgggtttcatgctgactcaatcgattcaacctcatcacattagttgaaaccgggcatagtagtgcactagtgcttagatcttcgtgcatcttttggtattgtaagttgatggacgcgttatatctggtaatacgttttaagaaactcaacgttcaaatggcggacctaaagtgaacttattcctgtgtaatactctgtagcaagaattgggcccgatttgattgtgcaagtagaagggaaggcccaaagatagttggctttgtgatatatgaagtgacgacgctaagattgggatggttgttgttgtgatgtgcatgggatggaatctgctagcgtggctgtggatgcgtgcgatatgatgcagcagggagggaaggagggagcgagcattggtggaggcagctgagccaagcgcagcccatccatattcctgctttttcccctatcgatgacacacatacatgtccatctaacaagtagacgtactagctagtagtaggaacgtgaggaacgtagccgtcgtcccagtcacacgaacacgcacacgcacactttcattcgtgtgtgtgtgtggctctgcttgcttctcgttagtattgtccatcggatcggtatatatatataagttgctgaggaagaagctagctagtaattaagaagaggcggagctggatcgatctatcgttgagttgttattgccacacaaacacaaacactgacgcccatggcctccgacggcaccgatgtcgtggcgctctacggcggcgccaatggcctctcgcacaagtccggtagcttctccgtcaaggtgggcctcgcccagatgctgcggggcggcgtcatcatggacgtggtcacccccgaacaggcgcgcatcgccgaggaggccggcgcctgcgctgtgatggcgctggagcgcgtccccgccgacatccgcgcccagggcggcgtcgcccgcatgtccgaccctggcctcatccgcgacatcaagcgctccgtcaccatcccggtcatggccaaggcccgcatcgggcacttggtggaggcccagatcctggaggccatcggcgtggactacgtggacgagagcgaggtgctcaccctcgccgacgacgcccaccacatcaacaagaacaacttccgcgtccccttcgtgtgcggctgtcgcgacctcggcgaggcgctccgccgcatccgggagggcgccgccatgatccgcaccaagggcgaggccggcacgggcaacgtcgtggaggccgtccgccacgtgcgctccgtgatgggcgacatccgcgcgctccgcagcatggacgacgacgaggtcttctcctacgccaagcgcatcgcggcgccctacgacctggtcatgcagaccaagcagctggggcgtctccccgtcgtgcagttcgcggcaggtggggtggccacccccgccgacgctgccctcatgatgcagctcggctgcgacggcgtcttcgtcggctccggcatcttcaagagcggcgaccccgcgctgcgcgcccgtgccatcgtgcaggctgtcacccactacagcgatcccaagattctggcggaggtcagcagtgggctcggcgaggccatggttggcatcaacctctccgaccccaagatacatgtcgagcgcttcgccgcccgctccgactagctagcaacgtagagtgccatccttcctttccgtcccctgccaccactgccaccaattccttcctcataattactgccatatctgtgatcgatggttgtcatatattgaaaataaacaacaaacatagtgtatatatagtactatatactccctcctttccacaatgtaaacggctgtaattaatatgcccctaacatcactaaaggaccatgcacatctatctatctatttatctattatattattaaaacagccttaaaagaagacaccacgtttactgtggggattagaaattcccacattaatcggataaaaggataaatatttacaccgttagatcgtagttgtactagattttagtggtatagattattcatgacaatattgagtctaaatagaaagcaactttgatctaataggaaatatgggagtcggacatgttgaatgaatagaagtcggacatgttgattgattaggagtcggacaggttgtctgagtatggatgctatggtcttatggacagtaatcagacaaattacattaatctatgtttagatggtaattagagtgcaaattgaactatagtgatctacgtttcatatgtggctggaaaatatacgtgccatacatacatggccattgatagtaaagagggagaacactgcatgcatgtcatgccgtatgcacatgccaagatagcagagacattgggcggagatagcccacaatcgatctagaagcaaaacaagtatgctacgaagaaatcaacatagatatacattattttataggacgagactaccgatcgggcgccccatccaagcatgaaaaaatcggacgctaacgtcagcataacgtcagagccatgcatgcgtgcaaaaccactttaaactattttttctcttaaattatttatccaaatcatgatccgattacatcattaaattcgttgcaattaaatattcaaaacaagaccacacatggatatattccggcgaaatttttttagcttattattaaatcgggcgttatttcaccttatataaaaataatactttagcaaatagcggaagaatgtttcagttcactgcaacattagatctatacatagtaaaacattgtgagtacacttggtggaacattttttgtggaacataaaaacgaattcccttaatagagaattttcaaaatatgtgggtgatttgttgcaaaagaagtttcgtttactgcaacattagatctatacgtagtgaaacattgtgagtacactaggtgaaacatttttagtggaacaaaaaaataaaacgactttccttaatagagggtttttaaaatatgtaggtgatttattgtaaaataatattttaattcactgcaacattagatctgtgaaatattatgagtacattaagtgaaatattttttgagacacgtggtggggccaggggaacgtgcgcacggggagggggggagcgctcgatcctgctccacccccgtcggtcgccctggcctaagcatatttgtattttataagacatggcaaataaaatttaaggtacaatatcttcgccagtatgatctatgcatgtacaagaccatctaaaacatttgacgagataaattaagtagcaggcctacaaaggagtagagtggtggcagttaatacgacatataaaaactgttaataaaacaccaaatcgaatcctaatgacgattaaaaggagggacgacaggcaggccgtgaagcaaataggcaaagcggttgccgggacttatagaaagtaaaaaaataaaccccattgataaccatattcgttttttaaattttcaatgataataaaaagtagaagcagcggacagggtgtatatgagtatagttacagagctgccaacggttggtgggacttctagaaaataaaaagtaaattctaacgatagttttgttcgatttttagaatcccaatgacaataaatagtaggtggcaaataggccttagaggagtatagtggcatcgtttgatgggacttctaaaaactataaaaaatgaaacccaataagacaataagctctaaaaactaccaatttttaaggttcgtaacttctaaaaagtaaaaaaaacaatgataatcatggtcgattttaaaatctcaatgacaataaagaagggaggcagcggacgagccatagaggagtacaatagcaaagcccctgacggtttggtaggacttctagaaagtaaaaaaatgaacccgaacggtaattatgttcaatttttaaaattccaatgacattaaagagaaaagacagtggacgggccgtagaagagcataatgacaacgtttgacgggacttctagaaattataaaaacgaaactataagatccaatttttaaaggtttcaaggagaatgaatagaaatagtggtagatcgagcaagcaaataaagaagtatatgacagaagtaagaggtagcagctggtctgacttttaagaactatatagttggaaatacggagatgataagatttggtcttttaaagtcttatgataacaagatagctatttaataaattttaatatatagttggaaatacggagatgataagatttggtcttttaaagtcttacgacaacaagatagctatttaataaattttaagcaaaattataccgaaaaatttataattgtgtttaggtgctaagcgcgcaattgcgtggtccacccagctagttatagaaatgctatactgtttatcccgcccgaccacacgcccacgggttgccattttcatcaatgtgcctcaaaggtgatggtttttaatgggaaccagcaccaataataaaagtgccgaatattttaacaaaccaacacctgtgcatgagataaaagtgttggttttataaaaaactgacacctcatcggagctgagccgagccgtgctgagcgcttggaccgccaggttttttaagtccggcactcccttgtttccttcacactatcattcttctctcgtctctctcccgccggcatatctaaggctggcagtggtgcggctgcggcgtgcccgccccgtggccgctatgcccgcaacaagttagtggtgccgagcagcccacatgcaagcccgcaaacttctggcggccttgcccacctgttcactggttctactttgtccagattaaaagaacatgcatgatcagataatcagcttactatttgtgtgctagtgtttgtaagtagtagtaaaccacagtggcatcaattacaagaaatgtttgagaagaattcagactaagcactcaatcccaaacaacgatatttcctccaagattttgaagatggcaaatagaatgacagaagtcacagaaccgttgcattgctcactgaatttacaatattgatatgagtggaataataggacattatgaatatcctaatgaagatcaaactaacgattgtatcaataacacaagactgtgctctacttcaatgcctgatggtgttgaagcttgcaaatcttcagattctggatattgacaaatcatgattatatatgagtttttcatcaggaagcactacttcgtgaatatttgaaagaacaaaggatgcatgttgcttgcactagttcagtcgaaaatatggccagcaaaaaaaacaagatcccaggatattagcaagcaacctactaaccataaagaatcagaagaatctgcaggcaccaaagagagaaaacaacctgcaatttctacataattgagttctgcataggaagtttagaatggtataatcaaaacttggtaaaaaaatgtgggcaattcatggcaaagaatataattttcttacgctggcaaagaatataaaataaatcaacattcagacaatttggaggctgcattcagcacataacctcaatgttcagactttctccaggaacttctcaggaacccctgcatatactgacagaattgcataacatcgaattccatgaaaatataatccacttaacgcaaagaaagaaatacaccaccatctgtctgtcagtaaaggtgtgaatacatcaccatctgtctgtcagtaaaggtgtgctcccgtctaagcaaaatgtaagcacacagtcatatgcacatctccaaactgtcttctgtcataaaaaggaatttgacagccaagcgactgcattatataattgacatagcttaaaatctagggggctctaaaactcatgaacaaaacagataattattttagtgctgaaacttagttatccaaggctaatcttgtgtgttcaaagtgagcgccgaaagtagttacacagtcaaaaaaaaaaagaagaagcagttacatgtaaattatttttttaacttgttttcatgtgtgaaaaaaaagcagtgtgtaagtaacgagtttatacataataatgctgaacaggaatcgaacagcaaatagaacagtctattcatataactcaaaacaaagtcagaaagatataagattaatgtacaagattcaatgatgtttctcaaacaggcatatcacatatttacatcccaggtgaccatcaagcatgttatgtaaaggcaagccatcaaaactgcacattgttatgcacgaaagcaactaatcacaaacaagcaggagctaaataatcttctttttttagtgaagtgatgcgtacatccttacaaaattaaatatggtttgaatctgaaaattacatccttgctttctggattcatcctactcagattcactgcatctgcatctccctttcactgcatccacatcagggaaaaaaaattcaagaactcacatgcatagaggtcgacaggattgaagcagaagctggtctagcaccacccacagaaattgacaaaacaggtggagtgggtgcgatgagctacgatgagtgcgccgccatgagcccatgaccggcgatgaccacgaaggtcccttggaggacgcattggaagcggcggtgctggaggaagtctgcaagatcactaggaatggcggcggaggtggagatggcagcaaaggcggcggaggaggaggcggtggaggcgtcatcaaatccatggcggcagcggctagggttcaagccgcaacagcgacgaacttgttcgttcccctcctctttctgatgctccctcgatgtgggttgtggtggcgccgccggacgtggtgggcttgccgcatcagcccacttactcctaagtggttaggcctaagtgggtaagtggtgcgggcctgcccagcagctgcatcagcccacgcacgccactgccagccttaggcatatctccccagcgcagcagcgggtcagcagctcctcgagaccttgacatggcggcggcggccaacggcacagcggggccgtgtctcaccggcgcagcagcggtcactggcacgatgggggactgggggctgtgcctccccagcgtgacggcggagacggccgtgtcttcctcctccgtcctactcgcccctccctctcctctcatgtcctatgaaaatgcgtggaattcatattttttttaaaaaaaagttatatcccaataggtcctaccaatatcatactatttataggattttttattatttatctattgaaatttaaattaggatgaaacttatcgaatttctagacagcaacaacatttgagcaacgtccgaacattggtttttttttttttggaatctaaccgtatttcatgaaccctagtcctgtcccgtgaggcggacaagaaggcgtgggggcctgatctggcccctgagcttgggacctccatagcggcgaggaggaggtctggtgaggagtagcggcggcctcctgctcgcccctccctctcctcttaaattagagaaaaatcttaaaaatttcgggaaaaaaattcctaccattggttttgacttaaattggacacgttattttcaatctattttttcttaaaaagaacacccaagtcctccttccctccctccttctcctcccctttgtggtatatgatgcatctgacacattattttaggtcgttagattagttatttagaaaaaaaacatcccaaacctccctccctccctgccccgtgtgcaacgtgtgtcattcttttctctctatgttttatctccttgataattaaaattaaaattatctatatgggaaaataacagaaacatacctccatctattacttatatcacattaggcatttaacgactttctaccaacctaattaatttctcttaacatgcatattggcgctatgtacctatacaaattgttcttgatacttttaaaatgatctttttaggagataaataaatgttcttgagaaagatgatcatagcatccaaattacacatatgatccatgaagtcactaataaattagagaaaaaatgtaagtgatatatcattttcttaataataacatgtactcatgtagcattatagacaacatattgaaaataaaggtgtggtctgttaaacatcataccgataagcatatgggttgcacctagaaatcttaacaatgaaacaaccttagtaatatatcaagtcgattccatataggaattaaagaccatatcctttctttttaaaacttgctaacgtacattgtaaattctttgatgtggaacaatctagaaatgtatatttgttataagacaatccagtttagtgataattagctaaaaacacaatgaccattacttcaatatttcatgagagaaaagttagaacgtattgcaaatatcaaagcatttcatggatgattcatagaatagaaatcttcaaaaagaattaaaaaatggacttgaaataaattgaaaattgaacaaatgttgatgtatttaaaacccattcaaaatagaaaaaatcaaacaatttacaaggacttttagaatgaatatatatatatatatatatatatatatatataaataatagaatagaataaaattttaatattattggatttgttttggggttgtaaaatatccttatggggagtcaaaatactctaaattttttcagaggaatttcatttcgatacaatattttgttttagaatttatatattgcaaaggtaattatcagaaaataaactagctttcaaaggacacaaaataagtttaattttagtttagaatatagtaaaaaaatattttaatgaaaattcacctgtacataaatatttataataaaaattcacacacattatataaggtgtgcatattatctttgtgctttatacatcggctctggcttacaacattgatggagtctttgtgctttatacatcggctctgtcttacaacattggtggatcacttgttttgaattggcactgtggccgagatcaagaacttatcttgccttaagagcagtacaatagcagactataagacagctataaacatatttcgagaatataaaacaggagagagaagagtagcgggctacaaatttatagccagctgcggcacagacttcaagatgcaaatgtaaatgacaggtgggaccaactatgacttgtgtagtatatatttataggtaactattatataaatcagcattaaattgactatagataatttggagcccgtaattggctatactattaaacttgctctaaccctccaccagttcactgatcccttggaaagtcactgaacgtcgtaccttctttcatcttctcaagaagacacaaggtaatgatcaatgacgtttttagtgacgtagtgtgcacaaaggtcaatgagatgagaccacaaagaaattatcaaccagtgcataagagcagttaaagattttcaagacgtactcagtccacatctccatgttgaccgtggaagattatcagaaaagctctcatgcgagcacacatttccttttcgtttaacccggacatcatcttaggaaaatacaatttaatttatctgcgacgttttaggcaatggccagtctagacaaaaacgaacattgccataataaaactcataattaaagtactcttaggatcctaccagaccagacctcaggtatgatctccaaatatgactttcattatgttgggcgtggtttctattgtttttcttttcatatatccctgatttgggaaagattgttgtgcatgcacttgtcagatatgttttcattcagtaacatacagtaatcaacatttatagaaaaaattagtatcatctacaacaccaaaatgtcttgttaatctaacattgaatatatttgttttgtgttaaaaatgtaactatgttttctataaatttgattgaactttaactgataaaaaaatcaaagcatcttacataagtaaagaaacggagggggtagtttgtcaaccccatgacaactgctacttagaccaaacgggcaactagcaagatactccgactgccctgaacatagctcctaactcactctatatgtacagtgacatttgctcgatacatgaaacttgaaatatttactctattattatttcgttacatcatgcatgtgctactaacaaacagactgactatgaaataaacaatgtgtacatacaaaatccagatccttggggaaaatcagaaaggagttgatctctgagagagccagtcatggatggcaaaacgaagggcgtggttgggggtgattggagggccattgtccatcaactcggaaatggcgcgcccttcgtacgtcaacccgtccgcccccacctggggatcatgcatcacttcctgcacaaattagaatgaaaaaaaaaacacattactaccgcattattattagtagatattttgggttacttatgggcttctgccctatcgatgttcttaggtttcgttcttgccttgaggatcgggcacaggaagaaggagggcacttgtctattatccctcatcaggtggagctgttccagatctcgcacagtttctggagtcagcagctctggacttgctgcctcactgcacttgagccccaactctgctaaccttcgagccacctccagaggccactctccagctgttggatctaacaatgaccatagctttccactggacattgcacgccttacttcgctgggaaggcctgcagcctgcttcccagttagtaactggagtatcacaatcccaaaggagtatatgtcagatttgggtgtcaatggtttgcttctccggtattccgggtctgcgtccttggcatcttccatgaataattgagaaataccacaatcagctatcttgcagtgcaggttggcatctaaaaggatgttttcaagcttcaagtcaccgtggacaatcatctgaggtttacaggaatgcaagaagaatagagcacttgagatttcagcaacaatacgtgcacggattttccatggcaactgaggaatgccgcacttgctccaaaggcggtcgtgaaggctcccgtttggcacgtattcatagacaagacacaatgcatccgggcatgccccaatcaaagtcaccaggtgagggtgcctcaccttgctaatgaggtggacctgccaaaaacaatgtgaaataactaccttctgctaaataactgctattgctatatgctcctaggtttttataaacacttagcacgataagttatgtgataaacaagacaagcaagcatatacttggaatgattggcccacatcatctcctgcttggtcatagtgcaaagagataatttttggtttttattatgacaaatgacacaacaagtaatctatctagataaatagaagaaaaaaaacaaatcctacataattcaacaagccccatagagtttcaagtgatatgtggagctgcaaaataacttttagcagtttcattgagctatgtatcactaatatatcaaccagcatgataaacagggtaacagagagtacctcttgctggaactgcatcgaactctgaatgatacacgagtgcaacttataaatcattacacttctgttcataatctctcctttataaacacatccaagacctcgtggcagtacttttaagctgtctgagaacttgcatgttgcagctttaatatctgacaaagtcaattctctaaagttgtacaagtcatcagcacaaacagttgaactgcaatttggtaacataatgtggttatatgcacacctttcaacctggtcagtatgtacaagttctagcttctctcttttgggaatttcctgattgagtgttcctatggaagattgaatcaatttcagctctgccacagcttcattcatccgaaaagctatgcttttagcacgtgcatctaggatggctagttttctcatcgaagagtccaacccttctgtagccttttctttattttctgcaagatcttcatgctgcttttttgtggctgtcaacaaagcttcaagttcctcccgcattttcatttcttgtttttgagcgaactcagaagcttttgcctgctcaagaagcacaagccagatcaacaaaggaatgcatatgtaattttcaccacattattcaaaatcaatgttaaagaatctaaaacttccgtttggtttcccaataatgttatactgcagaggaaccgtgcagtttaaaatacaagataggataagtggtttgcataccctggcaataacaccggctactcttgactctgtatctttgcgcttgagaagctcaacaaaagcatccttccttgatctctctgcttctagaatgacctgcttgaaatttttatccaagatttcctgacagataataccatcagtatttaaattgaaaaaaaggatcatcctttaattacaaaattatcaatgaacatgtcaatgtagcaggagagcacctgaggatataacactaatgattccatgtctacagaagaaccaggctggaatgttgagttaaatgcagactgtgcattttgcaaatttggtacaataatattgcagaaatggttggcatcaacaagagattcataatcattcggttgaccattatctgaaatggtgatttcataacgatcagcaggtgtttgtgcctcgtatgaaatgtatccttcatcaagtatggattcagcattgttactagtagagctgaacctgattcttttcctgatcataacatcatcttcattgtaaactgagatattgttgccaatggctgcagctgcttctctggtccaaatgtgtcttcctctccaaacaaaccagatttcacaaaatgatggggcattccttgccataaaagatgctttgccatagctcgctttcaacttgaagcaactgcattacaggtagagagagttcaaattttcagggacacccaccccgaaataaaacaaaagaaagggaatatagtggtcactatgggatgtcaatatcctagtacatatcataggatcccacaaacactacggaaccatctgcatacatatcattacagttagatgatctatttcttgggatcattataaccatacattccgaacaaaattgtaagattacgttagatgatactcatatcaacaagttgatgtgacatgtaattgacaatgggtttaattgtattcaagtttgctcactttttactgaaattatgtggattcatgaggcatggttaaacaaataatgatggatctaggtgagtgagcacgggaatacttgacataaggtggttgaggacagggttttcaattttgatttcatccgaaatttcgctcattttggttctaccgaaattcctgaaaatcaggatttttggcactttttggaccgatttttttttaaattttagcataatttaactgaatttgattaaattttgaccaaattcacagaaatttgagaaaaacaaaaaaaaaacggccgatataatcacttgccgcgtgggggggggtccggaattaccaaaatttcgatccgaaattgcaatcctaggtgaggagcatgtggtgcattgtccagttgatgttggttgcaagattttggtgctacatcaagttggggcagacaatgttaacatcaagttgggagatcaaagtttcaaaaccatcgaggtgctgttggaagatgccagtgctggaaattgttactaagaatggttacgagcaatgaagggtgtagaatacacacaaaaaatatctagtctatcgagcacctgagatcaagtttttttgtttcttgttttccttcatgctccataagttgataaagagagtattagattaatttgagttattagtattatttccaatttctgttatgttcttgggctgaacttttctagcttgaagtagatacttggggactagactacctagttttccaatactgatagctgctttgttcagtattgaaattttgatgaagaatacacatgacaaccacaagaacagcaagttagaacgggtattagtaacaacgtaattggacccagaggcggattcacctcccgggcagcaggggcggatgcccaggcttcacagcgatgaacccatattatctagcgctaatccttggctgaaacagattaattcctgggaaagatttgcatgttattaattaaatacggcaagccatgctgcaggaggcgattgggccttgggcctcagctgcctatggcctgcctgcccccacaagtactagactcactgtcgttatcaaatcacacggacatttacttgtattgaacatgtccatgtagacacaatataggtgtattagtgggtacgtttctctgaatatgaatagtatttgttattttcttccatgttccattgatattgataaaagcttttacctagtaaatttatatttcagcgtattagtgaatcatcgaattaagcttggacgttctcgtcgtagtatcctttcatccataaacatatttacaagtattttgggtcacatttctataaaaaaaaatggtagaaaattttaatggtgatatatggaaaatgaacatgttttgagtgtaatagtttcagttagacccgccttggcttcacaaaactcttggcgccgccactgattggaccatcagctaggggccaaagatgaaacttcaaatcatggtagtaggacctgctgttagccatatgcccgtgaccattaataaagaatgcataacatgacagcatgtggggactgaaaacggctggtttgaagcaggtttgtaagaacaggatacacgaattttagcagcgatatatttgaactaacagtagaattccttgtgtagaacagagagtttgaattgttttatagagatggcactatcaagaagggtgttttgttagcacgcaattgatgaaaattgaagtagtacatacgtatcaggtgtagaacccatgacaagctttgtaatcccatgatctttgaccaaagtgataataccatcatggatttgttcattctccgtgacaagaagacttgcctgaacctgtggcagagcaaaagcccgattaattagcgtcgcacacccataaaaattgaatctgtgatgtttctcctagataaaaaaaaggttggagaagaaggtgagtagcacttacctgtgccctgtgacagaaagtgaggtaggtgaggaggatcttgttcatttcgtccttctcggatttgcgatgcgacagcacgagctcttcggtggcttgagcggcaggaatcttgcctactgaagaagaagaagaagaagaagaagaagaagaagaagaagatgtgatgggtgagccgtgagcggcggagaaggaagaatcgagaaattaactcataaataaataaatactccaagaaagaaagaaagaaagaaggaattgaaacactagaatcgtacagagggtagggatgagcggagaaggttggtggacgtgcacgaggacgacttgggcgcaggcgaagcggcggaaggcccatcgcagcaggcccaacgtcttctccggcgacctcccgacggcgacatggacccgcgcgtcgacgttgtcgcggcgggggaaatgccagccggcacctctgtggatgaaggaatccatggcggagccggaggcggaggcggaggcggaggcggggccggggctgggcggcggcgacgggctaagtatctccatggatggatggatcgattggctgggcaatttgggtcaattttctcggtggggattgcaattgctaatgggagctttcctcctcaattaattgcagcatgtcaaagacttgcgcgccggcaaggcacgcaaatggcataaacacatggatattccacagcatccacagtgcttgccgttgactagttcatggtcaactcctgctctttcctctccactctgacacgactctcagattcagatgagtcatttcttcctctattttccctttttaatcccgatcgatcttttttttctttatgcgacgctatgcaaagttgcaaacccaaccccaacccaaccaatctactggtggagtaaagttctccctaaatttaacatctacacacgaaatagaaaactatgatcgattttaaaaaagatctgaattgccaacacgagaccgatctgaccgtcgccatagggctggtctaatcagcagcatgtggctggtcaaaccgactgactccaactctaaatctaattttaaccagtctcaggttttcttatttgggttaagtttttcgaattctaattgatttctatccgagtaatccatgaaagggttttatagaagacaagatcaacctctttataagattcatgactggttcaattgaggcaacaatagacttcaacacaattaaccaattgaatcgctcttttgatttcgcatctactttttgtctagtttttagctagtttgttcatcttcatcagtttgtgctataagccgtgcgtactcgttgcgagaacgcgaatgttcatcaaactagctcagtgccacttgtattttgtaaaatttagactggccattatatacggctaggatgttcttggactagtatctttttgcatactatatagcttaaagaggcatagttctgccaaaagtaaaccttatcttcctcttcccccgccccctacccaaatgcccctagcccttatcttcatctgtccatctacttgcaacacaatcactttcatcagaggcaatcttgcaagtgaagaaggaaaaggaaactttgctaatctttggcacgatggagtagagcctggagaggcatagctccgccaccaggttcttggacaacatctcctccaccctcttctgcttccatggcgtcatcattgtccaacgctgaacctaaaacctaaacccactgtcgctgccctccaccagcctagttccactttgcacactccaagcccgtcctccacttccgacgagaaaaggtcccccatgacaacctgttcagatgcacacaacccaatgttggtatcttcaaggcggtgagacccctccccctctagccacctagtcctccacgatgccatgtttcctcaggcatatggaaaaggagagaccacgagagaggtaacgagagaaagaaagaggtaggggatgatgtgtggggcccaaatgtcagtgaggtgggagagaagagatgtagaatgggtattttgggcaatttgaaatacaatagcttgcatttggatacaatggtgtccagggtgtagaaaatgatatatgtatgtaagagagaattgtaatggtatgatccaaataagtgaatagtaatgttccaaataggtgaatagtaatggtagatctttaaattgtggaattcgtagtggcaccgattaaattaaccatagataatacttgggagaagtttagtggcaaggaataatctccttagagaagatgccaaattagaatccttccttagagaagcatgtaaaattggaatccggatccagaggttacccatcaactcatcaccgatcatacagaacttgatcgaattaatgtttgatggcgacaattcaatctccttggtggtggaaagagaaaagtacatatacttaaaattattcacttctcaactatcaggtttgtctaaaatttacccctcaactataaattcgggataggaaacactcctcaactattataattatccactttatcctccctaatatccaagctgggagagttttcacttatgtgcacctacatgacaatctagtcggtgaaaagattaataaaatagtggccctgtatgtcgtcatcctcccgctctcccttgccctactctctctcattacttaccctctgttgtcactgcgagctcaacctcctaggggatatatacctctgcagcctcgaccaagatctccacctctatgagatcttcgcgtccgctagtgtcctcctctaccacaatctccaagattcattgtggtggtggctccagtcaagcttaggagaaaat

SEQ ID NO: 63375 - DNA, 23296 bp, Oryza sativa
taactttagagcgtggaagctgctggtaggtttcatcaaagttatagtagaataattttcatcttgtttccaacaaatgccatgttcctgaacgttcctttcacttcaacgatcgaagtagtaatataagcaatcaaattgggatcaatcaagagcaaagtcttctttactttcactcaaaacgaaacaagaatatagcaaagataagaaaggaaagaatggaacggaggaaggatggcaactttatctctattatatactactaggtactaaacgagtatcatatagatgtaggcacagcagaacacaatgtcatggttacttggttagtgctaatcacgtctgaacatgtttgctgctgctttaagggacatattcttaggcttgtcctgaaactcgggacaagttcctttcatcaacaagtttttgttaagctcccctcgtgtatcagacgctgtcccctctgaatccatattagtgtccaaaaagggttcagatcttctattgctaaaaatacatctgttttttttttgtttgttaaggaatagttgcactgtccttgttgctcgctgcatgttcttcaaatatttccctgtctaaattactccaaatggttgaacaaaaactagataagtttgcaaaagatcaacacaactcatctcaagacagccttttgctaatcttgatccatcaagtagtccagcctccagaattggaacacataaaagcggcgccggagttcatctgaaacaagttacctagccctgtctcgcagccatctttttcattcttttttgttcttcttttcttgaatgaaactgagttgaaccctttggagcctacaaacactgacccacaagctagtattgcaagtgctccaacgatcaaacactgaaaaaacaaaagagagttgaggagcttgctttgcacaagcaaaacccgctttcccactcgctaatctcgtgatgtgtcccccacttctcatcagacaatgtactactagaatacaaaattagtacgcattgcagcggcaacaaaaagttcatgatagtacgagcacttgcagatcgattagttaatctatcagtttacctgctcatcgccgacgtgatcttgcagatcgtggcttagcacgtacgcggatttagacaacgtgctgcatgcataatctgaaaagaaaataaaggaggaaccctattcactatcctaaccctgaaggacatgcactttcgtgtctaatctttgtcatcttgtcagtggaacaagagctggcagtaccctttgattaatcacgttgattagctctgaccccatcttaattacttaactagcatagcgacccgcacagattgtgcggctagcatcattatattttcttttatataatagcatatatgttttctcattatattattaaaatatattacaatgacaacataattttaaattttacaataactttacgaaactactaatgtgtaatattcatattgtattttatatatgtgttagttattaattatttttaatatcaaattttagttatttgtaaattatatatattcctatatggactctagactcgtcttttaatatttctttttttaattctgatttttttattatttctaattgtatttatatgtggactctaaagtcatctttcaatattctttaatttttaatttcaaatttcagttacttctaaattgtattcctatattgactttaaactcttcttcccatgtttttcttaatttcgaattttagttatttgtaaattgtatttttatacggactctaaactctacttttaattttattatgtttattctaaattttaattagttttaaattcctatatggactctatactctacttctaatattcctttttttaattccgaatttctttttttcttaattgtatttctatatggactctatactctatttctaatattccttttttttaattccgaatttctattatttcctaattgtatttctatatgcactctatactctacttctaatattccttatttttaattttgaatttcagtcatttcctaattgtatttctatatggactctagtctcctcttctaatattccttatttgttaatttcgaatttcaactatttctaaattgtatttgtagatagactctagtctcctcttctaatattccttatattttaattccgaattttagctatttctaaattgtatttctatatggactctagtctctttctaaattgtatttctatatggactctattttttctttttcttcgattaatgtgagaatttctaggccatgagagcgaacgtgaaggctcctttttctattcctttaataatataatagattaggagtcgtgaacattgtgctaataccaattgagtacatgcttgtgttaattgcttcacggttggttgagcctggatttttatttttcggtgatgagcacttagtagcagctattagttgtagatatagcaattaccaaaagtagatgggttttcgttcctacaaagaatgttcgctcactcaaataatcataattattttaagatagatcaatatgatttatattgttttataaatatataagtttaaatgacttatgcactttttttaaaaaaagaaacaaaaattgaatgcccgtgttatagtttaatttgttcttttgttataatgtgcagaagtcaaatttgaatttgtatatttgtagaagtaataaatcacatattaatttatcttatcaatttttaaaagatattaataattatttgggtgacataatataaacaagggaatgtctcgaaaaaaacaataatttccctatagaaaaacatgtcttaccatactgcatgtctgcatactgaacactattttatcattttttcgtcgggtcgacaaagaacgccgaccgtaatatattaagaaaatagagaatgtacagggatggcgaggcttcacagccaccgcctatttacaagatgctacaccacaaacactattttatctgagattctcatccccaacctcgaaaatgcaagcgtatctgcatatatggacacatatggattgaacagtacagtggtctgcatatatgagtcaactcgaatacacgtatggtaatccatagaataattcccatttaaaaacccacgaattcagagaatagtttgacctttgctagcaagcaaacagatttgcatatgcatgaacaggaacatgtctattaatctggctacctagctttggcatttggcaatggaaaagaaaaacaataatgtcagggacaatctggcaatggatggacgagaccacggcacttgatcgattgtatccaataccagggactgatcatccaggtcagtgtgtgtgtgattaagcagctgcaattctaaatgacagcactttgcttggacttgatagagatccctgtgacagatcagaggagaccagagtctgcgagtttgacaaaattgggcaccctagctgaaaaacaattcaatccaaatgctcaaatttcaacgcgcggtgtggaacctgaccataccctgctgtactgtatttgtatttgtgattgtttttggttttagaatgatcaagttggtaatttagttagcagaaattgggttgcaaaagattctgatattagctcaagcagttgactgattgctcataattgagtgacaaaatgtgtactagttgtatattgtattatagtaccagttattttcagtagcatgttgacaaacttggctagatggtgtgggtgtgttcatttcaagtttcaactctgaacagcacataaatctgataaatctaagctaaaatgacagccacaattaatccggccttgtcaccatcaaaaagcctaattaaattaaggctaagaaagaaatctatgtcctgatcatgcaaaaagaaaagaactaaattatattgtgctatgattcagaaaagtctgaatttttttcactgaagtagtacaaatcaatatcgatgtgaaactaatgaaagtacagtgaagttggcatatgtgagacaggcaaactggatacagagacagacaaaacagagagagagagagagagagagatttgggaaggaagtaaggagataagtcagaggaggcgtcaaagttgacgtgtgtgggtggattagcatcgttaatgtggtgttgtaattccaaaagataaactaatcacgcatggcatccatggccagctccgtcgctttaggcttttggaatcgatcagagcacagcagctatctcatcgattaagctaattaagctgcttgattgttagtaattttcttccaagtccacacatgccattatcatcctctcctctcctctatatataaggccaaagcccgacccgagctctcccgccattttcctcaaacgatatagctagctctactacacacttgctctgcccgatgatgatggcgcgagaggtgagcagcgaggaggaggctggcggcggcgacgagctccggcgagggccgtggacggtggaggaggacctgctcctcgtcaactacatcgccgcccatggcgagggccgctggaacgcgctcgcgcgctgcgccggtaagcagagcaattcttccttcttctccgatggatcgatggatggatagatgaattgagttggatggtgcatgcagggctgaagcggacggggaagagctgccggctgcggtggctgaactacctgaggccggacgtgaggagggggaacatgacggcggaggagcagctgctgatactggagctccatgggcggtgggggaatcggtggagcaagatcgcgcagcatctccccggccgcaccgacaacgagatcaagaactactggcgcacccgcgtccagaagcacgccaagcacctcaactgcgacgtcaactcccagcagttcaaggacctcatgcgctacctctggatgccccgcctcctcgaacgcatccaccgctcctcccaatcccaatcccacgacgccgacgacgccgacctctccgtctccgccgccaccagctgcatcacctccgacctcgtcgtcgacgcgcatcacccgccgctcgccatggccgacagcaacgactctgcagccatgtggcagcaacatcaagcaccacagatgagcgtcgccggcgcgccgccgccgacgacgacgatggcccaacatgtagtactgccgaccgcggcggcgtcgtgccaccagatgcaggatcagttcgtctgcgcgcgcgcggcggagacgacgacgtgctgctggtccgagtcggagtcgctgccgggtctcgcggggctgtactacgacgacgcggcggcggcgctgccggagtttgacgtggagaccatggccatgtggggccctgaggacgacccatggtacacgcaaatgcttggcttgtgaaaaccgttgaccaaatatgatgccttcctacctacacctacacatttgtgtggattaaagaagaaggagatgcttattatttggaggttaatttgatttgatttaacccccaataatctcgtctccagttcttaccacatatatcgtcaattctcaagtacagtacattagctacactttagtacagtagtagtattttggaacatgcatggagtaattacttaagctacacttggtagttttcctcctccatgatcatcaagtaaaagcatgcatgcatgatcatggatggagataaactacagtgctaattaaattagtctggatgtacggttaatcgatcgcttggtttttactatactgcctgaattactccattcttaatttctcgggacggatgaaacggattggtttaatttgtttgtaataatgtatatcaagctagctagctagcttaatttggtgatgatctggataccacaataagacttttggaactccttgtgatatgatggtgaggtgtgggactgattaagaaatctgtatctatgcatatgtgtataagcaaactcatggatcggtcactttcttgtctgatcaagatccagataattctatctcggctttcgttattacgtgtttttcaaactgataaatatatggttggtttggtttgtgacctaaataggccttaccaaattttgttggtgtcaaattttagcaagttttggcatgactaattttggtaaggcaaagttgtgtttggattgaagccaaaatagtctaagttcactattaaaatggcctattttcttaggcatgtcaaaatttggcttcaaaccaaatagacactaaacactattgaaattgacaaatattggtaagcctaatttaggcctcaaaccaaccagcccatagtgtcttttgtataaaagttttctatgtaaaaattactctaaaatattagacaaattaaaattttgaacttgtaataattacaacttaattaattaagtaataattgttttcaccatgtcttaactttatttttatctttagcagaaaagaaacacctcatcaatcaccaacaattccttcattactgtacaaacgaccagccaatataatattagtccattaatcagtagtgatatttgcaaacttgtttgtcctggtgacggtgccgattgtgacacatatctctcagagttgttaatttgcaattataaaatacaactgacttctaagtattcgaacattatattagttttgtttttcgttttaaacaaagactgcattaattaagcacgcgtacgtttgtgatgctacacttttctcagaggctaattgcatcaacctcatctagctagctttagcacttggtaacaagcagtgtcaagtgatgtaattgcagatgagagatcagcagggagcagcactaagaaccaacaggaaagggcacgttatgattagcaacagggaagaaatgttagctagtggggttaactgtgcaagctagctagcatgggtcgcttttagctagctagttagcatgggaaaagggacaaaaaaaggatgcattattacctgcatatattgctgcttcttacaaaattaatgcttttggttaatttctctgtcagctagcttagctggggaatcagaacattttaatgaggatgatatttccgaatcagaattaaaaatgagattaatttgtacgttatgggagtaatattccagctgaaagctaattaagcaagtaatactactagttgctagtgctggacgaaccgatcgatccatgagattcaggcgtcacctgaggaaagagagagagatatatatatgaaaaagtagttgctagcttgccgccacacatggatcatcgaattaattcgtgcgattagaatcattccgttcattccctcgcggtttgcgtggctagatagctgggcccaaattaatcgatcgacaatatgatcagctagctagtttgctccggccaataacagtaagtaatgattatatcggcggtcggcggcggcgccaattcaagcaagcttgttccttttcagatcatcgacgcagcatggtccaattatattagatgctgttaatttacagcagctgcgacactgatcgatggcgaagcgcattagccgactatacgtacataagtaatagtgtacgtctccaaattaatcatcttctgttctgatatactccttccttccctaaattttaacgccgttgactttttaaaatatatttaaccgttcgtcttattaaaaaaaatttgtgaaatgtgtaaaactatatgtatacgaaaaagtatatttaacaataaattaaatgatagaaaaagaattaataattacttaaattttttgaataagacgaacggtcaaacttttttaaaaagtcaacggcgtcaaatattttaagattgagggagtatatagtttttagcctcctaaggagggtggctaatataattagtccatctacagttaattaagtcattttaaaaatactctttaatatattagaagaaaacataattttagttagacagcacaaacaaccaaaagactattaccggggcaaggaaaaagcaacaaaagaaacccacaaaagttgctaaggggaatctaaaagctaaaaactgctcttataggctatgggtggcggttgtgccccactaaatcccaaaagccacatcactcgcagttgactacaggcaaccttcctaaggataaactccaaaaccactgaaaccgatgagagagatagtcgaacactctggagttccgctactttcacagttaccagaataccgacaggattaacaaatcgaagccctagaggtcggccaccacacctggagcaagcagccacggggagatgcaaggtctggcaagccaggaggagacataaaatggtgcgagacctaacaggtgaacacatagacgagaaaaatgtggttcaccgtttcaatctcttgggtgcaaaaagggcaggccgagtgactgtcaatgccacgctttttgtagaagatcgatcatccaactgcggtactggaacacaagcacaagccataggaagaatttgcatttagcggggcctttagcccgccaaagcagataagagcagagggtcgctagccaaggaagaaagcatggtaaacggagcgagccaaataacgctggtcgcttgtccaacgccagataagacggttcaccgtactcgaagagaggtggatagaaaataccgtatcccgaaccgccaggaattaagtcgatcgatcggcttgttagaagcaacagcgacatccacaatgccagtatatgtatcgtgcatacaagtagctagctagcttgattgcagatgctgatcgagatgcagatacatatccacaaatagctaccgcatctttcttaattactgtcattctaactctatcgataatgatcgatcgagctagatctcaactaaattggcaagaaattaagaggaagaataaaccggccatgctttctacatacgtgatccttatgtatcgcctactatatagcgctaatggactagtatttttttagtttatttaagagaattttaagtcatatgcatgcatcttaattgaagctggcttgtaggtagatttgaggcaaatccccggccgatcaaaacgcacaactaactacctttaattgactagtgactagctagtgtttccctgccatacatttcgcaatcatctgtctatgtatctctgaattaaactgtacctttggtcatcaatcatcatatgcatgtgtcgtcgtttcagactttcttcagtaattaaccggccggcttaattgccccatggaatatattggccacgaattgcatgcaggtgacaaaagtgcatctgcaagtcaatcaaaagcaacgagacgacttgaaaagtgcagagctgaaggcgaaagagcaaaagtccaatgcatctcatccaatctcatcctctaatcgaatcgagacacacaagttgtagcgctgttgatgtactgcttcgatcttgcacggaacacacactgctggctatgtacgcctttttctttcaatcattcaatttatctcatattcctcaacgcgcatgcatatttgtcccatttcgatcgaccattcgagcatgtgtcgtgcttacctcaaattgtctttcctcgataaactcctttcaagcagctgcatgattgatgcatttatatatattgcatccaccaaattcttgcaattatatatattcgcaagatatgttactacagcataaggaatatgcgtgtacatatatcctcaccaatcatatcttcagttatacattaccatttttctttcgggaaatgaagggatatatatgcatggttctcctgagaagatgcaaacaaccacagataatgcatgtacacatcttatccaattccaaacgaaagaaattataataaacttgcatgtgcatgcataacctgagcctaactatgttgggaacaagtagttgtcgatcaatatacaggaacgtgtcgtttgagaatattggcatatgcaacttgcatgcatctctctgcccatgccatatgaaagtctcctttggaactcaccagttcagttcgagccatgaattgtcaaaatggcatgcacttgaatcaagcaagatcgatcgaattgaagcacgaggtgaacgacgagcttagctttcggtttggttagcttccatcaacccagtgttgttgaaggtgacacttaaaaaattcagatacacacttagaatttacatacattaatatcgaccacgtcggtaaattaaacaaacatgattgaggctgtatatttttgtgtgcctactatatttgcttcaattgacttcgatcgcttcaattgacttggatcgagagagatgcaggtttactgattacggtcgtacaaactcagatatcttggatagcgattgatggaagccaacacgtagtgtatgaacggaattgatggtttttgagcgaaacgtatcgctcctaacaagtcataagttgatcatatcttgcttagccatgaggttggcaacttgccatgatgcatgcaacacgaaccaaaactagattgtgccactagcctctgctgacgacaattgtgcaggtaagtacagtaccctgatatggttgtgttggtcttggactcttggtagtagtagagatgagagtatctcaggtcttttcatccactgtttagtctcacactgtttacagcgagaaaatcttgccccaaaaaacagtcatgccttcattctcttttcaccggacaagggaaattaagatcaaattcctgctcaaacattcacaaaaatttcattagtatataatacataaattgtagtaatgttataaattcggcagagtgacggtttggcatgacaccaacgaaccagatggttacatcttacaggaaggaagcattacaagtcattcgctttcatttgggctggccgatggctctgttggctgcgcagcatcttcagatgccgtctccacggtctctgcagagtcatttgaagttggtaaatttgggtcatcatcacttacttcctcgtcccagtaaccctccagcaacttcatgactaacttgtaaatggcatcattgtcgacttcctgcagatcttccagtttatccaaacccccacattctaaaataaactgtgcatacgggttcaccgtggaaccctgcccctgcttccccactgcacccgcctgaagtatgttttgaagaccttccaggcacgcatatactaggtcagcatcttggtaagtgagaacattgcagagtggctccaaacatcctcgactcaccaaatatctgtggccaaatagagaataatcattgcagagcaccaggttcaatttcattgacacaaaaaaaatacattaaacatacatttgaatgtaaaagaataccaagacaattcctggctagaacttactgaatttgatcatttgaaccaccagacgcagcatttgatatagcccaagcagcttcctccttgatatccttctcggaggtctttaataggaaaatgagagggcttataacatctgcatcaattactgcctgttggaagaattatggtcaaaacatagtagtacaatcacttaatgtagggcatggaagatgatgcagcaaaaatagacatggacattatccttgctgagaaagcacaaaagtcagaaaacacttctacctgaatattatccttgctgccagtggagatattagaaacaattagacaagcttgcttcttgatgctctttgggtaatttcgtgctagcaacggggccaaataattaagaatgtcattttctactaggacctgcaaaaaattgcctcgtaggctcaacattaattccagaagataaggagaaaaacatagcagaatataagaactatcagtcaagtattagaacaagtacagaagtatacaaagtatatttacattgtcatttctacaatgtatactatcctggaagataatagtatacattggcatttctatgatggaggaatacacatatgaacaaagagaacacacgatggcacaaggtgaccacaatatgagtttcaggtcataaaaagattccgagctttactgcaaacttccagccactccacatatgtcttctagtctaattgttgcacatcattgctaatccatagtggtaaaacaaagaacagcgacaggtaaaaacaatatgatgagtaaacaacctgcacttgagcatcatctccagaagagattctcgcaagtaccgtaatgacaggaagcaggatattagctgatgcatgcctaaaatcatgaaacaagttaaagtgttgtaacaaagaatatttggaagttttccatacgcaaaactgtagtacaaagagaacccagaaacttacatcaaaagatttacaagttgagggcaagcacccgcatctagcacatgttgaattccgtcagatacaccgtcacatatataacaaagagcccagcatgcatcacccagtatcttttcgtcgactgaatgaataagctggctgattatatccagtattggcttcacctgcaacaatcagcaatgacagctcaaattatattccttttaaatttaatactacacacgcagtagtcattcagcaacctacttgcacttcagctggtaattttccaaaacaaaggtttgacaacgcccaagtggcagtcctcagaactggaactttcatgccttctctaaattgggcaagtaatggtgtcacagcaccatgatcaaggacgatctctctgcaggtaggcacgtctgcagctatatttccaagagcccagatagccttttaactcataagaagccagaaccaacaatatcagtaaccaaaccattacaaaaacaagtagcatagagtaccaatctttacctgatgcctgatattagcatttgcagattctaagagctcgaccaaccttggaacagcaccacattctgcaactagcaatgtatagtcagatgcagctatgttggtaagaacccatgccgcctccatctgcaaaacagtacatgcagaataagaacatttacaaatggaaaatccggaaaggggagacagaagaagagaaaaatagactaaacatacttgtagctgaggatgctcatgtcttgagaggaaatcagaaaaccttggcaggacatctgctctgatgatttttatcacggttgggttcttctctacagagagaacaatgatgataagggggatattaatgaataaaaagagcaaaacaatatcgcatattaaacatgtgaaataccatctgaaaggagtctcctgaattggatcgtggcttctaactgactagtggtatcatctgaccagaccttctccaccatttctgataggccttcaagctagctggatagaaaagacagaatgagggaatttgaaaggaaacggaagaagagcacttcacaatgagtttgtgaaaccaatggaagcatttcattgtcctagcaatgtcacaaaccaaagcttttctttagacttcacaaaccaaagtatcgtggtaaacaattggaatgcaattgcagtttcgcacaccataagaggaacgcgacatgggttatttatgtttcaaataacgcagcagtatacaaacttagcctacatctatctacttctagtgagtgtattcagccaatgacagcagtgactagtgagagtgagaggcctttttccttgaatttcgttttgcagattgcctacaatacatgaccagaactcaaacatacggtgggaaattgcaggtttctttacatagaatgagaaatttgactagctctagtatatgtgccagaagcgagaacagtcagatactccgaaagtagagttaaaaccctagagtaagcacgcacctcagagtcggcggcagtcggaggaacggattcggcgggaggtgaggacgggggcgaagagggtgcagaggaagggggagaggtggcggtggtggtggtgggcacatcatcggcctgagatgagggggtcgcggccctcgcgggcgggatgggagtgggagtgggttcgtctcggcggcgcttgaagaggccggcatcgcggttgctgcggcggacggcgaggaggcggtcctcgcggcggcggcgcgagcgggcgacgtcgacgccgggcttgtaggcggcgaggcgcgcgtcctccgacggccgcggaggtggggctcgcggcattgcggcggccggcggggtcgggcttgagtcgagcctgcctggctggtcaacccggtcggtttggaacggaagttggggcataaatccgggccgttgattctaagggggtgtttggtaactctgtgataaggacttatatttttatgaggggaaataaagtttagccccactttaatctctccaatcaaacaccaccttgtgtagtccaacggtccgggttcgactcccggcaaacgcaaatttatgccttttgggccaatggcacatcggcccatcccatcaagggaaatgtcttggcccaataattgttttgcgcgtgtactatctggagtattttaaatgaatatgacatatcatgcatttaagggttaattggatccatgccactgcaattttgccatattagaaaattgccggtactatttgcgaaatctgctgagtgccactggaattttgtaaaattggatccatgccaccgccgtcgcattttccatccatcgccgtcactccagtgtgggacccacacgttagctccatcctcttcctccatcccctctcttctcccttccccgtctctcttcggcaaacagcagcagcatgtggtcggcaaacagcagcagcaggtggccggcagcagcatcgatcaacctccaacgcccttcatagttgtctgcaccaaacactcgtgctccgcagctctttgcccaacaccaaaaattaaatctcaccgccgccaagaaatccaggtccaatctcttatttgctttgatgatttgcaatcacgtggatgttctttgctaatcgtacgatcattgactctgctgttcgagttggcccacgacgacgacagccaccacggcgacgacgaccacgatgatgacgagggtggcgctgcaagaaagaagcacctcctgaggcagcgacgaagaggccgtcgaccagctggtggtggccaccacgccggcaagccagctgcagatggactacaccatggaccagctttggaacgacatcgcggcggtggaagctgacacaagctacgacgcggcggcgacggtgatggcctcgccgtcatcgccggtctgggaattccgcggcggcgttcgtggcccttgccgccgtcgtcggccgactgctgccgttgccgccgccggccacctgctgctgttgtttgccggagagagatgggaaagggagaagagaggggatggaggaatagggtggagctgacgtgtgggtcccacactggagtgacggcgatggatggaaaatgcgacggcggtggcatggatccaattttacaaagttccagtggcactcagcagatttcgcaaatagtaccggcaattttctaatatggcaaaattctagtggcatggatccaattaaccctttttaaaactcaatatataagcaatgtcaaatcattatttccacatcattttcacattatttaatcatatacgtttatcatttctataactagatgaatatcccgccgcgttgctgtaaaaaattaagttacataatatgtataaataagatgtaatttgattataaaaacaaaacaatttgatacaattttaagactaaaaataattgagattgcatgtttttaagagagaagaaataagagataatttggaccgtagatctatcatccaaaggttagaaataattggagtgatgtggcttaatgggagaagagagaaatagcattaactacacttagtggggatgaactatataagtatataggatgtataatatgtatttatccacatattccgcggcaaagcacgaggtattaactagtaatttaaaacggtaaagctctgatatttagatttagcataaagtgtgggcccatatgctaacttagccgattgaactacgtcaacgagccacatctgcgaaaaactatcctcaaaactcattttgcactggtttaaaatatctagtattgcggttaactgacacgaattaggccttgtttagctgataaaattttttgcccagcgtgtcatatcggatatacggacacacatttgaagtattaaaacatagtctaataacaaaataaattatagattccgctagaaaactacgagactaatttattaagcctaattaatccgtcattagcaaatgtttaatgtagtaccacattgtcaaatcatggcgtaattaggcttaaaagattcgtttcgcaatttacacgcaatctgtgcaattagttttttcacctatatttaatactccatgcgtgtgtccaatattcgatattcgatgtgatagataaaaaatttttgttttggaaactacattcgatgtgacatggccttagattgaagctacattttgagggagttaaagtgaacatattccgcgtaaaaagccttgggctgggcgctcacagaaccttctggaaggccgggccgaaccaacgcaacgcggtccccacagcccacacgcacacctcacttggtgctggtggtataaacccaaaccaccgcgtctctcccgtagaaaaccccgcgattaaggaacgaaaccttctccgccaccgccgcggacatcaccgccggcgaccacctcacctcgccgccgcccccgcaccctccgatcctcctcccctgatcgcctatggcttcggcgagggccactgacccgctcgcctcgcgcgatcccccaaccttgccctcgtaccttcctccgcctcctcctcctcccttgccctcgccatcgccccaccaccgtctcctccccgctcccatggccccgatcctcctgcacctccaccccgccttcctcgcccaaatggactcccgccggaccacctccctcctccaggttgctacatctatcaccatgctttcttgctcctgcttccgctgtttattttttttcccaccaattttgggtcactaactcgctcttgttgttggattagtttttgaaggacgaggggggcatcccgtcgccggaggcggacaagaagagggagcaggtcatccgcaagctcaacaaggtaataaagcttcaatattgcggtgcgcgccgcgatcgaatctctatctcatccgcgctgctcttcacagattgtgatggactgggccaaggtggtggcgtacgagcagagggtgcccccaaggcgagcaaccgctaccgttttgacctatggatcatacacgttaggggtaagcaaccaacacacaaaatatctgaatgattctttccaattgttgcttccgatatattgtgtgatatgttcccgacccatgctgctacagattagtacactatacttattttttgtgttgtcttcacaaaatcaccacacacattaccaattataagcacaactatattccacagagaggcagtttactaagcgcttaattgttactgggatagtgcaggatgttctaaggaatatatgcccaaccaactttgctgcattgttagttgtgtggtgtctggtgtatgtatcactgtaaagtgcactgccttgtcacctttctgttttcattaccttctattctaatatacttgtctcctattattgagccgggctggcctaagataggcggaccaaatttacttaagaaaggggtatgtacatatttacaaggttccaacttcgacaagaggctgtcgaagtaaaaggatgttgtcacaagggcaacttcccgaaagaaaaaacaattacatcatgctgttgttactctcctaaaactttgaaaaccccggcttctttccagaccacaacctcctctttaatcaaagcaaagaggctacccgctgtccggctctgactctggaaaacacgtgcgtttctctccttccaaaccatccaacagacaagcaaaactagcgtgtcaaaagcgcccctgcagctagtctgaactccttgccatgccaagagccaccattcccctagttccaaccctgcttcagccggcagttggacgccaattccagcccaacccttaatcatcctccatactctggtggcagtctcctattattgcaaaaacacatccatggcaatgaatgaatttccccctttgctcatctaggaaccaacttgcgcgtgttttaagaaaactcttgttggtaatggagcatcaggtggttgcaaaataggcactcaatgtgcatcaaaagttcacacttttcattttaaggggggatcatataattatctggcataagaaaattaaatagtagttgccatgactcatggacaggatcagaaagccaagaatgctcatcttattaggctgcaaaaagcatgtgcattatgcagtcattatgtagtcaataactcaatgtgcgcattatgtgtttaatattcttattcaagtcctgagggttaataacatatatgcatgtagattcaacactgagcaagttgacctaaacagtaatctaaattaaagctttgttaatcctttctttttttttcctcatgtgtatgaattaaagctttgtgtaagccttacaaattgaatcctgtagaacaaatgacaacttgtagaatataagatggcacaattccgcctggctttgacttattgagaagatttggctaacaattttctgtttctgaaggctcatggacctgaatctgacattgatgcactatgtgttggtccttgtattgcaacactgcaggtgggttttgttattattattttcagttctccttcaacctgagatcatggcagggtatttaacatgtgttgattttgcagtaccattttttcattgttctgaggcaaattcttgaagacaggccagaagtatcagaactgcagactgtcgaaagtgctaaggttccattgatgcgatttagattcagcggtatttctgttgattttacatatgctcagcttccagttatcgatgcatcagaggcaagtttattctgtaatcaatatgtagttacaagggtactcagttattgtactcgataaacaatctgaatttcatcgacttcctttatcctgcaggctataattacatctaatcctcatttgctccaaaaacttgattcgctgagttggagaagtttgtctggagttcgtgttaacgaacaaatcgtccagttagtaccaaacgcacaggttgatgactaatctaatttaagttaccagcagcccagcatcctcccttatattctcatttgctacattaagtcgcgtttagatacacttttctctgtattttcatatttgtcctgggtaccttccatgtacttatgttattgccttaagactgatctgtcactatgcagatttgttcatttttcttttcccatagaacacctcaaaatattttgtttcattttgtcagattccgcttttaacattttatctctgaaaatttgtgatgcagaagtttcaaattctgttgcggtgcatcaagctatgggctaagaggcgaggaattcactgccatgtatgtggtttaatatgctttaatggctgttattcagctatatgaccttcatatcttctttccgctctaactgttgtattttcacctatgatggtgttttttcagttgctcggcttcttcgctgggattcatttagcgattcttgcagcttatgtttgtcagagatatccatatggcaccatcaatggtctgttcaccatattctttgatatatttgctcactggaattggcaaattccagtaagcttgcatggtcaaccaactaattgcaggcgtcctgatgggtctttcatgcccatactgttgccttgtactccaccggagttttgcacatccaatatgacaaaaggcaccttcaagaaaattagagaagagcttatgcgtggttatgctttgaccaaggtcagcttagatccagttatgcttctctcatttcttgaacaataggagatttttagtgttgggtgataactgtgatgcatagttaaaaattgcaactcttttatataaccgaaaacaaatttccgacattcctatgtcatactcctgatctcttcgtgcatgccagtttgtcgatatgcttattcctgttctgatttcttcgttgaaccacaaatgatgcattcctccattcttgcatacgctcatggcttgcgatattagccattagtctgtactaacttgacacatggaacctatctcattttcgttattatgctttcggtaactcaaagagtgtcgactctttctcatattttgataggcatagctcattgataagcataggagcgacctcatctgtcgaaaaatggtcgaatctgtaactcagatttaaatctccgtgtacagttttcactgagtagtgattgttctcctctgcattattactagggtaatgtatatatcagtgcttgagtgcttggatgttatttgatcatgtcacagttactttgtttatccaatgcaggagccatggaggcatgattttgagtgggtctggctttttgcaccgtttccatatgctacaaaatacgaagaattccttcgaattgctctatgtgccccaacgtctgaagagctacgcgattgggctggttgggtgaagtcccgcttcaaccttatcctcaaggttatttcttggcttctgtcatgttccctttttttgttcctcaactgttctttactcattctttatcattgggaatgttgagcaagaatttacatgctatgttaacttcctcttttgttctgcagctggaaagtattggtgttgagtgtgacccagattccacagaggaagttgatcatacagtcttcgagccaagcattgtatgccactggggcctcatatataaaacaagcacccatattgatattagctcactgggagaagatttcatgaaggatgtcatcaatgatgtgtatggcaaggtgaaaggtacacattcaaagctgacaatgtccatcgttaggtcatcacagcttccgaaaagcttgtacagccactctgtgtacactccatacattcctcaatatatgctgggctaccagactccgaccgactacagtggcgcagctggctaggacttgtgtggatcatcgttatctgggacttgttgtgcgaccattggatcttacctgacgtttcatccattgtcggatatcctgaactggggctattcctactctctgttctgttgcacctatcacacacactatcagagcagatctggagatcagagtctgctccctttgagcttgcagttgcagtgtatatatactgaattcatgagaagtgtgaagtttccggctgctcgatctgacggctgcacaagtgaacatatggtagcgtgcggcagctagaaaaatgcagcaaaagcggtggcagtaaagtggtcgaggatattgtacgctgaacatccaaatgagttgcatttggactgaaaactggtgctggggtgcaggtcatgaatccaatggtgaatgcacagtggatttttcatggcagatctgaaatctgaaggatagtagattttcattagcatcatttgtggctgtgatactgctgatgtagggcctgttcactttgataaaaaaaaccttaccaaattttggcattaccaaaattttggggcctgttcactttgttgctattttcaaccttaccaaattttggtaaagttgtaaaaaaaaatggctacatttagtttgctgccaaatttttgtaactatattagaaatcctaccaaaattttggcataccaaaattggtatcaaagtgaacaggcccttagcaacttgctaaaattttggcaggatttcttatatagttatcaaaatttggcagcaaaataaatgtagccacttttttttggtaactttatcaaaatttggtaaggttgaaaatgacatcaaagtgaacaagcccgtataatcagaatacatctcctacgttcatttgtaacctgtagttgtaagggggaaaaagggttgtactactactacgaggcatcagagttgtcgctattggtttgttttgcacaaaaaaaacattgatgctatttttgttgagttaatcagtacatatatactagtactgtagtaaaatactgttgggtaaggactaatatagttgatccgatacagaaacacgattggcatgtgaagtgcaacgaaaagatggaatggcgttgcctcgttgttaagtctctcgtgggtcgtgtttgatttggcaagaggctgaggatgattgtgagcgtgccacatggaccagatggagctagatgatcgaaagggagagaagaatactcctactcctactagatgcaaacatttgggagtactacctcaaacgcacgtgacaaggcattagataagttaggtggacccgggccctcttaagcaatgcaatggatacaacgccacaaaaagctgagaaaaaaaaagagagatggatcgaccagcaaggccaggccaggctgacatacagctgagctagctaagctgcatatgcatatgcagtgtggtgattagcattatcagctaattaatgacaccacacttttttgattagttggttgatggagggagacatgacacgtgtgggtgtcatgcggacgcatccatccatccatctcgcgccaaaggctaccactacacgacagcagcaagtatagtgaggtttctatggtgcgcgcacacgtcagcgcagatctcttctgggccgtgcgatgcaaaaccgtccgtacgcaacgtgatactgtcatgtgggccccaccccacccctctcgacaggcaggccccggcgcccatgtgccgctgcctccgccgtcgcgtcgcgtcgtctagcgcagccgcagccgctgccgctgggccccacctccctgatcagccacgtgccgttcaatcctccccacatgcccccttccgctgtttaccaccaccatctcccccctcccttttccaaaccaaaattaaattgataattactcctactagtaatcaattaatctcaattcatttcaattttgcgaatagaacattttattgtcagaagaagcaaaagcatttctcaatcagt

SEQ ID NO: 63376 - DNA, 8726 bp, Oryza sativa
ggcactatgtctgtcaactgacaaagtaataccaatggacgatgctctgctaacaaggaaaatagggtatccaccagagcctcttccatctttcttatggttgatttgcaagacggcaggtgtatctatatctgagtagaattttgcataacagatggaaaggatatcagggatgtttaattaagttctgacctccaacttctctagatgaatggccacatagaaatagcgcgaaagtatcagttggctctttcatggtttgattagcacctttgcagttcctcttgataaaataatgagatggcagcagtacatctctaaccatcaccaagatgattttgtttagactatcacattctttctgaggttgtttactcctcagtgctctctctgaaatgttgagaacaaataacaaatacagaatagaaggcccactgttcaaacattgcatgcaaccattttgtagttggatttgccttcttttcagtttcctgagaacgctttcttccacctgaaacaataaatatatgaaaattcaaaattaaggagcacataaagcatgaactctgtggcatgttaaggtgaacaacaatataaaatggctaaaagaggcacttaaccttaattgtttgactcaataagcccaggttaatatgaaataattatttcagattgttcatacaccggggaatatatgctgctgataaagaagcctggaaaagctgaaaattatgactgatgaagtaattttgataaaaatgtgtatgctgaaatgaacatctagcagaatgggagaaggccagaacagctaataccatcaaaaatgtgaatgacagaagaagctgggaaacttctgaaatcagtagcccgaataaagaaaaatccctcttgcaatgtagaaggaaaatacagaaggtcatataaacactaatccgataccgaattacaaacccagttgagttatatgtgtatagagtaggcacctcatcttctctagcagctgtttcttcagctgattgttttgccagatgagccactaccagctcttacaatttcacaatggcaagtacgtagttcgaagttcgtaaatcagaaaatgtgcctttatcaatacacagtacagaactaaaggtactgctgtatggcataatttactgaaaggtatacaaccattcccaaacaaaaccagaaaatgaaaactgaaattcagcagggtaagcagacatataacaggtgctagtcagcatacgacaaggatgaacttaagttaaagcatctttcaccaacggtcgaagaccatggtctagtgaacagaaaaaggggaaatcttccttcagaactctgcgccaaaatagcttcagctttgaccggcgatgtaaaaaaggatatgatctgcttctaattggcaacagacaagctctcctagtgttgaggaactttggaacactttgcaaagcagagagttctcatctttgtaggactaaaatctaagatagctgcacaaaataattacagcaattagaacatttctagtaacaattgtacacatgagctaaactcagagagaacaaaatggaaacctcatcatgcacaactcttaatggaatccatttgcgtgcttattgaatcatgcttgtgcaactaaccaccattacaactagtgaaaatatctcatgcagtcagataaaaaaaatattatgtggatctgagaaactctgccatgcatatcttctaacgcgaaacatgtgcttaaggaaaaggataaatgagcatgatcacagaggatatatctgtcccaaacattgtctatgcagtgctagaagcacttgttacttgtttgatcaattaaaatgtaatgccaggagtaagcaaaaaaaaaaaaatcgaagccagggctttgatcttacttggaataacaagaagaaagtttaatcaacatttgaccaaatcaccacttaatcagaacaagatttttctaagcaaattgattggattttgcaacttcagacaatcaagttaaattgcttatgttcaacttgctaatagctgttgatagcgtaattcttcttcatgactttgagtagtacacagtagtttgccttactttatgcattagaatagtgtgcctttgcagtccacattttaaacgacagaataatattgcaaatccatgatatttcaatttgtagagtgcacacctgctgcattcgggggtttgatgaatcatgggcaagtcagaaggcacatcaggttattttacatatatgatgtcctcctcatctggctcatctgcatcccagtcaccttcttcttcttctgatagatttgcaccttctccatcttcctcttcttcatttccttcttgttgctccctttcctcctttaatttgtccagtatagcaagatctatatatatggcaacaattagactatagtttcccaatatatttgagagatatgaaaaaaaaacgcttagtgcaatactgcaataattcattgtgtgctaatgcaacccctgcaaacattggattgttaagttataggttctgtgatgttaaagcttaaaaaaatgtctgtatttggggctgattgcctcgcaaagaccctacaggaagaagcttacgtctggtgtggtatcaatgaagcgtaacctatgatcttatccaaataaagcatatgggtacttgtagctataattttcaggtaaaccgaattgcaaacagccaaacacaattttaagtttaaacagagatgcaaaatactaacacaacttgtaaggtaacaaaaacaatgaccatgcttcttttgaactatttggatcttgatatttgataactatccgaggagcagtactggacaatcacatagtatagatacgttcaaggatgcatgtactaaatgaagataaaccagtgaaagcagatattcattggaacaggtagatagatgagtttagagtgtgtaccctgcttccccgctccatggactcatcctcgatgaaccgtatctcaggcgtgaggcgcagcttcatccgcttgcctatttggctcctgacgtacttagtcttagccttgagcccagcaatggccaccttcttccccctctcgtccccaaacacggagacatacaccttgcacacctacgaacaaacagtgaagttcagcatagctcgcacaaatttacaatctctctatgactcgctaagcgaggggaagcgtcgttggagaattaacgcaggaggcagtgacctggaggtcgttggagagctcgacgtcggcgatggtggtgagggaggagaggtactggtcggcgccgagcgcggcctcggggaggacggcgcgctggaggacggggtcgcgggtgagcatgtccgcgagctcccgctggatctgcttcgccaccatccgcacccgccgctccttcgccatgcaccgcaccacgcgcagcgacgacgccgacgagggaggcggccgcgcgggcgccagaggggacgcgacggcgaggcgccgcggcagcggaggggacaccagcggccggcaggtgaacatcgccgatcacctcgacgcgagtgtagcggtggcggtggtggcggtggtggttttccggcggcttcgcggtgaggccgtggaagacgatgagtcggggaagtgggaggggatagtgtcgtcgtgtcgaatcgaacaatatctcgcgtctttttttagttttgttttatttgaaagcattttagacgattttaagaagagtttagtgcaatccattttatacagttctggttgtaaaagaaaactccagcaaaatcatcttgcccattcaggccaaaattctacaaatttctctctgtaaatttcatcgtgccctggaaaggcactaaaaggataatacgattttgaagactattatctgatgtagatggagtcatagaaataagaaatctaataaaaatgtcaaatactccctccattccaaaatataaaggcataaccacctctaacccaaagacaaaaaaataattattattatcatctcgtagttttattatcctaataaatacaatgcatgtatcaaatagaattagagaacatgagagtaaaggattttaaaaagtaataatttaatagagaaatggtcatagttaagggcttacatgcatgcatgccttatattataaaatactccttccgtttcaaaatgtttgacaccgttgattttttagcacatgtttgaccgtttgtcttattccaaaaaaaattgtgaaatatgtaaaactatatgtgtatatgaaagtatatttaacaatgaatcaaatgatatgaaaagaataaataattacttaaattttttgaataagacgaatggtcaaacacgtactaaaaagtcaacggtgtcaagtattttgaaacgaagggagtataagaaaagtagttgtggcttatattatggaatggagggagtattttgtaggattgattccatagtcaaaccaagcaacatacagcccatgggcaccgtgcccacatcttggaaaggaaagcccatctaggtaaccaggcctataaacccggcccactatatcatcaaatgccacgttgccctagacgcttaaaccctcacctcccaaacgaacacacacctcaacctcccccgagacgacggcggcgacggcgacggcgatggcgaaggagaggaagcggaggcagcccgccgacgcgccgccgccgggggacgacgacgaggggagggaccaccggagggagaagaagccgaggaaggagaggcccgacccggtgctgccgtcgcagatcaagaacaaggacaagcgcaaggaggtgcacgcgaagctcaagcgcgagaagaaggcccagaagcgcaagctcgcccgcgagcgcggccaggccgcgcagcgcgccgtcgagctcggcgagcaggcaagcgcgcgcctcgatttctcccctccgcagcgagctccccctctcgaattcctccaagctttgtttcttaggtttttgtgagggttttcattatgggtgttcgcagccgccggagaagctggtgccgcggacgatcgagaacaccagggaacctgacgagaccgtgtgccggcccgacgaccaagaggtttgtgcacgttcttctgtgtttcttacttggattgatcctaccaatgcgagtttctcaattatcggagtaattgtaattttaatttctaattgtacattcgaacctgtttgactaatagtagtttggaatcaaggacatttatctgacagggtctccttaatgttgcattaggtttgtggaacatgagaattacatttctttggtagttaggctaggtatgcggtgaggttggggcaatttctgaattacatttctttggtagttaggctaggtatgaggtgaggttggggcaaattctttctttactagttatgaccagggaaggctatctggaacgtggtgccttgccgaggttaaggaataaggatgagataacgattataagtggatttagctgcttgcttgggggagtttgcagaagttcatgaggcttgtcagtgaatgagtgttgtgctgattcctgttattcactagcatagaacactatactatacagatgtcatgctatcatcatatcatgcttataacatgaatcagttaccagtatttatgattttaattaagcatgcaacttctacaagacacatcactgtgtttttctgccttcacatgcttgcttcgattgagttccttgcacttgttatacatattcagtatgcaacgtcaatgcttggtagtgctgcactggttgatgctgctgccttatattatataatttgtgcgtacacatcacgggtttttatatgctaagctgcaaacattagattttttttctagacattttactgctttactaagtactaagaagtaagatctagatgtcctttttgtttcatatagcaatgtgcactccaagatatcattagcatctcctttagatttattagtctatttagaatcttggtgtattatatccttttctgttactttctcttaggatgaacactcattcgatcattgtgattcaactttacatggtatcagatatcaaattatcgttcttctgtgcagctgtttgcagggaatgatgctgatgaattcaatgcagttctgaagcagcaaacaactccaaaagtgttgattaccacatgtcgcttcaattcaggcgtatgcattttctatgcttatcacctctgcttttggatttttgttcttctcaatatcttgtgctggctgttctgaattgataattatttgataacctctattcttaagaagttgcatctaacactttatgtttatctgcacatatgtctacagaggggacctgcctttattgaggagttaatgcaagtgatacccaattcgtgttatgttaaaagaggaacttatgaactcaagaaagtatgacatgttcaaagtagctaacctgttcatttgtttgaattagacacttcatatggactgaaacacatttctttttagattgtggaatatgcaaataacagagatttcacttcacttgttgttgtccacacaaaccgaagggaacctggtaagaatccatcaatttattagttcaaaatttgcacttgttatctgttatgacatatttattgttattgtgtcacagatgctctactgatcatcaattacctgctggtcctactgcacattttaaactatctaaacttattctgcggaaggacataaaggtactttatctgtattttctttatcatactagcaaaatgcctttgctatgggtaaaatgcacatgcttatttgaatatatgttattcacttgattcaaatgaatattagactattatataatacaagaaaatatcaagggctattttgtaagttgtgcaaatgtagttgtgggttggtgaaccaccaccaccgctattgtcttttacagtagtatagattatcacctactaactaatgttatattgttttcttaaataatatctactgaaactacaactcttagatgagttattcaaaattttgttggaaatggtaacctgtatttatttatttttatttttgtttttgggagaacttgttgaatagctttggtgttgtctacatatctttgtgctaacttagcatatattttcaccataccaaagggataggacagcaacactgttatccatcttctatgtgttctgataatctttgtatttgcattgtgaagaacaaatagtaacagctacttcagacaagcacaaattagtgctatttttgaagaatcatatgcatactatcttctgctactgcaaatctcctgtattagttagtttataataactgtttgatctgtttgtgtttttaattgtgatctgatcacgatatcctttgttcttagttttttgcacacatgtaagagtgagaaaatcccacggctgtctagatcttagcaaattgacaacaatatgctagttgggaactgtgattatgtcctctccagaaaaaaaaaagttaactgtgattatgtgttatgatgactgagagccaacacacatggctattttctgaattctttagatctaatgctgatctttaccctattaaacatttaaacctctatacacaaaaggaagaatataaaattatatgagtatatttaaagtcagatagtaaatgtgccattgttttattttcagaaatcttaaacacaatcttgtttttaccgaatgctatcaggaattcattagggacatactggttgtggtttggtatattgttatctgcaggaaaagagccttgcttgtgcataacaactccttttgagggtcttatattattgttagtaattagtgcggtggcctattggctaatataaacacatagtgtagttcagaagataaaacaaactttgatgatcacgttcatcacaatgatgaatatgaaaatgtcaactaattcgtaacgttgtttagatagttatggtaataacaatgattatatcatagctgcatatctgttattacaccgctaacctctttagactaaaggtgcactggaagtgaacaaagcccaagttgacatcaattggtcatcctacttgtctctagtttgtctctaggatgacttagtcatctgagctttgccctcaaaatcaaatgtgcatgtgactatgttcggtatcatatgacatgtctgctagatgctgatccatgtctctatccaacatagcatgttttagttttagtttttccagtctttcaatgattgtatatattattgcaattgcaatggagttgggttgataaccatgttgctgatggtcatctagattgatggaaagcagaaaaaaaatagctggaaggaacgtctttattctgctgcacctggactttgactaattttagtagcgtttcatatccagatttattcagtttatttgatatgttcttgttaaatgacaaaaggttctcagcttattttccaatattatataaatctgtttttgaattttagctttgcgaaccagttaatattcatggctttgtttacctttttggttgcagaaccacggcaaccccacaagtcataagccagagttagtgttgaacaatttcactacgcgccttggtcatcgtgttggaaggtgatttgtgaacatgaacccttgtgctcctttgctgatc

SEQ ID NO: 63377 - DNA, 1925 bp, Oryza sativa
ggcgaggcgcacggcctcaaggaggcggagcgcgccggtggcggtgacgtcggcggtgtagtcggggacctcgaaggagacggcgacgtgggactgggcggcgaggttgtagacctcgtcggggaggatgtggtcgagcgcgcggcggagggaggaggattcggaaagtcacgtattggaggcgcatcggggggcgcggcgtcaacggctgggagtgcgggtcgtggtagatatggtcgaggcgctgggtgttgaagttggaggagcggcggatgaggccgtgcacctcgtagcccttgccgaggagcagctccgtcaggtagctcccgtcctgccccgtgatgcccgtcaccagggccaccttccgcggcggcgcgagggagggcggaaccgacggcggcgcggcctcgccgttgtcgccggcggcgccgccgttggagtgctgcgtcgtggccatttcaacctgcttagatctggtgggtgggggacgaggcgaggcgaggcgaggaggaaatttgaggggaagagtgggcaacgagggcagggagtatttgtagggcccgcctgcagtgggaccctctacctgtatgtgatgagcgaagtgacgaagacgcaaagtgcaactcaacacgatttttgtagtcttctagggggtgtttggagagaggacttatgttttggagagtttatgtttttgagagtttagcctctctctcccaaacaccctcttacttacacaaacatatatttttaagagatgtgtgaatattatgctcactttatcatgtaaaaaaataacttagtgctggatataacacattatattactatgaatttagacatatttctgtcaagattcgttgtactataatatatcacatctaattataaattctcgtctttttagagagtatggtcgagttgaatttcatgtcgtgctagccatgaccaggcaacgggcactatgactttgtgagtctgatttttgagaaatcaggaaaaaaaactcaaaattcttgcaaacaatagcaatgttttttttttctaattacatggataacgcacgacaacactaacactaagtacccacacaccggcaagtcccaaagaaacgcttaaatggattaacggacaaaagcctcgtggagatcaacatttaaaccgtgcgaagtttccctaaaaaaaaacgtgcgaagtaaagatatgcactcgtgatccacttcttgggtatatgattattacgatagaaacaaaataggtaaatcatcaattttaactttacaggcaaattatgaaagaatgtgattaaaagacgtacaccctccattctaaaatgaatcatatccatatcatatagccccatcaattttggcatatcggaggaaaaagtgaaacgacatatttgtaaatgaaaaataatttgtgaataaaacttttatatacgtgttctgaacgatctaaaagcaaatgttgaaaaataaactacgatgaaaaaaaccccaaaatcaactctaaatttaagattgaaaattcaaactttggctgataagcgtgagtgaaaagatgaggctaataatatccatattattgctaggatgcctcaaacggaacatatcctatatagattaaaccgggatttgtttttttttcatatgattaattttctgaaggaaagggatgtaatttgggcttgggctgaccaaattgatagcaggccagatcaaatcatccagtcaattcttgtattaactctaggcgatatcagtatcacaaaaaggttgatagcatgcgtagcatagtgcaaagacatttaggttgttaatccgtagtactaattactaagcttcaaaatccacgaggcgtcctttgcctgcttaatccttccctttcgtgatcgcaactcgcaagcaacaggtgcaagctgc

SEQ ID NO: 63378 - DNA, 688 bp, Oryza sativa
caagccaacatacgccaagataagccgccggatatcgacatcagggataagcacggctagtcccctacgatgtctccggatactgtcaggagagacatagcgttgtctctgatcttgccgggcacgaactcgaggaggaaggctaccctgttgtcgactacgagtcagacgttcagaccgtcatgtcgacaacagttagataggctaccccaaatattgtactggtgtgattatgatgaataagagcaacgaccggcttcggtcaacaggatgtagggttattacctgccaattaaggggtcctaacctgtataaaaatcatgtctccgtctcttttacctcactctcgtatatatcctagtaccaacgatctccatcctatacaaataccggaattgcaacatcaaacgtcgacatatacaatacaaaatttatacatacgtatataaagtatatacatacgtatatataatttttatgtgtaccaaaaattgacatataaaaagtatacatgtatacaatttttgcatacgtgtatacaaaccacctatatatataccgagagaaaataacacgaatacaaactttatatgcgtacaaatacaaaatttggtatatatacgaatataaactttgcatacgtacatcttaaaaaaagcagaaaaagaaggagaaaaaaagccgaaaa

SEQ ID NO: 63379 - DNA, 576 bp, Oryza sativa
aggccattctgtgctggtaatgatcatcttacggacttcatcttcggttcgcattggtgtttttcttttctgctgaggacgctcccttgcatagtgcccttgctcatcacacataaagcaaatgttacttgcttcttttgggtcaacatgtggcacgtcaccatgggtccttcgggatgctggcggcatgctgacttgtggtgtgagtgcttggactgcctccaactgcacttgaggttgtatttgactcaggttcagaattggcgtctgatgctgctgtagtatctctataagcaatcggttctggttaatcaggtgttggaccagtgtcacacaactggtgtctggtgcttcattcactcgggagcttgaggtaccaatgtcctgacttctaaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattaagcaagttgattaagcaaacaacctagcatgg

SEQ ID NO: 63380 - DNA, 1491 bp, Oryza sativa
agatttatggtgtgcttccacaatatttgaagtgttgtatttaatgtttagactacttttttgatacattgtgaatacccttatatttgatccagatacaacctccatctgagaatataagggatttcccccatataattctataaaaaaaatccctcatattcttatactgaggtagtattaagttgtgtcaagcattgctgtgtactacagtaatgtgtccgtatcggtcacgggctgatgcttcatgctttgcattctctcttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatggatcacaaacaagttggttatcttcagacactgattgtgtagaagactactaattcaacatgcctgagagattatgagtaagagttttagtttaacatagcaaaacttaagcatgaacggggatgtagctcagatggtagagcgctcgcttagcatgcgagaggtacggggatcgataccccgcatctccacctgttgttgttttcatttttgaaaaatgcaatctttagttttcttccatgcagcaatcatgtaaccgccgcatcatctacattctcccaaattattttttaaaaattgattcttgtttgtttttcttttccaaattgaaaaatgcaatctaaagttgtctttcatgcagcaatcatatgtaaccgccgcatcatctatattcttccaaattgaaaaaaatgcaattagcagttttctttcatgcagcagtgatccataatatacctgcaccatctacattctctgatcttagaatattaacaaacgacagcataacattcaacaaagttctgttgataacagcactgcaataacgatctgtttatcacaaacgcccgaagcaaaaatacaccaaaaatgctggaagaaatgttgtggtcacagtggaatcaaattattgagaggtcctcattcatcaacgagaaatgcatccatattaagtcacaattacagcattcccaaaaaatactcttatctacagaataggggcctgactatcagctgacaaatttcatcaaatcaatactaagtgttttagtaagttatatatgctggtgt

SEQ ID NO: 63381 - DNA, 1373 bp, Oryza sativa
ccacgggttgtagaggtagttaacaggtggtgacagtattcgggtacatcatagagccatagccagagtctccttggcagaccaggggtaagccgatgcttgaagcaattgatagagttttatcttaacttgattaagataattaacccataggaatcctctctattcttggcctaccatatagttatttcccttggaagaatctcgttcttagattatacacatacgttgcctgtggatactatatcctggaatactcttggggtgaaggctacgactgtatttgtgcgcttgcggattattctgtcgtcgtaataaataataataggcggttgaactcgtgtaggtactctatagctatcttgtttccctaatgaagcgcatggaactccctcttattttgtgctacagtcccatcgggaacctatgccttcctgaagctacggcaaaattccgcccaagtgacatatgtcacagctgagcgggtgaccatgtagttgtcccaccaagcagaagcgggaccttgaagtttgtacgtggcaaagacaaccttctcctagtcgttccaccggaggaggttcatcttcttctcaatggcatgaagccagtcattggcttccattgggttgatggtgctggagaaagtgggtggcctgacatggagaaactaaagtagtttggactaatgtggtggtggtggaccaaactgctgattcagctgctgcagtgcctgatggtgcatcatctgctattgcatatattggtgttgtttttgcatctgctgcatatcattgtatgatatgcgtctaattggccaacacctgagcgattgttgaattctctagcggtggaggtggaccattgctagttgcaccactggtattggctcctccagtctattcctcactgctgctaccatcacctgttgcatggtcgccattccttgtgttcaccatctgaatggggatggacagaaaaagggggaaaggaaagaatatagactgctaaaaaacctaagctttattacattataatttagtgcaattgtctaatctgaattaaaacaactacaaagaaaacaattcaactcctaattaaggtagtcataccgcaaccactgttgacggtcgttgtcgatcagtttcgaccatcaatattaccaaattaagagagaactagtgatgcttgcaatgcatatgtttgttagaataataatattccactagtattaggtatattaatctttgtagagaatgacactaaagtggaggagaatcggcataacatagacgataaatcaatcggacaatgtcgagaaccagacttatgtatgaatgggaaaagaactcagaattgacacgatgaattaggcc

SEQ ID NO: 63382 - DNA, 608 bp, Oryza sativa
taatgaatggggtcgacagagggatacgacattattgttgtgatgacttcatcctccacaggccagatctattactaacgtacgcaccgcttaggtggccctgtcaatgtgattcaccggactcaacaaaatatgtcactaatttattggttaaatcagatgcaccctcttgtctaacctaagtaagctatgctaaaccaaatgcaccctatatatatacacataaatattatatatttgatttttaaataattaattaagttgatcaccatgaatcatcacgcaatatatacacatctaaaatcacacataagcgaagtgggcgtaactcaactagttagatttttttgtggtggaaccaatccatccgggttcaagttctagacttgatacgggtactcgcatttatggcaaattattctttcagtagtagacgatgtacccattgacatcgagacacccatggtgactttattaatctcaagatatattggctcagtctcgcgaagatgcttataggggtagaaatcacatgtaagagattagattcgcagatacgagtcttgcgaagatgtttatacgggtagatatcacaggtaagagattag

SEQ ID NO: 63383 - DNA, 33111 bp, Oryza sativa
cccttctgccgaggtggcatggtgacggcgctaggttagctggcgccaccatcactactagaaaaacaatttttcctggcgttaccctttaattttcgctggcagccatatgcaaaaaccgccagcacaaatataatgaggggagggggttacggaccgccagcgaaaactgattttcgctggcggccaagctaggtaaaggggaccattgcgaaaaaagttttgaggcgaatatataaacccaccacactagccacctaccgcccccacctcagtctctcctcctctccttctctctctccttcctccaccgccgcgggctgccatcgccaccaccgccgagggctgccatcgccaccaccgccgcgtcgatgggggaggccggatctgccgctgcgatgacaggggtggctggatccgccgccgcgacgacgtgggtagccagatccgtagccacgatgacgggggaggctggagccgccgctaccacgacggggggtggccggatccgccgccacgacgacgggggagcccgatagggtagggaggccgctgcgacgacgacataatcactactgggccgcgggcagccgatccggccacgggagagccgtgacgggctcctccccgctgttgcgacgagctcctccccactccatgtggcggcgacgtcgagctccatgcggcggggtccggcggctgcggtggagtgcagcaatgacctcagcggcggcggcagctagtggcgataggtgcggtggccgttgtggagtgcagcgacaacgacaatttttttttactttttgtgatttgtgaatgaatgtgagtttaatttgtgatttgtgaatggtttggaatgtttgtgaatgaatttgttcaattgattatgagatttgtgatgaatttgtgattttgtgaatggattagggcgtccaaggattttggatttggggtgggggatttttgggtaggggatttgagatttggggtgggggattttggatttgctggtgtgattttcactggcggttctctttaggtagccgccagtgaaaatatattttcactggcggctaattcccgcttgcgaaaatacgctattttcactgggttttcttactggcgactgcactggccgacagcaaaaatataaaatagccaccagcgaaaagctttttcattgtagtgcatgttggagggtggcgctatcccctccggcgcaaccaaaaaagagcattgttaggttaagttttttgggatctatttgtaaaataagattttgaaaagtacacaaatgtaaaaattcagcatcgaattcagatgcatcgatccgtctccacacctaacagagttaataagctagcaattaattaaggtgagtagcaaaagtatagctagctagctatctgccaaaggaacgtgacgaatgagatgaagtagccgacacagaaataacaagcggctacgagatgactttattagctagacttttgtcatgttgtaggtactcaccgatatgtgtttcttccttgttgaattgtctatgtctagctcgtgggagaatttgaatgtgctcgtgttttacttttacaatcttcattccaaaataaaatatgaaatattttaattaagtataagtacaggtattaagaaaagagataagattaaataagagaggattttcattgctcgagaaaacaaaatagatgaaaaatttaaatagcgatgaaactgttatatatattatgagataaatttttaatattaaatgttgttatattttggaaagagttgagaagcatgctgggcatgtgtcccgatcgagaggagatatagttgtacagtagctaatagcttacagtaggtaggtagattcgtgtacgtgtggtgcagctagctagggtgaagttagatgacggcaatgcgtcgcagcctctcatatgatatcgatcagctggagagctggcctggtactcttgcgcagtagggaaaggaaacggacggagtagctcacgcaatcgctgaccgcatatatgcaccccgggtcactagctacctttacctttttcgatctcttctcttcatctccagtgtaaagcttttttgactgcttttttttttgtgtgtggggggagtgcttgtaaacaagtccatcgatctcgttaataaaattcgtgaagaaatcaattaatttaattattgtcccacagggccgggcggcatgcacagtaaataaattaaattaagaaatggacaagagcatggtagccagacaaagacggacggacggacggacggaggacctttatttaagaaagaaaagggggcccctgctgccctggctcatgcatttgctagctagctcatcgtcgataccaatggcgactaccagggccacatcgacgctgctgctgctgctgctgctggtttcggcaacatgggcggcatcggcgccgacgacgagtcgggcgaggaacgtgataacacacgtgaaggggttccaagggaggctgccgttccacctggagacggggtatgtggaggtggacaacaccaataccgttgagctcttctactacttcatccagtcggagcgcagccccgccgatgaccccctcatcctctggatcaccggcggccccggctgctccgccctctccggcctcctcttcgagattggtacccagctctatcttaattatttcttcattcattttcgatcgcccaataaattaaccactgatataggagttttcatcaatctactctagctagctagcttgtcacacgtacgattaactatgcaaagcatcattgattaaagcaccccgcccggtatatgcatggtggtgaagcgccgtacatataattaattaattccacccttgcactaggattcaatcccaatatatactatcaacgaatatttcatacatatcaactagctaggatattcattttagtgagactaagtattggccgttagtcttcgtttctctctctaaatacgtacgtattaatcaggagactgttaatttctcaggtgtgtgtacctatggtggcatgcatgtcttcagtgtaataaaagaactactaatatatatatatccaactatatatatctaacaagcttatctgcgaacagcaaaaggttaattaagtatatatgtaagacttggcctttatataattatatatacatatatatctgccggccagtactgccaccatgcaacatagtagtttacaaaagttcaaattaacttgcaatataatattgctggtctacggaaatgacaaagcaattgagttagaataatactacataatataattaatcgatcttctcaatacaacttggggctcgcggcgttatcaacaacggcttttctttcgttggaaatatctcccctgtccacatcatacaagcatggcacattgtatatagatggttgccgaagaaaaactgacgatgagtcaagtctttatttggcctcaaatttgttgaatgctccttccactattaattaaagttgaaacctgccaagttaatagactccttccactgtatatatctatccgttctgagaggtctttcacaatattgtggatattttgccgtgtaggtattcccttgctgtattgccagtgacctatcttcttagaaaaattctactccctccttttcacactataattcactttgtttttatcctaagtcaaccctctttaagttaaccaagtttaataaaaagatatggcaacatctataataccaaataagtttcattaaatccaacatttaatactttatagtataattatttggtattggtaatattatcctattttcctatacacttagtcaaacttgaagagatttgacatggaacaaactaaagtaacttataatatgaaacagaggaagtacaccttaggctgcactcgaacgagtagtttcggaactcatctcttatgcacggaaaacaaggtaatttattagtgcatgattaattaaatattagctaaaagaacttgaaaagtgaattaatatgtttttaaagaaattttcctatagtatttttttaaaaaaacatcgtttaaccgtttggaaaatgcacttacgaaaaacgagggaacattgaacacaaccttagtattcacactcctatatacttctataaaagttggagcattcccaattaggctgtgttcaggaggtgaggttggaaactcacctcccgcgcacgcaaaacggagcaatgtattttcttatgattaattatttttttgaaaaatggattggtatggtttttaaagcaacttttgtatagaaacattttgcaaaaaaaacatatcgtttagcagtttgaaaagcgtgcgcggaacacgatagagatgagttaggaaaggtgggggaagaacacagccttaatatattccccctacccaccctggccccaataaaataattaattcctatatatgagtctctgtgtcctaaacagaatcgatttctggctatgaacattttttaggtgaaggaaatataccagaagttagagtagcttgtcaatgacattcaagaagggatttggttttcctgaatggttttatttaaattaatacagaacgaatatgcccaagattgggaacatcctgaaattaaggccgtgtttagtttccctccaccaacttcaaacttccaacttcccatcacatcaaaaacttttctacacacataaacttttaatttttttcaaattaccaactttcttcaaacttcccactctttccaccaactaaacacagcctaaattgaattgactaagcctcatttaactttccaattgctcaaaataaagtagagcagaagccattagctagctgggctagctgctaatacatcacaactatttgtctacgttcatttcagcttatggactatacatatataattacaagcggtaaagcgatatagcattttacaatataaaattcgagggttggtttaaaacgggtggaataaaattttattcacttttgactttaaaatatttaagggcttaggtaaggttatgaaagaacctatgtgccttagacctattaccacccatatgtactatgcatggttcttaagtactaatataattgctcgaaaagcattacatatataacaataattgattacatgggcttgtcttagctgagctatttttagttttatattatactatgtctagatttaaatgttgctatattttagaacgaaggtatatagtatgatattaatttcatactatgaacttggccactctcgaaacatgaacaacacctatccattgagtggcctgctatactgacttagaccgatcagccggtcttggtgataggtggataaaaagagagagaaaagaggtgattgtatgataatttaatttgaagacaccattcattgaatatatagtttctacacatagtgtctatatgacatggcaagtatggaaactacttgataatttctgggttgggaatggccttaatgcatgacgcactagtgtgataacactagtaagtactctgtctaagactaaatccaacaattaataaatcctttggaaaatgcagatctagggaagataaaatgaaattaatgcttttgcaaggtcactcagagctcgtacgtgatcgctcggccccagctaggatagcacaagcggcaaccagcactatcgccatccctagccgtcgtcccctccgcctcgccaccgccgcctgagctatcgtgggcaaagccgggggagggggcacaaggacaacggcagcaagctctcttattcttctcacggttgcgatagtccgaggcactgccaagatcgaagggaaggctgtcagtggcggtatcagcggccaaaccggcatcgttgggtctcggctctagtcctcttctgatctgccgccccagcagtcggtgatggggaggatgcacgacgaaccagcaaggaggagaggagaaactagattgcgcaagggtggaggcacgacttacaagggcgaggcctaggtggtagcgcctgcaggtggccagtgcggcaagcacacaacgaggaggctgacaaagcgtgaggaggtggccagcgactcgtgaggaggaggctggcagcacgcagacccacgacacgtgtggccatggccgggaagatagcagagcaaggcggttgttggtgctatgaggaggtggcagggggcgtgcgaggagatcggcgatgcgtgatgggagcatgaggtgaaggccggtggtgcacaaggccatggccgaggaggaggccgacaccatgacgaggtggttggcagaactggtagcgttgaatgtggctggccagcaaaggattgctagcgtggcggagaccggttgagtggtggagtgctaggttgctggtgacaaatttggagagggatctacatgcaaaagccatgcttggagttctctgggccaacaaccacgtctagggttgttcccccctttagggcattttcgagctaacgcctcctcccctggtaagattattcgggtgaaaatgaagcccttttgacagatgatagtggtattttcagcatcatgacctcgttggaggcatcatcctcaagatctcgtcttcctattgacgcggacttctctcagtttggttttcaatgttttctcagttgtcatcgccgggtaggtgtgaggaacaagcggatcttcttttgtctcgccctttccctctccaacccttctccatgaggatgactgggagcccgctgatgatgttttgttttggagaaggtgttcggtggcgcatttccagcccatgtagactagcagcaatcggtcctgcatatcggcgctggcttcgtcctagttcttttttccaggagtgtatttggaattgttagcacggggtggtggtgtgtttttgtttaactttttccttattatagcctgtatattttttctgctatatccaatgaaattggcacaatcatgtgccggttcgtttgaagaaaaaaagaattgcttttacaagtgaattagtgaaaaggatttcaattagctagccagacaaaaaggccagtgcgtatatatgcctaccacagatggttgctgaaattagctcgtgatcctgtcggttatataattaataggagtataattttttttgttaggaaaatgattttcaaaggtaatgagtacacgtgcatatatacaggccctctcaagtttgacgtagctgggtacacggaagggttccctcaattgttctacttccaagattcctggaccaaggtactagctaatgaatcaagtatgtggaatatattttgcctaaaaaaataaattgcatgaataatgaagagtgatatatgtttgatgttaggtgagcaacgtgatatttctggacgcgccggtggggacggggttctcctacgcccgtgaggaacaagggtacaacgtcaccctcacacagacgggacagcagctggtggtgttcctcaccaaatggctgggcgatcacccagagttcgcctcgaaccctctctacatcggcggcgactcctactccggctacaccgtcccagtgacggcgctccagatcgccaacgacgacgacgcccgggcgcggctgaacctcaagggctacctggtgggcaacgctgccacggacgtcaagtacgacagtgggggcaaggtgcccttcatgcacggcatggggctcatctccgacgagatgtacgaggccgcgcggagcagctgccgtggcgactacgtgtccaccccgaccaacgccgactgcgccaacgcgctgcaggccatcagcatggcaaccttcgccatcaacccggtgcacatcctggagcccatatgcggattcgcgctgcgcgggcgcgcgatgcctgagacgacgatggaccagcgcctgcgcctgggcctccccgtggagtgcagggacaacggctaccggctgtcgtacctgtgggcggacgacccggaggtgcgcgccacgctgggcatccacgagggctccatcgcctcctggagccgctgcacggcgctgccgctcttccggcacgacgtggacagcgccatcccctaccacgcggagctcacgcagcgcggctacagggcgctggtgtacaacggcgaccacgacctggacatgacgttcgttggcacgcagcagtggatccggacgctgggctacaacgtggtgaccgcctggaggccgtggtactccaaccgccaggttgccggcttcaccaccgtctacgaccacaacctcaccttcgccaccgtcaagggcggtggccacaccgccccggagtaccgccccaaggagtgcctcgacatgctcgacagatggacctctccggccggcgagctctgaattactttactatactaattcatcaccgtccgtatatatgtccgtttatgggaaatcttacccccttcataatttatctacttatcttttatcatgtcttatctttctcttttcttagcctatactacacacacttacttacaaaattcggagcatttgtgtggtctgtcgttcttttcccactcggtttccatttcgagagtgacgaggccctcctttttttcctgcacggcaaatttcttggatttgtccctcacgcacgtgtagctcttcacgcgtctgattccattctatttccatacggaaccaaactcattgtgatggacgcgcgtcttcttaatccctagaacatgcacccactttccatgtttcattttctccccaatttactgttaaaaacttgaatgggccttatagggacgattcggtccagaccaggttgcaagctcaagcctcatttttttctcaaacaaaccaagaaaggatataaaaagaggaggagctcgttccaagcaaatcgaacataatctttaggctgtaacagcagtggcgagctggtggtcacttggtaccttgtcaatcttattcctacctacctactctttccgtcctgaaaagagatgatttctagcgagaagagtttgtcccgtaaaaaggcgacttctacacaaaaacaagaagcattcaaccgctgctgattacgaagtgactgctcaatcggctcattaattagcatcgatgggtgagaaaaaaataaagacaactacgttcacacttgttcacacttgctggatgctagtactactccagagcactagtactactttgcagagaatcttggtttgattttacataactgtcaattaatggcagtactttacgagggtatttgggtctttagctacttgtgctaattttgccttggccttccaggagtcgcttctttctgagacggagggagtacttgttgatatgcgggcgtagtataagatctattatgtagtagatgagttcttagatgatcagaacatgagatggaccgataggcacatgggttgatgagatcaatcggtatatgtgctggtgacttcactggaatgtctggtactcaccatggccgagcgcgattgtgttcatcggatagtccgatgtccattggaaccgcacgccaatgagaaaagacaagccaatgagattgcctcggtttcggcataatttgattacgctgttaaggttttcacatggcgaatcgtagataagatctatgtaccccgtgacctttttagggcgctgccctaaaaaccgcggggggcggctccccctcgacccttagatgagatctattctggttgatcgccataaccacgggcacgactattcgaatagttttactctgatcataaataatcgtgcccgcgattatgggcgatcaaacagattcaccatgattagactcgtctataataatttgacttaatggaactggtttaatttaggtggttggttgggccttatcgcaacgtggtgtagcgttggacagtgatgattaatattgcttaattaactacaaaagttttacttaactacaaaagttttactgctttcaacttatgcttttaaatgctagctttatgcaaatgaacccctctagctctccttggttatatcctgcatcatactctcttccggtatgacttgctgagtacagtgggtagtagtcagtcttgctctgtctcccatcccatagttggagtatgcgtcagatggtggctactcggaggagcaggctttgtccgttccatcaaggatgcgtgtggaatggtgttgccccgctgttagcatcaagatctagaataagctcgcttttattttccgttgcatttatgtaagacttttatatgtgtgtaagacgtggatctgtatatcaactttgtcgtttgtgtaccctggctggtcctggacaggggtttaatgcacatcttactcggaattatattcgggaatttctggacgtagcatatgtgtaagtaggcttgcccgtcggatgggctggctatgcggttctgtagggaggactgttacaaatggtatcagagctgaccctcgtggttgcacatacgggtcaatgtgtgggcatatgaagcatggcacctgtgggctctgtgtgaggcacatggcatggcgtatggcgccggcactagacatacagacatgcgctaaagagggggtgtgttcctggacatttgcctatatacctgtgtagctacatgggtaagttgggccatggggacgtcgggtcctttgagggagggtgtatgtgacatcctggcccaattaggatttggcctgtgtggcccatgaatttagcaaggttgaaaccaatttataaggcatcttccctccaaccatgtcactctcaggttaacccttttacaggaagcgagaacgcaagtgtaagtggagtggtatatctgtcggatgaactgactacgtggttctggaggaagggctgttacaattgggccttcaatatactgtgtatcttgtagggagggattttacaattggggtttcaatatactgggtatcctgcgatacttgagagatacagtgattctaattggatctctaatgtggatgggatcaaaatcactagtggatatgtcttcaaaaaagctagtgctgttgtttcatagtggtcttgcaaacaaactattttgacgaggtcaaccatggaagcagagctgacagcactagatactgctactgttgaggtagaatggctgcgtgatctattgatggatctgcctatggttgaaaaagtgatgtattaattgatctgtctgtggttgaaaaaccgtgccagctattcttatgaactgtgacaatcaaacggtaattgtgaaagtgaacagttataaggataacatgaaatcatctaaacatgtgaaaagacaattgtagtctgtcaggaatttgagaaactccggggttataacattgaattacactgaaatagctagaaacctggcaaatccatctacgaagtaactatcacgaaatgtgatagacaatgcatcgaaggagatgagtttgaaacccatgtgagttatactatggcggtaacccaatctatatgatcggagatcccgtgaattagaacctgtgaagaacaagccattagtcaactggaggagagtaccaatctaaatcctctttaagtgaagatgcatgtactctcatgagctgcaaggcaggttggctatatgccttaatgagttctattagctttaattagcaaagatgctatcctgtagagcattcttaaaagaacacacctttgtgagcttgactattggttgtactcttgatattttaggtgaatcttctaggaagcttactaagagaccaatgagtatgacttatacactctacccgaggagcagtctactgacggtctagtaccagataagactctgtgtgaaacttgcttgcacaagacttgcaattcaaggcatagtccattgttcaagttgtgagtaagtgtagcttgaagttctaggtggatgttcaatcttaatcggtctccatcaacagttggtatataaacagtacattggaaaaaggcaaatctcagtaggattttgagatttggtggggaattattagaattaatagatgggtcttaacccattcgaagattaattctttggaaaatcacaaaagcccacctgggatggcatgcacggggactttagtaccacctttcatattctagaagaggaagacctccttataagggaggatactcgcctagccacttgaggcatgtgaggtggagagaacggggggaacacacacgcgctcgctcgcctggcctagcatggcggcacccgtgcacaacgtacgcgtcgaatggtccccaaaattggttcctcacccttgcacagatacgatctcctttcgcagttttgttttgctgcagaaatttcgaattcgttttttggaaacccttcgaataatccgatgcgtgaaacgacgtggagtccggataagttacacgagacttatccggttcggttacgcggagtgaagattgtgcaggtgccctgatcaagcgtcctaatatttctatataagttgagcggctgcctccacgcaatatacgtgaaatcaatctagggtttgcctcctcctctgtactgcgccgtcgctcatagtctactccatcctgctcgctgacgtgcaccggcaatcgggagagcaggtctccggaaccttcgccttcgatgtcttgcactgggagaaggcggcaataaggtttttggaaaatgctttgcgcgactgctccctgtttgtccacaatggctcatcttcctcttcgctggcgtgttgcgcgccatcgtcaatgcacggtaccctgagtccttcctgctgagcagccagttttccaaaaccctcggtatgcattcgacatattccgcatattcaatctgttcatactttactgtctagtttacatgtgtagatcgtatgatgtgattatgtcatttgcaatgtcatgatttatttatggaataaatgaaataattatgtgctaatattttcaacaatccaaaaaccttattataggcattgtggttttactatgactagtttttcccatgctctaaggccggataaattcatcggtgtgcacttcaagagatggaagatcagggttactctgtggttgatggctatgaaatgcttctagattaataatggcaaacctgaaggagttctcattgctgaaaagcagaaagaattcgagaagaccactactctctttgtgggatggattcgtagcgttcttatcgatcgtctagtcgaggtgtatatgcacatgactgacgctaaggagttgtgggatgcactgccaaattcggtgctactgatgctagcaatgatctgtacgtcatggagcagtttcatgactacaggatggttgacaaacgttttgtacttgagcaggctcatgaaatacatgccatggctaaggaactcgaactccttaagtgtgtcttactcgataaaattgtggccgggtgcattattgataaactacctccatcttagagaagttttggtactgcacttaaacacaagagacaggaatactccgttgagggatttatagcgtctcttgatgttgaggagaaagctcaggaaaaagacgtcgcgtctaagggcaatgatgggcagtctaatgccaatgttgtgcacaaggcccaaaacaagaacaaagagaaatataaacctcagcagaccatcaacttcaagcatcagaagaagaagaatataacaacaatctgaactagcatgagagaacttattttgtgctttttttacttcaaacattaacaacatgacctaaatactaacctacctatgccttaacctgctccaaccgagcacaagcccagctggtctaaccccatactcagagctatcgggttgcagcaaaagcagagccactagctttcactgattaccctaagtagttttgaacagtaacatggtcttcaaaacacaactttaacttcttgtttttataaaaatatttattaaaaagtaatatatgtatacttttataaaagtatttttcaagacaaatctatttatataacttttacattttcaaactcaacaacttgagagttattcatgatttatattcccaaggtttgaattaaacattgtcctaaacgacttcctttacgagtacggagcgagaactaaccaatatgcatatgacaaggaaaaatattatctgctcggtttcaaaaaaatatattatctgctatatgaaaaatataaatcaatatattatacgctatattgtttaaatgatttttttaaaaaagagttaaataaatatttttagacttcgatacggtcttcaacatgctactttgaccatttttcctgaaaagttataaaaaatgtctgcgtttagtttgttgctaaatttggtaaatatataaaaaaaatcctgtcaaaattttggtaatattactgacttactaaaattttggttttatccaaatttaatgaggtttattttgactgtctgaacagacctttaattataagagtgcgggctgcggcgtctactgtgctgggcaagcttaattaattagtggcatcgaacgatgctacgtcacgttcccactcccaccaagtcaaggatatatactctttttctcgtttcttttagaaacatgcaagggaggaaaagacaaataaatttctgagattcagaatttttattaattttgtaccttaaaaaattgataaaaagttaaatagcaaaacccaaaaaaataataatgccctcgtgatcgtacacatcccatccatctacccacggcctgtttagttggagggagtttttagaagggattgggagtttagagggatgagactattaagtgttttgtttggttgggagatatgggaactttggtgggatggggatgaggaattgaggaaggaactccctcctttttaatacctgggtaggggcaggtaattgggagggaattcctcctctattttatctaagcaaatctcagccatccgtttttattaatgatataatctctaactaaactccctatcaattttcatcacctctaccaaacaatgtattggaattaaaaatcgaattcctatcttaatctcatcatcaatttcctcgtataaacttccaatcccttttcatcaagttaccaaacaagccgccatatcaatctgatttgggtcaacgatgcaacaataattagcaagtggaagacaagtaattaaggaggcaggagcagcatggaaaaagaagaatagaagattactagatattgtactgctgagcgaagaggacagacaggtaagctagctaggcaatcaatcatattcgctctccaaaatgaagggatcgatcatctcacaaacaaaaacgtgagggatgaaggacaaggacaagaaataggtgaagctatctacttctcgatgcatctatgtacggaggcggcggtaacacggcggcggctgctgctgcttcttcttctcctggtcacctgcagctgcctgtctgcgagagagagaagcaatagcagcagcagcagcagcaggagagtggtgaggcatctcccggggttcgatggggcgctccccttcgagctggagaccgggtacgtggaggtggaccgcatcgccggcgtgcgcctcttctactacttcatccgctcggagagcagcccggccgacgatcccctcttgctctggctcaccggcgggccaggctgctcggccttctccggcctcgtctacgaggtcggacccctcaccttcgatgtccatggccatggacatggacaactgccaaggctcttgtacaagccggagtcgtggaccaaacgtaccaacgtcatcttcctcgactcccctgtcggaactggcttttcctacgctgacaccgacgccggattccgcaccggcgataccattgctgtccaccacattctcgtcttcctcaacaactggtttcaggaggtgcaccccgatttcctctccaatcctctatacatcgccggcgactcctactctgggatgattgtgccggctgtcaccttcggaatcgccacttcatcacccaaaccatctctcaatctcaaggtactagctacttttaaagatacaaataggagtacaacttactgaaactgataccctgccacatcgtcatcttcagggctaccttttgggcaatccagtcactgatcacaacttcgatgctccatccaaaattccatttgcccatgggatgggtctcatatctgaccaactgtatcaggtaattggcatccatatatcctacttcacgacggatttttaccagcatcttactatatactacgtacgtatataatcatgtatgatttctaggcatacaagaagagctgcagtgtcaagcacaacacccagcagcaaagcgttcagtgcacaaatactcttgatgccatagatgaggcatgtacttagtaggattacttactctgctttgttgttcagtttcagtgatgctgaccactaataatcaatggtctgtctcttgaattaattgtgcagtgtgtcaaggacatatacggaaatcacattctggagccttactgcacttttgcaagcccgcataatccgcgcatcgataagccattcacttcaggggtacggcagatactccaactccaagactttcacttgtctgagatttcttcagaatgcagagtcagtggaccctaattattttctttatcaaatcttcttcgagtactagctacccctcccgtcccaaaaaatctgaacagccttgtactaatatatcctatctaattaaaatatatcctccgtcccataatatacactcaaaatatcttataatatgggactgtgagagtatatgttagtgggtagtattggttagccgaccaaatcttaccatttggtatttcttcatgtcatgcagacggcagaatatacaatgtccagaatatgggccaacaatgatacagtaagagaggcccttggaattcaccaggtatatacacatctcttcatcatcattcaattgaacagtaatttgcatgcaggttcgatcattctgtcacacagcataacacaacacaatgcaatgatccactgtattcattctgcaatgcagggaacagttccttcgtggcaaagatgcaactacgacattctgtacacttatgacatcaaaagttcagtaagataccatctggatttgacaactagaggctacagaagcctaatttacagtggtgatcatgacatgattatccctttcatcggcacgcaagcctggattagatctctgaatttctctgtcgtggatgagtggagaccatggtttgtggatggacaagttgcagggtgaggacacacagtattcatcgataccatcaaattaattgagtacgtgtgcgagtactgtgtctgtctctgaccagatatattatccgtctgtcttatgtgcagatatataaggtcatactccaataacctcacattcgcaactgtcaaggtatgtgccagcgttttagcttccttcaagggatgcaacacattaatatcttggtacgcatgatctagggtctgtttagattgtagccaaaataaatattatcaagttttggcaatactaaaattctggtaagatggcaatattgtcaaaattttggcagaatttcttatgtattgaccaaatttggcaacaaactaaacgtagatattttttttataactttaaaaaaataatatggttgaaaatggcatcaaagtgaacaggccctcagtaactaaaaagagtattttggtgttaatttgtgtagggtggtggacatactgctccagaatacatgccaaagcaatgccttgctatgcttgcaaggtgggtttctggcaatcctctttgacgatggtgcatatatgtgtaagagaaaattccaggatggagatattacatcacaagaaatttatgattttgctaaaattgtggcgacatttttttccccatcacggttgaatgcttttctcttgggttgcggcggagactatactcgcgcgtgtattatatatgtctgtttcttcacgaagtgcatgaagatttgtcccatgtgtaagatctggagagtgagaacaaaacatggttcaatacagtgcaaatgatggatcgaagagcatactcctacacgtcaatgtaaatagacatgtaacattttattacgccgtcagtgtggcccccagttttgtacaccggaaatccaatgtgttttacgatatcattctctgaatcatcagtacttatttgtataaagctagatttcataattcattttacaaccctatgacttagcagttttaactgaaaacaatgttaagttgaaatcctcgattatcaacgagggttcatccaccttccctaagcttcacttcatccggtttacccttgcatccagttttccgtattcttcaccattccaaccttcccgcacattaggcagggtcacacaatccctcccaacactattcaaagcaagattaaaatttataaggctattcaagagtaatacaagtcccgacgcttaatcgcgagcatgactattcgaatatatttgtttactcacattgcaagggatgtacgcttttaatcccgcactccgtgacgcacacaacacatgagacttgtcacaaccctatttttcagtcacccttgcattgcgacacccactgcaaggactcctggtatttcgaggtactaggaggattacacaatatatatacttaggtgccttttagatttttgtcatggcatttgatcaatcgaacacatcttccatcacaaacagtaacaactgcagaactaccatgacaggtgctgccccactcaggttacctaatgcatcaggtctatacccactcaagcaatggaatcatactctgattgtttcctgcgtagcttcttgactcggtcctttacttactacaatcgatggcttgttgtttcatagaaccacacatattgtatccatgtcgtcccagtcgaaattattttgttttattaagtttttggtatttgcaaaagtcttatgttgcgggtgatgctcatgtctccacccgtctttcaacaatcactcacatcgactgaccaacacattcacatccatataccaaacatggagtgtaaaattgtctaaacaagcaatactaagttatgttaataattgaccatgtaataataaatagactaagacagcaaggaatatgaataataattttaaggtggctcagaatcaagtttaggtacgaactttataactactccctccgttgcatgttataagactttctagcattgcctatattcatatatatgctaatgaatctagacacacatatatgtctagattcattagcatatatatgatgtgggaaatcctagaaagtcttataatatgaaacagatgaagtagcatgcaactttatttgcaatcaatacatctattaacttattaaaggaatagaaaaaggagcctccacgttcgctctcacgatctagaaattctcatattaatcggagaaaaagaaaaatagagttcatatagaaatacaatttagaaataattgaaattcgaaggaatattggaagagaagactagagtccatatagaaatacaattaagaaataatggaaatttggaattaaaaataaggaatattagaagtagagtatagagtccatatagaaatacaattaagaaataatagaaattcggaattaaaaatgcggaatattaaaagtagagtatagagtccatgtagaaagccattaagaaataatagaaattcggaattaaagataaggaatattagaagtagagtatagagtccatatagaaatttaaaactaactcaaattccaaataaacataataaaattaacgtagagtttagagttcatataaaactacaatttgcaaataaccaaaattcgaaattaaaagaaaatatgggaagaagagtctaaagtcaatataggaatacaatttagaaataactgaaattcgaaattaaaaattaaagaatattgaaagatgagtttagagttcacatagaaatacaattagaaataataaaaattcagaattaaaaataaataatataggaagaagagcctagagtctatatagaaatacaattgacaaataacgaaaatttggaattcaaaaaagaaatattgaaagacgagtctagagtcgaatataatttacaaataactaaaatttaatattaaaaataattaataactaacacgtatataaaatacaatataaaaattacacattagtagtttcataaagttaatacaaaatttaaaattatgttgtcattttaatatatttgaataatacattgagaaaacatgtatgttattatatgagagaaaatataatgattttagctgcacaatctgcgcaggtcaacatactagtttataaaaatatgatcaacatgctaaatgaggggagcgtagagactttgaagtttgaacagctcttcgtcgattactgcggcttcgtctacgcaaacgtaaaacctgtttggcgaacaacgggtcaaaacccggttttcctattttaaagcaaaggggcaaaatcctagaaaaaggagtaaattttacaaaattacaaatactttgatcaaattatcgcaaaactacagatttaacaagatgtatcacaagactacagatttaacactaattttatcacaaaactacagatttaaggtaaaatatcacaaaactacagatttagtaataaagttatcacaaacatatatgtttaatgtcaatttaatcacaaaacttggatatttataactcaaacattacattagtgcaaaggatttaaatcctaaaatttatagttttgtgataattttattctaaattatgtagttttgtgataaatttgttgctaaatatgtagttctatgatatatgaccttaaatatgtagttttatgataatttagtcaaagtatatgtagttttatgaaatttactaataaaaaaaaggtaaatatatgtcatgatatctgcgctgagcctacgagagagatgccgacgaatttgatggtgcgtatcattttgaagcgtaatccactcatcatgtacatttgccttgctcagttgctgtcgtgagcccagcaggcaaatcagacaacgcaggatatgcagtgctctgctctgatctgatctgaactagtactagtataataaataagaaagataatttgtgtgtctctcgtggcaagaagtggagtactcctaggagagatcagtcgtcctggacgcagaagatggtgggcttgacgggctcggtgatctcgacggtgccctcgagcatcttggcgaccttgcccatggagggcctcatgtcggcgcggtcctgaaggcaccacatggccgtcttgaccatgcgctcgacggtggcgaggctggcggggtcgtcgtcgtaggcctcggcctggacgatgcgagggtcgatgatgtcgtcgatgcggcgctcgacgtagaccttctcgaaggcccacttggggaagtaccagtcctcgctgccgacggagtcctggcggaagccgtagttgcggcggccggagacgatctcaagcagaaccatgccgaagctgtagacgtcggccttggcggtgatgggctcgcggtggatgacccactcgggggccatgtacccgcgggtgccacggatgcgggacatggtcaccttctccttcttgctggtgagcttggacagcccgaagtcggacaccttggggcagaagtcgtcctccagaaggatgttctcaggcttgatgtcgcagtgcagaacccactcgaggcactcctcgtgaaggtacgcgatggcgcgcgccacgcccagagcgatgcggtagcgggtgtgcaggtcaagcagaggccgcttgttgctctcttcttcgtctccttgggtgccggtgcctggagcgaacaggtacttgtccagcgatccgtttggcacatactcgtacaccagcatcctctgctccttgtccgcgcagaacccccacatccgcaccaggttgaggtggtgcatccgcgcgatgatggtcacctccgcccagaactccgcctctcccccgcccaccccgtccagctgcttcactgccaccgcccgccggtccggcagctccccgcggtacaccttcccgtacgccccgcgccccaccaagtccgagaactccttggtcgccgccttcagctccgcgtacgagaaccgccgcggcccgccggcggggaggtactccagccccagcgtccgcgccatctccctgtactgcgagtacttgcgcaggaacgcccagaacgacagcacccccgccagcagctccaccgcgaacagcgccgtgatgatggcgatgttccggatcgtcgtccgcccctgcttcggcggcaccggcagcgccagccgcaccgggcacaccgtgtcgatcatcgtcgtcatccccgtgaagttgttcgggtcgttgttcgactccaccacccgcaggtaggtcgacatctccgtcgccggcgaccaatagccgtccaccagccgcgtgtagtgcaggcacgtccggtccccgcccaacttgtagccgaaggccacgcaagaggcgttggcccggcacttgctctggcagtccgccaggttctgcggcgtcaggctggtcatgtacttgccggggacggacactccggtgtcggcgccaccggagaaggaaacgaaatccatccgcacgaacttgtcgtcgttgcccttgccgctgtagttaagcttgggggcgcagcccaggccctgcgggcggtaccccggcgggcagacgcaggtggtgttgtcggcgccttgggggacgcagatgttggcctccccttggcaggcgccccggatggtgcagagctcctgcaccagctgccataccacccgccactgccctttcttggactgcaggctgtagaggcgcaggttgccgtcgtcgtcgagggtgaggcggcgcaggcggcgagtggagccctggtcggaggcgatgagctgggagggattgccaccagcgagttgcagcgtgccgtcggcggtgaggttgcgcagggcggtgttgccggtgatgttggcgtaggcggaggagccgtgctgcagggtgagggcgttgaacagctggaatctgccgttctgggactgcagggtgatgctggtggtggtggtggtgccgttgctaatgctggggatggcctgcgacgccatcagcgtgtccgtcggctccccgaagctggaccaggcgccgtggtcgaggctccccgagtcgttcagagacaaaggggcactcgtggagttgaagttgcgggaccaaagggtggtgctgttgccgttgtcgctccacgacagcttccccgccgcgtcgatggagagcacggaattggcgtcgccctccacggcggagtggtcgtcgttgtgggcgtaccatatgacgaccggcctggactcgttggcgttggcgctcacccagacggcgaaccagaacttggctggggaggagggggagggccggaatccggcggcgaagtccccgttgttggagacgagggtgcggttgctctcggcggggctccaattggtgtcgttggcggagaaggtccgcatctgctgggcctgggcctgggcggcggcgagggccggtaggaggaggaggaggaggacagcggccgccatggttgtgcttgctggattggggaagggaattggatttcttgcttttggatttgggatcgaaccgacgactctcctcacctcgagtctagtcaacaacactgtagccaatttgcccatcatgtaaattgaatattcattgccttgactgtggactggaatttcttcttcaatcgcgcgcgtaatccatgtgcctttcctgttgcccacggcggctaatcacaatcaatattaacgctttctcaaatactccctccgtttcaacatatttgacaccgttgactttttaatatatgtttaactatatgtatacataaaagtatatttagcaatgaatcacatgatacgaaaagaataactaattactttaatttttttttgaataagacgaatggtcaaacacgtactaaaaagtcaacggtgttaaatattttgaaacggagggaatataattactggagtactactaaacatttgtaatacaggtaaacagcgatatagtaatatattaactgcatctgcatgctttcgtccatccgtctgacttgcttccaaattcatgctactataactaacttaaacctctgttactctccatttttactgcaaaataattgccactcgctactccggtttggtggttacattattgagagagatgctctccgtggacttgtcatatagtactagtatgtgtgctgtgctgtgctgtgctgtgcgtggtctggtggtggcgatgaggacaatgctgcaggaagctagatttagacttggacacgaaaccgttgactttgatcggaccagtcagcattgctaagagcacccgcaatggtaaagtaaggtgctatctataaaacatgtacatctcagcaatagactagattaataagtaaaccatctcaatagtatgtctacataggtatctatagctctctaatacattgtctcgtttttctctatagactatctccaggttagtagatagctttgctctctctcttcatttaatctcttccaagtaggaaaatatgctgacatggatatcttatagagagcctatagataaccattgtgggtgccctaagcagccaacctgaccgctgtttcctgcctccttgcgtgatctcaatcatttcccctttgttaacactacatgtacgcttacattttacggttacccaaatttaccggtgaaataaaatcccaacaattctgaatgtttgggataggaagattagacagcatacgctcagagaaattagatgggtggtccgcgcaattacgctgctagcatatatataaaattatatatttttaatatgattttacttaaaatttattaaatagttgtctcattgtcttaagattttgaaagaccaaaacttagcatacttgtgtttctaattttatagtttttaaaagtcacaccagttactagcccttacttctgttatattattatttatttacttgctcgatcaaccactgtttctattcattctccttgaaacctttaaaatttggatataaaaacttatagtttttagagtttattgtcatgttgggcttcttttttataatttctagaagtttcgtcaaacgctaccattataatcctctacgaccgtccactgcatcttctctttattgtcattactattttaatagtctaacataattatcgtttacgttcatttttttactttctataagttccgccaaaacgtcagcgactttgttattgtcctcccctacgattcacacgttgccgcccttctttaatgtcattgagattttaaaattaaacatgattatcattggtttttttttactttttagaagcccaaacctttaaaaatggaccttatagtttttacagttttttgtctcgttgggtttctttttttttacaatatttagaagcccgaacctttaaaaaatcctatcaaacgctaccactatactcttctacgacccgttcgccgcatactctttattatcattgggattataaaaatcgaacataactattgttggaattcatattttaatttcaagaagacccaccaactattggtggctctgccattgtactcctatacgacccgcccgctgcctcatattttaattgagattttaaaaataaaatatgattatcattggggtttattttttttactttctagaagtcccgccaaccgccttgaccgattgcttcatgacctgtccatcgtccttccttttaatcgtcatttggaatttctatttggtgttttattaatagtttttagatgtcccatcaaccgccaccactctgctcctgtataggcttgctacttaattaatctcatcatgtgtttcagatggtcttttctttcaataatctttattttttatcactaattttagttataaattgtatccctagttgaaatctttttttctttttctcattttagaatttagtttatttacatattgtgttcttttgatatttttatttttttatttttaatttcagttgttttaaaattgtattcctactttaactctctttttaatttgcctaattttggatttcattttatttttttattccgaattttaattaatctactattgggttcttatacatactcttattttaatattgcttatatttaattccgaatttcagctaattttaaattgtactcctactttaactcttcttttcttttccttttttctaattttgattttttttatttttatttcgaattttaattaatctcgtattggattcttttatggactcttctttcaatatttcttttttaattccaaattttagttatttttaaattgtattcctacttggactctttttttttctaatttcggattttattttatttttattgctaattttgattaatctcgtattactttcctatttagactttttattcaatattgcttacttttaatttcgaatctcagctacttttagattatatttctacttggactcttcttttctttttctcgaattaatgttggaatttctagcctccacagcgaacgttgtgcctcctttcaaggtttgctaatttcagattttattttatttttattccgaattttgattaatctcgtattactttcctatttggactcttttttcaatattgcttacttttaattccgaatttcagctatttttagattatatttttacttggacttttcttttctttttctccaattaacatgggaatttctagcccgcacagcgaacttagtgcctcctttcaaggctgttttaataatataatagatagataaaaatagagagcagaccaaatgagcctaaatcgaattgcgtgaaaaaaacgaagaggaagtccaactcagcagataaggcctggcttagtttcctaaaaatatcacaacgaatctttgacacatgcatagagcattaaatatagattaaaaaactaattgtatagttagaggggaaatcatgagacgaattttttttatcctaattagtccataattagccataagtgctacagtaacccacatatgctaatgacggattaattaggctaaaaagattcgtctcgcggtttccagacgagttatgaaattagtttttttaatcgtgtccaaaaaccccttctaatatccggtcaaacatgtgtgtaacacaaaagtattcttttcgtgaactaaatgggccctaaaaacatcatttcttgtatatggcccaaaaaaagatgattaagagtttttcttacaacgcacgggtaaatataatttgtagcatgcatcgaagtataaccaatcaatcgaccacggcagcgtaaggatacacagaagaaaaaggtaagccgatggatcgagataattaataaagaaaggctaataatgactattttcagtttttccaccacacaaaagcgttgttacgggtgaaatcaattttaatctttcctattaatccactcaaatgtgtcattaggagaaatgtgtgggccccatcgggagaagaaatatctcctccggctcggctcggctcgattctaaaggtgccggtttttctgaaaaccagcccctttaattaatataggtgtcatttcattaaaaaaccgacatctataattaattaatggtgtcgttttactttaaaaaatcgacacctttagtataggtggttttttttacagaatcgacacctataataaaggtgtcggttttttatattttcggaccgtagaggtgggaaaatgcttataggtaccggttttaacacttccggtatctattgtgctaacatctatttgatattttgtagcaatggtacaaagagccatagaatgagtggggcctaacaattgtagcccacagtcatataacagagcaatcaaagatttcaagacacgtacgcacgtagttagtaattagtagttggacgataagttagaataaaagaaagccaaatctatatctctactattataaaaattaaagatgtttttgccggcactttggtacgttatccgtgtaagagtcggtttttaagttcgttcgcttttggaaatacggatatctatttgagtcaggtttctagattgttcgctttgggaaatacataaggagtcgtataagaaatctctttaaaaaaaactcgtatactaacttgagatgattggactcctaattgtagttcatgattttctagaaaaatacatatccaagcgaattctcacagtaaatttcacattaactaaaccgtataacaataataaaatttaaataaccttcacccgttgcaacgcatgggtattctttatagtctatctaactaaaaaatacgtaaggtttccataaaaaaatttccgtctgttttttttccgattcagtttttcccgtgatttttcgctgttttcttttttttccgattctttttttcgtgttttttgtccgcctcttttttttctgtccctttttttttatttcttcgtttcttttttccatccggctttttttctgcctcattttcatccgctcttttttcgttcgttttttatctaacccctagcgtcgctgccacgttaatctgggttcagggtttaggttcctccccatacattccctcctccaattgactgaaaaaagattcttcactactccctcattattttccccactattgtttctttcaattccgctttaatttaccagatctaatctccatttaaaagtcaccatgtaatctccattaaaagttcatttttatcctgaattttatggattcgtttcgattttgataaaaacgaaaatagtacgagtgtatcataagtccacaatcaattttgggagatcgagaaaaattcaatctggggaggatcggttctaacattgtatggtgacgaaaatatctttctagagattgaagacggcagtcgcatattgatggggaggatctgtctttcagagattgaagacgacagtcacatattgatggggaggatcggttctaggatggtttggacacgagattgtcttccagagattgaagacatcagtcgattaggcgagctaggcttacggctttacttgtaggctagccaaagagaggcaagccaaacagacggaggtaacaggttagactgggactgaaaaggaaatgagtttttcctcagaataaaaagtataatgtaaaaaatgtttttacccgttgcaacaaatggacattttttctaggtacttactaattaagcattgatttttcttttgatttttcgcaattttgttttctaatttttcaagccttgacgaggcattgaacctcccggtcccagcccgacgccagggctaccggccgctcccagatctcatttgaagcattgagcagttaggtctaaccacacggaactttccccgatgtgaagaggattggaaaaataggaagagggcagcctccagcgacaggaagttcactttagatctcttaaatcgtcgcctggtttttgtccttattcgaaaaaccagatacaactcatcacttaacttacaaaaccgtgcaaacgagattcctcgatattattgtctctggttttgactaacgtggcgtctttaaccatgtcttcatcacacgtggtattgacgtggcgcttacgtggctatttgatgaaaaaaaaataaaaggaacaaaataaaaatttggaaataaaacaaaatatacggacgcacatgtcagaataaaaaatagtgagacccacctcctacacctcaccctcttcccctctcttccaatcctctgcctccatcctccatcctcccggcgacaagcacggcggtacctagctgtcgtccgcgctgagatcgtgcatgagctctcctcctccgcttcgtcctctcccccgttactccaatcctaggtaccaactccaccgccacatctcgccgccgcttgcagcctcgcccccaaatccagcgccactcactccccactcacacgctcctcatgttcttcttctatcgctagagagcaacagcaaggacctctccatccatcggtggctttttacccataggaggggagaggggaggcctggccattgacgctgtcgcgatggagcgcatggccaagcactgctgggatctgtgggacgcaggcagcgacgccggcgttagatccagctggccggtagctcatgccagtggcggaggggtcaagccgtcgtgggaggaacaggtgttctcgcaggacgcagcggagcacctcggcggctgcttgtggccgccgtgctcctacatgtgcagcttctgccggtgggagttccggttagcaggcgcttggtaggcacatgaacgtgcattgctatgaccgtgctcccctccggcagtgcgacgacgacatcgacccgattcaaccaccaatcggcagcatctgcgagccgcctactcttttaccgtcaacggtagtagcagcagcagagtatcctttttagataatggaagtttttatttaactcagtcaattacatcgagatgatacaattatcctaagaacactctcggcctatgcatatctcctgctacaaatatccagccctaaatccacaactgctcatcatcatcatcataatcagcagctgcagggcactaattcttcgtctctgaattcctgcataacaaccatcatcaagaagagcaggaacaagacaagatgaagagaggggagattggaagagctgaggaagatgaggaggggagtaagaatgacatgtggccccaccattttaaattactatctttttgtaactaacgtgtgggtccatgactattatttttcaaatcgaattgtcatgtaagcgccacgtcaatgccacatgggacgaagatctagtcaaattagtcacataggcgccacatcagccaaaaccgccgtccaaaccaccgagggacctcatctgcactggttttgatagttgagggacccgttatatctggttttgcggttgaaggacgaaaatcggattcgttgacaagttaagggacctcaaatgaacttattccctagggacatgtcacgcccagaaattcccgaatagaatttcaagcagaatgtgcattaaaatccccgtccaggaccagccggggtacacaaacgacaatgttgacattcagatccacgtcttacaaacatcataaaagtcttacataaatgcagcggaaagaaagagagacaacaggagctaagccttgactagaaccgcagcgggatcaccactccacaggcatcctcgacggcacggacgaagcctactcctcggagaaaccttcatctgacacatactcgaactctggggttgggaaaagtagagcaagactgagtactacccactgtactcagcaagtcataccggaatagaggcatgatgcagggaatcatcaaagaagagctaaagtggttcatttgcataaagcgagcatttataaacagaagttgaaagattaaacagttgtaataattaattaatattaactatccactgtccaacgctatcccacgttgcaacaggcccaaccatccacctaaactatccagtttcaaaagattacactagggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacggcatatcagaaagaggccgtgacaggacccttcgcataaccccctctagccaagcacaccacacctcaggtttcacacccactcctcgcaaggcagcgggcagtcccctctcgtgcctaggtgaatccggaagcgacagaggccgtcgcagggcccgccccgctccatcacgcccacccttgcctggatgcgtcgactagaggaaagctatactacaagcccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaagcggtgtcactaatccaacaaaaccattagaaccaacagtctaaacgttaataggattttccccaatgtgaactagttgaactaagcatggctaagcaatccctagtcctaactctaatcatgttagaaccccaagttgacaaagaaacaaggtacaacaatagcatggctacgacaataggtaaacaacccatagtaacattataaaacaatgcaatatttgacagaaagcaatagagcatttgcaatataggatcaacatattcaagtgacaagcatgacttgccttgctctgctgctggaggaacctcggcgactatttcgaagtacaccggagcgtcggaggaaccggaatgtagcgacatacaaagcaaacattgcaaacaggctataagactactgaaacagagaacgaaaccatttttaatggactctacacatttttcttgatttactgagacttgaatgggcttaaacggagctcggatgaattagttatgaattttagaagattcactgtgtttattactatacaagaaaaaccttaaattattcattgggcaatatattccagggctgacgtcatcaaggcggggcggcgccggcaagcggggcccactggtcagcggctcaggggagagcggttcaccgtgg

SEQ ID NO: 63384 - DNA, 8055 bp, Oryza sativa
gcatattaacacattgatgactacatcgccaaccaactgaactactatcaagtatcatctggcacttaagatacaatattgttcacatccttcgatgccatttgatcaagtgatcattatctacaaaagaattaattgatcatctgtccaattctgaattactgattttcttctccaggggtgagaagaccttctgcagtcacgaatgctgctaccaagagatgttcctttttgtaacttgtcaattcaattagccaggataatttccaaatgtccgatcaacatgatctgcctcaagccctcttgcttttcttgttcttgtagagtgattgttgaccaattaggagctagtgttcagagttgagattaaaatcctcattgtgagatgcacatcaattctggttgtctgaaatgttgcagtttttatatgactgttatatcaatataagtaaagctgccaggatgttcatcagtttgtactgctcccacacaaatgcatgctggatacgaaaacggactggcaggtggcagcccccctctgtatacagtactacatacgaaacgggaaaaaagagaggggggtttttaaggataggaggactggtccctgacaggcagaggcctagcccatcttatcagatgggccgccaacctcctgaatcgtccttctcaatgcattgcatacaggctttgcagtatgcagctcaggaatctcgcaaatcttagactgaagaactaaaaacttagagtaaatttcacaaaactacaggtattttggtcaaattatcagaaaactacagatttaacatgatgtatcacaaaactacagatttaacactaattttatcacggaactacagatttaagataaaatatctcaaaactatagattttagtaacaaagatatcacaaaactacatgtttaatatcaattaatcataaaacttgaacattttcaactcaaacataatattagtgcaacgaatttaacccccaaaatatgtagttttgtgataattttattattaaatatgtagttttgtgataattagtcttaaacctgtagttttgtgataaatttgttgctaaatctgtagttttgtgatatatatccttaaatctgtagttttgtgataatttggtcaaagtatatgtagttttgtgaaatttattcaaaaacttaaaaagatttggccctgtagatacaagaaatgaagtaataaaaaggttagaaatgcaaggatactaaaaggtcattagctgaccatcggaatcccaacaagcaaaccatacagactatttatctgccgaaagttaacagacctgaataggctttgattgaacatatgggaatatggtcatcaactgccttgacaacgccacataccagtaaaccttccaccagcaaatcttccaaatccactgtcttatacaccattttagctgcaccgacaaagagaaatgaataaaaacatgcttcagcaatacgatgaacatgaatgccaaacactacaaaataagcatgcaggctgcacaagatctttcaataattaaagcttaaggttataacacaaactagcaagtgctaattagctacctgacatataacttgaggcaaaatcatcgattaccgcaacaccacaatgtagttcggatgctatttcgatgacaccttccgggttgccattaaaaaacagcacaaccagttgcttcatgaagtaatatactgctacccgataaaaatacggttgaactgtcaccaattgccttactgccagcttttgctgatttctccagtccagatttggttaaaacacatagctgtcatcttatgttatattgaatctgcaaatggacaaaccagacattataacaatagatagcaccgatgaaaaaaatttatatgtttgtccccaaagttgcctttgtgggtttgcatgtcacagcctagcgataagtgttagctcgtgattaaaagttccaggaaccaacattcatagctattgtagcaatatatggggataagaaagtttttttgccgatacatatatataggagatatcaggtcatatgtcttcagttacgatcataaatgatttacatgagctataaccacgattatctagttccgctagatctgtcccctgaacaatcttgcatagtttcttttggatctgctaaagtacaagcctgagaatcacagttagatgtatgatgtttacatgagaaaagtagcatagtgtccatatttcagaaggtttaaaagaatagtaccttgtcgctttgctaccttggtgtgtgtgccatggtctggttcagaaggtgcaaagtactgcatgcatcaagccgaggtgttcatgaaatctgtgttcaaccatccaccagcttagagccttagatccattaagagtagatcggaccttcaagcttgttggtatgtccatgtaggcaacacaagcaagaaagcatctagaagctcaagttttcgaaaaacttagttgttcttcaacttaagcacacttatcagcctttcagaaacatctctatcgagaatgataccattctccatcatatactcccatatctcataagccaacgtagctttcccttcatccagaagaccactgattatatacctaaatgtcaagttatctggttctaccccttttgtcctcatttccttaaaaaggtcaagggcctcaacggctcttgagctttttccaagccagtatattagtgtgttaaaagtaactgtatctggtgatacttctttctgagtcatctgccaaaatattttctgtgcatgtttgaaatgaccaaccttacataaattatgcagcataatattgtacacatttacattaggaacaattttggtgtttagcatctggtcaaaaagctcttcggctagatttgagtatcctatgccaaaaagaccattaatcagaatcccataagtcacagcatcagcttgaattcccttgtaacccatttccttgaataggttcagtgcagaatttaccttttttgccctgcaaaatgcatcgatgagtatgttgcaggatacaatatcgcagaacccaccaacttccatatgatcagaaacgaaagcaaatgctttgtccagttgatgagctttgcatagcccttttaacagtatattatagctgtacctgtcaggattcaccccactcatttccatctttctgatcaaattttcagctttatctgtcatacctatactacagtaatggtttagaaggatattgtacgtcacaacatctggttcacaaccatttctctgcatgaaggacacagttttgtaggctttctctatgctgccagctctccagaaaccacttattagggcattataaatcgaaacattaagttggatatccagagttagcatccttgatgctaattcaaaagcctcatcaaccttttgattcttgcacaaaccaaatatcaatgcaccacaagctacaacatcaggtttaagtcccctcctcaccatttcttcccagagcccaactgcttctgagaacctcctgtgatcgcataaacagctaacaactgttgtgtaggtgacgacatctgggccggttcctttcatggtcatcttctctaccatttgcaaagcatcatataacctattgtgaccacacaaatagtgaacgtatatgttacatgcccaaaaatctgggaagcacccaaatttatccatgtcagtcagaagctcctctacaagctcaatcctgtttgattgacacaatgcagtaatccaccttgagtaagtgaatggagttaaacaaaatccttttgcaagtgccatgttgtaatacttctcgaccaaatcaaagcaacagttcttaatcataacacctatgaacctgttgtaatcgacaccgaactcacgacaacctgatgtgaccatctcatcaaatgtttctatgacggaatcaaacttgccagctcgggcatagccagccaaaagtacccgatagagagagcgatgaaatgctaccccctggctccttactcttcccaggaactccgaaagcagggcgaaattgtcatctacaaacagcaagcttatgatgtacgctatggcaaaattgttatgataaaatccagggcgtgactctgcccaccagtaaaaccgaactgccatccccgagtccaacaagccacggagcaccttgttgacgacgaaaggatccagctcgacatggaggccctccagctccagctcaaccgactctgaccacctcccacactccagcgctcgcccaataataacgcaactggtctctgtgcgaactggccggaaaagctcagacaaccggcagtgagcccctggattggcattgtcgacgccggtgctgaacctcgctacctgcctcgatgaaacgatccaggaaacggtgtggagcacgcagagcctggtaatgagagacgacgacccagatggtcgtgtggccaagaacataacagattgacctcctcaggggagttgtgtcgaacaccttgccggcagtcaggcgctggctgcgggccaaggcagacgagctgactggacgcgaccacgccggttgtttcgctgggcggagctgaagacgaggaggatgcaggtggagaaggtaccggattgaagcggcaggcgaggtaggatgcgaggcgcaggtggtgggagcgcgcggatcggagcagagggaggagaagcgaggagctaggttagatagaggatggcgcgaccgagcggcaagcgcatggggaggaatggggcgggggggatggtgcggaagacggatggggatcgagcgggaggtcagccggcggcgagacggcggcggcggcggctggcgacgagacgacgagggggggggggtgagatggcaaggcaacggctccaccttcgagatgggctgtgctgtactgggcgttatctaggaggaagcccatgagagaaactacggcccatatggatggatcatagtgggccacatgttgacggcccatatagatcaaagcagccgcagaaaagcccaatgtacgccgaggagccggtggtcgcacccatctatccatggctcgcgaccaccgtggatggatatatggatggtctcaatcgggaataattagggtcgtttgctaattacacccttaattaactaattgggatttcccttaattattcttttgggctacaagcctacaatacaatacataatactaccaccagccaatcgcccaatcagtacgaattactgtttttttgttcttttcaagatgaaaacaacaagtgtagggagttcggagacaggattttttttttctaaacaaggcttaatgggatctcgaaaattaaatcgaagagggaaaaggagggagagggacgaaattttactctaccgatccaaatgatcggggtttgtcttttttttttaaacgagatttaggggttcggcgatgaaatatccgaccccttctacggccgaaatttcttgttttttagaacgatgcatgcacagcacagtgcggcgcgcgcgcatgagcttttgaacgattcatgcatgcacgcacatacgctcactggtctagggaaaaaaagaagcagctcacatcagatgagaatccagagaatcttagctactctagagattaaaaagaacagcaatatacaactaatatcctttttttaaaggaattactaaatatccttgaagattatcatggatatgcatgcacagcgcatgatgattcagaaagaaaaatgaaataaaatcagaaaggaaacaaagctaggcagtcaggattcgcgcgttgttgttgggtgaagcagagacagcagcaaagcgcgacgacacacgtttgtctaatccgattcctttgcccattactactagagtatttcattatactagtgctgctgaatctagacaaagtatactagtggtagtacatctatcagtgattcagtagtagtaatgcagtttcacttttaccccccgggataactagcaacgttagtttaccaacgaagatcatgctatactctctctctctctctttttctttttttggttacaaatcctgcatgttgaaacagtcatacagaagatcattacaatactgtataattaagaagagaagatccaagattgaatttgactaatagtaggaagaggaaccggcaacgattgcggcatgcatacagcttctagacaaattaagtggcttctctgaatctatgatgatcatgttcatccttgtccatctgcttgcttgggtggtcactggtcagacaagctaatttgctgccttttagtattacgactaatcaaaaagctactacagcagcctgcctactcacgcattttgcacctgatgttccattccacgatcgatctcttatactaagttgttggttttgattaattgtcagctctctcatcttcttgtgatcttgtctcactgtcggacttgaccacaacaacaatacaattatagcgatcgatcgagatgtgaccccttattttggtcagagcatctcctgtttcgttcttcgatatattcctgtctcctaatttcttgttcttctccaacccactaacactacgacttaaagattcatttgcatcatgtctagtgtgttttactggtcttggagtggcactaattgggttcgtttactgccagttgttgtggatggactgaagattttattacttctagggcatcaaactttcttctccgagtcaaagctaattctatctatcctcgttgagatctgttcaaattaagtggaatgttctatatatgcatcttaaagacttgtgtcaacgcatggtctcaattctcttaaactttattaccactgttaaaacttggaaaaatcatccaaggaaaccctaaattactactactgctactaatgtcagggttattgctcggtcactacggctgtcagtctgaattctgcatactactacacttgttgagctaactacccctccactgattatgctgctaaatcatctcaaagtcaatcaatttcttctagaagatgatgctccttgtaatacgtccttgtctgcaaggacctcgcattgaaactagcaaccccctgcaacaactcatttcttggcataccaaataaacaaacacatcctgaaacgaactcatttcagtgtcgtttttatgccatcactcacctaacctagctcgcacatcaaacgaggactgcaaagtcaaggccctgtcctgaattgctgtactaaattcaagaaagcgccaagcaaaccatttctcagccatatacaagtctcatatatcatgcaaccagcagcattatttgtctttgtgaaaatgaaaaaaagggaaaaaggtcctggcttgcatcatcatcacttaaattttgactcgagaaaggaagtttgaatattgcaatagctttgcaatttgcattcgactgcactgcactttgttggctgccttcttttttctctgaattcagttttgtcatcagtgatcagctagcctagtcaccaaatcgagtgtttgcgtcggagtggtgcttgtggcctagtatttaactgtacgctggacatgacccttatctacgcatttgaacattgaagggtctaaagattttttaaagcaatttcagtcaaagacgcttcaacttggaagcagaccagtgttactaaaattccatcgcccatcatttccatgccgcggtaatggcgctactcagatatttggaggagcaagttgttacctcattgccattgaaattttgtgtctgattaacaattaatcaaactgcaactaacttgactagtgtcttcatctgctgaccaatacagtacaaacttggttcctgctgggatgatacatttcacttgtagtatttcagtgaaaccatcaattgtaaccctgaaactgctgcttttttcagatagaaaacagtattggtcagcacctgaagcactaagctgcttaaggtttacaaacattgacaaccaaaaaaaaaaaaagctgctgctttt

SEQ ID NO: 63385 - DNA, 51003 bp, Oryza sativa
  unsure (1)..(51003): unsure at all n locations
cttcagaaggctagtttcataataaaaactactacctctgtgccataatacaactacttttgccatttcttgaggggattaaggttgaagagagaaatggttgtgattggttgagatgagggagtaggtgaagaaattaaaattgggatggttgtgattggttgaggtggggaagtaggcgactaggcggagaagtagtagtattttgggacaaatgtcaaatgccaaaggtagttgtaacattggatgaagggagtaccaagttcaaatcatagaaagtatcaatatacagccaattcataacagctcaaaagcctcttaaattttggccagtagacacggtatggatcaaaggattcatccactgaattaatgccaaggattatgtagcatttcaatatattagcacaactcatacatatatgagcacacaagtatgcagatgcacgtggttatgacagaatgatggagatgaaggctacaacattcagaaaatggtgatgagttgttcctctcaaaccgctcctctcttctttgaagacataatttccatttgctgaaatatatacaaatattgccatcacagcaatatgaaaatatgcgtaaaactaaatccttgattatttaaggtagcttgtttcatacaagcatatgataaaaaggaaacatcgttttctaaaaaaataaaaaataaatttcatgatatataatctacacagcagaagcaactggaactaaacgacagactaacctcaaaaaatgtatttccgccgcttcttattacttggacaagataaccctcttcattgccttcttcattcaatcttacagaaccaacaacaatactgtcatcgcgcacccacccaatcgaatccactgataaaaagaaaacattaataacaaatcaaaatgatcacctacttaacacagtccaatgcatttgactgtgtgcctgcaatgatggcaatagaataataaaaaaatgaataagatgaccttgaggaaaagagcataaacttcatagagcatggaacaaatcttgaaacccatgttcaccccattagtcatttttattctataagtggcgatcatatttgtgggttgtgtttttctcacatatttttggaaaataagaaacgggtatgtttagcatgtctgtgtactgtgacgctaagagtaacaaaccatgtgctgctcatgaagtttaggcctgagtaacaagcttacttgtttcatttaccacagaatagaaaacaattttacgagttttacgcactaggacgtagtgagccaatcaatatgtcctagtgtgtaatagtgctaatagtgctaccaaattaagcctggtgatgattgtatctgttctaatagtgctaccataaaccatttcgtttaaaaatgtgtgaataataataactgcgaagaacttggagcaattcaataattcatcctgtaactggggaatggagatacaggccacaaaagaaaaactgaatggtgcttacctttgatgctagcatcatctgaatcactatcatcagaccatagctggaacaagaggggcatgcaacatatttccttaaaatctgatgataatatgttaagtgtattcttttttgaaagaacaatgtgagtcccttccttgcagcagtcaactgtatacatttcaaaacgatgggagaattcagttcagaaactagtatggtggtgatggttaacttcaattacaacaatgaatcattgatcaagaaatatgctatgctagcacataatggccaaggagtgtgctaatgactaaaggcaggaatgcgccaaagataagtactcaatatggcatcatcctttttatacagcccacaacaaaaatcaatctagtttgtctagctgtcttctgtaaagactaagcattatagaaaaaagatgactcatagaaacaaagatctgtcgaatgaacttgcaatacccacagagagatatatgttgcaaatgaacgatgttcttgtaattttcattcacaataatataggctatagcatcaataaattaatggttcttaccatctatgatccaaatatataccatttacaaaccaatgcatgtttaacaactgtacagatgcatttctaaaacaaaactacaaaaaggatcctagaacatgatctcctatccaaaacagtaacacgacgaaataaggttttcaagtattgaacttcacaacagccaataacaaataaaatttactttataaggtgtgaatattgaatatttgaaatatattggtgtatgctatatctcacatctgcttcaagaaagtttcactggaatttgtaacagttagtcattgcataacattgtgcctcaaatttattaggaatagaagaagccacaaaccagcatcaacattttccattatgtccttcagaccttcccccagacttccttgagacagcaacccgtctttcgagagtacaataaaggctttggaagcatgatttagccacttgaaatctttcacagtgctggatccttccaaggtacatgatgacagtggttccacatcctatgtagcataattgtgaatagcatgagtagaagatacatgagcaaaattactagatgtataagagatccacgaggtcaaagtgcaaatagacatgggatactgaaaacattcactgactataggtcattatcgcataaacatttctgtcagatattgttatgtaaaatgcagctcagtaggatatatattaaaaaaaacaattctccggttctaataagttgtgctggccctgtggttgaaatttatcatcgacatgagggaaggagatgagataaccttgtctgtgagcagggaagaagccgagaagaagtggatcacactgcctgcgcaggcagcaagcaccgattcatcacgggagagttcgaggagagagaccccggggagagggatgtccgcgacgcagcagtcccgtgcgcagcgggtggtcgacttgcccttctcgcgcgcctccttgctggcctcgatcaacgccttggtcgtcgcagccataaaccctggaaacacgaggggaaacccgaagcggtgagatcgagatgggaatgccctggtccgtcgcgacttctccgtggcttaccgttggggtgggcaaggaagaccgcggcccggcggttggagacggcgagcgggcgcgagggaggcgactggaggtcgaagagcgggagcggcgaggaggtggtagggaggagggggatggggtcgccggcgaggcggaagacgaagtcggtggtgccgtcctcctcgccctcgacctcgtcggagaggtccagctcccgcggcggcgccatggccccccaccggtggtcggaggagcctagggttttgggcgggaagcgggacggagacggcgcggcggcgagggagcaatagcaaatggggtttcgtgaagcgagagcgctagtagcggaggccttggcgtggagtgtaagcagagcccagcagcgtggccggcgggcgggcgcacgcggcggaggggagagggagaggcggaggcggccgcttcgcttgccggcggtgatggtggtggcgctgaatacatgggctcttgtcgttgccccgtgggcttaattgggccttctactgggccgtcacatatattaatttggacttctttttattgggcttgaccttgacggtgagtaagaacagaaggcgcatgannnnnnnnnnnnnnnnnnnnaggcgagaaaattccggcgatgtcgcgacggtgacacggcgaccgaacacaaagatatcgccggcaaactcacgcaagcaccgcgcgaccgacgaacggcaggcggaaccgcgcgaacagtcgctgcttccttttcgtctccacctagcgacgtggagcaacgccatacacacgctcccatccgcacgcgcatttccagccttactactctctcgcaccatcgtcttccatccgcccatctacctccctcctccgtccaccctaactacggcgggtcgccggccatgctcgcgttcgcggtcatcgtctcgccttccgcgtggccgagagccgtctcctcagctttcgcggcggccgtcttcgcgttcctggacgtcgtcgacgtgctcctctgcttcgtgtacggcttcctcgacgccgtcttcgaggacagcccggtcagctgctactgccacgggagccacagcgcggcggcgctggacgacgacgacgaggtctccgacacattgtaccaccggcggagcgctctccgagacgcgctgatggggctcgtcagaggcaggagcggcggctcgccggagacggagacggagcggcgcaaggggcggagcccgaggtggtcggactgcggctgcgattcgtgccgcgcatggcagcgccacgacgacggccggctgcacttcgtcgccaaccaaccgccgccgccgccaaacggtctcaaccgcttccgttatttctgttacaatcctttcgctttgccgtgtcggcgacattaacgttcgcgagcttagcttttgcagatggagcagtgacaacgacgcagcagagtggagaagaagacgccatcttcatccacggcttcacctcgtcatcgtcgttctgggcaacagtgttccgcgaatcatccatcctcaacaactgcagaatgttggcggtcgatctcctcggcttcggcaagtctcccaagccggcaaactgcatgtacagactgaaagatcacgtcgagatgatcgagcggagcctcatcgatccactcaacctgagctccttccatcttgtcagccactccatgggctgcatcatcgccctcgcattggctgccaagcacccagaacgagtcagatcaatcacactgattgcaccggtaagtacagtacatatatatctgaagaagaatcagtgagagctctgaatttaattaaggaaatatcgatccgttgctttggttgtagccgtacttcggagcatgcgaagagaaggcgagccaagtggcactgaagagactggcggagaagaagctgtggccgccattgcagttcggatccgcagtgatgtcatggtacgagcacattgggaggactgtctgcttcttggtctgcaaaaatcacctgctctgggagcgcctcttcaggctcatcacaggaaagaggtaatcacatactaggattaattcagagttcagaaaacaaagctccttttaactaagattgattttaaacaaaaaaaaatgttgttgcatgctgcagggatgtggactttctgctgggtgatctgacgaagcacacgcaccactcggcgtggcacacgatgcacaacgtcatctgcggtggggccatgctgcaggacaggaacctggaggccgtcgaggcggccggcgtcccggtgcaggtgatccacggcggcgacgatcaggtggttccggcggagtgcggccgccacctcaaggccaagcttcccggcgccgagctccgactcatggaaggctgcgaccacaagacggtggttttcggcagggagaggggatttgctgaggagctcagagcattctggtccgcgtctcatcagaataagcagctagcagcatctgcatcagggtgggcaggttaacggatgttgattgttggtgtgtagaataatgtctgatatgaaatcatgatgtagcatagagaaattcagtccacactttgaaattactggtactacaatttttagagattaaagactagggtgaatccatcgacacgtttctttcgtcagaacagtgtccgtatattggaaaatccttttctagctcgtggattggcagattaatctttgaatttgcaaaggggacttgactgtttcagatataagcactcactcttgttttcatattataaatcataatataagtcggttttattttttttctattcaaattttatttaagtttaaccaagtttatagaaacaataccaaatgatttaatatttttttgatagtatatttgttttgtgttaaaaagaagttactatatctttctacaaatttagacaaacctaataaaaattgactagaaaaaaaagtaaaacaaattataatatgaaactgagggagttgatactatcgacgacatgaagtttggcctgacaaatgttcatacccccatgtggctgttaactgggagatatagattcctttcccgattgatcaaagcgcacagaaattaagtcgtgcatatagttcagctacatttattctccgatcgctttcatagcttttccttttctcatcgatcgagctgattgctgcttcgcgtacgcgcctagaaatacagcacgccccgtcgacccggggggttgcagatcgatcggaagctcaaacgcacgctagctactgcaggcacaccaagctgacgaacgacaacatgagcaccaccggaagggctctcctcgtcgctctcgccgccgttcttctcgtcaccggcgacgcactcctcgctcccgccggtggccaggagcagtacaccaaggcgccggcggaagcgcacaaaggctacagcatcgtgcctggtgagcatgcaattgaatccatcctagctatactcaaactcccaatgttatcaacttatcatgtgatgatgatcgtcatcgtatatcgtatatactgggccacgagaaatattgcataatgggcccttacagatcgcattacgggggcaggatgtcaaggcccatgaccacgagaaatttagcatactgggccgttgcagacctagctggtagcccatgccaagaaatcagtcctcgttagttttgtaccacatcgcctaccagagaggatagggagagcacccagggtataagaagaggggttcagcttcgtaccaactcatacctttctcggccttttggctaagatcaagtgtagtatctgttcttatcagtttaatatctgatatgtgggccatgtgcccacttcgatattaaatttattttttatgggggagggtccaccatagtggcttgccactggggccctcgcgtgtcgcccaggcgttgcactgcagcctgggcctggcgcaccccaaccaagtctcaacttaaatttttaattttgtttacaaaatctaatctaagttttaaatttatttttaccaaagctcaatcgaagttttaaatatttttacttcattatttcttcatgctcattcaggcttggtttcagcccaggaatgcaactattttgaatcgacccaaattccttcaattcgtaaattcctgcatcaatatgatcccttaggaattcgatttgtatttctcatcactgtacatatgatggctgtatgaataatctgacagcctgaatatgaactaggttcagtgatactagagatcgcttggatgagttgggtggccgacaagtgttatcctccaacctgtcgccgttactgttcagagaggataataacaaacgagtactattgtagcatagtcacccagattcctagcgtttatacgtactacagaacgtataatatccggcctgttgcttccctcaacagagaacatgaaaggcacatgatagttcagcgttgctgataaaaagagcacgaagattgaaggacacgacgtaacataggcaagcacaactggttcaatacttacttcagattgttagatttgcctttccatgccatgatgtagtactaggccatcacttcctttaaaaagttcagaacttaacctctgctaaagagaagaaagggaagacagataagttcagcaatcagcattcctgttgctagatactagtagagtacaaaactgcatgcatacaatttcatgattaccatatctaagtctggtaactgttcaagacttgaagtgtttatcattccttttgctaccaacaaagagaatttgaggccgtcttgcgatatgtacgattggtacgtactcggtactctctctgaatgttgagcaagcaatgagcacacacacacacgatgacacgagacatctgaaaattggcacttcgagacttgtacagtagcagtaacagtagtagtaccaatccgatgttgagatggattgggtgcaaacgcatgcaggaaccaaatgaggccccaacacctgtatcatatccacgatctccatctccatccatgttccccagtactgcaaatattgcgccagccactgtatgatatacatgcagggggatctatctatatccacagtgttgagagcacccaccaatcgcaggcacgagacgtgtaatcctgtcgagccaagggaccacccacgagcggcagatcagagaatttcactattgcagcggctccatctccatactgcagtcgatcgatcgatcgccgactcgccgtcgccgtcgatgttgctgtcagccgccgaccggcaggcagccgctctcgatccctctctgagaaagtcgagtctgaatttcttcgctggccacacttggcgcgcagctgcgtgcgtcgtactcgctcactgtcctctcctctcctcgcgttgatgccgtgtcctacatactgctagctatcaaaagcagcctcctccattatttttgtgtagctgaaggtggagagaacgttccttcttgaggccttttgttttgttttggccacgagttttccatgcgtttgtcaacttgtcctcccctatttattcctgcagaattcgacgtgtgaggtttttggtcgggagttactactagccaccagtatttcttcactctgaaaatagtaggagtattttttttctagtatatcttcttcttcagattcagcaaaacggctaaggaattcctttcggttggtttcttcaattgactatactttttagttatgaggttactgtcagtttctttgagtctcatctgaagactggaagggtttcagataaaataaacagccatccccatatgttttaaaacagctgtatattagttctactttaatgagtgattattccgcttttgttcttcctcctaccgatttcataattaaacattgaccaaaagtagaggattattggtgaaccataccatgggaatgttaaattatctctagtcacactagccatttttttaatcctgtaaacggctgaaggcatatgttaatcacaaaccaaatcgtgtacataaaaaaattgcaaggacctattttttaagagtcagattaggtagatctcaagaatgatttggagccgacagggcccagatttggtggcatcagcatggtagcttatactcctaaatccatagctcacaactggctcgaatgttcatcggagaggcatcttaattcattcagttataagtgttccctcccctgtttcaaccatagcatctgattaaaaatcttcagacatttttaagcccatttcgagacaattaagccactaaaatcagttatgctacatttccaaaaaaaaaaaagaacctcagttaccttgagccgagtgcaccatgtgctgtattgccgtgtccgtcaggtaaacagtccttatcatgactcaacagttcatagctcctacatgaccatgatatgctcatcgaggattacgagcatgtgagtgaggggtcaccgaatgaatcaaagaaaaagggacaagatgatggatcgatggatgtatcgccaccagcaccggcaccaagctgcagcagatcgagtaaagcacaagattgttttttttttttaattttaacgcaaggaaagactgttgaaagagcctttgtgctcatgaaagggcaacatcacttttctagataagggaaagacaccttttattataaaaaaatattgcaaaaaaatgtttttttatttttaaaaaaggatctttgagctgctggacgagcaaatttgaccttgttcatggagagaaaccgtgcgtatgcatgtcttggcttaatttgcatttcgtgtccatatcgatcgatcagaagatcacgagaagtagctcacgtagtacatctagatcgtcctatcgagtacacgagcagcaccacgacaaagaaaaaaaaaatcaaacatggaaatttccataaagaggtttgatggcgtgaaccgttttgcagagccaactgtgttttgcaagcttgcatagcatggatctacactgaaaaattattaaccaataattcttacaagcacactgaaaattaatcaggcttatgagctcctctaatcccctacagctacaagctactgatcgaatcgaactaggggtggtgattcttttggttcccattcgattcgaattcgtttcagtagaaccagttggatccggcgtacttcgccggcggttgctgcatggcgccgccgtagtccacggcgccccctcctgtcacgttgaaatttgaactgaacctgaactccggcgccgccgccgccgtggcggcgacgtcgcctccgaacggcgcgtcgtcgcggatgaagaaattagcctgctgctgctgatggtggtggtggtgcatctgcgtggcggcggcgacgtcgttgtcgtacatggtcatcagcccggcgaggcatctctggccgtcgacggggaggtcgaagtcgaagctgccgagtggctcgaagatgtgcggcggcggcggcttgctctcggcggcggcggcggcggcgttgtgcttgcaggcgtactgatgggcgttgcgttcgttgcggtcgaggaagccgagcgcgtagttgctgtgcgggcactgcacgttgccgcaggtgtagacgcgggcatggctgtcgctgctcagcatcagctccggctcgctcctcttctggatgaagtcgacgtcgatggcctcttccttcatcagcggcatgatcaggaacttgttgttgctcagagcagcatccatggtggtggtgaggtccatgaacgcggtcgcgtcgttctgcgccttctgcaggttgttgttcccggcctcgtcgccgtcgactccttcgacgtcgtactcgccggagacgctggcgttgaaggacgcggcggagagcggcggggggagggcgccgggatggagcttgagatagaggtcctcctcctgcttgaggacggcgagccaggtgacgatctccttggcggtcatcttgtcctggaggcacttggactgacgcacgaggcggcggaccttgtcgacgtcgggggacatgtgcttgatgacggcggtgagcacggcgaccttccacgccttcttgaggtcgtgcggcttcttgtacggcggcgggccgagctccttgggcacgccggcctcgggccaccacgcctcgctcccctccggccaccacggcggcggcacgcccttctccagcgggaagcggcgctgcggcgggtcgcagtgctgcatgagcgccgagagcagcgatcccagcgtggtgtcctgcagctcgtgcagggagtgcggccccgccggcgcggcgccgccggcgtcgccgtcgcaccccggcacggcgttgtcggcctggtacttggcgatggcggccgggccattgcggtcgaagcggaccttctccttccaccatgagcggaggttgtcggaggcgccgctcaccggcttccccttctccgggatgatgccgtacacgaacccctgcgcgttgcacacctccatcatcttgagcatgtacttgaggatcccgtcctgcgcccgcgacatcttcttccgccgcgcctgctcctgcgactgccgctgctgcctgcctccgccgccggcgtcgcccgcccggctctccctcccggcgcggctctgctgaagctccttgagccgcttgtgccggacgcggtcgcgccacatgcggcgctccagctcctcgatgtcgtccacgtcgtcgtcgtcgtcgtcgtcgtcgtcgccgtcgctctcgtcctcggcggcgaatccgccctcgtgcacctgctgctgctgcggcggcggcggcgccgggttgaccaggtcgccctcgccgacgaagcactcgcctccgaagaatccaaaggcggccttgctatcaacgtcggcctccgccgcgaacgccatgcgccgatccaccatggtcaccgctgctcccatcatctcctcgatcgtagcacagactgacttaatagcagcagcagagcagtagctatctatagatccacctgcacgtaagccgacctcgaattagttttttttccccatagtaattactttgctgatcaatgatcataagcttttggtaactcaaatgatgatttcattaacaaagagaaatggtttagcagaagtgaaaacaagctagaacatgcgcccatgtgccaaatgatgaacaaaggatcatcaaaggccatcatcaagtaagaagacaaaaataaaataataatcgggccgtatacagacacgcatcaaaatcagggaactcaaaatggaatctttattgaatgaatcctaggagcatggaacacacacatacctctctctgactctctctatgcccttatctgatctccttctgattactctaccactctttccataagcttggcactcagctagtagaaagagaagaagagagagtgcctttgtgtgtgtggactggagaagaagaaggacgacaacaacaataaggagaagttaaaaaggataagaagagaggagaggagaggagacgatgctgccagccacgagtccactgtaggaggaggaggaagaaaggaggaaagaagcaagtaggggcgggcgacgacgaaccgagcgagaggtgctgggaaacaacagcgacaactaccatttataatgccctcttgactaacgcctttgcccaaattcaatccaggaaaatgcagtactacggtttttaataccacgtgttgagtggtatctctcctcgtgcgccgatgaacaattgtactaccaaaccaaggcggcttctttcgctcaaaaacaaacaatttgccttgcaatacacaatactgctgcgtacactccgtcagtgaccaagcaaatttaccagcatgatgcttgtaaaacatggttcaagctctgaaaaacagtttttttaattaaaaaaaagctccgaaaaacaattgcggagttctgaacttttttgttgcaaaagggaacacactgttcatcggctttaggggtggttcctagttcctgctggaaattaaaagcacaataattagacaaggtaccttcatttgctacgtggcgaactctgtgctaatggccaaaaggaccaacacaatcagggccctaccataccacccacaccacatgtagtagcagcagcagtttacaagaggcctgcaaattctgttggggagaggtagctaggtctcctccgtctccatggagatggagaccacatatttactcattagccttatcgcacagctattgttttggttggttcctctaactctgagattaatttcaggatttcaggccccatgtaaaggctggctggaccatcatgcccatcttcttcttcacttgtgtcattctccctaccatttctccatgtttatctgtaggtgtcggcaggtttggccagcttgctctctctaacttcatctgcaaattaaaacccagcaccttgatagcgatccacgcgtttactaaaggatcgttgaaagacacctctttcatctgcgctgctcttaattcatgctgttgtatattcattctgaaaaatgttgtgttgctgtgctgtagtcagtaacagactaacagtaacacgcctcatgcacattcaattttggagaggtcaagttgtaacataaagaatgaattctcaggatcagatttcagaagacagtgaatgagagagagagattttgcaccatgtttatgcctgatgctttgattgacaacaaaagcaagtcaactgtattagcaacttgcaagcgtggagagtagtactagtatatcgaatgctgctgggtcgaccatgtttccggtagcagtggcaatgattggcccaagtattctagagagttttattcagttatcgacatctcctccccaatcctttgatctgatacaccacgttgtacgcaatgtttgccaacttatttaatccagtttgatagttctatttcaggtcgttatcgctgttagtttattttgcttctttcttcaagtctccaataggagggatcactacatttgcaaatgccgactgaattttttgaaagatcgccgactgaatttattaacttttttttttctgaaggtcagtaaacttggtgtgacaatttcttgccaaatttcggcacaaaaacaagatgattcatactagtactaagaaaacaagatgacttgctttaactttgtgaagcacatgccatctctccaaaacccaaagtgaacaggttctctgaacaacgaacaggtagcagaatagctcgcggtgttgcatgtgtaggatgtcgcacgcagcagcaaagttttacaagagttgcagataattgacgatgacaaggatgtgctccctcctcatcaggcaaggatctccttggatcatctcgaatctagatagatactcaggaagatctcaggagcaaatctcgtcgtcaatggtgttcagttcactgaacagggctgtagaaacctgcaatgatctgaacattggagttccaagtcattgcttggacttgtgtgcaatcatttgtccatgttcagatcactttgggcgatggtctttctgaatgacttcagaaatctaactctatatcacttatatagcatgaaacatatgcgtagtttgcttagaattttttttgtcaaagtttatgaacttttgaatcttgagttcgttgtgtcttatatcactttcataaattctgaaatttaaaatgcctaaaaaatttttgagcacatctctgttactcaaagcacttgaaaatgttatactgccacatcatctatatatccaaatcagtttcagcttaagcaagcattggcaactgtgaaaattctcattttattcctccatattctgaacatgtttgacttcgaatttcagtaggatgccggaaacccatatttcgcacgctcttgattttttgggggattttttcgtggtgatttagtgggtaaaaatggggaaaggttggtcagggaagagaactccgaccccctaatgagtccgaataaagctgaccgagtgaccggttacctccttccgttgaagaattttgagcacatctctgttacttgaaaaatgctacactaccgcacagtctatatccaaatcagctgcagcttcagaaaactccgaaccccctgataagcaatgcaaaacctgtaacttaagcaaaagcattggcaactgtaaaatttctcattttatgtttccatcttctgaacgcgtttgacttcgaatttcagttggatactggaaagccgtaccccgcgtatccttaacatttttaggggaatttttcgcggattaaaacggggaaagatttgggggtcggagaagaaaacaccgaacccaaccccaaaaggagtccgaataaagcggagcagtcaacgccagcggcccgtcatctccttccgctgaaaagtcaaatcagtcttcgcctacgcagactcccgtcgcgctcactgccatgtgggcccaaccgccaacaaaacccggctccgccttccgaggcgagcacggtcgtcgtctacggcgccggcggcagtccagcggcggcgcacggagtcacgatgccggtcgtcgtcgagacgagattgtgcctgcagtcaagatcgcaggcgacagtacaagaagacctaacgcaacgtcttgtggttaaaaaaaaaagcctacaatgctgtttaattagggtttagtccattcagtcatccaccgaaccctgcaaccccaagcgccgccgcttccctccttttttgtcgctgggccggcgggggcacgccggccaaatattttaagcaaaatccggcggccggcgcctcctctcacgcggttatctatccaaagctgaaggtgcgatggccgccgccgccgccgccgcgagctactcatctacttcttggagagtccgacccggcctaaccccatttcgctcccctctccagccacacccgcagggacgactccagcggatagccatcttcgccacccgcatccgcatcgcaacaccctcggcggcgatgcagtcgtcctcaacgcggcacaggttgcgccccctccccccatttcgttactctgataggtctgcttcactgtaaaatgctgtattcctgtccatgctatacatgtctgaaagtctgaaattatcctgagtgcatgtctgaaagtctgaatttatcctgagtgcagagcatttcataggttgcatgtttttctaagtatttattagctactcacccaaaaccctcatgttgttttcaacataagcaggtagaaacctccttgttcaagtaaataactatattcagtactctatatgtcgagatatggataagaggggcagttagggcctgtttagattcatactatcattttaaaccatatcattgtttggtaaaatcaacaaatgtatggcggtgtttactttgttatcaaatattggtcatgtctaaagaatttgacaatatcatatttaatctatattttagcaatgctaaattttggaaaggttgaaaatagctataaagtgaacaagcccttagtatattgttccacggcaataaaagctattgcctgtttattcctttctgctgcctggttggggtaatgcatagatgatatctataaatactctttattcctactatattcaaagaaattggcacacctggtgccggttcgtttccccaaaaaatagtaagctggttaggtgcaacagttagtctgaacttcttcttctttttttaggatcagctactctaaacttttgaagaaccgtattttgttagtttagcagcattcagtttaaccattccgctctcatgagacgtcaagttactcataaaaatcatagagtttttgcatttttctttctgcaccaagaacaccaccctgcgccaccagtacttttcagcacaaaagagattatagtcatttttactattttatccaatgcaacagaactcacactgtttgttccacaggcttgaggcagtgaatcatgaccatgaaacaatacctgaaaggtattactatacatacaaaaaataggcacttttagtcctcaatgaacaggatactaaatttttgcctgtccgatttaggcttgcagtagtcactggtggaaacagagggattggcctagaagtgtgccgccagcttgccctccaaggtgtgacagtcattctgacagcaagagacgagaaaagggggaaagatgctgttgagtccctttgccatgaatctaacctctccaacataatcttccatcaacttgatatcctagatggtaacagtcgtgcctcattggcccgatacatcaacagtagatttggaaagcttgacatcttggtaaaaatacagctgtttccttctctttactacaaagtctaaccaatctgtttctacaagaacgaacatatactgaagatcgcgtgagaaatgcaggtgaacaatgcaggtgttggaggggttgcagtagaccaggatggcctgagagctctcaacattgatcccagggtttgggtatgtagatttatgttagctttttactttctctggattgataatacttattgttttggacaaagctattttcaaactttaaaaactttaactataaataacatctaaaatatttattgtagaaatatggtgaccatatgtatagattggtcttaaaaggtgctccaataaaatcatatatttattgatattatatatatatatatatattataataaaaaatagtggttaaagttgttttttgcataccgtgtctttgttcaaaacaacaagtattatcagccagtaggaagtagcatatttgcatagcttcaaatgcctcccctattttgttctctaatttttcccttggatgatatggccccttacagttgtcagtagttttagtgtcagatatccttgcgttattttggtgcgtagtgttcattgcgaactttgaacactggtgtctattcaattaaaaattctctttttgatgcacaaatgaatagtcagcagcaaccatctcaaccactaaaaaatgtgtttgcaattcagctatccggcaaagcagtcaatctgatccaatcagtaattgtacaaacatacgacgaggcagtaaaatgcctcaacaccaactattatggattgaaatggataacagaagctctcctgccgctactgaaacaatcgccgtcaggagcaagaattgttaacaccacctctcttcggtcagagttgaaggtacaaattctttctattaaaaaaaagggtacttctgtgcttcaactagcttacctaacaacatgatagttcctgtgccaaacttgccacagagaattcccaatgagaagctccgcgacgagctgcgcaacatcgacatctgggacgaagcacggatagaagcgatgctgaacgagttcttgcttgacctgaagaacgaacggcttgaggaggcaggatggccaacaatgctgccggcttacagcatgtccaagaccgtcgtcaacctctacaccaggatcctggccaagaggcacccggagatgcgcatcaactgcgttcaccctggatttgtcaacacggagatcaactggaatacagggatcatccctcctgaagaaggcgcgagaggtgcggtcaaggcagctctgctccctcaggatggaccaaccggttgctactttgatcaaacagagttgggtgaagcttggtagtaaaatatagcattataaaattattaagcatgtttaataatcatccttccatgctagcttagcgatcagagctgtgtaaacatataccactacatgattcatggatgtttcacagactaaatttgttatgcaaggatgcttaataatcaaccacttttgaatcgttttgcatggatgttcagagatgctcagggagtggggaacgttgatgatgtcatttttttagaagggtattcttttactctggatatatacaatctttttaaattagaaacttagcctattaaaacttagccctcaaataatccaatccgaatattcgatcttatagagatttgaactcaagatcttaaaatgctactcagaaaacttcaatcactagtctccgtaccctttcatggtaatgctggcatatgctactcgtcttctcggagataaggggcacacttggccctggccgtgaccaaaatcctatcaaacgtgacacgttgcaatacgtgtccaccctctaagggacgtgtcgcctagccgtcgcacgtacaggtttatatatgttcatcatcagaggcgctaccctacgacgaacaggaaaccaccaatttagcagtgcagtgcgcgatcatgtcgtcgacgcaggagaagcgaggcgagcagatggcgcgcgcgcgggaggcggcgcgcgagatcacgcccgaaggcaccgagcgcgcgcgcgtggtcggcgaggaggaggccggccccgagcaccaccgcgccggcatcctggaggcggcgcagcggggcgcctggtccctcgtgagcgccgtcggccgcacgctcggcgtcgtgagggacaccgccgcccagaccaagcccagcgagtacggcgacgcggcggaagcgaaggacaccaccgtggagaaggcaagggagacgaaggacgcatccaagcagcagaacgaggagctgaaggcgacggacagcgttgcaggcgagcgtggaggcgacgcggcaacaagcggacgcgggcaggtggcagggaaggaggaagactagtacggcccgcccatgtgatccgtcttgggccaagtcggcccagaaacgttgacctaattattagacttggaataagtacactttgggtccctctatttgttgcccagtccgattttcgtcccttgaccgcaaaaccgggtatgacccagcccccaacttaagaaaaccgggtaaacgtggttcctcggcgttttgaaggcagtttggctgacgtggcgcctacatagcttatttgacttggtcttcgtcccatgtggcattgatgtggcgcttacgtggcaattatatctcgggaaaataataaaaaacgtggccccacatgtcagctgcacaaacaaaaatagttttaaaatggtggggcccacatgtcagcctcactcatctcttcttccctctcccttctctctctcttctttcctttcccctctctctctccttcccaggcaggggacggcacgggtgggcggcggagcaggcgagctccggcggcggcggcgggcgtggttggcgctgctccccgaccggagcgccgccggtccgcgtgaaggcaggtccggccgttcgggggggtctggcagctagcgctacggcggcggcgatcggcggcgggagcgctgggcgggaaaatgaacggggcggcggcgggaagagcggcggcacgaagccgaaggggtgctagcctcgtcgtcatcttcttccggcgcatagtcgtggagcggccggcggagcgacgacgacgggcggcgggcggagggcggagtagaggggcggttgacggagcgacgacgggcggcgggcagcgtggcgagagcactgcgagggaggaggcgagctcgtcagggtggtcggcgggaaaagaggtagcgcagcgcacgccggtcgatgggagggagggagaggaacgggggtcggcagccggcgggtgtcggcggtgcgtgggggtcaacggctggtggaggtggccggaggaggaagaggcagaggaggaggtcgccggcgagcgcgggctccatgccgtcggccgctccgcccgagatgcccagcagaacggcgccgcccctcctcgctcggtcgccgagcgccgccttcctcctcgcccggtcgccgagcgccgcctccctccttgcccggttgccgcgagcggcccctcctctcacccagccgcggcgcgccgcctccctcctcgcccgaccgtcgcgcgccgctccgcccaccgccccctgctgcgccgccgctcaccattctgtaagggagagaggagggatagagagtagagggggctgacatgtgggaccacaggggccccaccttttcttattatttcttgtagctgacatgtaggtcccatgttttttatattttcctgagatcctattgccacgtaagcgccacgtcaatgccacgtgggacgaggaccaagtcaaagggagccacgtaggcgccacgtcatccaaaaccggacacaatccacggttttataagttgagggacccgtcatacccggttttgcgacggagggacgaaaatcggactggccgacaaatagagggacctaatgtgaacttattccattagactttgtgtaggtctaatagcccggaaatgttggcccaaatgttaatggaagaaggtgcaggcttccctgaggaaaaaagtccatatgtatccttcaacttatggttcgtgtctgattttgctcgctcaaccacaaaaggaataagtttatctaagttcccttaacttgtcaatgatccaattttcgtccttcaactgaaaaatcagatacaatgggtccccttaactaccaaaaaccggtacaatataggtcccatggtaatttggatggcggttttcgttaaggtgtagcctacatggctaatttgactagtcttcatacgatatggcaatgacacggcgcttacgtggcaatttgatttggaaaataataaaaaatatcggcccatatgttagttacaccaaaaaataatttaaaaatggtgggctccgtgtgggcctcacatgtcattctcacccctcctcttcttcctcctctctccccaactcacctttcttcgtctctctctctctccaagcccgcattgcagggagatggggatccatgggatgttgcagagcagacgaagcgggggatttgggtttggtttatgctagttttggaacaagaccaacagtcagggggtggccagtgcccggtggtgagcacagtagcgacgccctatggaggaaggcggtggagggagctcatctatcaactccggtggcgagtgcttgtggcggcgctgcctccctcctcaccctgctgccgcgtgccgcccctcctcactcacacctagagagagaacgagtagagtggagaaagaaatgattagaggggagttggggtgagaggaggaagaagaggaggggtgagaatgacatgtggggcctatcatttttaaattatttttttaactaacgtgtggggccacaaattttattatttttcaaatcaaattgccacgtaagcgccacatcatataaagaccgagtcaaattagctacgtacgcaccacgtcaacgaataccgccgtccaaaccgccatcagacctatattgcaccggttttaacagttaagggatccgttgtatctgattttctcgttgaaggatgaaaatcagattcgttgacaagttaagagaactaagatgaacttattccacacaaaaccagacatggaggctctgtcaaatacgtaaatcggcccaatatcatgctgaattgctgagtagcctactcaatatctagcccaacctttttccccctttccgtgatgaattcatatgcgtgcaaaatttatgtgatctctcctgaggcattcgctagctgtcacgattggatcctcgattaccttccatacttgagctatgatttactatatatgctgcacctaggtgtcatggcacctatcatttgcatgtgacttaaatagttatagaaaaaattaaaaaaattagtaacatcgtttgtgatgatacaagtctatacacaaacatgcaagactaaatttgatctacaactagagaaacaaaaataataaaatcagacattcaatagtacccgtacagtgcagataaaatttcttatttttgtttcttcatatatcgatcgaatttagacttgcatgtttgcatagtgacttatattatcatggattatcttatcaaattttatgtattttttatataattatttaaattacaggcatacacctaggtgccatgtcacctaggtgtaaaaaatactttctgttatagtgctggactcgataattttcatagttaagggaggcttataatatgtttttttgcgtttatgggatcaaaatggcctgtagttaaggcaggcataataagtgatgagttcatatacgtgcaactgcaaacttatctgatctctcgcgacattcactagctgtcacaattggatctccgattacctcccatacttgggctatgattttcctacaatgaattaaggtgcaaacgtggaggatgaaactaaaactcgtctagattcatgcagaaacatagataagtgttgcatttgagtcgctggcagaggatgaattccaacccaaatctgctgagatatcaattgccatgatacgtcgggtccagatcctctagagttgggtataactctatcgggtggagttggctaaatctgtgccattcggcatacttcaagggctaggcttaagccacattaatttatacttaaaaaccagtaactgaccatgcaacaaataatcttgtatcaacagcttgtcacgagatcatttttactgtataattagcacaaaaaattcaagattcatctattatttaaaaaaaatcatacacattaatattgatatggttcgctgtttgcatatatgtgaaagcactatgttgatatacactgactgccgctttagagttgatcgactatatctgttgtttggggaataacaaaacgttattctgttacatttttttgggggtgagaacttaatcaaatcgctattattgagcaaacacatgaaaaaattaagtcataaccattaatttaaggagttaatttattaggtgaaaattccttaaaaaaaacttattaggttaaattgacgaggaatgatctcagccgtagaaaacaatggatagcacagatttggccaactccacacggtagagttatactcaactccaggggatccagaccctgatacgtccacgaaatgcattcctctcaaatcccagccggatttggcaccaactaatggcggtgaattggataggttaattcatagatgaaggtaattgattgatacgggctaatatcatcttgccaaaacaaacatgccatccaggcgtgtataacaacacatcaccaccattgcaaagcttcttcatcgatcgccatcgtcttctccagtcctcatgcaggctatggcgtccttactcccaattctgttgctcaccgccttcctatcgtctaaacctgcactctgctacatcaatccaggtgcaacgccgccacagaaaattggcacgaaatcttcaggtggccgtgcaacctacatcgtgttcgtcgagccgccgccgccgcttggccacggcgatggcgaggacgaccactgccggtggcatgaatctttcctgccactgagtgagctcgccggctccgacgacgagccacgcctcgtccactcgtacaccgaggcggtcagcggcttcgccgcgaggctcaccggcggcgagctcgacgcggtgtccaagaagccggggttcgtgcgcgcgatcccggacaggacgctgcagctgatgaccacgcacacgccggagttcctcgggctgaggaaggacgccggattgtggagggactccgggtacgggaagggcgtcatcgtcggcgtcctcgacaccggcatcgactcctcgcacccttccttcgacgaccgcggcgtgccgccgccgccggcgaggtggaagggctcctgcagggacaccgccgcccggtgcaacaacaagctcatcggcgtcaagtcgttcattcccggcgacaatgacaccagcgacggggtggggcacgggacacacaccgcgtcgacggccgccgggaacttcgtcgacggcgccgcggtgaacgggctcggcgtgggcacggtcgccggaatcgcgcctggcgcgcacatcgccatgtacagggtgtgcaccgtggaagggtgcaccgagtcggccttgctgggtggaatcgacgaggccatcaaggatggcgtcgacgtgctctccatctccctcggtagcagctttgctgcggactatgacaaggaccccctcgccatcggcgcgttcagcgcggtgtccaagggtatcgtcgtggtgtgcgccgccggcaacaatggcccggcgttcgcgacgcttagcaacgaagcgccgtggatggtcacggtcgccgccagctcagtcgaccggcggttctcggcccccacgcggctcggcgacggcagggtcatcgacggcgaggcgcttgatcaggcgagcaactcgagcggcaaggcgtaccctctgtcctactccaaggagcaggctggtctctgcgagatcgcggacacgggcgacatcaagggcaagatcgtgctgtgcaagctggaggggagccctccgacggtcgtcgacaacataaagcgcggcggcgccgccggcgtggtgctgatcaacaccgacctcttgggctacaccaccatcctccgggattacggctccgacgtggtgcaggtgaccgttgccgacggagccaggatgatagagtacgcggggtcgagaaatccggtggcgaccatcacgttcaagaacaggacagtgctaggtgttcgtccagctcccaccctcgcggcgttctcgtcgcggggaccgagcttcctcaacgtcggcatcctcaagccggacatcatggcaccaggtctcaacatcctcgccgcgtggccctcgtcggttgctcgcaccgatgccgccgccgcgccgccgtctttcaacgtcatatccggcacgtccatggcgacgccgcatgtgagtggcgtggcggcgcttgtcaagagcgtccaccccgactggtcgccggccgccatcaagtccgccatcttgacgacatccgacgaggtcgacaacaccggcggcccgatcttggacgagcagcacaacaagaccatgttgttcgggcccttcaacaccggcgccggccacgtgaacccgacgagagccgccgacccgggcctcgtctacgacatcggagtcgccgaatacgccggcttcctctgcacgctcgtcggcgagtatgtcctgccgatcatcgtgcgcaactccagcctgcagagctgcagggatctcccccgggtggggcagtcgcacctcaactacccgtcgatcacggtggagctggagaagacgccgttcacggtgaaccggacggtgaccaacgtcgggccggcggagtcgacgtacacggcgaacgtgacgctggccgcggagacgtcgctgaagctgagcgtgtcgccggagacgctggtgttctccaaggccggggagaagaagacgttcgccgtgacggtgagcgggaggttcacgaaggcggcgcaggcggtggcggtgctggaagggagcctgagatgggtgtcgccggagcacgtcgtccggagtccggtggtgctctacatccccgtcgcttccgcaccgccgtcgccgccgatgccggcggttgggactcggcgcggagacaactgggcctgaagttcttcatgggctatgtacatgggtcgtacgctttgctgtgtgaatactaataactgggccgattttttactataatcctaatgggcttttgggttactctcgcacgcagtttcagcccatcagactgtactggaaaggattgagatactctacctgccactttgccttgttaataacgggttggtttggtttgagtcctatattggccttaccaatatttggcaatttcaatagtgtttattgtctatttggtttggagccaaattttggcatgcctaagaaaataggccatttcaacagttaatttaggctattttggtttcaatccaaacacaattttacctttgccaaaattagccatgacaaaagttaccaaaatttaacattgacaaaaattggtaaggccaatttaggccacgaaccaaaccagcccaacatgtgtgggtctagggttcatcgggcttacatattagtgatggaatcagtttacttcgaaggttgaggatcttgatccgtactataataacacattttacttagcttttgcaattgaattcaactgcatctactactagagtaagtactctagttttgctattttgcaagcttcacatcttccttaatataagctcgacagaagggcaggagaaatggaaagaagaacaggacagacagaaagaaaagcttgagctcggcatgaagccatggggatggagatcaggatggcacgagagcaccttgcagcttttatggtgctcttgctagctgaataacggccggtggaaggtgagctacaggaagattcgtccttatagcaataaacaatgtcagcatcggtgcacagaacctaactgttcgctgttaaacgcaaagcagctcttcagttcagttcagttcggttcagctcttcagttcagttcagttcggttaggttcagttgacagcaacaggagcatcacttactaaaccaacacaaaagtagataggacactacctctatccagattcgttgtaacatgtagtatctcatttactcataggttagttttttcttatgggatggagggaatactccgttccttttaaaatacagtgacctaaaatggatggggtaaattttaacccctatttatattcgtagtattaaaacgcgtctcatactattgtatattgttacattttagaacaaagtaaggactccacttggatggttcagactactctacaaagactgcgttgctcgccttcattcaggtaaggagagagagccttctctaatctctacaacgaactgaaccgtgtgagcgagatcaatcttaacgctctgaacattggaaatgcaggacaggaaacgaatcgaatccgatgaaatttcagacgccagtaaaaagggtggaaggtacggtgaaggtaatatcaaaacgtgagaaagaatctgctgcgaattggacagcagtagcagtgaaaggtaagatcacagtagtagtaggaggagcattttcaagaccaacccgtttacccgcgtgcatttccacgtcaggcccgtacgaaagtagaagccgcagttgccacttgccactgcagctagctggaatagcttaccgtacagcattcagctggatcactcaaaaaaaaaaatctgtaaaacatcacaccaactcttcgtttgcactacccgtcccaaaataagtgcagcattagatatctgtatccaacatttgaccatccatcttattaaaaaattttaaaaaaattagtcacacacataaagtattattcatgttttttcatctagtaccaataaaaatactaataaaaaattcaaataagacgagcgatcaaatattggacataaatattgcaaaattgtatttattatgggaaggaggtattactgctacttcacgtttgcgtacgggaaattcgtttgtactccattgtcgagaaaatctcagggctcattagggtcaaccttcatttttatttttgaaaacaatgttaaataaacaaacttaaaaagtaagacatgattgatagttagacttaagagtagaatcaaatgaacaattgtattttttctataaacttgtaaagatgtttgatttaggataaacccaaaataacttattacataaaataagtttcaaaattttagtcaaataaaatcaacaattttggccgtgtttagttcccttcaaacttccaaaaattccatcacatcaaatgttttgacacatgcatagagcattaaatgtgaacgaaaaaaaacaattacatagtttgcatgtaaattgcaagacgaatcttttgagcctaattacgccatgatatgacaatgtgatgctacagtaaatatttgctaatggtggattaattaggcttaataaattcgtctcgcagtttacaggcggaatctgtaatttattttattattaatctatatttaatactttaaatgtgtgtccgtataattaaataaaaattagccaacgaactagacacagtctttatacaatatgcggatggagtacgtacgttatagggcaagcactgcctcttcttaggtttcttctgttttgagagaggggttgaacaattgcaggcaggcactgcagcgtctagaagaattagaagctcggtttttgaatcatgtacagttctctctctttttctttcctggaataaggtagagctagctctcgagctcaatcttaattaactcgtctgttaaaaaaaaatctaatcctaactatgtatttagacacacatgtatttagattcgtagctcaaagttagctttttatatacgtcctgatgaatgatgtatagtggcgtgtgtggtgctgatgatgattagctatttaaatctgggcgtgccgctccctgatgctgtgattatgaacttattttggctcttcctcttgtagctctcaagagtgtctgccatgattgagcagggccaggggcatggatagtttacaaacaagtctaccagatgtgtccatggacccgccatcttcctatacaaacgcaccctttgatactcaaaagattcagccacaacttgtgctattaaagaacgttggttacaaacgtttacagctttgcacttaggtcctgtttagatcccaccctcaaatttttcaccatatcacatcaaacatttaaacacctacatgaagtattgaatataggaaaaaaactaattgcgctgattgcgactaatttacgagacgaatctttttaagcctaattgctatatgatttgataatatggtgctacagtaaatatttactaatgactgattaattaggcttaataaattcgtattgtggtttactgatggattctgtaattagtttttttattagttctgaacaccccatgcgacacacatcctatataatacccgatgtgacacgtcaaaactttacacccctaaatctaaacactcccgtaagattactataccaacctgaatctatctctgtttttttttctctttcacagaaggatgctcccatgaattactagctgatgagtatggtactatggtgtgtactcattcaggccattgatgatactaccaagcaaagttatcagccgatttattttttgcttgatgcattactgcattatccctttgtaattttactttgggacaaataaagtagaaaaaggtggacaggggaatagaaaacgagtagtacaaacgttggaacttgaactcttgactgacctatcaccaaccatctcgtggtactagcacaccacttagggctgtttagatacctcgtaaaatttttcactctgtcgcatcgaatgtttagacatatgtatgaagtattaaatatagaaaaaaataattactagattacgtgtaaattacgagatgaatcttttaattctaattgctccatgatctgacaatgtgatgttacattaaacatttgctaatgatagattaattaggcttaataaattcgtctcgcagtttacgggaggattatataatttgtttttgttattagtctatatttaataattcaaatgtgtgtccgtatatccgatacgacactccaaaacttttcacccatatatctaaagacagttttaatctccatccattctccaaacatcgagatctctgacgagtataggccaacaaataattcctccatctcaaaacaaactaatctcatattaaaatataatgtatactagtacatcgaatctgaatatactctatatccagatttattgtattaaaatgtatcgtatcttagtatagagttgttttatttttaaggcggatagagtactctaaccaactcaacagtcaattaccattagaaaccacctgcgacaacactactgccattagtttatctggaatgagacagagcaatgagccatgcgtttaacccaggagaattctgaggcgtgctgacgaaaatgggaactttccttacacttcctctattttcttttatatgatgttgcttagtatgattttctatactctatctattgaactaaccaatattaaaaaatatttactactgatactttctccattttataattcttgaggtttaaataatgacaaataaactaaagaaactggaaattaaaatctagtgtggtgcaacttgatagtaagcagtgtagtctacttgaagtggaatacttcctccgtttcaagttataagactttctaccattgcccatatttatatagatattaataaatctagacacgtgtcttataatctgaaacggtggtagtagtatctttgctcggctatcaaggtgcagggaaagttctcattggcatagagcgtatctgacagcaagtctttttagcttttggcaacatctctcttcgctcgtcgtaactaggctttcgatgcaatcgagagaaaggaaaacttcaaggacatatccagttgtgttacagaaagatcagtggagttcacttcccctggggccatgcaatacatgctgagttttcagttcagtttcagagaatatataaaagacttttggatccgtagcactcagcaaaactcttatgtctcggaaacatctgtgctcagtttgatttgaggtcaattttgttttccttagagcaagttcaataaaagaattaagttggtggtataatatcgaggctagcaaaagcaatgagcttgagaaataatctttttaacttattaattttccaatcatccgtttggaggaaaagagtagtattattttttcacaaaagctgggaaaagaaggtgggctttattcttcaccatgccgtcacatgaataggggcatactccatgccaccatcactaatcaatgtcacatcctgctaatgcaaaactcttgcacaaatccactaattaaaaccgtgctagtcaccctaagatgacgccaaatcaagatcttgcacatttaattaaactactctaagatagaagtatgctttatgctaaagcaaatgaataaaaaccattaagagattttagagtatccaggtggccgaatttgctaaaagaaagggttaagagaatttgttcttgccatttctgctaaagccgagcatcttcgtactcctacatgcatatacatgttctgcctgccggaatttcttttctactctccatttaaaaatgtaagaacctataaccgaatgatacgttttatagtacaacatatcttgatacactcctatctagatatattatattagaaaacgttttatctgattttagattcttaggccctgtttagatcccaccctaaattttttcaccatatcacatggaacatttgaacacatgcatgaagtattaaatataggttaaaaaataactaattacatagattgcgactaatttacgagacaaatcttttaagcctaattactctatgatttaacaatgtggtgttgtagtaaacatttgctagtgacggattaattaggcttaataaattcgtctcgcagtttactaacggattctgtaacagattttgtaattagttttttattagtactcgaacactctatacgacatcatatataatatctgatatgacacgtaaaaactttacaccctgaatctaaacacccccttatattttaggacagaggtgtagtagcgttttcttatgactgctggaatttcttggtgaagggaaaacgcacactggactgccacgtgtcacgcacaattagctgttaagcatcgggcagtgagcgacgcgatctgctttgcccttttgttaagctttggtttgacagccaagccatgtcggggaggcgccacgtggcgtgcacccaacaaagccctttcttttacctctccttttttacggttcacgattggttgctggtggcaacaacagtaaaaactgtactgtagtttggtcagaggggtgacgagtgagtccgaaatggagtcagtggtcaagtcaataataggagtagtccaaccacgttacctgtgacgaaacaaaaaagacgcattgcattattaatttattaatggtaggagtacataaacatttgggaccaataatcgctacagtttctgcacatacaggagtaccagtactactcctacgtgggtgttttttttttcttcattactacccccattccatttttaaacgtagttattagttttcgttttcagttttaatggtttgtcttatttatttattttttaaaaaataaaaaatataagtcatgcataaaagtactactcatattttatcatctaataataataaaataattaatcataaaaatatttaaataagacggacgatcataattaaacactgaaacttatagttgcgcttaaaatgtgatagaggaagtaataatagtagtagtggaccaaccaaactttttgttgttcacgtccaagtgtacagtacttctgaaatttctgctaatggttgggttgctggagagactccggagacatgggaacacagcaactgtcaatatccaacacatgaacaggacattatcagataagtgggcttgcaccattaatattatggtccagctagctgctggtactcctagataagacattatctcaagtacttaagtagcattagtagtacttaattatgagttaaacggcttgaagaaaaaatatatgtgacctttggtacttagtacaaatcaatgacgttacgcaataattaccatcattagctagtactaggagataagctcgccggctaatcaacatgattaatttgcttagaaatcttttttggtgcatccggcgatctgattgggccaggcaagatgttttcggattctttaaggcaaagttgacgttgtttcgctaaaccggagccggtgaataattaaacaagctgccgaagaagatgtgatgcgctgctggttaatggaattaaaagggaatcagactaacatcatctagttacatgatcgagcgacatttccagcatcttgttaattagtaagcaattatttcttccatgtcgatcgttcaagtgagctagacaacatttttaacaacataatatggctatactcttagggccatcggatttgtagatatttaactatttaccacttttagatgtgacaaataactttttgccactggattcacatgtcatagatacatgtggacccacatatcgttgaaataggggcaacaaatagttaattgccaattggaaaagtggcaaatagttaaatgcatacatgtgtcttataataattaagacaataaagactctaatcattaacctaaaatatattttttattttctattctaaaaactctaaaatcctgttgagtgagactaagtgccttttatgaatgattattgtacatgccatattaattagtgatttgctgaaacatgcataatgaaaacccgtgaattaatttttgtatggtacaaattccattccttggctgatcttcaacggcgatgcaaagccatatagtcctatatgcaggcaggggcaggcatgaaatgttccctcgtgacactttttttttcctttgctctatgcctttttctgtaccctagcaaattaacaagtttttgttttctttatcctgtgcctttttgtgtagccttggaaattaacaatgacaaataaatatatggagtatgaaggacactagatagtgcgtcatgccgttttcggcagcttctttttctatctttaccgtgtataggaaagaaggaatcggattccttcctgaaagacagacttgatgagagaaatgacttgaccaattttcttgcatgtttactagtagtatgccggaaggagtcaacaagttcaacagattgcatataatcgagcgagacacactgcattacatggtagcacaatctgtagcttgcatttgtttggtcttaaacgacaaagtgcattaatagtattttctcctttcagttcagtaagatgaagattttcccttttttttcggcatgttctttgtaactgatagataaaattaaattcatgacaattatttgaggacacagcataataaattaaatattagaaagctgaaaaattgatttgaattttttttcaaagaaatgttgattaagaaactttcttcactagaatttctttgaatgttttagagcttagaaactatgcccgtggcaatccataatctataagggcatgtttagatccccggtaaaatttttcacgatgttatatcgaatatttggacacatgcatagaatattaaatataaacgaaaaaataactaattatacatattacgtgtaaattgcgagacgaatattttaaacctaattgctccatgatttgacaatgtggtgctacagtaaacatttgctaatgatggattaattaggcttaataaatttgtctcgcggtttacaggcggattctgtaatttattttgttattagactacgtttaatacttcaaatgtgtgtccgtatattcgatgtggcacagtaaaaatttttaccctggatctaaccaatgtctaagacaaaaagaaaggacaaccctgagttcagaaccggtgtgacaggttaagccaatccattcatgtttatttcagggtagttaagaattttcatgcaatttccagttgatcaggacatcagaagaaaactttgatccgatttctcccgtaatagtagattcactgagatacctaggatgatccaatattattcctttccatccatatcgtttgcctgttgaagggaccccaccaaaactgccctaaaccccttgagccaatcaatcagtttgaccgtccgagtactacgagtacgagcagtactagtagtatttggtttgcatagtcacacactaaactgtcagatgatcacgttatccacaatagggtgttgtgtaggtcactgcaattacatagtaggctgtgtttaaatccaaagtttggatccaaacttcaatctttttccatcacatcaacctatcatacatacataactttccaatcacatcatcttcaattttaatcaaaatataaactttgcgctgaactagacacagccgtagtagcagagtgctatgatagccggcatcttgtgctgctcttctcttctccatacgtttgtttgttcatttgtctctgcctttatcggacgtccaatccatcattgactagccatagcccatggccagccagccagccctccttgtgttgctcatccaatgcccaaacgatgcaaaagatgtcagactatgcacagtgtttagtacatgtcctccattggcatgcttcctttgctctgggacggttactgttgtgcttctattatccggctgcatttcttcactatttttgaattcaacatgtaaaagcctgtacaatttatgttacaagcacttttacaaatattggtacgagtacgtagtactggatgttaccagctatagagcttgattgagcaaactcacggagatagcaaggacaaagaatgtacttcctccattccacgatgcaagggcccctttgaatcgcaggattgagaaaacgtaggaatataaaaaacgtaggattttgatagaaatataagaccttatttagatgggactaaaacttttaagtccttatcacatcggatgtttagacgctaattataaacattaaacgtagactattaataaaacacatccataatcttagactaattcgcgagacaaatctattgagcctaattaatacatgattagcctatgtgatgctacagtaaacattctctaattatggattaattaggctttaaaaaattgtctcgcgaattagctttcatttatgtaattagttttgtaagtagtctatatttaatactctaaattagtgtctaaatacagggactaaagttaagtccctggatacaaacaccacctaagtgtaaaacataggattgcaaaatgcaggaaaaacacatgaatgaccgtttgattgaaccgcgggaaaaacacagtaattggatgatagagatagactcgaaggaaagttaccaagaggttctacctcattgttaaattttctctaaaatttgcatgggaagaggcattccataggaattttataggatttcataggatccattcctttgattcaaagggctatataggaaaaattcctataggaataaaatcctctaaaattcctatgaatttcctttgaatcaaagggggcctaagtcattctagcatttctcacattcatattgatgttaatgaatctagacatatatatcaatctagattcattaacatcaatatgaatataggaaatgacagaatgacttacattgtgaaacggagggagtataacccatggtttagagtgatgaatcatatgtactgttaggccgtgtttagttcatccccaactaccctaaacttccaactttctatcacatcacatcacatctaaaactatcctacacacataaactttcaactttcctcaaacttccaactttttccagaaattaaacacagccttatatgtcaacattgggttttatagcagctgaagagctgcatagtgattgctttataacttatgtcttgtattacagaaacacatagatgatagagattttcttaaatctcaaccacctgctctctagccatggatcttagcctagtaaaaaacattgtcttcaatctctagccaacagagagagggacgtgaatcctgatggagcttagaactcaaggtgatggaattatttcctacgattgtgacgtggcagtagtacaagcaaggcggtgaaagcaacaacgcccagagggaggaaaggagggatttatgtctctttttttttcttccaaaatatcttcctctactacatgtccatctacattggcatgcttcctttactctgggacaattgctattgctgctattatcgacctggaattcttaactattcttgaaatcgcatacaaaatttatgttaatggcacttgtacaataactggtggatgttagtagggcgagagcttgattgaaagaattcagaggtagcagggacaaaagaaggtataacccatggtttagagcggtaaatcatacttaccgttatatgttaatgttagattttgtactagcaattgaagagaagcacaacgattccttatataaataaatatatgttacaaaatatactatagattgtgattttcttaaatctcaaccacccgcccatctcccctctctagcaaacagagagagggacatgagttgtgacagcattgaactcaaggtgtggtggcggagttttctcccgcgactgtgacttgagagtgatataaggaagtcagcgataacaacatcgatgaacgggatgaaaggaggaagaaattatgggctttttttttccttccaaaatatctcaaatttgttatttttgtgttagtaaaaaaagttctacagcagaaacactaaaatatcccaaacagaaagccccaaaaaacttcttttgagattgatgaggcaccttggggttgggcccagccagcccagtggaggtggagtactctgctcatccccacaagccacagttctccctccaaaaaccaaaaaaaaaaagttggaaaatactgcttccttctactaccccagcaatacctacagccctggaacattggccatgccaaaaagttaggctttctttccattcattcattcattcatcagctagcaaagcaaagcattttctcagctcaagttgcttgctcctcttctttctttcttcctcctccccttccctttcaggactcctccccccacatcagtagctttcactgcccaaaccctctttgtgggtggcaaccctagattattaatgtcctcctcctcatcatcaccatctcctcctcttcttcctcccctgcttctctctccagattctcttctcatctggtcccttccttcccctgctttgcttgctcaggtaaaacctctcccctccttgcaagattctcccctttcttggcatgctccaagatttttctttcctcctacatcgccggcaagatcgcttctgttaatgtttccgcgccatttttttttgtttgcagctagctgatcgcacgtgggtagggtgagtgtgtgtgcgtgtgtggatgggagtccacgcaatgtcgtgccacggcggcggcggcggtggcggcgaaggggcactgtcgcggcaggggtcggtgtacagcctgacgctgaacgaggtggagagccacctgggcgagccgctgcggagcatgaacctggacgacctcctgcgcacggtgctccccgccgcggcggcggcggcggagacggcggggaggaagacggtggacgaggtgtggcgcgacatccagggcgccagcaccggccggcaccacgcgacgcccatgggcgagatgacgctcgaggacttcctctcgcgcgccggcgtcgccgtcgacggtgccgcctccgccgccggcgcgcattggctgcgtgggcactacccgccgccgccgccgccgacgacgacgacgctgcagtacgtgggcggctccggggcggtggtggacggcgtgtataaccgcgtggacgggcacggcgtcgcggggttcctctcgcaggtgggcgtggcggggcggaagcgcggcggcggcgtggacggcgtggtggagaagacggtggagcggaggcagaagcgcatgatcaagaaccgcgagtcggcggcgcggtcccgagcacggaagcaggtgagctttccatccatcgaatcaatctgcagagaagcttcaatttccttccccccccccccccccccccccatggattcgtgagacgctcatgtggtggcaacgcaggcatacacgaacgagctcgagaacaagatctcgcggttggaggaggagaaccagcgcctcagggagcacaaggtaacaacaaaaaaaatgtttattagtagcttctcctcctaaatcctactaattgctcactgctagtactcagttccactgatcttgatgtgagcttcagctccactgtttctttgtttgtttttaaatcttttctgtggctcccagtttgcacaaactctgcaaagtcattttttagttaaagccaaactagaaatataattttcttactagttgttaggtttataattgagctggatgctcagtggagagagagagagagagagagagagagagagagagagagaggggtaacgagccttgattagcatcttgtgtgtgtgtgtgcaaatgtggtactccttgggatgctgggtcatagatgggcgagcaaaggttgcaatttgaggttaaacaggtgacattgtggacaaatcatgcacgtagtactctgcaaaaaatggttctttatatcttacttgctctagtatattttctcaatgtactaattcctccagatgcgcacttataggacagattatgactgttcagggtggtacgaatttctaatttgaactgaacgatcgtcttaattaactagggagtagtatatagttttttctacagttcagttgatgcattactgaatctttgtttttatgaaacaggctgttgctgatttctcaacattccctagctgcgtcgatttcctgaaagcattcttgacgcagaagctggaaccagtaatgcagattgtgccccagccggagccgaagcagcagctgcgacgaactacttcggcctctttctaatcaaccaaccacaatgttcatagcgaaatgatttaaactcgatctctgtaggaaaatcaatgggggtttgtacttggggatgctggctgttgtgaacaagagctgaaacgacgaactcttttcttaactatcgatctgcacgtctcttcctcttgcaaatttcactctgtggttaaactttcaacgaaagattcactctgatgggcgtgattcttgtgttgatcgatgtggtgcgaatgattctcttttgcaaggttcgagtaattctcattgatccttgtattttgctgtttgtttcttaagtttcttcgtcttagaaatgctagtactacctctgttttttttaaaaatgttaactttttacatcatgtttgatcaccttgttcaaaaaatttaagtaaatatcttttcatgtgttgtggtttgatttgtcaataaacaaaatttaagcaatacttatatttttaatatttgcataaatttttaaataacacgaatgatcaaaggttgtaacaaaaattaacaactttatatattataaaaagcggaggagagtatagtaccggtatattgtgaagcaacatattttagagctcaggtaacttgggcccttggcccgttttggaattaagaaggcctaggtctcgttccgtggaataagttcatctgagatcccttaacttgtcaacgaatcttattttcatccttcaactcaaaaatcagatacagcgggtccctcatctatcaaaaccgatgcagataagatctcttggcggtttagatggcggttttggctgatgtgactcctacgtagctattttgactatgtgttcatctgacgtggcgttgacgtggcaatttgaccaagaaaaataacaaaacttgtgggacccacatgtcagtttcacacacaaaataaaaaatggcaagatcgacattgggttcgcgctcctctcgtcctgccggagagactgagggagggaggatagagtcatagagataagatgaagggacctctgttgtacctggttttctggttgaaggacgaaaatcagattcgttaacaagttaagaggcctaagatgaacttattcttcgttccgtttgacgtcgcgtaacgggcgtaaggcctgctaatctggctgtctgggcctcccttggcgtggcccacgtgggcttgggtcaggcggattcatgtacgcacgacgcacggtcaccgcaagatccaacggcatgcagtctccggagctaggttagcgagaaaaatccgtgcaacttttctttccaacgaaccaagagggatcaacatagaatagactagattgactctgtatttaaaaagtaaattatattaacctaacacaaacctaataggtggatgcaacatagtacagtggaaaaaattataaaatacttgtcacaaacttgtctggtgtgtgcaaaattaatgacgccaaaaccgtggttgatatactaagttgaaacatgcttagaatggcacatgcacacgtcaggaggtcatgaggcatactatatgtgcaaattaccactatttttttttcttccattgtttttaattcactgcatcactggtatttttttcactgtataattagcatcccctactatgtatttgatcgagtacacatatgtctagatggcatcattctgaaatgtgtacccatgtagcatcctaataaacattcaaacttagtaagattaaccatggcatgcttatttggttctgattcgcatgcatcaacatgtccgtacattaaaacgtgtgttttacaagcttatgtaattcgttacatccaatacaatttactctttaaaaaataggcatccaatttgtcttcaacataattcgaatttgaatggtctaggcatacacccatacccatcaaccaactgagctaagccctagaatccatgctagtgcttactactagcatgcgggcgaagcatatcgatatcgatgccacgaagcggtcaatttttttcgaacagccggtcagaattgactggcgttatattgatagaaggagaaaaagtacaaatagccaaagggctaagaaagagaaaaactgtacatgacaacatgcaaacaagcttgcatgtagccttcctagctcctcattgcaacattctcccaatgtgtttagcgccggccatactccaccaacctaattcctcttggatgtgactaatcatctggtgtactgtcgcctcctttgctctaaagattcttgcatttcgttccttccagatttcccaaacaatgagcaagaagagagttctgagtcctttctgttttgttgcttccgggtcgcttgttccttgtgtccaccaatctaagaggtttctacttgtgttccatttcgggatgatgtgcccttggtgcagccatgtgagaatcccaaaccagatttgctttgagaccgggcattcaaacagaagatggtcgattgtttcgagatttcgaaagcatagctggcagaaataattatttggccatcccctgatctgtaaccggtcagctgtccacacccggttttgaagaaccaaccaactgaagattttgcactttgccagagcccatgcctcccaagacaactttgttgatggcgagagtaccattccattgaattggaattggtacgcggatttttcactgtattccccattagttgtccattgccaaacaatcgagtcttgtaccccctctattagttgtggggtgtcacgggctaaaatttcctaaacatagaaggattcatcaagaaggggaatggtgaggctgtggcggatgtcgttaatccatctttcttgttgcaacgcgtcctggacggtgcgggttttcctcttcgaatgcctataaagattcggtgcttgactttttaggctttggccactgatccaatttgattcctaaaagctcgccttttgtccgtcaccaatttggactctcgttgatgccgcgaaaagatccttatccaattcatcacagggtgtttcagtccatatccaaggcttctctggcgtcctccattcgaaccataaccatctcagtcgaagagctctggcaaacttttctaagttcggaacccccaaaccaccgtaccggacaggtgagcaaactttaagccaattgaccttgcattttccgccatgcatattcttgttacctgcccacaggaaccgccttcttgctttgtcaatttcttgaagagattgtttcgccggtttcagcaccgtgagggtgtaagttgggatggcacttagaactgagttcaccataattcggcgcccccccatgtacaacaatgatggcttccatcccgagagccgacctttgatcttatcctggagaggctggaaatgcaccttacgtaggcggccaggagtgagtggtagccctaggtaagtcagtgggaagctggctcttgcccccgaaaaactacgcaagacgtcgtccagatctacttcctggcatcgaattggtgccaccagactttttccaagattgacgtgcagccctgttgccttgccaaagtccctaagcatggtaataagaacatccacctcgctttgtacagggttgagaaaaacagctgcatcatctgcataaagcgaagtcctcaatctagcatggcgacttccgatgttggttagttgcccaccttcggtcgccagatgtagaagcctttgcagggggtcgatagccaggataaagagatagggggataggggtccccttgcctcaagccacgtctgtgtgcaatgcattccccctggtctccatttaggactaccttgaaagtggtggtggaaaagagcaaacagatccaatttctccaccgggggccaaaacccatgttttgcatcagttcaagtaaatattcccaggagaccgaatcaaaagctctagcaatgtctagcttgaaaaaaagtgttggctttttgctggcatttaggttcctgagcacattccgaacatacaggaagttgtcttgaatgcatctttttttttatgaaggcgctctgtgcaaccgagatcagtccatccatctgcctggcaagccttattgttagaactttgaatatcagcttggcgacggagtgaatgaggctgattggcctaaaatcggtcaccaaggtaggggcgttcctctttggaagcaaggtaattgctgctctgttgagtgctctaaagtttcctcctgacaggttatacaaacactggaaaacatccatgatatcctgtttaattaactgccagcatttcttgtagaaggtaccattaaagccatctggacctggggccttttctgccggcatctgctttaaagcggcccaaacttcctcctctgtaaaaggttcatctagttcatcggggtgaacctgtggtagatccatcgcgtttcaatttagggtgcaatacgtagcggtcaatttgacttcattaattctagggtgcattcatgcagttgacttcctttaatttgttacgggaaagcgatcggttaatccatgttgagggcaaacatccttatccgaaatggagttggaaccatttgaatcattaggcagagtgaatcgaatttcaaccagaaattgtaatacggtgttggagtgtcatttgggactgatcatgcagctccagatcgaacgcacatatacgaaaaacccaccgatctacactaaaattagtcacaaatgtcatggacatactcattctcaggcatcactttggtccctatgcaccaaaacaagttttgggttcatttgataggactctaactcctaaattctactccctccatcccaaattgataatcacacatataatgtttgtgcactaagacaaaaagttatttaaaccgcatcgattaagagtttaagacgtcatgcacaatatacacacattatctcataatgcatgcatcgattaaaacacaattcataattatatccttagcatgcactacattctcctatgctacattaattgtactccgatgaaatccgtgtccacgcgattatatgacactaatcaatttgaaaaattatataatgatcaatttggtaaggagggagtactttagaaggatatattagtcgtgctagcttattttgtgagagcactataatcagctccactttacttcctttttaagtgaagctaaaattatttggttgaggttcagctctatataagagatgaaattgaagctagaactacgccgaattaacacttactctgatactattacgccaacgatacacatgatgacataaaaccaataacaatgatactaggacaggaacatctctcttgtatgaacaacgtataaaatactcagagcacaagatcgatcgatgtacgcgtgttacgtgggcctgcctcatccaacaaaatagaggcgtgggcgatcgagtgatgagacactcggacatcaaccaacgttacgttacgtgcctccctctctacgtggcgctcttctagttctccctcgcacgctgcctgcctgatgccgatcgatcgatgctgcgacgtgatctccatgcatcgcctgcctctccatctcgaacatcaattaggcatgttttagctggtgaaatattttttttttgtcacgttgtacgtttgaccggatgtcaaaagggattttcggtcacgaataaaaaaactaaaaccacgagacgaatcttttaagcctaatcaatctgtcattagcacatgtaagttattgtagcacttatagttaatcatggcctaattagactcaaaagattcgtctcgcgatttatatgcaaactatgccattagttttttatttatctatatttaatgtcctatatatgtgtctaaagatttgatgcgatgtttttgagaaaagtttttggaactaaacacgcccttaatggctagagccaggtgctactgcttcgcaggtacgccatgaacatcaccatgtccgagtccgaatcctcctcgccgtcgccgtcgccgtcgtccgccgccgccgacgggctctgcaggagccggcagcggcagagcgggcacgtggcgggcggccgcgccgacaaccaccaccggtcgaggcagccacggtggaacaggtgccggcaccggagctccctcacctcgtcgccctcctcgatgccgctcaggcacaccgcgcactgatccggccgcccaccatcatccgccgccgccgccgccggacgactactctcgctgccgcctggttgttggacagcactagcggcagcggcggcgctagcgctactgtaccgcgccacgcgcagcagctcgtcgcgcgccgcctgctccggcgccaccttcttggcgatcagcttcctcaccgacgacgaccccgacggccacgcgaggctcggcgcggcgacggcgaggagggcggacaagggtggcacgaggagcaggagcagtgcactcaccaagatctccatcactagctagctatagctactcgatccacaacaatgcagtgagacgcgaggcgacatgggagacgacgcaatatttatatatctgcgcagcagcttcaattcaaagcttaatgtcctctaaataatttatctatttaattaatacccactccatcttaaaatataaaaatttagaatcggataaaaaatactcttatattttagaatggaaagagtacaaattaagatgatcgtttaattaatttatcttcgtctatctctatcgctattgtacacagttgcacaagacgtgtccaacatcgtgatcaataggatggctgaaagctctagtgctgtaaatgtcagcttgtaatagaagcatcaatggctttaatatttgggtctcgttttcaatcggtagctacagatgaacttcatctagatcgtctttttggtttggtgcaaccaaattgggcatttgctcctctgcaagtagctatgccgtcgagcatcagtaaggagatatcatacttagttcgtccttctgacttttcgatgtgtttttgcattcaatatgcaatcctttcaggacaatgacttcaaagagaggtagaataacagatagagatcgtgtcaccgtgccattcaatgcgagtcctacctgttcacaagtcacaacaccatctcatatctaggcatctgtctccctttctccccttaatttccagagctactatacccaatcgatcacacgtctcctctctgtccctggttcatttttttttaagagatggttgatgcttcttcatatatagtccaagaaaccttacaaaaaggagggcaagttaattagcatgggctaattgagaaaaatggaagatttttctctcttaatactactaaacaggagaggaagagactagacatacatgcatggatgtaataatagtaaaatcaattgggacgtccaggattcaggaaattcagacatgagggtagctctccaaatcttgttctggtcaacttcttttttctaatccggattaggcaaaaacttaatgcctatcttaatcagtctgtaccaagatcaacttgaacatactcctcttcaccgatgttcactgaccaaatataaatatcccagagaggattctagattgccaaaaacaaattattcagagttccaatgcaacatacactttcggagtgatgtaatcgtttcttaatgtcaagctcaaaagttaaacagatctggtgcacttatagttaaccactgaggtattccttcacttccactcaataaataatgtatacacagtgtccagacttagggtgcgttcgtttggagaacaaagcgagtgagtttgtttcgttttccacgcgcacgtttcctgaactactaaacggtgtgtttttttaaaaaaaaattctatagaaaagttgcttaaaaaatcatattaatctatttttaaagtttaaaataattaatactcaattaatcatgtgctaatggctcacctcgttttgcgtatctttctaatattctctatctcgttcttctcaaacacacccttaatgtctgtctgacacaaacttataaaaataatgaatgagaggtaagactaccttacgctgccgctgctcacaagcttcaaagccacatggacagagaacaggcacacctatcttaatttgattcttttatactccctccatcccataaaaaatcaatctaagatcaaatgtgacatattttagtactataaatttgaaaacatctgctaaaatatgttatatcatcagatattaagttggttttttattggacggaaggagtatgtatctactagtacttttttttttatggaaccttgcatatctatgtcagacgccccttttcacccttcattttaatgaacagacgaagaccatatttcagcgtacagtccctcagagcattgcaccagtggttgaaagatacctaaaaatcaaataattattcaaaaaggttggacaaagccaaagccaggaaccccaacatattgcttaaataccaaatttgcaggaagcagaatgaaactgtcgcatgcatttcattgaaaaaaaaattgaaactactgcaaatgctagatgctagttgctgctgatctaccacccactaatgcaggttttggtctccaatcgctcccagtgcagcaaacaacaccggcaaaaaggacacctgaattgtctagctacctaccattaggccatcaattcatgcaacatgtgctcactctttgatcatcagtcgataaaacaagataaacgcattgacactggaatatctcattctactttgccacaacttccggattcatgaagagacatgaacaaaacagaaaaaaaaaatggaatagtcgttgaagcttccgaaattaagatagaagtacgcaagctttacaaaaggtataagctgggtaatgggttgcataacatatcggtatggagtagcgaagatattgtagaagcatatgaacactgtattcacaagcatctatctttgtcttcagaagtataaactattgaggctatctgacaatctctgttctaaaaccttttctgtgtatgcagttttcactccaggccaaactccttcactgatctaggactgcagatgaagtcaagttgaggattcttgatgttatcttgtagtattgatatctgaccctccttaacaagtatgtcttcctcaagggcttcaattttcttctttagtgaggcagtctcattttgcatgatgctgatggtttttctcagctgctttgcttcctgccataaaaggtccctctcatcagttactgttttcagcgttcctctaagggcactaatctcctttgcagattcctggaaatccagctggacctgactaatgatctcatctttcttcaagccctgctagtgcaacaagtatgtaaacaaacaaggtatacaaattgtaggttctaaaggagtgcatgggaaaaaaatgccactaatacaaaaggacgatcataagcatataatccgacatagagaattttcacacgccttgcaagttacaccactagaggctcctggtactggtcaaataacatgctaaatgtcagattatagactgtctctatacataaactgatttaaggaccctggtgaattttcatgcttcacttagtataacaaagaatatcacattgtaatctcatttaccatttatagtcagtttgtctaagcatttattttatgatccgtgagctgatactgatattcttgttgaccagaagccactaaaaactcgcataatttcatacgctaattcagagtcttaaaactttggaacttcttctacaataatctgaaacacctcagttgaagaacctatcaagaggcaaattgaagagcttccgttactgacctaagctccaatactaacagatgacctttttctctcagattgtcactaatatttacggtttaggtcatatgaagtctgatttcattagtgttaaacatgtcccttgtagcacacgtataaagtcataagttgattcttagtaagac

SEQ ID NO: 63386 - DNA, 990 bp, Oryza sativa
tttcaattcattttatctccaacaaatcaatatataatcttaaatctcctatggttttcctatgatacatccaaacacatgttttaaacgattcctgtagtattacttcctgtatgattcaccatcgtgtgacatctcaatccttgtgttttttatattcctgtattctcctgtgacttttgttgagaatgccttggaaggctgaaacgataggtggtactacgtgttgtttaaactgtgctgataggtagaccacaaattagaacttaagaattgatgtttgccagcagcctagcaccctagtcggaacttggaagggaccagaataatgaaatgatttgttggtcattaatagacagtttcttttgattgacagcggaaattactcgatattgttcttcaaattattagtggtatgaaccttttgagtgattgacaggaaacaaatccaccactatctgttaaagatgagagccaaaagtctgcagttggcctgacgatattgttctgttcatagtcagtcgcgtcttcttgtattggttttgttttaccctgattgcgtgaagtgaaactattattcaggttcgctcaagtcaataagattttcacatttctctttttaaaaagggataagattcagacaatcatttctgcaagtgcatattgttctgctgctccttttgcagattataattgtcgacgctatttgtgatcccgtgcatgcactttggcactcgtccatgcctcattttttccccttccgcagccactgcagatggttggtgatcataggttattcaacactcaagtcctgaacttcccttttccttaattgacaataccagggttggtgccgatattggcttttacctaatttaagtatctccgccatgtgtggcagggatttctcttggttaggattaacctaattaaccatccggcatgatccatgcatggcacagcttgtgggtctcctatttttggggttga

SEQ ID NO: 63387 - DNA, 1016 bp, Oryza sativa
atgtggagctttagtagttagtgggcatcaactttatagtaagatatgatttgacacattaaaagaaaactaaattctattttaccacctaagttgtttcttatcagtttaatattccctccattttagaacataaggtgttttggttttatcctgtattaaactttctgtaagtttaacccagcttataggaaaatatagaaacaaattgttaacgccaaaatttggtaagccccgaggtcatcatcggcctaggaaccgtatcggcttcagagttctagaatcggctaatgggaaatgtcactcgccagcggtcagattcttagtggattcggggcatggcaattacaggaagattatcgagaacagaccaagtttaaagagtatgcggcatggcaatttttgtattaactagatagagtcagttagttccttttatttttaggaaatattgtttagagtctgatcaggacttgtatattttactttatctttaggaaagtttgtgtctttttccagcaaggactaatatctacccatgtgtataaatatgtacatcccgtatccttgtaatatatctctcgatcaatacaattatggcgcatcccaccctttttatttccttctttctcaacgagttcttgtttcaagttaggtttcattggcgtcgatctccgatgaggggtaaggcttgttaaggatgtttgatcggcagggctagggcctcgatactataatcttgtcgatgtaaacatctattcattatatatcttagttaatttaagtcaatgtctgaatttacctgtatcgactagatcttttctaaggatttattggtattaggtaaattggttcatcgatctagattagttaaggtatccaccaccctgaaaatcagtcaaaggccttattgtttagacttaatgctgcatcaattgggtttgacctacaaagtcgtgcttagaatcataaaagctaatctgcctttgattgacaataagggtttcattggtatt

SEQ ID NO: 63388 - DNA, 1445 bp, Oryza sativa
cagtggcggcggcgagaattggagttatagctaggcgatggcgaggtcttgtagtaaacgatcgtcgggttcgtcacatcccaccaatcgtgctcccaattccgctgtgagttgggcaattcgattatcagccagcggtgatgtgccggtgtggtgcaaaagcggcgcagtggatctcctggagcatggacaacccaggccggtggtactacagatgcaacaatcagttgagtgtttgcgatttgttttgattgttttttttttgttggacctagcacattggttgggtgattttgtatgtcaagttttcagggcgccggttgcaatctttttgggtggtatgacccccaacaagcagctttttgagggagttgttgaatgatcttcctgaagccgtgttgtcgctaagaagggagaaggctgagttagagcgtgctgttgaagaactgaggccaaaggaagaagagcagtgcacagagctgagtgcagcaataaatcaagtggcaaatttgaggcttgtggcatcggagaatgatgcaaaaatggctgctatgagggcaattaacagtaggatagagaaacagagatttgtgcttgtaatgttattgctggcatgtgtgtttgtgatgttggttgtgttactagttcagacgtgaggtgcaatatgttttttttaattacatagtacaacgcagacactcacccctgtgaacgcatgcacgcaaaccctacccctatgagcatcttcaaagactgggccggcaaatccttgagattgacgaaatcactacaagcgcctcactgtcgacagtacatcgcccaccactgaagcacaatgccgttaaatcctagaacattcgctctcatggggaatcgaacccaggacctaaggtgctattgaggctcttgtaaccactaggctatagtccctttcgcatgaggtgcactatgttagcaccaattaggtcacaatggtggttgttctagtcctattgctgccatttgtgttaggtgttagttaataacttgatgtgtacaacaactgagctgtaatattctgaattatcaatgaatacatctaagatgcaatatggttgtctggaatttgagtgaatgcagctatggctgtctgaaatttcagtaattccagtgaatttcgatgaagatagctcacattgcacattgcacaatattttcatattacaaacatgatatagctcacaaacataagataccaaatagaacattttgaaatttcagcttagatcaggtcaacatatcagatcatacaaattcacaaacataatatcagctcagatcatcacaatgcacataacttcaacatttttacatgccatctcagatcagatcagtacaagccacataatttcagcaaattgaaacatagctcaaatcaaattatcaaatgtcactcagttcaaatg

SEQ ID NO: 63389 - DNA, 43621 bp, Oryza sativa
taaaagcttagttgggcataaatgacgaaggaaatataaacgtataaataacaacatgaaactataaataactttgccgggaatgataattcaatatcaggaaaattatataacttaatcatattttcaaatttagctataaataatttaatatagagaaaactatatgttacaataatttttagtggatcaaatagtgctaaatctaataatataaatgaaaaaaacaacttaaattagttagaaattgaaaaaaaacttattttagcccacgtatgaaaatctgattcattaattctgaacgggtgcttctttcattgatataaaatagaatttttcatgttctattcatactccatttgtcttaatatgatgtgagtggtccaggagcatggttgggtagactaagaaggaataatgcccaacagacgttgttcattgttttccctagctcaaggcgagaaacaaaagaggagggaaggtgagcgtcggtgctccggcgaccaaacgacagtaaggaaagtggtagtacgtatcccacgatgtgactcgttcataaatggtggaggttggcaatgaaaaaaccggaacaagagggatgtaggggggcaacgaggtagtcccgtgatagattgagaaatgacaatgatgagctctagtggtgaacacgaccaggtgagtgtgtcaaaactcgttcctaaacgagaggattatgttttccttgaacaagcaggagaaaccgactaatattatctatcgtcttccctaaccaacacaataaacaaaagagaaagggagatggacgacggtgctccagtgatcaaacagtggtgagtaaggtggtcgagtgtgtttgacaatatgactcatccatagatggtggcggttggcaacgaagaaaaccagaacaatgggaatgaggtcgacaacaacatggtcctgatagagagaaacaacaacggtgatctcttgtggtaaacatgaccgagtgagtacttcaaaacgtgctcccgaacgaggaggttctgtttttcttaaatgcgtaagagatagggaatgcaggagagaggagggacaccagggagaagagatgtcgagggggagggggagcatgtgtagcgaggaaaagatgtgggggtgtgccgggagggaaggagggaggcgggagaggaggggcaacgccaggaaaagagggtctgcgggggagagggagagatgggggcgccaagagggagggagagaggcggaaggaggaggggcaagggagggaggggggagcggacggatttgggggagggggagagatgggggcgccgggtgggaggagggggggcaagggagggaggggggagcggacggatttgggggagggggagagatgggggtgccgggtgggaggaggggggcgacggaaggaaaaaaaggcggaagccttaagtattttttaattaggtatagataggccagattttggcatacatacatacatacatacatacatacatacatacatacacacatatatatatatatatatatatatatatatatatatttgaaaaccaggaaatattattagtagaaacatagaacatgagttattttacaattgatagaagagagagtctagtagggtaagcaatatgagaaatattttgacagctaataacaggatttgacagaagacttgttctagatttccatgccacctgaagcaaattttcaggaatgtctctttgaatttggctccataaaggtctgaggcttcaatggcctggttcattgctgaagtctattttcttgatcgtatccgctattactgaattatcagttaaaaaactagtacctgcaaagttgaagaatttggcaatctccatagcaagttgcaatgctgccaattctgccagcaaagaagattgagccacctcacttgtggctttaataaaaagagcatttgtgtgttgtcggcatgtggaagaaaataccaatctttgtgaattgattctcccaagctgcatctatataatatttattgccctccggaatagtctccattcttcttttatatacctcctcctgaggctccacctgcaaattatgatttatagagaaaagagtatatatgaatttatcatagcttctgccgcaaaacacacttgggtcggctcctttaagatgccctgaaatttcagatcattcttggccttccaaagctgccacacaagataatcaaagatttatggagatcaattttattagaaccatttgaggaaatgtaagcaatgatgtgagccagggaaacattatcagagaaaatgtcagtactcagtagaaagatttgcttcagaaattctccaggttagtctgctaaagaaacaaccaaagaaaagatggaaatctgtctcagggtggttgcaactacagcaattggctgaaatatcagaaattctgtgatttaacctttgcgctgaaggcagagcttctccaagcaaaaactttgaccttgggaggagtttggtaaggcatgtttatttcccaaacaaaaatttttatgctttaacatcgaatgtttggacacatgtgtggagtattaaatgtaggaaaaaaaccaattacacagattgcgtgtaaattgtgagacaaatcttttaatcctaattgtgccatgatttaataatatggtgctacagtaaatatttgctaatgacagattaattaggcttaataaatttgtctcgtagtttcctggcgaaatatgtaattaatgtaatttattttgttattagactacatttaatacttcaaatgtgtatccgtatatctgatttgacaaccaaatctaaaatttttccccggctaaacaaggcctaattgagttgtgcctaaaccctaggctacagcgaaaccagcccgtactaattgtttgggcagcagacgtacacgttgttccgtttgaatttaactacgacgaagataaagctagggtacgcaaaatgataaaattattaacatgtgattaattgatttttaatcattacaaatttaaaaaaatagatttatttgatattttaaattaatgtttgaaaaacacgctaatggaaatcgaggaaaaaatccgtatcttttagctacaaaagaacaccaccgggttagagcaagtttaatagtataaccaactgctagcttcaaatcatctatagccaatgtaatagccaattcatacaactaggaaagtagcccgcgcgaatgcgcgggcatgcgtcgtacactatgtttgagacacttataagagtgaaatattaactggagaacatatgccacaatttttctattgttttcattggcattaattgtttttataattttataacctattagctttatattacatcttatttaagcgatatttataagcaactatttataatcttcttcatcatttgaaaagaaggtagactaattttctttagaaaacatgtcaccgaaagtaaaagtaaggtaaagtaaaagtaaggtttttttctaaatgcatatatattatcatgatttattagaggatgaattgggtgggacatgaagctccactaaattctatatagcctaatatgattgatgtagtttgagaggctgtccatccataaatattttatgtacagtgggtaagaggttatacgcaacctaacatgaatacaataatgataagatatttatatattttgtttaatatttttaataaaatgaatggtcaaacattattaaaaaaagaaggaagtaatatatttttatctttctcttacatggaatatcctaattccatatttcttttgcaatcatacttgggaaaatatgtagtgatgtggacaaatctcatgcgttcatttttgatccaatggtgattttcaggtttccactacgtatgttgtttgtactgtatattttttccatcatactatacgtaggtaagtttgttttgggttttgggctataacgtttttcccccgtgaactgtatgtacgtggtgtactttacgtacatacttattttctatcatacattttcccggtgaactttacgaaagcatgcattttttttctgcatacgtggatggagattagggagtagagatcacttttttagtttttttaagtatgataatataatggtctaaaatattgggtccatcaacgtaagtaaaaataaatatctataattttctctaattaattagagtgtcatgttgtgatgtaggaatgtttgcagagtaccacgtgatggatacgtagcgtttgtaaaaagtttaataaacttttagtatataatagatacatggattataatatgttagttatctaatgtttgattttaattaatattaaactttgctaggtagaaaattaaaagatgaaagtatatataacagatgataggagatagatggagggactgacgtaccaatgttacttaggtgatgatggagtgagggtgcctaggaggtggtggggtaggggtgggatgggatttatggatgggttgttggattttgtttaaagatggatctaatggtgaaaaataatagatccactgtattaattaaaaatttaaggtcggatgttttctttttttcttggaatttctttgatttctctaatttattaaagtgtcgagtgacgatttaggagtgtttgtagtgcatacgtattttctatcgtacgttttccatgtgaactttacgaacatacatattttatctcttacgcggctggggattaggaaggatatattacttttttattttttaaagtatgataatctaatggtctaaaatattgggtcggtcaatttaactaaaaataaatacatttttcttagaatatctatgattttctctaattcattggtgtgtcatgtagtgatataggtgcgtttatggaataccgcgtgacggattggtggcgtttgtagaaggtttaataaacttttaatttataatagatagatagattataagctgttagttatttaatgtttgattttatttaatcttaaacttataatataatatgttagttatataatgtttgattttatttaatcttaaattttgctgggtagaaacaaaaagatggaaagagtaatcgatgataggagataggagacagagggagggacggacgcacgaatgttaagtaggtgatgacggggagaggatgccaaggaggtggtgggttaggggtgggattggatttatggatgggttgatagatctaatgatgaaaatttcttcgacttctctatttagtagaacatttgtaaaaagtataatggatttttttatataatagatttaaaaaatacaacaggatcacaaattagatactctctctatcccataatataaatcgtggtgaaagttggcatggtcatcaaaactaagttttagcttataatttttcatatactataaggttaatagtaacaaaattataaccatatgaaagtaattttaaatttcaatctaatgatatatttttaacaaataaaatttattttatattatacaaagtgttagtcttaaaatatgtgcgcgccttatattgtgggatagtgggagtatattttcttttacaaaattaaaagatggtttaaagaatgttgattggatattttaaatttttttattatatatcttaattttactacatatttatatttgtgaagtaatatattttatttttatattataaaaaataaaatggaccgttaatttttttcctccgggcagcagaaggaaagcttcgttttaaacagtaatgtacgtactcaaatttttgtttccaatcatacgtacgtacctacgtaggggacagcagtcatgtttgtatcatatatacggtcggaggaagttattattttttaataataaatttaatctaatggtgtaaaataatgggtccacaaattaagcgaaaatcaacggtacggttaggacgggtccaccaatttaagtgaaaatcaacggtgagattagatagtgccatgtgacggcttaagaacgtttataggagtgacacatggcagcgttagagcgtttgtaagaagtttaatggacttttagtatataatagaagatagatagatatagttgcttactgtattattaatatctagtcctacctatcatatgcacattatgttttggagctggctataaatttgtagcctgttgctgctctatctctttctttatttttttaaaatatgtttatagctggcttatagtttttattgtacctgtatgtaaagatgctcaagcacgagctgcagcgcaggtggtctgtgagaagtagcagcagatgaggagcgggccctacgttatctcggagcgtggacacgactacgccacgtcggatagcacatcatgatcggcagctaacccaacgtagccgcaggctggagctgtgttggaaagggagagtgatgaatccatgaacgaaccattagcagctagctaggtcgcgggctgagggctgactaatcatggagcaagcagcgaaggccaccatctcactgtcgccgccgagttacgctggatgttgcatggcagcatgtccctaccgatcaacgcggcacctgcgcagaggaggcggctgctctgctcgctccatctcctccctccggcatgccccttctgctcgtgtttacgccgcagccgcagccgcagccacgccggagtccaagtcgacgaaagagaatgacctcgtcttcatcgcgggagccaccggaaaggtgggatcccgagctgtaaggtacacctcctcctcctcgatccgttcgtcctccaggccggctagccagtcatccctcgatcgatctgtccctggaaaaatatactccagtatgttaattactgcagagacacgtacgcttgtatgcgcttgcagggagttcatcaagcttggcttccgtgtccgcgccggcgttagaagtgcacagagagcatcgtcccttgtgcaggtaacaataatccatgaatcttgctaccagctacacctatgtaaatgttggagtacagtacttttcatttatacatcttgaccatacatacgatcgacatttcaatttcagagtgttgagcaactgaaagtcgatgacgatgcaacttcgcgtgagtcgtcggcatagatatattaattcgagtttccggttaactgtttgtgtctgaactggatcaataatctctagaccagccgcagaaaggctcgagatcgtagaatgcgacctggagaagcaggcgcagtcagacatcgtgtcggccattggcaacgcggcgattgtggtgtgctccatcggcgccagcgagaaggacatcctggatgtaacgggcccctaccgtatcgactacatggccaccaacaacctcgtgcaggctggtatgtatatataatatactctagctagcttaattagctttaatttgttcatcattaatattactctataagcagaaacaattaataattgaaactcattaactacgtacatcattgacgtacgtgcgccagcaactgctgcaaaggttgagcacttcatcctggttacatccctgggcacaaacaggattggcttccctgcttttcttctcaagtaagctagatcgatgtgtaattaattaatttccttgttcgatataattattggccctgttttagtttgaggaagaaaaaaagagatcgatatgtatgcatatatatgtagacagcccagccctttaggacgtacaaaaacgaaatgaaatttatgatgcatatgcacgcatggttacagcttgttttggggggttctgtgctggaaaaggcgagctgaagaagcgctcatcggcagcggccttccttacacggtacgctttctttaagataataaaaatggtttgcatcttcagcttctaccaatgagtttaggtgtattgtcaggtatatatacactatatatatgcaattaattaatgggttaattagatccatgctattaaaaatatgctgattttgaaatataccattagtattcaagtattttgaaccatgccattataattttatacatatttgatatatgccactatttatcacttagatgcatttaaaaaaaaattggacaaaattgcccttcttcttccttcctccacttcttctcccttcttcctgttcgacggcagcggtggagcggcccggcggcaagtggcggcggcaggagcggcggtgcggcgggcggcggcgagcggtggcggcgacggcagcagcaggcagcggcgcgacgacaagcggcctcttcaccgtcaatcttgccggcctcttgaaaccagccacgcaccatgacagtgtcaccatccccggcgttcaactgctcccaattccccacctcacacactgctgaaagacgcggcggcggatggacttggggtcgtcgtcccaggggtagtcgtgttcgagctggaggatggacttggcggagcggcccggcggcaagcggcggcagcagcaaggagcggcggtgatgacagcagcagcgagcagcggcgcggcggcgagtggccgcagcagcagcggcggagcaagaagcaacaagaagagggggtagaagatgagggtaatttcgtccaataaatacaaaatacgtatcttaatggcatcgttacaaatatgtaaatattaatggtatattttaaaaccagtaaaattttaatagcatagatctaattaattactatataatttctcatcagatcgtccgacctggtggcatggagaggccaacggacgctttcaaggagacgcacaacctggtggtggcagttgaggacacctacgtcggtggactcgtttccaaccttcaggtggcggagctcatcgcgtgcatcgccagcaacaggagaacggcctactgcaaggtggtcgaagcgatcgcagagaccaccgcgccattgctgcccacggaggatcagctcgccaacataccttcaaagcgggtatacccatgcctattattagcatttaatttctccatttcatattataatttgatatttttcacagtcaatattttttattttaagctcaatcaactttattagaaaaatatagcaacattttcgataaaaaatcatatattatcggaatataatttaatgttagtttcgacgaaactaaggctgcattttttcgcttagatttgagagagatttttcaatgcacgcaaaacgagaaagattattagtatatgattaattaagtaaataattataaacttgaaaaatagatttatttaatttttttaaacaacttttgtatataatttttttttgcaaaaaaacaccattgaacagtttgaaaaatgtgctaacaaaaaaaataagcaagttaaagtttggagttgatgaaaataataatcctaagttgatgttgctatttttttaaaaaaaaatttagttaactcaagtaagtttaacttaaaaaaattaaaccgacttataatatttttattatatacatatgaaataatgtgttaaattgatggcatatgtatacccatatgtgcagcaacctccgcccgaacctgaggtagttcagcagggagagacccctccaaaaccgatccagcaaagccaacgaccactctcaccctacacggcgtaagtataacgtgcacctacatatacagtacattctactccctaaattaatcctattttttctataaaaaaactagtgtagaaactttttcccttttagagatggttgccaagagcatgctcataatcaggactgaaacaaaatatctatctatctatctatctatctatctattatctattatctatcttctattatataagtccattaactttctacaaatgctcctaaatcgccacgtgacactttaaaatttaaaaaaattctttaaaattctgaaaaaaaaacatctaaccattgatttttattaaatctggtggacccattatttataaccattagatttatctttgagaaaaaaaacatctcctaacccgggtccacctggcatgtaggtacgtacattcctgtacgtacgtctccccatgttccctcaaatccttggttcctcctcttttttatcacaaaatataacctgagaagttaggcttaaccagtgacacatgtgtgagggaagtactactatacatgcatggcttttttgctattagacatgcatgtcttttttctctcttcttataaagttttctcacaaattacttgtccgatcaacaattagattacaccatcgtattcgttgcaattaaatctttacatcaaagatcttacacgattatattacgatgaaaaaatatttatgtttgtaaattaattttattatatacgtaagttacttttatcatatatataaattacttttagatttgactaaattacttcttatacattcataatactctaaattgattatttttattattgttttaagttaatttaataatttatggactttaaatttaatttttacatagaccatatttttctctctacagcaaatttacttctaatgttgtaacaacttattttcattttgtgctaagttatttttatgattgatgtaaattacttttagactttattaaatttatttttagactttattaaatttactttcataaatgcatttacttaaaaatattctctacgctttacttgtgaatttactctacttactgtttcatttcaactcagtcacaaatgtaattacttctactacaaaaagttactcctgttagatagctaagttatttctacaatttcaatgaattgcttttaaattaataaattgtttgaatatattcaacgtgcatcttgttttctcacatgttttatatagagtacaatgatgcaaatagatcttgaaaacaatatgtgatttaaaatatataagttattaaagaggttaaatctaaaagtaatttatatatatgataaacgtaacctacatatatattaaaattaatttacaatatagatatttttttcagaatataatcatgtaaaatcttattgtaaagatttaattataacaacacaacggtataatcgaattatggatcggataagtaatttgagagaaaattctataagaagaaaaagaaaagcatgcactattgagtctagtagtagcaactaaagtgaggtcgcagaatattatgcctaactagcgatggttttgtcatagtcacgtcccttttttttatctaatcattctcttatttttatgccttactctctccgtttcaggttataagatgttttgactttggtcaaaattaaactgcttcaaatttgacaaagtttatagacaaatatagtaatatttacattaccaaattagttttcttaaattaataattaaatatattttataataactttatcttggttcgaaaatattactattcttttctataaatttgattaaacttaaagcagtttgactttgactaaagtcaaaacatcttataagttgaaatgtagggagtattagttagaaaaccaaaaattttgcgattttgctaaatatttatttacagatttttttttggctaaaaatcactcggtattttttaccgtccgattcattgatgatttctgtgcttcgttattagccgcacagtttctttgcgtgtcctctttccttttccctgtgttgtatgcacatatttattcgttcactacccgtgattggttggctatcgtttgagagatagaagatgcatattctctatttactagctgctatatgactatgcgaatggcttctgctgttcttttgtgagactagcatactacttttatatatatatatatatatatatatatatatatatatatatatatatatatatatatatatatatatataaatacatatcagttacactataattatattatatttctaccttagttgcatttgtatgattttagtggaaaaatctgtcgagcgatacatagatagaccaaaaattttgtgttaaataattgagcaactataacatataaatcataaaactaatttttatctacttacatctttaaattatttatgaataaatttagacttgaagaccaaacttcactataattcaactttgaatgtcattttgggttatactttttgatttttgagtgccatcaagcaattattaaaaaaataaaatataataataataacaatatagatttcattatcgtaaacaacttcataatagtcaaattagatctataatcattaaagtaaaatgataactatgagtaatgttcccaaagtatattagttagaaatcataagttatggctggaaataagcaactataacatctaaaccatacaactgatattttatatcatctaaatcatacatataatatttgatccacttatgtctttagattattttacgttcaaagactcatatccagtgtaatttaactttgaaaagaattatgtcactttcgggaggtgtattttctgaattctgtgtgccattcaaacaatttaaaattataaaaagatagtgatttagattttatcatcctacataactttataattattaaattagacctatagtgataaaatttgaattaacctaactctgagtaataatgaaaaattactcccaaattctaacattataataagtcaaaataatattattagatttgtagtgttcatattttgaatatctactatgaatatgaatataccataagaatagatgagtaaaaacttttattctatttttatttaataaagtaatagcaactaagatactattacccgtgaaaaaaatataattatctgcaagcgtacattctccccttcggctctctcttcctctcctctctcattcaattcctccgtgttctaatttttaactaattaataaaagctatcaatatttagaaagaaaaatgattataattcttaagtgatatcctatttttattttgtgaattattgttttatttatagttaagtaaataatttaagatccacattaccacttatttctgcataaaataaaaacacgtcatttgaacatagacacctatgcttttgcatggtaaccaaatagcaaaaagaacataacattatcacaagtacatgctctgtagcgcacttaaaatgtcacgtttccgtcttaaacaaaaataaaatcatagatattgtaaagaaaaaatcatctgccttgtgttatgtcttaaaaattaaaaaaaagatattagaaatgtgagaaaaaagttggatcatcggttttcacttaatatcatttagagaaaaaaaccacccctccgcttcagcctcccccacacatggacacaatacaatactacatgtctcctccctgtccttttatagtttgcaataataaaaaatattaaaatatgcataatttttaagatactcatatgatttctaatctaactattgttgtattcacaattaaaccaacgatatgaagatccataacgcctaaattttgaactggtataaaataaaataggaaacaaaaaatgtcaataaggactaaattgaactatttggagaaaatttaataagttcgtaaaagcatttgtgcttaatttttactaaaattggaccaaccattgcatgtcccatttttataacaatttgtaaatgcttagtttctcgatatactattgcatatataagccacgctaaggttgttgtatatagtttgttgaaaagttatatttcttactattaaatttaattttttggattcatgttaacaaggtattttctttgaaaaagagaaagtatataccgcaaatatcacaaggaaggaggtatacgacatctctttgttaatttatatgcatgtatgtaacaacttgtgtcaatctgaaccaactaagtaggactagcttacaaataatacacattattaacaataatagttctttagggttttaaaaaaagcccctatgaatttaattaaacaagataaaacaccttagttttaagtgcatttacacttagtttgttagacacgtttatcaaatgttatatattttaaatgctaacaaatagtttggaaaaattatctaagcaataccaatgaagaaaattcatagagaaataatacttttgaaatatggcatcttacaatgggttgatattccgcctatataaatttttcaaacacaatcaataatatacatgtccgcacgaatgcacgggctatcttcctagttgcaattaatagttaaaaaaatgttttttacaaaacatatttagggtgaaacattgtctgacttttaatataattttgattgaaccattattatgaatgtttgcatgcgggtgattttttttcttgaaatattctttgattctactctaaacctgtttctgtcaataatttatttgggattgttttcatagtggttatgattttcttctaattacccttctaacatataaattgtaaagtagaaatacttgaaatcgtacagtcctgaatttatgagaatttattgtagtggaataatggagtttctaaactttaaatactatttgttttttttgtatatatagtattttctctgttttttaatatataacaccattgattttttagactattcatcttattaaacacaattaactaatgctatgagagagtatatgtatgaagagtgccgccatttatagatggatttgttcggtttgtttggtttgtttgcacatatgtggattaatttagttttgaatatttgtaaagttgtatatttgatttcataatatatacgaagatttttagaaatttctaaggttgtttggatcacgtgtaaatgatgtaaatgaggtagatatttgaactaatgacataattgtaagcacatattattttacatgtaagaacatataattggatcatgccactacaaatatgccattttagataaataccattactattcacaatatcggctcatggcactgaaacatggggaaattggaatagtgccactccatcatgttttccgtcaaaaatttccgttagccctaactgcacattggacctagctagctgtcagttccatcttcccctcactcccctctcttctctttcccccttcctctctcttcaccaccgtcgtcgaccaccactgtcgcaaccaccatcatcgactacctctgctgtgggaggcctcgggagccgccacaaccaccaccacggtccttgatgccatccgcgacaggaggcttgggagcagccatcctcgaccccatccatgcaggagggctcgggagctgccaccgccatcatcgtcgttgtcctcgtagtagttgcggggatgcatggaggaagagatagggaagaaagaagagggaggatggtggaagatggaagtgatatgtgctccccacgtctaggggtctgacggaaaacatgatggagtggcactgttccaattttccccaatttcactggcatgtagccgatatcgtgaatagtagtgtcatttatctaaaataacatatttgtagcggcatgatccaattaaccctagtcaatatatggatgtaaaaactattaatttaattgtgaagctagactacaaccattcaaatggatcttatcaaggtgtttaaaagtgtgcatacaaattatattagccgttttttgacttgaagtccagcaaaggaaaaacaggctaagtgccctagctagattacttaacattttctatcatcaatcataccatcaaccctcttatggcctctaaatataggattaggcttattggtttcaagttttaagttaaagttttagcttatatatgatttataattagtggatttaaagttctaagtttaacggtggagtcatacatctgtcttacataagctaaaaaaagtttctccaaccaagcttttgatttaatagtataagtttggcttatggctttaaaaaaaccaaaataattgcttgtttgtttaggtttaaactttttggctcataataaattggcttataaatctaaacaataggcccttagctaggaccaagcatccattgagtttatagattttgattgcacatgtgatctctgttcacaccaagtcgatgagatgcacggatgcatgcaagcgcctcaaacatttatgccataatttttatggaaggatatgtttaacctataactcatcaatagagataatctatgctctaattggttcacacgatgctaccatttgcacatataccgagcaagacatctaccccttccagtccacattttggacaatgatatgatatctaaaatatataatatatacaataaattattttttctctttttattatagttcgctgtaagataaatctatatatatattgttctaataactctaaattaaatattatttgagttattgatagtaaaagatatgaaagttacctaacctttttcaaaatttcagagggagtaaaatgctaaattaaattatttactataaatttgtcatagtagcttgtgattataaatgcctcacacagtcacatgattgcaatgaatactgaattaagcattgattacaatttacaagtttggtagtttcttcacacttctttccctaataattcctaccgtttcttatttttcttctctaattgtaagatcatttatggatttttggtgtgcatatgtacgcatatagatcattcacaactgtgtggctatctaactagcataaaaaacgatgcatgatttgcttggagagagttgggcatgtacgggaggcagtcaggaggcggtacgtacagactcatacatatataatatactaggtgaaacccagcgcattgctgcgggaatttagtataataacaataaaaaaaataatatgtaaaatagctagataatattagattaagtaaattaatgtggtttatgataatttaaatttaaatagtatgtagaatggtgattcaaacgtaaaaagtaaggtagaatgactttatggaagaagaaaaataggaagatagtttggaccgtagattaatcatctaaagactaaaaacaattgatataatatgacttaattagagggaaaaaggagaaagataatttgtaccatagattaatcatttaagcactaacaagtaaggatgaactatataagtatataggatatcataaaacataataaagatatactttgaaacattatgtgaattatgttggatgataatttaacatgtttgtatttgaaaagctcttaaattataaaaactataaagatatagcatgtttacatgatgtttaaatgtgatgattgttagtggatgatgatgtgacatcttgttaattagtggactagtggatgatatgcgatatctttgcatgttaagcttaaggagttagtggaggataacttagtaagataggatacctacaggaggcagggtttaaggaatttattttttaagattgatctaatggttgatactaatgggtccaccgatttaaatgaaaatcaatggttagattctttagttgccacatgacagtttgagagtgttttgaggagtaccatgtgacggcttgagagcgtttttaggaagtttaatggatttttagtatataataataggtagattggggtgctaatagatagatagatatattaattatattatactctctctccactgttcacagagaaaacgttcgatcgcttcaatatcgaaatcctaactcattagctttgtactgattttgccataacttcagattacctgttggcaatatatagctttgtgctgatgattttggccggtctggcatggctacagatttgtggacctgaagcctccaagctcgccatcgccgtgcccaccatcagcagcagctcctgctcctacttctacagataccgctgcggcaggttcatcgtcaacgttgaactccagcgccaccggcacccccatcagcgtggatcaaccgaagcagcagcagaggcctctttcaccgtacactaggtactatatatacttaagactaattgattaattgatgccatttcatttttggtgttgtctattaatgaattggttaattaatttgttgaatgcacggtgcaccgtggatgtaatgatttgttctaagatatgaggagctgaagccacccagctcgccgtcaccgacgccgccatcagcagcttcatcggcttctgtttctgcttctcctgatacacctcctgcagcagcagcttcatcggcggcgttggactccagcgccaacggcactcccatcaccggcgatcaactgaatcagcagcagagtcctctttcaccatacacaaggtgcgtactgtacgactatatatgtatatacatgcttgtccattcttgtactaattcgatctttttgtgaatgcattattcaaggtacgaggaactcaagcctccaagctcgccaaccccatctacccccaaactatagaagcaagatagttagcatataaggctatattcgttttttgccttggccaatcatcactcaagatccagttatccactactagttaattaccttcatccaggaaaagcgacttgtatttttcatgtccaaattcaaaaaaaacaaagagtagtattggaattggaagtcaacaaattaattctctctaagtcttacaatgtttgtgcaccaagacccaggaataatttaaacggcatcaatcaatatgacatgcacaatatgcacacattatcccacaatgcatgcatcaatttaaaacacaatgcacaattacacccttagcatgcacatattttcccatgctgtattaatttaattgtactccgatgaaatccttgtccatgcagttatatgatgatcaaattgagaaaatttggttttcaatatatgatgatcaatttgggcaagagtgagtaagtcttaaccataaatactccatccatcccattttaaacatcacataagcaaagaacacaaagatcatggacaactaaacctttatcattctgtaattaattctcatcagttataagagcatctccaatagcctctccaaatcggactctccaaacacccatatagccaactctccatcttatttggctagtcaaactacttactcgctccaacagcctctccatctacccactctattttaagtctatcacagtgggtccccacatgtcagtcgctgcttcttcttcctcctctcccctccttcctctttctcccgcaggtatcaccgagcgcctcttcggcgacggcgaaggtggaactgtgcgcacgcgaggcaaaggcatcggaggcggcaagggggaagggggtgggagaaatccgtgtgcgcgaggtgggctcgtgcagcaagtagacgacgacgatgaaaggggagaagcaggcggcggcaaatccgtgcacatgcgagtcgacggcgacggcgagggatgacgaagactacggcgacggcgaaaggggaagccggccccactgccgcctcatttcctatctcgctagcgccaccactcccttcacgccgccttgtctcccttctcccacctcgacaccgtcgtcaggctgcgaggtgacaggttgcagcgagtggcggggcgggcggaggcggggtaacggctgcggtgagcggaggcggcgggctgtagcgagcggaggccggcggctgcggcggcagggcggccagaggatgatgctatggcaggctgcggcgagcggcggggcgggcaccgtcttcacctgccatagcagtgctcctccccgtgctcctcgcctggttgcctgtgctcgaggggtgggaaagagacggatgcgagagagagagagggggggtatggaggagactgtcagtgtggggcccaccattggccagccaaatttagccagtgaggaggagggtttggcggccagtgagttggagaggctgttggagcatgttttttgggtagaatagccaaaatttaacttggagagtcaatgggagaggctgttggagatgttgtactacgttgtttcgtatcccatggattacatcaagttttaaatattgcatgtagttgaccaatagaaattaatcttggttggttgcatgcggcgtattcaatgatgctcatttactctttttgcacaaataaataaagatgtgtttgttagaggatgatcattttgggaagatctcaagaaccttacgtgctgatcaaattaggatagagggagtaccaaatttcaggaaccaaaaggctttcttcttccatgcatcaaattcagatatacatttccagtcctagttcagctacaacgctcttcgcgggagcgattcctcggacagcggggagtggagaccccttcccaggtgtgaagattggaccaggggtttgtggtgcaaggcataggaaggtatctaggcaagatcggatctgcggggcctgagctccccgctgagcaaaagatacatgaatttatacccacccggaggtgtaataccctactcctgtgttggtttcgttgtcttcccaagataaggtaagtacaagggaggcctttccaggcaacaatgtgaaatgtactgatctaaagaatccaacccttcatccgtagcttgtcccctcccttttatagtccaaggaggggctcacattattacaaatatactctttgtcttgtcttatcagccgtcttgtcgttgtcggctagttctctaacacaatcttcaagaaacccattgagatttgaaacctgcattatattaccccgggtacctgggcttctgttcgacacagctgggttgcgacaactagcccaccacgtggcaagtggtgggcctggaggaacccgggctgcctgaaacagcgccacggttcctcttctgcccgtttggccaaattaggtggtgtgaggcatgttcgacacgcatcaaagacgccaccagttctaatgactcagcgctggtatcttgtccacgtcctttcagctccagactggctggggctccccataaacatgtttcatttatggtggagaggtccacttcacaacagtccatggagtgcgcccatctccccagccggtcctgatgttgcgcccttgcgctttttgtgatgataattcatctattcttaggcgagcttctcgaagatgtcgttgatcagtagataatgtgcttattttgtatgtttagacgctcttctttgcagatgaacttggaaactataaggactaaggtgagctcggggcccaggacaaggccgggcctaaggcagacctgagtctacttcttaagatgtagatcttgtatgtctctacgctcctcttattgagtagcataggacttacaaagactaaggtgagttcgggacccaggacaagaccaggtctgaggcaaaccttaggttacattcctcttcatagagcagtgtgtaacctagacgtgctaaggtgaacctgggacccgagacaggactgggtttgaggcaaaccttaggctacattcttatccccgaagacaaacaaaggactcaccaaggtggggcccctagccctatcaccctaggagtagctttttatttttaagaatgatttaagcatgtcatttattttacttctaactattttgttagagaaatgggtaccttggtttccatttcactgaaagtagcccccagcctcgggctgggctagagagatgaacgaggccgggcctggggcttctctccgaaggaaaaccgaagtcaaggtctcgggtccaacttgtcagggttcaacgagcgtgacaacactctgtcatgtcgcacgtctcatcattctgtgggtcagctgcgggagttaagccacgttcacacgccgccttaacttcccactaccatcccgtttttcgaggcgtcgtgggcgtggagaccgaaatgtctactcggggtttcttcttttaaaacctccctttcatccccattcgatctttccacgccctagcgctcttaccctcgattcaatcttgccgccaccgatcttcactaactccggtcatctttccccgccaccttctttctctccttttgcctgcaccatgctgttgtccaaccgcaacacactgtcggtgccggttgaatagaaaactaagtccatttgaaaatcattaaaatagttagaaataagtagaatgcattaaatatatgtttggaacttttaattttttaaaataattaaaataaggataatacatggaaaattatatttacaattattcgagacatataaaatttatatataattaaccatatctccgattaagtccatttaaaactcattaaaatcgttagaaatcagaagaatacattaaaaatgtgtaccatcggtttttagtttaattttgatgttttaaattattatatgattatttaatttttttcactttcgtggacttcctttacatttgttatcttctgatgtagatgaatcggcaatggatgttgtcatggttatggataccacatacttaatagtagttgactaaacttgccagggcccaccgcataccatgtcttatacggaaacaaacctcgtatatagaaggagttccggataatgaaggataaatagagttctatatggaaacggcaaggactactcggattgtatccatatttatctccctagtcttacttggacaagagggcatatatgagtataaatacaagccccccaggaggagaggggtcacgccacaacgcctcaaagccacaagccaacacacgtcgccagatatcaacatcagatataagtctagacataccccatccgactcctacggaggctggcaagagggatctagcaccatctctgatctcgccgagtacggattcgaggaggaagactaccctgttgtcgactacgggttggttatctagccgcctagtcgacgacggctagatgagttatcccaattattgtacttgtgtgattcagatgaataaaggagcaacaccagctgcggccaacaggatgtagggctattacctgtcagataaggggcccaaacctgtataaaaatccctgtctccatctcttttacctcaatctggcatataccctggtaccaacgatccccataccatctaaataacgtagtcgcaatatcaaacgttaacagtggcgtgctaggtagggggattttggtgcttcaaggttttgacgagatgggttcgagggatggattctccgacaacaaaatactcgatgacttcggctataggaagatctaacccgaccggagtatgtcccccgcagagatcaatgacttgaccaggaagcctccgttcgagtcgactgcccgggaagtgacatcgtcaattaattttgattctgttgggacctggattatcctcacccctaacacatagtgagaacgtccatcccgacaagtcgtggcgaggagaccgaatacatcattattcaagaccatcacgtactatttgctcctgacatgtgcacctacatatgcatggactcaatacatgcctaggtgtgcattgatttgacgacatgtacatgcacagaagacaattcagatcggctaccaaggctaattaaggtaattagtagattaattaaattgatctactaattccgtagatatattcggcatgtatctacaaaggtacgcaatattttatatacaatttatcgtacctattttccgatctatacaatattgttagataaataatttattatgtttacctagagcatgttttctatacaatatttattgtgcaagtgtttccggtgttaggccgactacggtttaatgctgggggctcgctctattttcttctgtataaatcatgtttgtttatggtttacataatgtccgatatttaatctgttcattatatcctgataatactagaagatccatgcagtcttttgagtatatactcgatattctctgctatacatcttgtcttctagaaaatatttttcaggaacgattgagcactcgagtaggatgtggtcgagtacaccgcattatcgagaacattctcgaaaaatgttgagttgtcgcacccaacctaccaacgaatattgacaacttatctcatgtatagcatcggctacagctagactatttgagaaaatgttgttaatggataattcctcgcgaacattgtcggcttgatcacccgacatgattgcgaatagacatccggatatgctatatgttgggtatgtgagtcatactggccacatgagatgcacatgtaatcaccaactctagcgcctctccaggtgatcgagatacgcctacacctagtcctcgaccagtagatcgtagtgatctctcactacctaaaaattcgttcgagacacgtctacacctagtccttggctagtagatcatagcgatctctcaccacctaaaaatttatcttcaggtgatcgagatatgcctacccctggtccttgactagtcggttgagcaatctctcgacatctaacgcgacaatcaacattgtcgtgatagcgacaaccaagaccgactagatcatcgttgtcaccaggacgacaacgtccaggactaacgacatcaggacgacatcagacaaggttaacgacatcatgacatcacacgacgacgacgaaactcgagatccccagacttctagagggcccgaggatgaggtagtaggtataggagccgaacctccgactacgataattcctcattgtcttcgtcttcatcaagaggctattctcgcagttcacgagaatgtcgtccatatattactctggattccttacaaatggtcgaggtaccactacgattggtcttcaatcgacaacgtagcgatcctcgtaccacaacttccactggttgaggtacgactacgactggttttcagccagcaacgtagcaatcctcgcaccacgacttctaatggtcgaggtacgactacgaatggttttccaccagcagcgtagcggtcctcgtatcatgacttccaaaggtcgagttacgacttcgactggtcctcgaccagtagcgtagcagtcctcgcacctcaatttcaaacagttgagagactcctactcctggttctcgaactagtaggtcgtagtgatctctcatacctccacttcaagtggtcgagttatgactacaactggtcttctgccagcgatgtagcgattctgccactacctatgcgatttgttgtgcacaactatacagttggtctttgcccagtgtggtggtcgtctgatcatctacgtcaaatttatgtaagtgcttgtatgtgcaatatttgtccagagatccattaccacgataacacctattgaccctttacgccgttccgacaagcctccaagagacctacgagaatttcagctagggacgcccatagtggataaggtcttgtcagactctgagagccgaacgaccatgtaagacctggtcatgtaagagtgctcaaaaggtgtattaactaagccgtgtaatcagaaattgatttttccaacttcacggctgggggctaggtaaatcgcattttcagctaggcaagttacaggtcgttgagccttctcctccgagaacgtgcttcttcgaggacaaggctgggggctaggaggagtaccgaactccgtttgctgagggcaactctagcgagagtactcttttattgtcaaacgcagattcaatttattttcaatttttcatacatattatatcatgttaccctttgagcgttcgcttcggggctatttctatttaatattctgttctgagtattgatttcaggaaagtaagccatcagaatagtcaagtcagattttcaaggctttgtcgctgaatttacaccttcttgattactcaagaacgattgatggagctcgacaaggaatatggaatgaagcgatggtgtacccgccgagatgaaatttcttgacttcaatccaaattctcgattacagcaagacgggagacttagtcgcatgatccataccttctcggtcaacatcaggacctagacaaacccagtatggtgcctgcggaggctgataaggggtatctagcattatctctgatctcaccgagaacggtcaaatgagcacgacaatagtttttcaaagtcttcggtcgagaacatgaacatgttcatttgcattgaagtcaggggctactgtcgtggttacctaatagtagttgactaaactcgctagggcctaccacataccatgtcttatacggaaacaaacctcgtatatagaaggagttccggataaggaaggttaaatagagttctatatgaaaacgacaaggactagtcgtattgtatccatatttatctctgaaagtgcatctaggcccctaatgattttggtgattaattacaatgcgattagaaaggactaacatttttatttaagcaaatgtgaaggttgttatgtcctcaatgagttagcgtaatacatatcccgccgaatatgttgatgtgatgtgatgcggcaaatgagcaaatggtattttgtacgttttcgtttccttgagttaataggaaagccgcactattaagagggatgacgcattgacatacgaggagtgatcaaagtgctcaaaatctatttttaaaaagtgtttctcctcagtttggtgtgttctggatttttttggagttttccgaaactcattttcagactttccgaaaacacacaaaaccagatttttgcttctggaaattttcggatatgtccgaaagtgattttcggactttccaaaaatgactgcgagggcaaaagtggttttgtatattttcggacttgtccgaaactgatttttggattttccgaaaatcatcagtagagtcaatttcgcttctgtatattttcggacttgtccgaaagttattttcggacttttccaagaacatccagaacgatgttgttggtactggaaattttcggacttgtccgaaaagttttcgaaatgtccgaaaaatccttcgttgactttgctgttggtgctgagctggaattttcggacatgtccgaaaatctttcggaatatccgaaaatctcaattattgtgcataacgggcagaatctgggctgtggctataaatagccccctcccctcacttgtgagggctgctggttccattccaatcatttgtgcccttggcttgctctctctcactagcacttttgagccttactttcttgtttcccctctcactggtgttcgatttggatttggtgtgtgtgtgagagttgtggattcgagtttgtgtgagtgcttattgttgacttcgtgaagatttgtgagcacttgcatcatctccaggagttttttgcttcatttgttactcttggaggttgaggactcctaggcggctaggtgtcgctcccgagccaccgatctacttgtggttggccgggagaagtttgtgaaggtcagatctcacctccgaataggaagagatacccttagtggaaggaggagtgcttagtgcaatctcttgaggaaagggttagctaagacccggctcttagtgagctcctcaacggagagtagaatcccctcaaggattcaaacttcgagaacaacctcgtgagcttcatctttggtgactttacttcctacctctccactagctttgcttgttcgagccactataggtctagttgctgtttgtgctagcatattcttgttgtaggcaactatttctaggatttactttgctatttgtgctgactccaaaaattttcggatatatccaaaaatttcggaaatatccgaaaattactgcttccacttttaattgatttttgaattagcctattcacccctcctctaggcctaattgacactttcaattggtatcagagcctaatctcctaattaggcttaaccgcttggagagatcatgtcgggccaagcgggggatgggaacgatggtggtaagggagctaatatcccttatgactatccctctacatctatatcttatgtgagtacctatagcggcaaagctccgtacttcaatggtacggactatgccgcttggaagcataagatgaagatgcatttgaagtctattaacccatctatttggagaatagtcgaaaaaggctatgttttgtagaatcccgaagatcccaccaaggaggacgacgagaacaagcacaagaacgctcaagccgctaatgcaatacttagcgccttgagtggaagtgagttcaaccgtgtgatggcattgagagtgccaaagtgatttgggacacgcttcggaacttgcatgaaggcacggatagtgttcgtgagtccaagatggagatcctcaaggggcaatttgagagatttgtgatgttagatggtgagagcccaagcgacatgtacgaccggttgagcaagatcgtcaatgagatcaagggacttggctccaaggacatgaccgatgaggttgtggtcaagaagatggttcgagcaatcactccaaggaactttaccttggtgaccatcattcgtgagcgtccggactacaagactctcacacctcatgatttgctcggacgcatccttgcccatgacatgctcgtgcaagagtccaaggatgtcattcaatacatcaaccaaagctcaaccgcaagcatcaagaaggaagacttggctttgaaggcaaaggaagaagaagaagagaaccgcaagagcaagagcaaggcggagatcgatgatgaagagatggctctcttcgtcaagaagttcggcaaattcatgaggcgaagcggcttcttcaagggaggatcttccaagcactactctaacaagtcaagtggaagacactctgcaagagtgtgctacgtgtgcaaagagcccgggcacttcattgcggattgcccccacctcaaggatggttcccacatcaaggaagataagaagaaggatgagaagaaggagaagcacaagcatagcaagagcgaacattatggccaagctcaccttgggatgatctttggctccgactccaagtcaagctcaagtgatgaagaaggagttgccacgttcgccgtcaagccctcatcaccaccgagactcttcaactactcaagtgatgagaatgctaaggtaccttctcctcttaagtcatttaatgttgatcttgttagtgatgaggaggatgaggttgaggatgaggttatggatgacgaattgttcaagtccataactaaggaatccctaccacacttgagtgagttgcttgggagaattgaggaccaatatgtaactcttgagaggcaagagactttgctcattcatgagaaagagcggtctcatgaactcaagagtgagcttgctaaggagagagagaaaaatgaggcattggtacggctttacaagcaaaccaaagagtctcatgctaatcttgaggtggcgaacgctcaacttcaagagagagtggatggcttggacaaagcatacctcactcttgaagagaagttcaaaaccttaaagaatagtgtctctctccctagcgagccatcttgttctaaaattgtcccaagcaatgaaccatgtgtgagatgcaaagatattgatattgaagcttgtgctactaactctatttccttgagtgctttgcaaaagcaaaatgagaagcttatgggactccttcacaatggcttacttaagtgccatatggatagtaaggccctaaaggagtacctaggctatcaaagggacaacttctaccatcagggtcttgggtatgttcctccaccaaaagaaaaggtggacaagagtgtgctgatcaggaggccccaaggtcttagcaattttgttaaggccaaaagtatccttcctaatgattatgcttcacattgttcttttgatgcatcttatgttcttaggaagaatgctagttgtcgtgttgttgctaagtatgtaggcccaaggggcaagaatatttctatcaagagagtactttgggtgcctaagacacttgttactaacatgagaggacccaagcaagtatgggtacctaaaattagaaattgatctcttgtaggaatatgtctccggtggaagaagttgggtgattgataatggatgcacaaatcacatgatcggagaagaatcaatgttttcaactcttgatccaaatggcacttaacaagataacatagttttcggggacgatggaaagggaaaggttatgggattgggtaagattgcaatctctaatgatctttccattgccaacgttctcttggtaaaatctctaaactacaatcttttgtccgtttctcaattatgttctatgggttacaattgtctttttaccgatgttgatgtgaccgtctatagaaggaatgattcctcggtagtctttaaggatgtcctcaagggaaagctttaccttgtagatttttcctcaagtaaagccaaacatgagacatgcttagtggctaagtccaatacggggtggctttggcatcggaggctagcccatgttggtatgaggaatcttcacaagcttctaaagcacgatcacatccttggacaaacaaatgttcaatttgagaaagatagggtgtgtagcgcatatcaagccggcaaacaaattggagcacatcaccccgtcaagaatgtgatgaccactacaagaccattggagcttctccacatggacctcttcggaccaattgcttatctaagcattggaggtaacaaatatggtcttgttattgttgatgacttttcacgcttcacgtgggtgttctttttgcatgacaagagtgagacacaagctatcttcaagaagtttgcaagaagagcacaaaacgagttcgacctcaagatcaagaacattcgaagcgacaacggcaaggaatttaagaacacgtgcatcgagagtttccttgatgaagaaggaatcaagcacgagttctcggctccatattcacctcaataaaatggagtagccgagaggaagaataggactctcattgagatggcgaggaccatgttggatgagtacaagacatcggacggtttttgggccgaagccgtcaacaccgcatgccatgccatcaactgcctttatcttcaccgccttcttaagaagactccctatgagcttcttaccggtaacaaaccaaatgtctcttactttcgtgttttcggtagtaagtgttacattcttaataagaaggctagatcctctaagttcgctcctaaagtggatgagggattcttgcttgggtatgggtcaaatgaatgcgcttaccgcgttttcaacaaaacctccggtattgttgagatcgcgcgtgatgtgacatttgaagaaactaatggctctcaagtagagcaagttgattctcatgtgttaggtgaagaggaggatccgagcgaagcaatcaaaagattggctcttggggacgtacgtcctagggagccacaacaaggagtctcttcctcaacacaagtggagccacctacatcaacccaagccaacgatccctctatctcaagcttggatcaaggtgaagaaggtgagcaagtgccaccctcaccgatcaacttagctcgcccaagaatccaccaaagtatccaaagagatcatcccaccgacaacatcttaggagacatcaacaagggagtatccactcgttctcgtattgcaaatttttgtgagcattactcgtttgtgtcttctcttgaacctctaagggtggaagaagctcttaatgatccggattgggtgatggcgatgcaagaggagttgaataatttcacccagaatgaagtgtggaatttggtggagcgagctcggcaaaatgtgattggcacaaagtggatcttccgcaacaagcaagacgaggccggggtcgtaataaggaacaaggcgaggttagtggcgcaagggttcacccaaatcgaaggattagatttcggtgaaacttttgcaccggtagctagacttgagtcgattcgcatattgcttgcttttgttactaacctcaattttaagctatatcaaatggatgtcaaaagcaccttcctcaacgggcctatgaacgagttggtatacgtggagcaaccaccgggcttcgaggatccgaagtatcctaaccgcgtgtacaagctccacaaggcactctacgggcttaagcaagcccctagagcttggtatgagtgtcttcgcaattttcttgtgaaaaacgactttgaaatcgggaaagccgattcaaccctttttactaaaagacatgataatgatatttttgtgtgctaaatatatgtcgatgacattatatttggttctactaacaagtcttttagtgaagagtttagtaggatgatgaccaaacgttttgagatgtccatgatgggtgaattgaagttcttcctcgtccttcaaatcaagcaactcaaggaaggaacttttatttgccaaacaaagtatttgaaggacatgcttaagaagtttggaatggagaacgccaagccaatccacactcccatgccatcaaatggccacctcgacttcaacgagcaaggtaaagacgtcgatcaaaaagtataccgttccatcattggctcacttctttacctttgtgcatctaggcccgatattatgcttagtgtgtgcatgtgtgcaagatttcaagccgctccgaaggagtgtcaccttgtggccatgaagagaattcttagatatttagtgcacacacctaaccttggtctttggtatcctaagggagcgaggtttgatctcattggctatgccaatgtggattatgccggatgcaaagtggataggaaaagcacatcgggtacttgccaattcttgggtaggtcccttgtttcttggtcttccaagaagcaaaactccgtcgtcctatccaccaccgaagcggaatatgtttcggcggggagttgttgtgctcaacttctttggatgaagcaaacattgagagactatggcctcaatgtatccaaaatcccactcctatgtgacaatgagagtgccattaagatagccaacaaccccattcaacactctcgaaccaaacatatcgatattcgccaccatttcttgagagatcattccataagaggcgacatagacatccaacatgtgagaaccgacaaacaattggcggatatctttaccaagcctctagatgaagctaggttttgtgagttgaggagtgaactaaatattttggattctcggaatatggcttgatcaattgcatgcatgtttgcttggtagaataggtttgcataccactttgtgacaaaatggtcattcaattcatggatggacactagtcacttttttgtgtggagattttgaatctatgtgtatggggatctcatttttcaatgaatttaggtcctagcacaacttgaaatagattcacacattccctctctcgagggtgaattatcttgtctcatggtaattccctctcttttgatcccttggatcgtccatttgacttgtggctattgttttgtgtgattgattgtgtgctagtcacaagttcaaatggagcctctagtgctcgtccatcccttccttcctaaatcctatcacaaatccttgtaaaaattgtttttatcaaaatttccggtgcttgtcccttgcaaaattcctttaaaatgtttgaaaaatagtttcatcaaaattctcggcgaaatctcattgcaaaactgtgttttccaggaattttcggactttccgaaaaattttcggacattctgaaaatctctgtcctgtcgctctttcaattgctgcaatcccaggattttttggactttccgaaaaaaattttggacatatccgaaaaacatcagaaccgtgcgcaactcttctgtatcctttcggacatatccgaaaatttttggaaatatccgaaaatctcggggttcttatatatcaccccgtggactcccttctctctcctttccacttcttttccccacgggttgactccctcctccctccccccggcgacctcctcctctccggcgacctcccgcgactcccctcctctccaacctcgagggagcacgtttggggcacttcttgggccctacattgtcgatcttcatcgcattcttcacgtgttcttcgtgttcttgaggtatttgccctaaaatcaaatccctagattcctcaagttttatcttgcgatttcctttggtggagatgttcccctagtgccataggccctgcaaattcaatttcacaagtttttgttggcggatttgtgcggcatctgagttatagggttcggccagaatttttcggacttgtccaaaaattgtcggatatattcgaaaattcctggccgacccctatcacttcggatttgcatgattcttgccctcactcacttgtttcttgcctctttggcttccatacttgattccttgtatctctattgcttgaaggatgcctccccgcaagcaaacctcccacaagtccaagcgcccgagggatcgctctcccactccatcctctcatgatgattcggacagtgattggtccggtggagaagatgcggttcctcaggttgcgtgggtggctcggcggtctactcaagctcatggtggtggtggcgatggtgagggctcctctcgtcaaccgcaaacgccgccgcaccaacccaatgtccccattgggcctctccgcattcatacccccgagagggatccggcggtgattcaccaagtgtatgattggtggcgcaagtctgaggttgttgctcctcgtcgggatgaggatctgcgctcctttcgccgcaccgccacggatctgcggttttggaccctttttcagcaagacttttatgagtctgtgattaagtccaaaactcatcccactgttcccatgcaatggatcaattgggaggagttgcaggcacacaatgatccagtgattgactctgtgattgccaattgtgatctcatgggtatccgctccttcatgacgttgcagcaaaattggtgcaacgaggtcattgctcagttttatgccaccgtctactttgatcgttatcgtgccatgcactggatgactcaggggtcctggtattctgtttcttatcagcagttggctgagatctggggcttccgtcttcgttctttgctcaaccttgatgaccttcataatcttcaaattcttgccaacacagaattgcttcccctttatactccaaatgatccaaatgtggtgttgggcaaggtcgacggcctcaagccgtactttgcctacttgaaccggatgtttcgccggtcttttgtgcctaaggatggtgatgccagcagcattaaccacctctctaggaccgtgcttctccggtttgatccccctcctcatcgcttccatgtctatcactttgtgtgggaggagatccgcatggcttcaattcagtacaagaaggggttggtctatgcccctcacattatgtggatgatcgagactgtgactcagctccagtttcgccatgatgtgactcattctcagcttcagttgcgccttcttaaggccccccgctcctcagctgctcgggacataccctcctcttccactcagccgcctcctgctcctgagcgccctgcctctgtggctcgtcgtgagccgtctcccttattccgcattttgcggagtctttttggtctttgctccacggaggccaaaaagaaccaccgattgcggaattcggcaaagaaaacggctcgtgatgtcaagttcctcaaggcaaggtattatgaggaccaccacattgatatccctccttctcctccaggtttcgaggccgagcccgatgagccagaggatgaagagattgaggatccttttgccgggttgccttccgacttcgacttctttggatatggccatggctatggctatcctcctccacgcccttcgcttgagtcgtcatctcatcgtcctctctttttggtgtcttgatgccaaagagggagactatctatcatggctttagattatctatcttgtccttagagtcgagcacagttggtttttatctgtatgagactgttgtggttttttatgttaagtttaaagctttgtaagactattgtttaattatgaatgcttgtgatgtaatggatctttttatcttttaatgtggtgcaatgtcacatcctgatttttgtttcaggatttataaattatttaataaattaataatagaatttatattaaatgatctttaatttacaagtgaagttaaatgtgggaaataaaatttcctaaatctaaggcatggatggatttaatttttattaaattctccatgattaagtatactctctgaaattttctcggatttttcagagctcaattcctaaatgatacaaagaacagttcagtaattatttgatcaataatgatctaattataattgttaagtgcttttcttgtttaaaatccttaaattataaattgttgtttaaaaggaattattagaaatgattttaaaagcttaaaagagaagatctaattttaatttgttaaatctcaatataaaatggggccagataaaatttcattaaatacttcgcttaattctataattcctagatttttctgggatttatttgagctaaggaagtatttttaataaatggaattgcatttcatgaataatttaaatagaaaaaggttttaaaatcctccttttggctttgggccgaaagccggcccaaaacctctctccttctctctctctttctcggcccaagccagcccagtccgcaaccgagccgccgctcttctctctctctcccactgacaggtgggccctacctgtcaggcctgtcttcctcctcgcgccgccaccgccgcccgaaaccctagcgcaagcagccgccgtctccttccaaattcggccgcgtctttcccgatctggtgaaatcaatagaggggaaatgatcttctcgatctcctcttccttttctcttatagaaactccggtcaatttcctttggaaataggcggattcgagtttgattcggattcgtttttccccaatctttccttctcgtcgccggccgccgtgggccttcgccgccgcctccttgcacctataaaaggacccccggtgtctcctctacccaccgccacctttgccttagcccgccgtcgtgtctagcgccgcctccgcgtagccctagtcgccgccgtcgttgccgtcggttcagccgcgccgcgccgccgttgcagccgccgtcgtcggtcgccgtcgccaccatcgggatcgccaagtcgtcgccgtcctcatccgccccttcgccgccgccgaagaccaccggagcaccgtcgccgccatcgacccgatcttcgccgccgcttcttcctcgtcgccggcgctgtccgttgttcctccgccgcttcttttggtcaccggtgagttcgccgcgtcgccctctacccgttggtgtcctctgttcgcgtcctcgcgccgtcgttcgccggcgagcttgcgccgtccgagccgcccgagtcaccgccggtgctgacgtcgtcgctgacgtcatcgtcgtcgttctctgtgagccggtcgtggaccgttcgatctcggccgtccgttttggatcaagtcgatctcggccgtccgttcccgtgagccgtcgctcgtgcgcccggtccaccgaaaccctagccgctgacgcaataaatctcttttccttttcaaaattaattcattattgcgtcataattcaattaaaatcaatataagtgtttttaatccgatttaatctttaaaaattcataactaattcatcttagctcagtttaatgtggttcaagttgcaaaagttgtataaaataaagatctacgtattaaaattgtccataaattgaattaaatttatttaattctttttaaatgggctttaattagatttaatcttgtaaaattcataataaattcatttgaagtcagaatgaggccgttcaagtctcataattcatctaaaattataatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcaaatgtcaccgggtggtgtgaacttattcctttgttatggccaatttgcattgattactttattccttgataccttgggttattataacttgactagttgagctttatatattggttcagctagatattagatatgattgcttagccatgcttagaaacattagcacattattgggataacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttacatttcgtatagcatggttcattgcagagcaccagactgagaagtggcggagataagcccacgggggtcgctggggagtccatgcctctggtttttgagggggtgattatgatccaggaaaggtgcactgtggtgggttgtgttatgcgaggggtactgtcacagctcctttccgaggtaccgtggtggtattgaggcgcatggtgacatgtcgtggggctgtgtcttgtgggtacagtggtacacctctggccagagtaaaactattcggatagctgtgcccgcggttatgggcgggttgagcaatgtttttcgtgattagtctcacacctctcacaataattattgatgttatgactggtaataatttgcttagctcctggtttggagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagcctatattatgccatcctttggtatccttgtgcacttgcatatttgctatgtggcttgctgagtatgtcatatgctcaccttgcaataatcaatcaacctcagttgaagaaaaaggatccagaaggagaagacgtttggcttataccccagttgagctgcctgtgggagtggagctggagcttcgctagattttattttccgctgcaattttcttcttggtgaggactaagtgcctcttaagtaagtatttattgttttagttaatttgatgaatctgtatattaaattgtcagtttgtgtacctcggctgattcctggacgaggattttatgcacaaataagttcggaaattactagtaaatttccgggcgtgacatgcaatgccttatcctctttatatggtgcttgtgatgagatgtaattattcctttgcatgtgatgtgttggatgtaatgagcatatgtgatatatttgttctcttgtgagcttcaatgtggatgcaataatttagggggagctctccacttgcttttatgcacactcttagggggagcttccactaaaactttgcaccaaaaaccttaaattatattcattctctcttgtgttctaatcatattgtcatcaatcaccaaaaagggggagattgaaagtgcatctaggcccctaatgattttggtgattaattataatgcgattagagaggactaacatttttatttaagcaaatgtgaaggttgttatgtcctcaatgagttagcgtaatgcatatcccgccgaatacgttgatgtgatgtgatgcggcaaatgagcaaatggtattttgtacgttttcatttccttgagttaataggaaagccgcactattaagagggatgatgcattgacatacgaggagtgatcaaagtgctcaaaatctatttttaaaaagtgtttctcctcagtttggtgtgttctgaattttttcggagttttccgaaactcattttcggactttccaaaaacacacagaaccagattttcgcttctggaaattttcggatatgtccgaaagtgattttcggactttccgaaaatgactgcgaaggcaaaagtggttctgtatattttcggacttgtctgaaactgattttcggattttccaaaaatcatcagtagagtcaatttcgcttatgtatatttttggacttttccgagaacatccagaacgatgttgttggtactggaaattttccgacttgtccgaaaagttttcggaatgtccgaaaaatccttcgttgactttgctgttggtgctgagctagaattttcggacatgtccgaaaatctttcggaatatccgaaaatctcaattattgtgcataacgggcaaaatctgggctgtggctataaatagccccctcccctcacttgtgagggctgctggttccattccaatcatttgtgcccttggcttgctctctctcactagcacttttgagccttgctttcttgtttcccctctcaccgatgtttgatttggatttggtgtgtgtgtgagagttgtggattcgagtttgtgtgagtgcttgttgttgacttcgtgaagatttgtgagcacttgcatcatctccgggagttctttgcttcatttgttactcttggaggttgaggacacctaggcggctaggtgttgctcccgagccaccgatctacttgtggttggccgggagaagtttgtgaaggtctatctcacctccgaataggaagagatacccttagtggaaggaggagtgcttagtgcaatctcttgaggaaagggttagctaagacccggctcttagtgagctcctcaacggagagtagaatcccctcaaggattcgaacttcgggaacaacctcgtgagcttcatctttggtgactttacttcctccctctccactagctttgcttgttcaagccgctataggtctagttgctgtttgtgctagcatattcttgttgtaggcaactagatctaggatttactttgcaatttgtgctaactccgaaaattttcggatatatccgaaaatttcggaaatatccgaaaattactgcttccgcttttaattgatttttgaattagcctattcaccccccctctaggcctaattgacactttcaatctccctagtcttacttggacaagggggcatatatgagtataaatacaagcccccctaggaggagaggggacacgccacaacgccagaaagccacaagccaacacacgtcgccagatatcaacatcagagataagtctagacatacaccatccggctcctatggaggctggcaagagggatctagcaccatctctgatctcgccgagtacggattcgaggaggaagactactctgtcgtcgactacgggttggttatctagccgcctagtcgacgacgtctagatgagttatcccaattattgtacttgtgtgattcagatgaataaaggagcaacaccagctgcggccaacaggatgtagggctattacctgtcatataatgggcccgaacctatatagaaatccctgtctccatctcttttacctcaatctcgcatataccctggtaccaacgatccccataccatctaaataacgtagtcgcgatatcaaacgtcgacagatgtacaccgcagaccgacggtctaaggagtttattgatggcgtgcattattttttaagtgtggccaatgcccataagcctaagagttttatattttgtctatgcagaaagtgtgaaaactagaaggtgtattctacatcaagaactcttcatatctacttgttgcagtcgggattcatgcctagctataattgttggaccttgcatggagagttaggggttgcaatggaagaagatgaagaagacgacgataacattccggactgggctcaatacgatggatttgcagaaaatacaaatgggcgaggtggacaaagctattgaagaaaacgacagtgtggattatcaaatcctaaagaatattctttctgagggaaacgacttgctcgaaacaacatacaaagataagaaggtagtctgcgctctaggactggaagtctagaagatacacgcatgtccgaacaattgtatcgtctatcgcggtgaggagtacgagaacctagaagcatgcccagtttgtaaggcactattatacaagattagacgagatgaccctggtgatgttgatgggaagcctgaagaagagggttccttctaagatgatgtggtatttccctataataccatggttgaggcgtttgttcaagtacaaagctcatgctagaatgatttgttgtcacgtagaagaacgtaaacatgacgggatgctgagacaccctgttgatggtcgtagtggtgaaacatcgatagaacatttaaagactacggaaaggatgcacagaacataaggtttggtttaagtacagatggcatgaatcattggagagatgagcagcggtagtagcacttggcctgtgaccatgtgtatctatgacctccccccttggttatgcatgaagtggaagtacatcatgatgctgattattactcaagaactagagcaacctggtaacgacattgatgtgtacttaagatcattggttgaagatctgaaacttttatggaagaaagaaggtgccatgtgtgggaggagaacaaacaagagcaatttaacctacgagcgttgtagttcatcaccattaacaattgccctacacttaacgacctatctagataatcaaacaaggggtataacgaaagaaaggcaaacattttgaagagaaggcagaccaccgtactaacctaaacatcataatggaaaaaccatgtttgctaaagatctgaaagtaatatttggaaagggacccgatagccaacctatagctagtgaatatgttcacgtggtgatgtggaagactaagtctatttttttcgggagttaccctattgggaagccttagaggtccgccaagcaatcgacatgatacactttactaagaacccgtgcatcaacctaccgggcttcctaggtgtatgtgagaagtcaaaaaatacacttgaagcatgtaataatctcaagcatatgaaacaacgtgacggccttcgtctgaagccaaggagaaaggaagccattgcttgagtccagccaactactctctgaggaaggcaaagaaggaaagcatgtttgtttcctgtgagagaatgtaagcagcttacgagttctcatagcatatgaacggagagaatagagtgtaaa

SEQ ID NO: 63390 - DNA, 71281 bp, Oryza sativa
gatttttcttcaggataatacagtaaaacagcatgacaagggaactcattgtttcaaagaagggttttgttggggaataagggtaggaaaaatctacctgaagctccaagtgcttagccttgtggttcatgcaagatagttcgtcctgaactctctggatctcatttctcatgacatcctgtatacgaagtgaagatgccagatctgactctaattgttcaacatcaagttcctttgaaaggagagcctcctttagcactctattgagtatagcctcttctttcagcttgagttcaggaatatcctacaataagaataagatggtggtaaacaaaggctcaaggagtcaaggttctgcacctgctgaacttataacacatattatactacactaattatttttccagctgagtgctcccctgtcttttcttattccaaccaaaaaggaaaaaaaacttgattgaacagaaaaagatttacagtaaaacataataggtgctcataccagaggtaactcatctgtgtgctccctggaaggactagatccaactacagtctctccagaacttccctttatattttccttttcagtgaggacagaactaataatccccaaactttgcttcagactctggattcgtcctttgatgctctggaactccaaagtgtagtcagtgacagttaatgcagctatgccattgccagcttcattttcatgccttttgcatttcattagttccaacaatttgatgcacagttggctagtcttatcaagcaatgacaagccatgtatctgcaagttatccactctggctagtagctcctggtcaagacgaattgaggacaagcgcggtccatttccagtactttgtatacgatttaaaagtgcaatgttctcttgccttagggactctgattcaagatgacaagattgaacttcacctcttaacttctgctcaactcctgtcagtctaataagttccatttgcattctcttctttatcttgtcactgcactcaacagatttcttatctaattcagtactgtatccctgtcttaagccactgattgttctttcttgttcattgcatatggtttgtagccttgaaatcactttatgcaatgctttgttctcaccatccttatcttccaagaatttcctgagatgatctttttcctccacagccttagtaaaacaatcatgtaactctacagatgaattctggagattgtcacaattgtttctgactttctctagctcatcaattagttttttgtttcccatttccaaacaagcaaccttattagaagcatcaaccttttctgcttcaagaaaagtaacctctcgctgaaaggagacattctgctctgcaagttctctcacccgatcacgtaatctctcttcctcgcactgaaatcttgatagtctgattgaccaatcgtctgatcttctatccatctctttctccaaagtagtttgcacttccatcttttccttctctagccttctagttctgatgtccaactctttcttcaaatttttgcattgctctttggcagcaaacctttctgtaaggcgtgccttgatctgtgaagacaattcatatgctagttgtttcctatcttcagtcaaacattggatcatctggaacatgtcatttgcgcttagcctcttgtttttggacatgttaagctcatattttttttcagaagagaccatgaactttgcctcaacctcttttgccctttggagcaacttgtcatcagtttctacatcctctgttgcaaaatacaagccaatatcagaaaaattgttgggcaatcatatatagaagagtatggtaatatagcatcttgagttgatacctgaagtaggatcgatggagggatgattaaagtcttgcaaatcctcatagatatcttcaacagaagtaacactttccgatttgtaatcttctaaatgtgaaaatctctcagaagcatctagcagacctgcatggtttctacttgcattgcacagtgttgtaatcttgcatgtgtctcttgtatcctcttgagctagttggtggagatgttcatcctttacatcctcatatgggtaagtctcaaggatctcttttgttagtcttggcaaagatggtactgtagactgcggtcgaggcggccttcccaaattcgaaaccgcagatctggtgggagagttttgcttctgtctctcaccaaggatggtggcttcctgctctccatcaatgtatcgatctagaacttcattcttgttcaataaattggttagtcttgttgacctgcatcgaatggcaatgggagaactaacaggagagtgccctgttgagcatgaatagcatctcgaaccaggagagtcactttgcaggactgaatgtgcttttggatcctttattgtgtattctcttggggctggacgcctttttggtgaccatgcatagcagctgcaagtcagtacgcactgttaggaccagcaaaaaaaatacacactttattatcatcactcagatgaaaggaaatggtagagtcacaattgcacataattcacttaatgagtgaggattgcaggtccatctaaaactattctagttgaaatgagtgaagaattacattgggaaaatgggatttacaagtaactgaaatgcctaaagaaagctctgagtgcattggctgaacaatttataaggagggcaatcaccaccgtataattaagcatttaacaattatagctgataagctgaaatgagtaaagtttgcaagtgcacaatacttctccttttcttgtttctactaatatggataaaaaagggaatagggtgttgctaccatgtattggtttgatgatggcaaaaacatcctaggtttcaatgcactattgaactgttgatggtaatcaaaatgtaaaccaatcacttacttagcaacatgatcgggtgcatcagattcattaaacagagaagatgggacatcacccgagaagctgaagctccgatccttcaagaaactgttgccggctggtgatgagaaggacatagacctcctgagctgcttcggattagatggttcctcattgttcagatttcgacgccggctctttgatctacacacttttgtgacaggggaattggaagcggaactggagctgccattgctgtcacctccgtccaatgccttcttcttaatcctgctatcatcgtcacttggtgttttaccaccattcccagtgcttgcggtggatgatccaaagaaaaagaaccttctcatcttacaaatgttcagaacatccgcagatccccacaattgaatcagtccctacaaggagcgaatcttgatcagcaaagaagtagcaacgagaataaatcttgtagcaactactgaatgacaccagatgatctgcaaatatacaatagcaaacccttgtgcgagggaggaatagccaataataataattaaacaggagtaacgaaccaagcaggaaaagcgatatctaaatgaagtttcaagcaattccacgtatccttttgcagggaactctgcaactaaaccacacatcaaactagtttgggccaggaaattgatcgagcaggtgacacgcaaggctaaatgaaaccaaaacacgccagcaaagcatcaacaagccacaggagacaaacctaaccccagaattcagaagcaccaaccccttgatttggcgcttgatcccggacgcaacaccaaatccaaaccccagaattgagattcgcaaagcacccgagacaccaaaaacgaacccaaaacgaaacgaagtcgcaggaagggagaggaggcgaacctctcgcggcggagggagacgaaagggaagtggaggagcgtggtggctttgccctaccaacggtcaagaaatttggggaaaaatcaaagcaaatcatacgcattgattgcgatttaacgatggagacgcgaatccgggggaaaaggaaaagggaaaaagggttttcaagtcgaggtgggagcgggacgggaagaggaagaggaagaagaggagcgtcttaaatgggccaggccgagccgaatcgcttctgtgggcttaattggttagatgggccgtagcggagtaatgatgcgtcgagagggaataagttcaccagaggtccctcaacttcacagcgagatttttcgaggtccatcaaccacaaaaccttctgcccctaaattcagtcaaaccgttcaccaccggaggtcctttggcagtatttttgcccggttttcctgacgtgacatactagtcagcaaaaaaattaaaaaaaatcatacggctcacatgtcagcttcacatatctctttttctcctcttcagtcttcttctcctcttcacttttctcttcaccggcggagcagcggtgggcgagaggttcggctgctggcggcgccgaccagcgacgcaagagaaggggagggcgtcggcggcggcgggaggtggccggaggaggaggtcgtcggcgagcgcgctcctggtcctgctctggctgttgatgcggccgggaggtatcgccgatataggggctcgtcgttggtcgtcgtcacgggaggtatcgccgtccgctggggatgtcaaaatgcagagagttcgtgtcttagaagacggccatgagcttggcttctcccagcacatgcccctcgatggcgtccatcagcttatccttgatcacctgtaagcaatcaagaatcaatcacagttaattaatccttaaacagcaaagataatcgctaaaagattgttcgatcgacttgccttgttgccgaggtgcacctcgtcgtcgaggacgtagagcttgaactggatgcggtggccgcaggagggagggatgacgacgacgccggccgcaccgccgaggccgcgacttgcgccagggccggcgccacgctcgcgccgagcggccgccagccgcgcctagccgcatcggcgccgccgtcgctcggccgagctcggctgcatcggcgccaccgccgccgcgcctgcgcagtagcagccagagcaggagcaggagcaggagcgcgctcgccggcgacctcctcctccggccagctcccgccgccgacgacaccctccccttctcttgcgtcgctggccggccccgccggcagccgaacctctcgtgacccgtgggccgtggctccgtgctcgttcgccgtccgcttcgcccgcagcccgcccaccgatgctctgtccgccgcccgctccgcccgtagctggccgccgctccactgccgcgctcgcccaccgccgctccgccggtgaagagaaaagtgaagaggagaaaaaagatatgtgaaggtgacatgtggtttccacgaaattttttttttttttctgtctaggatgtcacgtcagcaaaactgggcaaaaatactgccaaggagctcgggtgaacggtttgaatgaatttatgggcgaatatttctggttttgtggttgagggacctccaaaaaatctcgctgttaagttgagggtcctacgatgaacttattccgcgtcgtgagcgactcggcaagtgggcccgtggcgacgcgccacacacacgcacatctgcagttactcactcctcttcgccgtcgccattgctgagctgctgctgttgctgtggctggctgataggcgacggcaatggcgccctcctccactcctcctccgccctccccgagccgccacctccttccggttttctctacacccccgcgtacccttctccagtcgccgcaactcacacagacacagtactgcatccaagacggacggccgtgccgcgcaaatttttcaccggcgaggcggcgacgctggattccttcgccgtccaagtccagccatccggacgctatccagacaggttctttcttttctttttcagattttcttgtttatattggagtaatctgctagcagaatggatgagaactggttggcttcttcctgatccctccaaaccctttcttttggggggagtttgcttgacaatatgtatatagtctcttgtcgacttcaattctagcacatgaattaactatggcagttacaaaatcatgcagaaggtgatcctaccaccaacctgtggtgattggtctcaaattttcatgccctagtaatctctgcacagctttcagtgctgctgctgcccttcaaaatgggggtggcgccttctaagattgaggatgatagggccctcgtgttatgccaggagaggaagcgtttcgtcagagaagcaatcgacggaagatgcgcacttgcagctgctcactgtgattatattcggtcactgagagacactggctttctgctaaggaaatgttttgaacatgaagcatctgaagaatcgataccaaataataaatcgccgtcttcttttcaggccagtcatatgaaagctgccatgaattccattagaacttatctggagaaggtggcaactcctgtgacagtgactatggtcagtgcctcatctcaagatcctactggtacttcaccattggaccattttgaccaaattcacccaggtgacaaccagttttcacctaaagaaaaggatagatctggccaatgtttggacaaggtggatgatcctagacccttcctagaggagggaatcccagagctcgaagaggaaggggagagaactccttcgaatgaggaggatggttttgcagaatcaaaagatgattttgcaaatgaggaagagaatttctctgaatcaaatgatgctttcctcagtccatccattgaaacgtttgtgccagtgtcaaacagcaacgacgtgtctgataaaaatagttcaacagacaaggcacctgagcatcatggtcatggaagtgtggcatcaaaagatattgctttaccaaatactggttgccaaaatgataacccccaaaatgagaggagaatgactgacattcacacaaatgaaaattatagcaattctgctgtgtccccagttaatgtcgtaccaccttcaggtgctgcctttcctatggtctcaaaggaaccgtatccttatttaagcatatctgtgaagggcctatatacaggcatggtagagattgagagattattttccagagcttgtgattcgggaaaagaagtcacaagggttctcgatgaagataaattacagtttcgcgccctactaccacaagaaacaggttagatatcttgcaatgcttttttctgttgcactatttcttttcatatcttctcttgtaatttgaggtgcacaataatttctggcagcgcgtggatcagcatcatctagttttctgtcaacattgtttgcctgctgcagggaggatgtccctcttcctgaaagtaagcttttttttccatttattagtatgaaattctatttcctgcactgctcagccctatgtactccttttttttatagacatatgacatatcacatggaacttgtaatgtttctgtgtaattgttcttattgtcatactcctctattgtaatagatgatatcatactctgctattgatctcatttagttttgttttttttaatctctcagctattgcattttccttatattgtaacaaatggtgtctcatatagtcatatcttagagtcaagattgtccgtcgtaatttgaccttgctgtttctttagtgttctattttcctgtgtaaactgtaatacctgtgtgttcccactgtacaatgaatttaatgtaccatggtataatgcagctccttctcaagctgaggtaaaataccttacctggcataggtcagtgtcttcacagttgtcgctgtctagaaatcctcctggggctattactgtcatgcatacctcaacactagataaactgtatgcatgggaggaaaagctttatgatgaagtcaaggtaattagcttttttgtggctactctatgtgaaatacctaaatcttttaattttggctgacagtttaatccattttgatttatgttccacatgtctgattgcttgtcacaacatgactttcttttccccgcctttcagaaaccatcgaatatacattgattcttctgattaatcccttagctggaactccctacattgatcgctagaattcatagatagattacttgcttctttaatcatagaggtttcagatattgtattagtcagagtttatgcagtttatgactagtggtagtgattttttgtcaagaatgttcaaataaaatctgataattcttctgaagtttcacaccaaatgattatcatgattctgctttcaggtcaacagtgccatatgcaggagatatgatgagaaatgcaagcaactgagagaccaggagtcgagagggaaaaatcaaattcttgttgattttacccgcgctactgtaaaggatttgcattccagaattctagtggctattcagaaaatagacttcatttctaagaacatagaagacataagagataaagagcttcaaccacagttggatgaactaatcagaaggtatatttgccgattcagtttttatagaataatttgtagtttgatgtgcacaagaagagagtattgtgtgcttgagtgtcatgcattgtttcaggattttctcagactgttttaacagaatgcaccaatcacagtatgcagtttgcattaaactgacagctatataaatctgacagtgtctgcctgtctttactgtagtttaactaggatgtgggaaacaatgcttgagtgccatcatcttcaacttgcaatcatgaagctagtatccagcaaacggagtgtaaaattatcatttcagtcagagtctgaatgccaagatgcccttctcctctcagctaagctaattaaattatgttcagacttccaaaactgggtggcatcacacaaggtttacctgtctagccttaacttatggctgcacaagtgcatgaaaccgctgaagaagaggaagggctccaggaagcaaaatgttgttgatgtttctctaacagaatgtgctgttgcacccatatttacaacttgcgaaatctggattaaattaattgacgatttactgaccaatgagttggtgaaagccattgaaaatctcgttgcagatgtcggccgttcctttccgcaccaagagcaggtgctaaatggtgaaacaggaggagaaatcctgagaaataatgcccctgctgatgtacagtcaagtctgatggcattcttagagaagcttgaagccttttcagcagtttcactgcagaagtatattgatctgcagaaaaacatcgacgaggcaaaggataggttttcgagagaagattaaagtacgattgcaagtagctcaagtgagctcttagtaatatggccccccttgagttggatgagtaaaatgttccatatgtaaattcctggttgtgatgatattgtgtatcgagtcgttttgtcagttgtaaatgttttgtgtagtctctggtgggagtatggggctacagttaagttagaaacatgagaggacaatacgctgtaagatactgatatgaacatgatgtatgcaccatttttccagaacagttcagtgatttgtcaatgtagcgttgaaagctaagtctccaatctcatgaatttgacgaagtacaaatgatcagtatgaagactttatgaaagaacaagtcctcttgatgcatattttagatgataccatcatcatccatgtagggaaaaagttatttctgtcaaatactgggtacctgttccaatgccccagcacccagctgggcaagtgatgtgagctgaaagcctgaaacattcaacttgcctgacagagcacacggatgcctaactagagtggcattcaactgtgatgcagattgctgctttctcattataatacgggaagggaatcagaccatgcatctgacctctaggaaacgaacaaacaggtcgagcagattcctgcctgtttaccctcgagaaaggacaaagccaagctgatccatggccaaagtcaaaagccatttgcactcaccatgatgcagatgcagtgttccttccctttgtttctcatatatacaaacaggcagcttgattgtcgagtcccctagctgctcaaactgaaaacaaaagaatactggtctactgtttgctgttcccaatatttattttttttcagcatatgagaaaatggattaggagatgtcatgctgttgcttaatttaataatgccagtgttttaatagcataatgcaggagagaggcaggggtttagaaaggtacaagcaacaaccatgcaaaaaacaaagctctgggccgtacccagcagctttccatgttctgaatttttctgatgaggcattgacctagggatagggacgttctcgcagcaaatacattacatgtcaaagggaattatgcgacaaggagatggtccaagcttaattgctttataattcctagggaatccggcatggttaggtacagttattttagtttttgtgtacagatgattatatatcttatatatactcctagctagcaatctttgttaatctgaaggtgttagttcagtatattctgaaacatgtacgactgatgctattacaaggaacaagtggatgaggagcaggtgtgataagtcaaaacagcctagtgtatcatcacatgaagagagctctctgatgatgtgcatggaatcctttaaataatgcacagtggatggccacagcatggtgatctcatcatgccctcactacttatgtcatttcttttccaatctaattgccacacattttatcttttgctgatgaaaatgaagaggactgatgagagtttcaggctgtctctgaaaacggttcaagtcagaacaatcataccgtaattttctcccttttctgcttgatcagcattcaacaacggatcgcattctggatgacttggattacgtagatcattgaacaagtaaaatacatctccgatgtcaaagtaggttttcagctttgcagttgaaactgacctatgcaagatgtgctgattagtgaggtaatactacgagctagtggaagtaatcaagtgtttgatggacccaatgacacacacaaagtcttcgaaagcactcaatcacaagggaatgcctcatgggatgtcttgattaaactaatttagccatgctcctacctctcgatcggtgcaaagctgctgcaacttgtggatttgtagtagtgttgactgctagcttgtgggttcgagattaattggagtgggtggctgctgaactgttttcaacgctgacaactgccggaaaccgtcaaacttgttcagttttgtgtaggagtaatctataagcctccgtccatgctgtcagctcgcctgttcatcctgtgcgcctctcgtccctgtgtgctgccatatgctgctggtcagctactatcgcattctcagaaacctgacgaatggcgatgcagtttgttcagagaacatctgtccacgccttgtttgagtgttcagactgatttccgtagtctgaatcacagtgttcagaaaacgaataaggctgtcagaagcattaccaaattgccctttcctgattactcatctaataatttcctgattgatttacagccttacgcaaatatgcacatgacagcagagcacagtggtggttattgaagaaggggcatggaagatgtgcagtcgcattttgaacacacatttggacttgtgcagaggtcaacgaatggtacagcatcgatgaggattacgcaatttggtttgagctcaatgtcgtcgtcgcctcacgagaccgattccatacagttgcagggtttgattattactattgttttttattcggtggacagacacagttacagaatacaacatttttctttttctgaaactgaagattatagtattaaagagctagagctggagatactccatataggcatcgtggaatcattcaaatcgttggccggtggtccttttcactggataggtgaaaactgcaagctcactcatttacactgatttacagtggacgcatagaatcaccgtcagaaaagaaaaccaaggaagaaacgaatattcagagaaacgctttcaggtaaagttggcaccgcaccatggacagaacgaccgatctcctctagatcttggcagaataataatctggtgcagtagtgagtaataatatatctcatgcggttttgtttggtgacgttacggcagccaatataaagaagagatctttaaactttttctctgaaagaagaaagaggaaatctttaattaggtaatactccatccgtttcaaaatgtttgacgccgttgactttttagcatatgtttgaccgttcgtcttattcaaaaaatttaagtaattattaattcttttcttatcatttaatttattgttaaatatatttttatgtaggcatataattttacatatttcacaaaagtttttaaataagacgaacggtcaaacatgtgctaaaaagtcaacggtgtcaaatatttcgaaacggagggagtgtggtttaggtgctagagctagcatcgatcggaggtggatagatggatgaatggatgcagagtgtgatggacaggtggattgtgattctgggtagggcaaatttggccatttttgatgagcgaggttgatcgagaggggtgtaggggctagctaaggcaagctaagctaaggtggagtgtagagagagatctttgatgtttgggtgggtaagggagaaaaagaaagaaaatctggtgagagcgacaaggagcccaccccctctaccccccgctattcccgcgattgtactgctgattagccgggaatggatgctcgatctctcatggataatttgcacatataatgtgtgctactgctgcctttgtttgttacttacatatgctgctgattgctgctcgatgaaaaggatggaagaaaataaaaaaagtttgaaataaattgtgtagtattagtggattcgactccctgttccttctggtctcttggcagttgtggaagaagcggaacttctgcagcctcatcttttcgcttatacttatgtttatcagccaaaatttgaatttttaacttcaattttggagttgattttgagggtttttttttcatcgaagtttatttgtcaacctttacttttagatcgttaagaatatgtatataaaagttgtatttcacaaattatttttcgtttgcaaatatgttgtttcgcttatcccccgataagtgaacgatggggctacagagttttcgactcagccgtctcctcggtctttgtgcgtgcttgtagtgtctgtccactcagaaggtcgtatgcggtattccgctggtataacaacttttaggggattgctgtgagtgtagcgtggctccgcctcctatctctcgtttgtttggagtatcctttgtttcatagtagcctcttggtttttcgtccttcccccatcccggcataggcctgtttagtcgattgcgttgtgtaattaaacttaatatattaacgtgtaatcttttacgcgttcacagaaaaaaaaataatattaagtggatgcataggtgagacgttggcaagcatattgcggccgacagacagttgaaaggtcgtgcatggcgaagagaagagactgttgctggcttgctcgcttggccagcagcacagggatcgagcgagttatacctattccatgctcgctacagttagtacgaaacacttggcaattaatcaattaatcagcaactagtactccacatgcatgcagttgagttacctgaaatcgcgaaatggcacagcatcagcatgggctcccaaaccaaaccaccaagcgatatccaataggcgatggatggcatatgccacatgccaccgtcgcgcgtcgacagcgccaccacgcgatacggcgcggcgcggttggcggtggcctccgacacccagacaaaaagcctcacctcaccctcacccgcacacgccgacaccccgacgcgttttccactgggtcccatgggccatggcctctctctatatactcggcccatccccgcctcctcctattcccaccttccacctccacttcctcctctcatcgaagctagctgatctgccatggacgctctctcctgcctggcgccgcacgccgcgctgctgccgtgcgcggccttcaccgacgccgacatcacgcgcgcgctccacttctcctcctccatgcccgacacctcctcctcaccctcctcatcctcctccgcggccttcctcgccgacttctgcggtggtggcgccggaggagggttcgtggtgtcggcgccgccaccgacgatgccggcgatcacctgcgagtccgttctcgtggccgacagcgcgcgcccgtcgccggccgggcctgcgcggcggcaccagcagcagcagctggggctgggccccgcgggtgggcgcgccgggaagcggcggtcgcgggcgtcgaagcgcgcgccgaccacctacatcagcaccgacccggccaacttccgcctcatggtgcagcacgtcaccggcgtccaggccgaccccgcctccctcgccgacggcgccgccggcatccttcccaccaccaccaccactgcgccgttcgacgcctcctccggcctccacatgctcgacaccttcgccgccgccaacccgctgctgcaagccgagcaagcggcggcgcttcagcagcagccgtgcttccccacgctggactcgtcgtggagcgccgtcatgtacgatggcagcgacctcctctgagcattccttcattcccagctgctgctgctgcactgcagtgccaacactagttaattaggacgccgccgccgacgacgacgacatagctagtagatttcttgctctcgatcgcagtggccggcctagctagctctacatcgatcgatcaatccactaccatttcttacttgattagtttgtcgttggagccaagatcgtatcgatgatgctcgcttgatcaggttaagttgttgagttactgtagggtgttactactagtattattgtacagctagcgcattatgcatgtcatgtcgtcgtccgtcggtcaaacggagtgtggctgctatatatgcccacattttatgcagtagtagctgtctatagctgatctcagttaatttaatttgtactacgtgtatgtcaaagctaattagtcagcagtaaaacatcagtttctctcgcaattaatctggtgaattctagaatgcatgctaaccatcgtactactttcgtttcatattacaaaactttctagtattatcaatatttatatatatgttaataaatctagatatttatatatgtctaaatttattaatatctatataaatataaatataagcaatcctaacctgaaacggaggaatcacatgcatagacaacgacttgctccgtgctggagtaattcattggctcgcaagacctgcgtgttggaggtagttgcagctagcttccaaacccacgatctggacatcattttggatttaagctatatatctgcaggttaattaattattattagtcgcaagaatgaaagatcgagagagatctgttaaagaataaaatatacggtaaacgagcgtactcaattaatattgccgcctttttgataattgaaatgagcacgtcgtgggtcggtggaattgacctggtcgcaccatggatgctgctgcttcgtcatcgacagacggatcatgtatatgatccgatcgagtggagatggaaggccgaggggtttgggccaggcccattcagtctcttgccgcctgtactaggcttttctcatcgataatatatgtgggcccatactaactaaaaaggaattttgcactatttatcacaaaacttcatgtattttacactatttatcataaaactacagatttaagagcttgtttcacaaaattatagatttagtgtctctatttatcacaaaactatatgtattttgtacaatctatcacaaaagaacatatttaagaacttgtttcacaaaactatagatttagtgtatttgtttatcatagaactacacatttagtgtcttgatttatcacaaaactacatattttgtgtctccattatcacaaaactacatgttttaacctgtagttttgtgataatgaagacaataaacctgtacttttgtgataaatgaagatattaaatctgtagttttgtgaaacaagttcttgaatctgtacttttgtgatatattgtgcaaagtacctgtagttttgtaataaacaaagacactgaatctatagttttgtgaaacaagttcttaaatctgcaaactttaatcagcctaaaagtacagatttaacaccatatttttcataaaattgtagattatagcattgtataaaaaaatgaagattaaactcatttctgttacaaagctacaacttttataactttaatagggctatggttataaactctaatatcggtagttctttcataatttcatcactaaatatataactttgggatacgattccttaaatatatatagttttgcaatagtttgtttgaagtacttgtacttttaaatttactcttttacctctcgccgaacaacacggccccggcccatgataattccatcaaacgaccgctttacaccggaattgctatttagtgcagcagagttcttaactcattttttttccattcataaaagttttcgtgtgaacattttttgaacaaaagtattcgagacgaaagtttaaagaaaaaagaatgcgctgggacctgggagcctggaaacacaatcgcgctaaatagcaatccccttcacaccgagatgaaaaagtctgcacattaccactgagaaggcccacaaataggaagcccaaaacctttttgggctcccgccaatttagcccatcggcgaagctgtctccagtccacttgaccacttcccagaactgattttattttctgggcgaaaaagaaaaaaaagaaaaagaaaaaaggttcgcgtttctctctcttgggcagccatggcgtccccgcggccgccgccggcgagcctgcggagcttcctggacgcgcacttcgcctcccccgaggacctcgcctccgcaccggcgctcgctgagctcctgcgccgcgagtgcgtgggcctggatgcatccctccgccgcctcgaggcgcagctcgcgtccgtatccgcctcctggctcgcgcgctccgccggcgctcgcgcatctctccgccgcatccgctcccgaggttcgcttctctgaaccctagtacggtttttgtcccccttttgtttcgttctggatttgtagggacgctcactgttacagtattattgcttcggggattccgctcgggtttcaacggattttatcggtggtaggcgggggattcggagtggaggaggatgatggcgaggagacgctgcggagcgcggagctgccggcgcttgtgcaggagatccatcggatcgacgccattcgactctatgcgggtcagccttccttcgtctcttcgtgctttcctattaacttgaaaattccgatattggatagttacagtgctaacttttgcaagttaatttggattatggggtcactccgattttagaaaaaaaaaagctcttagaatttcagtggtgttttacctgccaaatcagttctgagttgggcaatagcaagttacgcttgtgtcgagtaactggaatgtcccaatcttggactagttacaatattaaatttgcaaattagtttggtagatgtagttgttacctactaccatattagcctgtatgcttgagcattgagtaacttatctatgcattgcaatatggatctcttgatgaattgtttcttcatacttcactagacactaagtacttccctgaaataaggcactagctacaataacctggcaatgcacttcacgtgcccacggcccacccaccactcaatctcaaactactgtaacttgatgatgtcaatggagaatatctgtgttaaacaaagctattatcaacatcgagtttttttctcaacaattgttacatagagtcaggggcggaggcagcattttagctagctgaaccatatagctataaattttttgtgcaaattctacgtaaatttcagtgtttctccattgaaaatttttgccacgtgtggggcccaagcccaagctgccccacacgtggctccgcccctgcatacagtgcaatgttgaccatgacctttaaactgattaacgcggattacctgccagtgatctccatgggaacatgccatttgcgctaaagaatttgtttggtgctgcaaattatattatgtctcctccatcatatccggcatgatgtaggaatttgtagtaccttctgtaacttttctatgctgacattccagaagctgctctacagttggaagcttttgttggtaacctagaagatgcaacgttttccatcgttagacaggcctcaaagttgaacttgtcctcggtatttaggccagcatctaatgtgagaagctgagaaaccttctctttcctttttcttccttaattgttattttaggtacaacctacaattattggtcatgccgatatgacgtctgttagcagtatgtttgtttgatatgttaatcacgcttttttttctctctccaaatgtaggaaatgcaatggaagcaagaaaagttgctccaggctgttgatgccatgagggatattgaactagagttgctacggatcagcacgaataggccacaatggaccaatcttatcatggctgttgattctagagtggacaaaaccctagcaattttgagacctaaagcactaacagattatcgagctctacttgcagcacttggctggccaccttccttgtcttcaccagatgcagcaaataataagtactcggaaattccaaaccccctcatcttaatgaatgaggcaaataaagagaagtattcacaaagttttctagcactgtgtgctctgcaacatgcgcaagccaactgtgaagcgcgtcaatgccaagcgaaaggagcaagtgctagcatgtcagattcaaagtactttgataaaactgctgcatgctttgataatggactttgggcaattgatgagttggttcagcctattgcttccaggttggaatatcattttgctaaatggtctgaacagccggagttcatttttgcccttgtttacaaaatagcaagagattttatgggtggtgtggatgatatattgcagcctttgattgatcgagcaagacttgtgggattgagtgctaaagagtcttgggtaactggaatggtgaaaatgcttctaggttaccttgagaggcaaattttcccagtccttgtcacatcttatcaggctactgatgacaaatttgaagtacattcctcatggatgcacttgaatgacctgatgattacttttgataaaagaatgcagttgcttgcagattcaggaatacagaagatagcttcaatttctgaaggcctgtccaggtccttatctgtcttttccatatatagcgagcattctgattggcttcacatgtgggctggtgtagagcttaattctgcacaacataagctcaaatctgagatggaggatgagataaattggtcatatagtattaaagagcttggtctacaagagatcactagtaattttcttctgtctacaagagaagattacaaagctccaacaatttctgaatttgtggtcaaaactgcatctgctatgattgaaagaggccatgctctgccaaataggggattaaggattcagtataacagatcctcttcagtccagttcctgagtgatttctttcttgtcttacgtgaacgatgtgaagccctacaactgacaaatacagctttagaagatgattctttactaaaagcttcatttgcaattaatgctgctcgatattgtgaatatgttcttcgggaatgggatgacgacatagttttcctggagatgggtgcccataggaaacatgttgatgaaggccagggacaaggccacaaacacagtgcccaacatccatgttctttctttggcgatgaaatcgccttcttggctaaattggggaccgattatctggaacagattatgtcttccgttctgctcgagtttgaagatctatcctgggactatgtccaaaacattggattgcccaatgagcagatccatccagttgatgaggtcctggatgaagaaaatctcggagtatctcctggatttgttgcctctctagaagttgtgagagacagaaccaccaaactgatgctacatcttaattcgaaggatttccttgatctgtggaggagtatagcagaaggcctcgactacttcatctacagcagcatacgatggggggagttgacattctctgaccaaggagttgtacagctaagagtcgatacgaaggcccttctccacatctttaggcccttctgtttaagacctgaagccttttttccattcataagtgattccctgaggctgttagccatgagaaagacagatgcacgatacctgttggaagtgctcaagaatgccaaggagaatgacagttgcctgaggcaacaaggactgcaacatgtaaatgcaagccaagctatgaaaatcttaggtagcaaaaggtctgatggataatcttcttaccttagcgtagaagacctgctggagatgatcagaatatgattttgcctatgctgggctgctctatgtcactatgatgacggcaatcttctgcctgtcctccttccaggaaacatctcttctgagaagtttaacacgtggttagtggttaccggctgcaattccaggcccactccaaggataatgcgcctgttggaacgcaggatagcaaaacagtttgcgtttcaagattgaagagacttatctggtgttcgcagcagcttcgcgttgaaactagttttggcatgtactacattctctccagggtgatgagacctgcgagtcttggacgacaaattggagatggccgctttgcaacgcaaaagtccgccgccgccgccccctgtttatcgcttctttgaccggctcgatcgtaatcaacccaaacacatcatgttgcatgcaaagctagcagatgtaacaacaaaatattcaagatctcgtctgcctcaaattctctgagtaatatagtcaatgttcaccgtctcgcagactatgattatgtcgcatatctcatgtatgccgtgttaatcctgatccgtaccttgaaaaaaaagattataatcttaatcttgatctacctggtcaccagttgcatgtacataaataaaaccgccagatcgctctcctttgactccaattgtttgacgcagcgaagatacgaggatccgagcgtacagtgcttgcagatgccaatctatgacacccattaaaactcattctagtttgactaaaaatttgtttctatgtttttggtttcttcccagttcgactaaaaaatgtttttatgtttttggttccattccagttcgactaaaaatttgttttatgtttttggttactcctacttggaggagaggccaacacaaaagaaaaggttgtttttatgtttttggttactcctgcttggaggatagaccaacataaaagaaagaaaatgtcaattagaaataatatttgctgatcaggtcaagaaagatgagcaggagctcatgttgatgcacatgcatctgactttgagcttgcaaaaatgtagtttcttctttctctcgaacacagaaatgcagactattgataatatattttattgaaccttgtgagatccatgccctgaatcctgcattctacggtcaaagcccaacaatctgtagaagatgtgagccagtatctatcagtttgaatgtgtcaaaactgaaaagcaataatcctgtcttggtaaaactaactgcaggacaggagctattttgtgctagttaccggctacaagcagacagatcttcaacaactgaaaatgatgtgatagtgcacattactaacctttttcacactaatgtggatagctactagaggactactgattgttctgttcttgtcctttgtgagcactagtttgagctgttactgaatcacaccttttgtttcttccagcactgtactctgcagttgacaaagtagcaaattttgccacctgtttcagtgttagtgctgtatgatgctactagtagctgctaagcaataaagtttctctccgaaaccaaagaaactatctttttctgccaacatatgtattttttttcttctacccaacatgttcaaagttagaagctgtcaaagacttgcacctaatgcagttcccattatgaaccattagttttattaatggtgaatgccttgcctgcatcaaattaattgatggtgtttaattaacagggaaggctacatctaattagaggtaattaatttatcagcactttggttgactgacaaaactggaggaagcctccaagtaggcatctagtactagacatgtactcgtagtcagtcaactgacagtttgatcagtcatctctatcccttgaattctttgccttcctgtccatatattcttccatgcctcccatcacaacctaagaccatactccattttggagttcgcagcaactgctcatctgggattgcagttgcaggtgatcaaggattaagaggttcatccaaaatggggaactgcatgggctcatccaagtgcgccagtgcatcggctccacttgaatcaagtaagatgctactctgatatatacatcatatttctgttcgtggtttgattagccaagaaacatgatgaggaagaagcaatcaaatagacaattagcagtatccatgctgatctatgtaatatggtttgaaaattattcagaggttacgagaagcagcaactcgacgacgacgacggacaacacctccaaggcatcgcagcgcagctcgtcggcgttctcgtcggggcagttctcgcgagccagctccgacgagtcgtcggcggcgccgtcgctgtcgtccctcaagtcgttcaacatgggcgacctccgcgcggcgaccaagaacttcggttccaactcgttcctgggagagggcgggttcgggtgcgtgtacaagggttggatcgacgagctcaccctcgcccctaccaagcccggcgtcggcaagatggtcgccatcaagaagctcaagaaggagagcttccagggtcacaaggagtggctggtaattaattaattaactaactacacttactaatcatttcaacttttcattgattaattaaccttcgatcacttgcaggcagaggtgacctacttggggcagctccaccatgagaacctggtgaagctggtgggctactgctcggattccgacagcaacaagctgctcgtctacgagtacatgctcagaggcagcctcgagaaccacctcttcagaagtgagtagtatatagtacactgtacactgatcaaatcgaatcgattcttcaattcagaagtgaatgtaatggatgttgcatactgtatgatgcatgcaggagggacgcagccgctgtcgtgggcgatgcgggtgaacatcgcggtggacgtggcgagggggctgtccttcttgcacgggctggagaaccccatcatcttccgggacctcaagtcgtccaacgtcctcctcgccggcgactaccgggccaagctgtcggacttcgggctggcgcggaacgggcccaccggcgacaagagccacgtgtccacccgcgtcgtcggcaccaggggctacgccgcgccggagtacgtcgccacgggccacctctccgtcaagagcgacgtctacagcttcggcgtcgtgctgctcgagctcctcacggggcgccgcgcgctcgacgccgcccgcggcgccaccgccgagatgctcgtcgactgggcgaggccccacctcggcgatcgccggaaggtcaaccgcatcatggacaccaggctcggcggccagtatcccaagaagcaggcgcaggacatggcggcgctcgcgctccgctgcctccaccacgaccccaagctccgccccgccatgcccgacgacgtgctgccgcagctgcgcctgctgcagcagaacaccaagccatcctcctcgtcgacctcggcgccggcgcacaggtcgaggccattccaagcgctagcgagctagctagctaggcgtcttgttaattaattacttcgtcatctctcaattactccagtattatttgtttgtcaatttcatgctagcatagtagcatgtggtgtctatacagacaaaagaatcgatgaacatctagctacctagtttgtaattagttaggtaggagatatatatcattgctgtgtgaaaattgtgaattatatattgctagctgcaaattaagtagataatattattatagctaggttcagaaattccatgcatttgtgtgcatcatcagtatagagacgattgaggatttgtgatttgttttgacactatgttcttgctttcatttccttttaccatcaaatgaaggctttgtttgctcatgccaatctgttgaacttcaattgattaattacggacgctgttagagtttttatcgaatatgtgtacagagtcggttatagttcagtaattggagttgtactaggtatatgaatagagtaagagtcagaatctatcctataatctcttttaaatagagagacggacctgttgtaacctcatatcgacttagcataacgagagagaatagctgccggtgacggccggctgtgagccgttgtaacttgtaactttgataagcgctataatatgctggatcggggaggagcgcctgtaatcagtaccccgaagatataggcttcggctgaacctcgttaacaaatatcatatctcggtatcgttattgtgtttagatatcctatgatgtttcttccgtgtttggtgagccggttttataacagacgcttctccttcatatgtggagtaattagcagcttcaaaatggttcagtcagcgctcaagacgtgcacgctacacacaattagcctagtcatacagcataaatcagacgacaatcagtaataatattcggatttgctgcctcacttttaaccgtgcctaatttcgcatcttcgcgctttcagaaagcaagaactgattaacaccactattacgatatctgtctaactttgttaaactggtcatgatctcgcatatatatagatggtatccacacactttatactttcaaaggacagtacgtattcacacactcaagtttcaaaagatagtattcacacacgaacttggtgatatattgactatttgactagagtcatccatttcatcatgattgcgcgccgtatgttgactaaaatgacaatcacttcctgcaataacatacacccttcatcctaaaaataattaacttttagaaatatatttgaacgttgtctatagaagttgtttttttttttgacatatggaatacgaagcttcttttgtagatcaaaagaggatccgcttcttttttttcccctagacaatatggcatagcgaagaggtagagagttaattcagtgcattataaggaaaaaagacagttaatttaaatcggcgactctgttagggcatcattacgagtaataaatataatgttcagtgaacaagaccactgaacttaactctgtatgatcactgaaaggaggacaattgatcttgagtagagattcgatcaatttaggcccaatggattacagagaggcctaattgcaaaaacgagcccattaggcagtttgcatagacggactgggctttgcattttcgccgggcctattgggcttttcttaggccatcatggactggcccacggaatcactcccgtcactcctcgagtccggcggcagcggcgccggcgctggcgacggccacggcgaggcgtatcggtattggggagcggcggctagagagaaggtggtggcgagatgcggcttggccacctactcggcgtccgccaccgtggcggtcatgcccaagaacaaggcctagggaagcaactgcggcgaccggcagtgccgcggcggcggcagcgagccgtatcggggacgccacggcttgagaggcggtggcggtgagatggtgaggttggccggctgctccccacccgccatcgtggcggacattccagtataggtacggcaaacctatgcacaaacaaataggcaactatcttgaatcagattcagactgatttccttcagaattaagccaagcaatcaagcaccattgatttttcttcttgttttctccgactctgagaatagtttttcgtgcgccatcttatcgaggaaaatgacggcacctggttttgcttccccgcgacgtgcagcagtggatggagaagtaagcttcaaacagaatgctgatgacgtccctatcggttcttatctcagttcctccccttctccttcttgcctagctttgcttccactcatgcaactgcttttgcacaacttgatgatgcatgcctcgatcgtctatctcatcttgtagtgcgtttcggcctttcaggcatatatatggaccgtgcattgagttggtgtgagctgcgagctcattgagcacaatggcagtgcagagaacagatgctgcctcttggctccgtgagctggttcttgtttacgccatgtgctggacagtctcactgggttttgttgcgggtcaaaccgggcagttgaatgtcgatgcctcgccgcagaatgcaaggaagatccctgataagatgttcggtatatttttcgaggtgagactgaatctggatattggtatctgtttagaacaacatttgttttctcactcaaaaagaaaatagaacaagcatttttgttctaaccggtatacgaactaaaagggacaattacttgtataaacttggtgccagcacaaacatttttcctagttgtagaccatattgttcagatagcatttctagttatttactgaatctcatacaattaaagtatgcactgtttggaacacagttattttctcctgatttgcaacattttcctatatatagtacctgcatatcaaatgaggttgcttcgacttctattccatgctgggagcttgaatatatttgtggttctacttgtaggagatcaaccatgctggggctggtgggttgtgggcagagcttgtaagtaacagaggtaaggcaaagcatatctgtgttaatcaagatgatagaagttatagaggagcttgtaagatgataggaggaacagcggtggttgggatatcgtacttttgcttaatgtttgtagtgctcaaatttatttccaggttttgaggctggtggacctaatacaccttcaaacattgacccatggctgataattgggaacgaatcaagtatcattgttgggactgataggacatcctgttttgagaaaaatccggtggcacttcggatggaagttctttgtgattctaaaggaaccaataactgcccttctggaggtgtaggagtctacaatcctggttattggggcatggtatgatgtgtttcttatttatttatctgtccgtctacaattttttttgaagtttccgtaatcttatttgacagtttaaatttgatctggcgtgtatttaactgattaaacatcatggaatacactatatagtatttcttcacattttccagaatattgaaagaagaagggtttataaggtgggcctgcacattagatcttcagatgcagtatccttaactgtttccttgacaagctccgatggtctgcagaaactggcctctcacaccataacgtaatatttatgtttccattaatatcgctgggatgctgcatttttttccctaataattgcttgaatttccatgttgcttccagggctagcaagaaacagtttgctaaatggacaaagatagagtttcatctgaaatctagccaaaccaatactaattcaaggctccagcttacaaccagcaaaagtggggtgatttggctcgaccaggtgtcagttatgccatcggatacctacatggtatactttattcatgtctcattttatttcttttggtgtaccattatctttacttatttcgtgcttcagctgcacagttttgcagactattcatcagtaaacgccagtagacaactatgatttttttaagagcaaacccatcactatactggatggcccatatcctataagggaaattccttttttgccgggtctataagggaaattcctactgagttgccatcagatttacaggtgttttatacttatcagttcccaccttttattcattgttatgttttcattttagggacacggttttaggaaagatctcgcttctatgttggccaatttaaaacctcaatttcttaagtttccaggtttgccaactttacatcatatattttttttctgaagttaggtatatcaatattatcatatagttttgataatatgtatcaaacttaggtggtaactatgccatgggaaattatctgcgaaatgcatttcgatggagtgaaactgtgggtccatgggaggaaagacccggtcacttcaatgatgcctggggatactggactgatgatggacttggattctttgagttccttcaggtaattggaacgtagtccatgacttcaaaactaatatttattaaaatatacttcataagttcatattgatattcatatactgcagctagctgaagacctcggtgcttcgccagtatgggtggtcaatgatggtagttcaaatctccatggattattaggtacaactaacactctgtttcatgttgtgtcaataaactattttcaacattgcaggagcaagccaaaatgaagaggtatctactgcaacaattgcatcattagtgaaggtttgttcttccaaaatattcaatcctttgataaaacgatcaatctagtacatcaataccttgttccccatttccttcgttcttgtaatgttcaggacgtggttgatggcatcgagtttgccaggggagggcccaagactacatggggttcagttcgtgcagcgatgggtcatccacaaccctttaaccttgactatgtttcaatagggaatcaagaatgctggatgctctattacagaggtctgtagctcttcagttgcacgtccttcctaacttcataccaagaattgatgtttgaacttaatgcatcatattcctgtacttcatgttggaaatttttgttaatcgaataatgtcatgtttgtgcttgcagatgatagaccaagagtttccttttccttcttatacatcaatttttaatagcgttttagtcctctataagataatttgtaaaataatttcatctacctttatatcttgtgggtaagcagggagagctcatattatatgatctttcaattaacaggcaattaccaaaaattctattccgcgattaaagctgcctatccagacatcaacgtcgtgtcaagttgtgataaatccactatttctccgtccaaccctgccgatctatatgatgttcatgtaatgtctattcattatgttcctttccttgtttgttttcacaatttcgtgttttttccaaattatggtttcgtttatggctgacaaaaacatcatctataccacaggtttatacctcatctagtgatatgttttccagaactagtatgtttgacaatacgacgcgcagtggaccgaaggtatgctcaaatgttatccctacatctgatatacatagatacttccactttccatgctcagaaattgacttggggagctctatgactctttaggcaattgtaagtgagtacgctgtgactggaaaggatgctggcaaaggaacactggtagaagcactagcagaggcagcatttctcgttggattagaaagaaacaggttaataatcatactttttttagaggaatatttatacttttattttctctccatcatggatttctgctgtgtaagctctgccataaattggtccatgataccaaagatttgaaactgcttgaagattaaagctttgggcatcaaagggcagtgtgaacgaacatgcttccccttcaggctaccatgtctgggctttctgcatcactggttgattgcattgcaaagataaacattccgtaccttgttttcctgcagcgacgtggtagagatggcaagctgtgcaccgctctttgtaaatgacaatgatcgcaggtaaggatccaacaactcaggaattcttatttttcagattgctttctttgtgtcatatctgactgagttcacaaccctcaaaaataaaatgaaatgatgcataccatagatggagtccagacgcaattgtgttcaactcatggcagaactatggatgcccaaactactggatgctacatttcttcaaagattcatgcggcgcaacgttccacccatcaaacattcagatttccagctacaaccagctggttgcatctgccatcacttggcagaatagcaaagacaagagcacttacctgaaaataaaggtgcgaactttgttaagctgctctttgtttcagagagagtgagctatgcattggtttagcttggaaatgaccaagtgagcacaaagcgaaactttttttttttttgcagctagtgaactttggcaaccaagctgtgaatctcagcatatctgtgtctgggctggatgagggcatcaagagctcagggtcgaagaagaccgtgcttacttccagcgggccgcttgatgagaactcattccagcagccacaaaaggttagtacactacacactgactgacagctgatcatgtatcctatcctgtaaattaaacaaaacagatggtagtaactatattgaatgtgtacgaaattgttgtaggtggcgccagtgtcgagcccggtggacaacgcgaatgagcagatgggcgtgttggtggatccatactccctcacgtcgttcgacctgctgctgcaaccgagcaagcactcgaccatatgaaaggagatatatactgtagtagtaatagtcttaagaatatttattagcctgcaaaaagaggggaaaagagaataaaggaatgttgatggggggcttgattgctcaggctaactgcattgcatggaacataatatgcccatcaatattcttattcgattcagcccaagaatagagagatttaccaggtgagggtgagtcatccgactcaagaattgttgtttcaatgaaattcagattagctgacgttgcaccgcatctgggatcttggctggcacacagcatatgtaagtatgtacatacgtgcataccatcaccacctgctagtgctaggaagcttcctaaattccttacagtggcaatttccttggcttattaggtcgcataaagctataacataatggtatattacttgtcaattgtattgctatgcaattttcagatgtttggtgtatatatagctgtatacgcgtcacctaaagtgcacttattgtattgttcgatcgagacacccatatagttcaggctatttaacttactgaaggcgaaatctcctggaaaatacatcatcttagcttgcaatgcagtgcgttgattgattgaactaccgatagctaaccaggctgctgatcggcgaccgctgacaaaaatatgcttaattaattcccttgtggctgacatgatagatgacgtataaattaatgacctgcagaaatgcttaagattaattaacggcaaattgtatatgcttaacctccacagttgactgctccaattaaaattcagacgtgcgcgcatctgagtttactcaagtttttcacatcatcgtgctaagcatgacgtcatgttctgatgtgcatgctgcagatgcctaaaaatcaatgcatttgagatcgattcatgtgacctgaaaaaaatcaagctactccatccgtttcacaatgtaagtcattctagcatttcttatatttatattgatgctaatgaatctaaacatagcatcaatataaatgtgggaaatatatgtctagattcattagcatcaatataaatgtggaagatgctagaataatttacattgtgaaacggaggaagtaacatgctaaaatggagttaaacagcccggcgaaaaaaatggagttaaacaagctagctagctgcaggtcaaggcagttgtgttagcctatattgattcccaaacaattcgcgtcttcaatttcctcgtacctacgggcgatcatcatcttgttctcttgtattgcaaagctaagagagagaaaataatctgtcaatggttaaataaaacctgccatagttgcatgtatcacgcgacctgaagcctctacttgcacttctcaattctcagcgtctgaccatctgatcagtaacttatgaaaaatatccgctctgttcataaatgtaaagggatgatgttggtggtactttcaaatgtaaggggtgatgtattccctccttacagaaaaaaaatccaatcatgagtgatgtgtccagatccaaactcaacattgagtttttcttttacatatatctagatttaaatttagaattgggtttctttttggaagaaagggagtagtatttgacaggaatatgataaaaaaatgaaatgccaagatattgaatggacaaaagagaagaggtgatgtgatacattttttctactcaatattttaaaatcttttaaatttatggataaatgaaagaattaaaatccttatacttcacccgtttaaaaatataacaactcctaacatttaatgtttgtcccaaaatatgacaatttcttcataaatattttctgtctcaaccaattataatcttccaccattcaattttcttatctaccttcacttctcaactaatcataatattcttctatttaattttatctacttgcttaatactcatatttaatttaaaaatattcttatattctgtgatggagggagtatatttttaacggaggaacaaatggctggacgatcggatctaagtacggacagctaaaagttgatgtcagtgcatcattaaccattcttctgttcaacttaaacatattcaattccttgattaaattctgcgggcaagagagaggagtcgtttgctgcaaaaacaaaaccaaacaaaacagctacgggcccctgtctcttcccctgtcgtctccacctctcactctctcctctccactgttccggcctcctctcctccatcctccctctcccattctaccagttcttctgttcttgaatgctccggactccatagatcacccttcttctcccaaaggtatgtccagttcttcagcattagttcctgttccttctacctctattagttacgccactcgccggaggagaggaatgctgtttctcattccagatgcaagggaattccatttggctcctgactgcgattaactatgtctccagctgcttgcatgtgcagcattctttcggtatttcgttccattctgtcaaggaatacatggaaagataaaaggactcgattttgacctatttcaagggttcgaatatggcttgttttgattgaacatggctctgtgttttcttcctaatacatgaacaatgaacatgatgttttattatttgttagctagtgccttcagattttggtttctttttttaaaccggcgtctacatcctgaaatggatgtacacagccaatactttggtttcttgttttgctggttatattaggtcgattccatcagcgtttaatttctgcacttctgcaaatttttaggagattctagggactaaaagcttgcaccttgcagattagcttacagttagatttttctttcatactatttgatacaatctcagttggaattttcatttgcaatgaaatttcgtatttctactgcaatggattattgttttctccttttgattaatagctttccattcagattcaacataatgcaatatcttctgtttttctatgtgctgaccatcaaatggtcaagctttatgaaaataaatcttgtaatattccctgtcagattcagttgaagtctagtttgaaggaaggattttttttttttgactgaggaaagaattttttttttctggaagatgtataaggctaaaaggactgctgcccagaaagtaaggcgctgccttggaaaatatgagcttggacgcgcaattggtcaaggaacttttgcaaaggttaggtttgcaaagaacatggagaccggtgatcatgttgctattaagatccttgacaaagcgaaggttcagaagcacagattagtcgaacaggttattttcagagtcagataattactcacaatattttgttctactttcctagattttttgcaacaacgaaaatagccaaaagtatctagaaaaaaaatattcctgtgtacgcgccagctgtgctcatgccactctaaagtctaaactctattgcagattagacgggaaatttgtacaatgaagttgatacaacaccccaatgttgttcacctgcatgaggtaaatctaaagcatgagagacaagaatatatctttcattattaccatgttgctagtttgaaactttgtgcagtagtacacccaagccttctgtttatgataacttggattacttttgtggtgttttataacaggtgatgggaagtaaaacaaggattttcattgttctagaatatgtgatgggaggagagctccatgatattattgttagtactattatacctctgaggctctgatcccctgtatgacatttttcctttgcagtagctgtaattgaagtaatctccacttacttttttttttgcatgacaattaagtgaatttcaataacttcataaattataaccaggccacaagtggaaggttgaaggaggatgaagcacggaaatactttcagcaactgatcaacgccgtagattactgccacagtaggggtgtataccacagagacctgaaggtctagtgttaaccccattgctctggtttataagttataactatgatctggcataaacaattggaaattgacaaattgatgttttatgcatgacagttagagaatttgttgcttgatactgccgggaacatcaaagtctcggactttggcctaagtgctatatctgagcaagtgaaggtaatatcacacaactactcgaaagttaaaaaaaaaaggttcctgcacatctatattgtttctatgtcgattgattgccttttttactgtgtgtgtgtgtcaattaacttcaactctgtcaggctgatggattactacatactacatgtggaacacctaattatgttgctcctgaggtaacatttgcttgtacaacttctcttatttttctttatccagaaatgagtttctcctataataaatatctttctgttttgtaggttattgaagataagggctacgatggtgctcttgcagacctttggtcatgtggagtaattctttttgtgctgcttgcaggatatcttccttttgaggatgaaaatattgtctccctttataacaaggtaaatttagaaatttaaccaaatcttgaacaccaatataccaggttatgatacatttttttttgtcattctgatgacagatttctggagctcagtttacttgtccctcttggttttctgctgaagctaagaggctcattgctagaattctggatccaaatcctgctactgtaagttttttgacacttacaaaatgtggatagaagctcttacagaagtgacattttgaagtttgtttaaactttaaatcttttattttttatcactgattgtactgactagataaagttgcaatttggatcagtaatcagtgcccaaaattacttgtttcttcttacttggttttctttgttgccaaccagcggataactacttctcaagtgctacaagatcaatggttcaaaaaaggctatgagtcccctgttttcgatgacaaatattacccttatttccacgatgtttatgatgcttttggagactcagaagtgagttaattaatcaatagtattatatctacaagggtacttatccttttgtgcttcagatgttcataatcttaaatataccgtctaataaatttgccaggaaaaacatgtgaaagaggctatggaagagcagccaaccttgatgaatgcctttgagttgatttcactaaataagggtctgaatctagacaatttttttgagtctgataaggtaaggatcttttctgattgcagcagtatggttaatgagccagtgggcagtgggatcaaatatgcacgtatcataaacatttttcataaattacttcagaaactatgcaattattgcagtggactcacttttttatttaaacatgacagaagtacaagagagagacaagatttacatcgcagtgccctccgaaagaaatcatcaataggatcgaagaagctgctaacttactaggatttaatattcagaagagaaactacagggtatgctaagaatccttgcaagtaatgtttgtcttactagtaccactttcagctcatttgtacaaactatgaagaagttgaatatcacaatgtgagattacctttatcacccctgcgctgcgtcctgaaccatgacaagcatctcactcgtttttttctactgttctatttagatgagaatggagaatataaaggaaggaagaaaaggacatctaaacattgcaactgaggtatagaaaacacaaaattaaagaagatatctgtcacaagaaacatgaggattgatcaaaatattatcccgctgtataggttttccaagtggcaccatccttacatgtggttgagctcaaaaaggccaagggagataccctggagtttcaaaaggtatatgtctatcaatggggttactcttattatggtcaattgatcaccttcagttttgtttaaatgacaaagtaactgagcaaaattattactatgaacagttctaccaaacgctctcgacgcaactaaaagatgttgtttgggaattagaagatgcggctgaggatatgagctaagcggaatgaggtttgctgcagaatagatttcagagtttagtgctagatttctctgtacatatcaaaatttccgagttgcagtaaatccttttgttacccatgtatggatagattcatataagtacccaacaggattaggcaacagcaggtcacggcttcactgctcaccatttgatttgttccttttagagcagaaaatctactcaattttatcttccacagatgtaggttgacataggatcagtataaccatgatcagtgatatgctctgaatatttccaccatgtgtaatttgtagtatcgttgtttttggcactgtaatagtatactactgtatcaaaaaacattgtgaaatgaaagtattgtattgagagggttatttaacaggatcttctggaatggaattgaaggtagatgaaatgcaggtcagaagcgaggaattttatggtccttgagaaagtagcttgaggtaatttagtatcttaagatacttagtgcttagatgtaccaaattttatactagaaaatatatagataccttctaaaggatagtaaaattatccccaaaagcaaaggatggatggtgggcgcttgcatcgagaacagcttcgccgtaagccgccgccactcgacggagatgtggctcaccttctccgtctccggcgcacggcgtccagatacttttcctccttttctgcttcgattggttcctgtttaaattggatctagcggctgaagttggatcgttcgtgtggccaaactgcccaacttggatcttaactcgcggcccaaagttggatgggcggcagaatcaggattgaaatcatttcacttttgtttttgtttttttgccttttttgtttttgtttctgataatggaattcactcagcctctgaattgaaaatcatctcagtttgaacctcagaatgttttgtggacattttacaccaattactctctcaagtagctggagctacagtgatgaatccctgaatccatttggtccggttatgagtcgattcaattagttcccccagagaatacaagcagtacccaggcaaatatatttgtggtaacaaagtttttaaacatcttcgctaaaaaagaaagctcttaaagacttaaacatttggatagatcgagtttcatgacggactaatccggtttaatttgaagcagcaatcagctccagcctccagacagtgtcaagactgtcagttaccatactcaagctgcaatttgctccaccaggttttcaccggactctgccacggtattaccctcagatggcttctccacaattgaagccttggcaacatcatctgcattcttgatgtcttccaggatgcttgagctccactcagaaagctgcttcacacttgcctcatctgtgaatgaacaatttccactcattaatacttaacaagcaagcaatgttggtgaacagttttaagaggagtgaaaagaaaaacaagatggaatgcaagtgctgggtagggtgcatgcataccaagcctagggacagtgtggccctggggatgtcttatgatgacagggtcctcaaaggcagcggccagctcctcggaaggcactttgagccaatccttctctccaatgaaatgcactgatttcaccttgatcggatccttataggctacattgcatatgcttgggtccctgaacttgctcccagctattgagaccatgaacttgattggtggatgatcattcagtactttgccctaagtcattcagcttaagtaagaatccagatggaactagatactgcagactttgaataacatctctcatataaaggacttatcccataaaagaagtaccctgctcaagtccatgttctagtgaatgaaatgttggtgcagcttacaaaagctagcacctagctaaacgatactattcagtatttaccatagcctataggagtgggactttatatttgtactagcatttaacaatttgaagccaaaacacatcaccaacaactgaatagctcatggaaactgctaggttcaaatatgggaccttgatgtcacagtcgtttcatgaatattcacacattattgccctctgttccttcaaactacaaccaaaattgaaaccttctgcaaaattaagagtacaagtgtacctgtgcttggtaacctatcaaaagagcagaaagagttgcaccctggaatgaaaaagaaattaacagatgagctgaaggacatgagcagttgtaaacaagatgttaaacaaacagtaagggatttcggtcaaaactgaattatgatattgttcagtaagtcagtactgattaaaaaatctaaaggtctgaccacaacccatgtcttttggctttcctatgtgagtgtctggtccaatagaaaaacgtgagtacacaggattctgtaaaaaaaaatgcgaaagtttttgcaacttggatatagaaataaaataagagatcgactgcaaggagtgagtgattatctatatacagcagaagcttcagataatctagtgttgctcagtgtgtcggaactgaactcataaattacagcacctcaaaagttgacaatttaaatggtgaatgcacttatctggaatttcatatgcaaattcttggcccaagatctctagcatgcacataataataacactcaagtaccaagtgggtcaaatacgtttcatagctaggttccatttttacctgggagaatccaagcaggccatcaaaaggtccatttttcaccatgtaatcacacaggtatgaaatgcactcatccagatttgtgtattcagtgaagtcctgtgtaggaacatgcacagtaaataaatgtttgtctatctttggtttgagccaaggcacactgtatagtatagcaacaaaactgaaactatagtacaaagtaagatctgacaacgctattgcaagtgttgtttcagtttgggttccatctgaagcatttaaccttgttgaactgaaaccactcaaagtagggtgggggaaatatgccttctatctctgatttccctccagctgggaatatgccatcagggaagacctgaaaaccaggaaaatcatgtaaacaatcaacaaagcaatacaaaaacctgatctttggatccagcgtagtaccatgtcaaattgttggaagatggaaggattccatttgctgatttgcttcttcagaaaactcccacttgtccggaagccgtgcaggcaaagcaccttaaatttcttgtccagctccatgcgcaatcgtgtatgactcttacaagcacagaatacattcagaaaaaggccttaagaaggccaggagcatgtggtagttgctacctactgccatactctcagaggctgcacgcagctatcagtctatcattcaacacttataattactagtagttgttgcaacctgccaggcaaccctctttgaaaggcatgcctgcctttcccatttgctcaattcaaatccaattcaaaccccaaaagatccttctctgcaattgaacaaattcttctgcatacaagcagaagaaacatatgtagatcgaagaagagaccaatggaataaaaaaaataccagatatccaattgatactagactcgagcataaattgatgaaaaaatatataactacatacaggcccaactgcaatctggacataccaaggacaagaattactggttcacataaaacacaagagatctgaaaacacacttcagaggaacatagcaggaaaatcctttttagcgactacagctagtaggatgcttcactggaaattgataaaacaagtgttgcatcttaactaggactatgcaacacacaatctcctctgccttagagtatggttccatggctcacttggccatcatgaccttcacaaactcctcatagtttatctgaccatcaccatcaacatcagcctcacggatcatctcatccacctcctcgtcagttagcttctcgccaagatttgtcatcacatggcggagctcagcagcggagatgaagccattttggtccttgtcaaacacccggaaggcctccttgagttcttcctctgaatcagtgtccttcatcttgcgagccatcagattgagaaactcaggaaaatcaatggttccattgccatcagcatcaacctcgttgatcatgtcctggagctcagcttccgttgggttctgccctagtgaacgcatgacagttcccaactccttggttgtgatgcaacctgtaaagttcacaagcaaccaattgtacaatcaattgctgaacagtgtagtcattataactagatactaacagaaaaactaggcacacactacacttcctaataactaataataatgtcaacatgcgtctaattggatccatacggaatggactgtctgatcctaacactgaagtccaaacgtaattacttgtttggtttgaagaatggaatgtgttggtacatagcaattgcatcctcagaagggcatgctaagaagaaaattgaagaatgggatcatcccaacaaaatcaggggatgactcaacaataaccaaatcattgtaggatgattatcctaaccaaacaggccattaggggatattaacttaaaaaagaaaaagaaaagggactccttattggctcatcaccagttgtaaagagtttgaaatagtacgattatgtctatttgaatatgctgagagtattccgttaaaagttacaaggctgagtgatatttgcatatttggatgcttttaactgggtgattcaccctgacagtaatatcaagaagggattgctgcagtcaaaacatttcagcacaaagtttcaaggtgggtatcgatcaactttaaagccatacttaatcaatcagtgagctaaaatgttagctgttcaacaataactagtccaagacaatttccacgaacatttcagctcaaaatttcaaggtgggtgttgttcaaccttaaagccgtacttagtgaatcagtgagctaaaatattaccaggttaacgagaaaccagtcgaagacaatttccaccaaggtaattgcagggttatggtctttaacaaggtccaaggtaaaccacaaaattatttgcatgtacttgctgtataattttttcaacgtgcccccatgaaatttatacaggatttccctgtggacaaatttctaacggagaaggtattccaagggctaggaatccaattacctaaactgaacagctttcagtagcgatcaagttattgatacaactacagcccaccataaaaaggttgaagctaccaaatgcactaacctaagaaaatgaccaaagttgcatgcgaaagggagcagttgatagctaagctacatccaacacatacactcctctctgttttcgactatgtaataaaccttttcgtacataaaaatcattgtaatgaaagtatattattctttgctgagcttattaacggcatgattaattaactactgtaaacttgaaaattaattttttaaaaagaaaattatatatccgaagtttttgcacgaaaaagaaaaatgagggagtaactaagcaaactagctgaatcaaacagggcctaatataagttgaaaagttattatgatgtagagtaagtgttcccgaaccaaacaggcagcgagacacgattgcgatagtgaagtcgagggaggtggcgcagtcaggaaatggtcaagtcagcacagcagataagcgttgcgtccatgtcggacaattcgccactggacacacaggacgatgacagcgaccggtttccgtccagatccgtgcccggatcggatctgccacccgacgacgcgaggaaggaagggcacccgcgcggtggaggcaatgccacaggcgcgagacggccagcgtgtgcaaacgagagagatcgatccaacgaacagatagagatggagaaagagagaacaaggtggtggtggtggttgttgttgttaccatcgccgtccttgtcgaagaggctgaaggcctccttgaactcggcgatctggtcgtcggtgagctgatccgccatggcctcctctgcgcgcggcgggtgagtggatcaacgaagaagaagaagaagggaagcggagatgggaggaggagagacttgtgtggcgtggcgtccggtggaagtttcccacccccgatttataccgcgtcttccgtcacctccgctttaccttcgaccacctgcttttcccaaactacccctcctcattagtaatgggtataatgtttttcaaaacatagacatgaaaatagtttcattttattacaggatcatatttttattaacatttttttacactttaaaccaccccgaactcttttatccatctacacctaaattgtcatatgtcaaaaaacatataatcatgatagtttattaaggaaccgacatactcaaaatcgctctcatatgtttcagaagagagttgaaatgatctaaaatatatagtatataagaagataaaatggtccaaagtaaaatttacttacttatttggtaaagttgcattttctttagcttgtcaatgtccaaatcatcctatatttgtggtggcatgagtttgctttgagccaatccctcaattggtaggataaaaaaaaatcagtccctggattggcgggattctacctagctattccctcagtcctttcgcttaaaaatatacttcctctgtcccattttaagtgtaaccatgagttttcgcgtctaattttaaccgtccgtcttatttgaaaattttttataattagtattttttgttgttatgagatgataaaatatgaatagtactttacccgtgacttatgtttttaaattctttattttttcaaatgagacagatgatcaagttgggcacgaaaaatcatgtctgcacttaggctctgttcgtttcaggcagttcggaacccaactcccctgcacggaaaacggagcaatccattagtgtgtgattaattaagtatttgctttttttcaaaaatagattaatttgatttttaagcaactttcgtatagaaactttttgcaaaaaacgcatcgtttagcagtttgaaaaacgtgtgcgcggaaaacgaggaatagaagttggaaacctgcccaaacgaacagagccttaaaatgagacggagagagcaactatctttttatttaaaatagaggaagtactattgtacatgttccattgattctctatgtatgcacaaaagcaaattctacaggattttcacataaaaacagttttattctttcagaatttacgtaaaactcatcccaaacgtcaaagtacagcatgtgtgtgagggcatttgtgtaatcttgaatgttccgtcaaggacaagcctctgtgactttacggcatgtgggcctgtaaaacggtggaattttccgatgatggatgctttcttgacatttttaaatgagcagaatgacgtatgtaccctcgacgcggtttggacgcggagtgcattttatcagtaaagtcccccgactttccaagctttcgtgttatggccttgtgggccatatgaaacgtgttactacaacttgggcctttttcctggttggatgctcgtactgggctttgggcccatcgcctttatgtgggctcaatttaagctttctgatatcatcgtatcatgacaaactgaaaagggattggtatgccctttgattagaaatcctctttctccctacaaaatatacatattagagaaaccgaaatataacaaagggataacaaatcttggaacgcaacaagataagagatgtgagcaaacgaacacaactacaaaactgaccaaccctgacacacacacacacaaaaatgtatgaaagagtatcgatcaccatctttattcttctggtagatccttaatatggcgtcagcaaacaaattggtgactgaaaagcacatcaatgggtctgtttttgttcctaacactgatgaaatcatcacggtccacgccctcaagattaccattattattactattccaaaacaatgaatgaacagaatgcatgactaatttgttctagcattgccagctaataaagctatctgtcctctctttggatggccttgtagaggactttggtgacaaacttggactggaacctgaaggtggtgccgagggcagcgaccatgggtggggtgcccttgccgatgaagacatggccgaggacgttgtgcttgggcatggcgcactctccctccttcccgccggagcctcctcgcgagttgagcacgcccaggtggagctgcggcggcagagcgggaggctccttggtgaactccttgtcgtcaggagccaggaaaccgtagctggagtccggcgatggaggagccatcagctctgacacactgtccacgctatccgggacataatcctgcaagcatatgcacaccagttatacattcaggcaatacgcaaacactgaattttcaagaagcagagataggtgatgcattcgtagtgtgtgtttcaaatgctagcagataaatcatgatgtgtgggaatgatctgtgcaatgcccaggctttgtgctccttctttggtgctttgagttgtagtctaatcctaattacattagaattgtttctctcatatatatgtgcctccaagttagactcttgcaagacacaatgaagaacataattttattgattataacgaaacaaggggacaattggttatactagtgcaacgattatttgcatcattcaattgattcttactaggcgagaaatataattttcagatatctgagcttggtccctttcttaatcatcatcaagtacttgagtgggaatctccctagcacattttcttgggtttaaataatcatggtcaagagtaagttttgctgatcaagttcgcacaaacaatcgtacgtgcaacggggaaaaaagttgaatgaaaaaaaaatactcacatgaacatcaataagatttgaaatggtgcccataatgtcagcttcacggggacgatcaggctgaaatcttctttctccatcaacaatgaatctataacggtaaactccagatgcaagccctaacatgacgcagtgatcctttccacatttatggacgagttgcctgtgatacacactaacaatgtcagaacaaaatcagttctatccttaagcttcagtttaggtactagaaacaaaagggaaatactatatgctatctctccaaaaaataaaaatgtactttgatttccagttatcccatgatccttctatatagacattcttccctccaagagtccacacaagcagagtaggaatcagcttgtcagggggaccatcgtgatcctcctcttgttcactcgttaatatctggttaaatactggaggaggtccatctacagctctatgcaatggagttacaggactctgcagtacatttatatcagtgcattaaaaacacaaaacttagaacaatgacatttgggaagaggtagactgacttggcaagaaacaaggtaattagatcatctgaagcgaccgtaagattaaacatgttcgctagtagagcaactgagcaaagttgtatgcctgtactacctctgtttaatacatgagacgtcttatttttttcaaatatatataaaaaatcatgtctaaggaactgataaatcaagtcacaacataataaatgataattatattaattttttataagacgaatggttaaatgtatctcaaacagtcaacaacatcatatactaaaaaggaaaaaggagggagtattattctagataaatctgataaaacaacagtacattattctacaattttaattgtcaaagttgtaacgaatatatttcatattatgaactttctaaagaacatatatttcagatcatgtttttttaaaaaaaacaaattgttagcaaccaaaataaatcatagaatcagcgaggagtccccaaaatgcaacgccgatgaaattgtggcatgcacattacaagtgcgacgcgcgtcacatgcactgatcgatcaagaggatgtatattgcacatggatgggtggaattgaaatcgagatcgaattgagtttagcgtgatctgacctgcggcacgaacatgcgcggggagtgcggccgcgggggggtccccggcggggacgacgaccctccgccgccggagtaccccgctgccgacgacgggggccgcaccagtccgccgcttcccccggcgccgccgtacggcgggaggccagcacggtccatggggcgcagcgaggaggagtagtccccagcgccggcgcggttgccgcctccgccgccgtcatccatttcggcgtcggcgatgtcgtccagcctgccgctcgcgttgcccatctccggccaccggcgccgcaccaccttaccaagattatatacacacacgcggaagaggaggagaggaatgggcctaagcccattttttcacttatgggcccaaatatctgttgggccgaaaatgtggctctgcagtttgggcttgaggaagcttgttggtctttataagtcaagatttacattttaaaacttaaactgattttatgttttttaatcgtggttaatttaataatatttgtttttatcactaagaacacatataaaattttacctataaattattatctattatattattaaaggaataaaaaaaggagcttccacgttcgctctcatggtctagaaattctcacattaatcggagaaaaagaaaaagcaaagtccacatagaaatacaatttagtaatagctgaaatttggaattaaaaaaaggagcctccacgttcgctctcatggtctagaaattctcacattaatcggagaaaaagaaaaagcagagtccatatagaaatacaatttagtaatagctgaaatttggaattaaaaaataaggaatattagaagaggagactagagtccatatagaaatacaattaagaaaaaatagaaattcggaattaaaaagtaaggaatattagaagtagagtatagagtccatataggaatttaaaactaactaaaattcggaataaaaaggagcctccacgttctctcccatgacctagaaattctcacattaatcggaagaaaagaaaacgcagagtccatataaaaatacaatttagaaatagttgaaattcagaattaaaaaataaggaatattagaagagaagactagagttcatatagaaatgcaatttagaaatagttaaaattcggaattaaaaaataagaaatattagaagaggagactagagcccatatagaaatacaattaggaaataactgaaattcggaattaaaaaataaggaatattagaagaggagctagaatccatatataaataccattaggaaataatagaaattcggaattaaaaaataaggaatattagaagcagagtatagagtacatataggaatttaaaactaactaaaatttggaataaatgtaataaaattaaaagtagagtttagagtctgtataaaaatacaatttacaagtaactaaaattcaaaattaagaaaaacatgggaagaagagtttaaagtcaatataggaatacaatttagaagtaactgaaatttgaaattaaaaattaaagaatattgaaatatgagtttatatagaaatacaatttagaaatagctgaaattcggaattacaaaataaggaatattagaagaggcgactagagtccacatagaaatacaatttagggatagttgaagttcggaagtaaaaaataaggaatattagaagaggagactagagtccatatagaaatacaattaggaaattactgaaatttagaattaaaaataagaaatattagaagtagagtatagaatccatatagaaatacaattaagaaataataaaaattcggaattaaaaataacgaatattagaagtagagtatagagtccatatagaaatacaattaagaaaaaaaatagaaattcagaattaaaaaataaggaatattagaagtagagtatagagtccatataagaatttaaaactaactaaaattcagaataaacataataaaatgaaaaatagtgtttagagtccgtataaaaatacaatttacaaataactaaaattcgaaattaagaaaaacacgagaagaagagtttaaagtcaatataggaatacaatttagaagtaatagaaatttgaaattaaaaattaaagaatattgaaagataagtttagagtccacatacaagtacaattagaaataataaaaattcagaattaaaaaaagaaatattaaaagacgagtctagagtccatataggaatatatataatttacaaataactaaaatttgatattaaaaataattaataactaacacgtatataaaatacaatatgaatattacacattagtagtttcttaaagttattgcaaaatttaaaattatgttgtcattgtaatatattttaataatataatgagaaaacatatatgctattatatgagaaagaatataatgatgctagccacatgctagttttactaatataagcggtacaaataagcataagaataaatgaaaaggtggatgttggtttctcatacaaaaccagctaataaaatagagtggaaatggataatataatttgaattctaattgataatttaaaaacctctcataagtgttttttttcataaaattggttggggcttttcttcacaccggcctgaccgaaaaaataatactaatataataatttgcaaaccttcatatacaataattttacagccctgcagtttcaactagacaaaacttaattatttcactatgagtgaattcaattgatttcctagataataatataatttaacctccatatatatacattattattcatctactaattaggagtaatagtgttgtctaccagcggtgcccttgtccgccgtgatcatacgactgaaatgtttgcggcggcaacggcggagtcagcaccggcggtggtacagctgcgacgggaggcgccgccgccgtggccgacgcagcataactggcacagtatgctggaggcggcggcggcggcggcgggagatcaatggtggagtcaacgtagtgacggtcggcgatgttggagtggcggccggtgagctcctgcacgacggcgcggaactcctcggggctcgccgtcagcttcatggggctggctatgtacaccaccctcacggcgccagggcattgcggcggcttgtacttcctcgccgccgccttccccttcttcgccggcggtggcttcgagatgccgtgccgctgccggccatgctgctgcaccccgagcatgttatctagagctttttgtgagcgtggtgtgcagccgtacgtgcaatgtgcgtgcctttatagaaacagtagccctgtttcggaacgatatcctgcagtaacagacgaaacagtggtaattttctgcagtaacagacgaaacagtggaaattttgggagaattggatcagagcattttcattgggcggctggggtgagagacaggagtagatattattgtgccagttaagtttttttttatatgatgaatattctggccttttttttaaaaaaaaaagaactggcattttcttcaattaagatagaaaccacttattacaaaattttgaacgtaatgaccaaagatgatgagagagtaagttcgaacaacaaaaggagaaatcttattcaatcctatgtgtaaactttcatccaaagttaagccaatatctacattaatggacttcaaattccaacatgcagtatgtataaatcttttatccttatcacacatttgtagttaagttcagaatctgagctagtatgctatgctaccttgaaaaaatcctgcctataaaatttagttggagatttgtaccagctagctactgtagttattaattttaaccatagaaaaattcacgcatggaaggaaggaagacaagacaagagacttgttggttcgagttagagggaggtcacccagtcaagtactcttacccaaaggataggttggaattaactgagataacccattcaaagtccagattcataggatgtgtttcatctatctacaaacaagaagttatctaggtaaaaagatgaacggtaaaaccagattgctagctagctagctgtctcacggctattcgctctctccagtcagtctctagccaattggctagcaggtaaacacaagttattctcttcagtcaaaaaatgaagtcgttttcgagtatatatattatatttggattctttgaaagcaaaatcatccagcgcagcattgatcgtcagtgatgaccgtcatcgacgatggcatcgcaaccgctcgacgacgaattgaagaaggtgggtgtgctagcctgctactattttttaaagacttgagaaattcagagctagaaaatcatccattcgttttgagtttgacctgccgatcgattaattatattccttgagatcgatcgataaattgtctcattcacacggacccaaggcgctcgtacatttcaacatccgtgcgcacgcgcgtgcgactgatcaggatatatagtttttggtgatcgataaaattcccaggtagctagcatgcagatgcagatcatacttatgtgcctaatgcatgcctagactagatcaatcgatcgattgctgatcgaggacaaaagcaatcaggaatccagatgcatgcattgtcgattcataattgactaattaagcaaacgcatatccaggatcagatactagtccaattgagtgattattgaccatatagcttgagtacttttatggtacattctagaccggtatacgtactaatagctgctgtttgcagtcaagatacatatagatactagtactacagtcaatgtctatccctttcacgtagctaccgccagtaaaaggcagaacgatgagagagaatctcattgttcatatatgggctttcaattaattcctcgcaatatatattaccagtactgtacgaatactagtattaccagtgataagagaccgatgcacgattaaaggtagggtccggatcaccatatgttcggtgatgctggtttgctgaatttttttagagggagaagttcggtgatttgttcgagtaacggaaatggtggccgcattctaagcgggcctcattcttggtagggaagcaggtggaaggaggacaggaaggcccaatagtaagtaaaatgggccgtcggatgacatgtcaggcccaagttgaagtgagcccatacagcgactccggccttgttgacgaacgaacgaatgatgcggaggtgaggggatctttctcttggcttcactcgtcttccaatccttcttcctcctccctcctctcctctcctctcctgcagcagcgcccaccgccatcggagcctcgccctcgcgcggccatgcttggtctgaggggagccagggcggcgcagctcccgtacgcttccgccgccgtcgctcccacccccacgccctcgttttccggcttcgcgcgccgcctcccgctcctcgcctccgcggccctctcgcctctgccgccctccttctccttctcctccgcttccgccgtcaggagggatagggaccctcccatgcgtcccgtctccggcgccctctccaggtccaggccaaccaccaggggtgagtcctcgtgctactcatttacctctactctgctgctgtatatgtatcgtatgtccaccagatatctagctattctcgcatgtgccatccgtatcaatactaggttttgcttcattttatttcctactatactatccggttactagttagtactagtgttgtttgcatttgtgtgcttcttgcatggtgccacatggtttcatcaagtaattgacatgaacacctgtttgttagttttctgctctgcggctgctactgctcccagggagggcaaggagttgcttgtccagcatctgctcgtcggcgaacaggatgtcaggcttttggtcgatcttgaaaagaacatcattacaggaggtactagtactagtattcatgtggatgctgatatacactttcacataaacatggagactaattaaaaggatattgctcagcatctagcttttttgtgtgtgtttcaggtgcagacttgagcgatttagctgtcgagtactctttatgcccatcgaaagaaaatggtggaatgctggggtgggttcgaagaggacagatggtactccatttacatgcttttctggcatggtagtagcgacttttcatctaggactttacatattgttaattgatcaaagggctgatcaaaactacaaatgagctaatcacatgcctaaaatgtactatggaaccatccagtttctctgactatgcttggtggtgctgataaggtccatactccatacaagatgcagttggaaaccttatgcttggcagtataaatttttactttaccactaaaatttggcttgactttcgttggtcaacttacttctttatgatggttccaatttgttaggagttcccaacctcaccaattggcgaactagaaaaatgtagaattaattgttttggtattggtacttggttgcttgccttggaaactaactgctgtgaattcatgccacaagttttgtcttttcttattaagcgcattgatactgatgtatgtactttatctaattaatttcaggcctttatgacatacacacctaaatccatctgccccttattctactctatgctagctctcttctcacaaccattaaattcaagtgtgacaatcacttgctagcttgatgtgtgaagctccaccaattttgtgtgtgtttttttttccttttctcttttctgtaagcaccgtgaaggcattaacaatgtcttcaatggagtttgaacatttttacttgaactgagcaggttccagaatttgaggaagcagctttcggtgctcctttgaacaaggttgtacggtgtaagacaaaatttggatggcatttgttgcaagtgcttgctgagaggtagatacttgtaacaaaattatgttctatgtatacaaacaatatttattgatttcttttccacctaacttcagagaacaatgcgtagtggaagacattccaccagaggagcttcatgcaaaaatgcaagatcctaactttcttgaagaagctcagttgattgatgttcgggagcctgatgaagtgtaagatttacctgtgtcctgattgctagaataatactcataattacgcatcagtgaaatgatagacatgtttaaccaaaatagtactactaggacctgtccatttcttttaagagctgtccttatattgccatcctcacacagaaaatgagcttcattttgacattttgtacttttctaaactatattccagtgaataactgttacgacatcttcgttgtggttttcaaaatacacattatcaggagtaaagaaaaactgttaagatgatcaaacatgaagtatttatctccatatccatgatgttgtggttacctagttcagtacagttactgttattgttcgcctattcgcatgaagcttatgttgagttttacttcttgcatggcagagataaagcttctcttgaagggtttaaagttctacctcttcgacagtttggaacttggggaccagttatgacagatgaatttgatcctcagaaggacacttatgttctggtaagttggttactcctctaatgaaacttgctgccagtgtgcatccataaaggccaagtacctgtcaaatgaaaaagagagcaccagtacctcctacatattgtgattttgagttgatccggtgattgcggaaggaagtaatatgcacacatcattggtacacacatttgcatcaatgtgttattattattcattctaacacttgtcctttcatatttgcccccagtgccaccatggtatgcgctcaatgcaggtagctaaatggctgcaatcacaggtaattgaagtactcgcatagttcttgcaaagtgtagtcgcactctatggtggatgtgcaatgcagagcaactgagtagtggaacggcatcctcacatgaagttccattgttttgcaggggttcagaaaagtttacaatgttgcgggtgggattcacgcttatgccgttaaagccgattcttccatcccaacttactagacatctccatgatcaccaatgcaacgtcagagccttttctacgtgttcgtttttcaggccaaaccaaaagcatgcttagtatagaatgataggattttccacgatgattttgtacggaatatcggtaccagaaattcagagttaagttttgtcgttctcatgctgctgtcatgtactagcagttctcttgaaattttatatggaggatatatcacttttattagtttgaatacaagggaaatacctgggaggaacttgtgggactgatccaggctcatggcctaaatttcattctgaatttctgatcaaacatgctttgatcattttatttacaaaaaaaaagtgctttgattattgggaaacgctgaaattctatacggaggttaccattttgtcagcccgaatagaagagatacctgggaggaactcgcgggagtactgatccagtattgggtctcatgaccaaagtttcattctgaattttctgatcaaacatgctttgatcattgaaaaaaaaactttgtgattttatcagtttcattctgaatttctgacaagacatgctaacttaaaaaaaggaagtggaggtgcggggaatcgaaccccgtgcctctcgcatgcgaagcgagcgctctaccatatgagctacacccccatttgtgctattcgttgaactctcacttactaattatatgtaaatacaccatatttttgtgagatgatttgcaccatgtcgccgtcgcctcctcctcctctgtctgcgccgccggccgccggcgacggcttgctcaccaggcgttcctcctttggtgtcccggcgttttcccttgagttgaagtgggcaagtcaaagacggagattagcaagaggaggaggagttggtgagcggaggctaagcggcgggccccaccagcgccgcctgcctatccacaaagttgcgtcacgcgacgagccaactgttgctgggcccacctgtcatcctcaccccaccccatgcaccgagtccaccccgccctccccccactttggcgccttccctctctccacctcctccactctcccaccaccacgagaccttctcgaagcttcctcccccccaaaccccttccgctcctcctcctcctcccaaatccaccacggcgacgccgccgccgcagagcccctagctcccggaggtccctcgcccccgccagctccgacggcctcacggaaggaggagtaacgtgggcgttgattggatttttttgttttccccccaccttgagtgagtctgtgccgtttccccggcggcgagggagggcagagggctgatcatggtcgtgcgccgccggtgccttgccgagatttcccccaaccgccaccgacgatcgttcactgtatgcatgctctcgctccccttcgtttttgagttggtttcgattatcaagtagtatgtatcaggccgggtattagtattaccaccaaattctcttatgctagtgtgcgcccgctattgctctagtatttacaagctgttatttttactccttagtactacttgttttggtcaaaattcaaaacgtctactgtacctgttgtattggaaattttaaatggttcatgaatgaattcactacccaagaacaaagcttgtccagtaatgacattatctattggctcgatttatgtttggtccagtggcacaaaggggagtagcactgtccaagctgttgtggtccgtcagggagattggccaacctgtggggtttcagatcgacataagtacgtcagtgtgcgtattcttgtccccacgtgcttatcatttaaattcttctactattatgttttctactatgtacgattgctgtaactcctgaggagttactgtctttgattagaaagaatttggcgcaagcatgtactgtacgatatccttagctgtttgaggtttcagtatgtaagctactaagtcgtcaaagatttcccttcttttttttaaaaaaaaaatgatctgtagatttcagccatcgatcaatctggcggttcatagggctgtgcttgcaacctttctggcagaaaggagagagcaaagtgatttgctgtctcctgttgattgtggcctgttgaggcccagtaatggcagatgctagttcaaggactgacacatcgattgttgtagacaacgacgacaaaaaccaccaggtaatcctttttgaggttgtcatctttcctttacacgttaagatgccatcaaattgactgctagagctcaagaatagagctggtgctgttagggtagtaacttcttttctcgttttctacttgctatgagttggataattgagagatactcaaccaatagtcttctggagaatggagataccactgactatgacagtagtaagaagaatcaaatgtaattgaccgtttaaaccttgcaattcttgtgctgtttcatctactgacactgaagcactcatacttttaatctattttatttactgattcgcaatgtcatgttttgctgtagcaccctgataacatattgatactatgaatccactgccaaatagtgctctaaatatgctcagttgctcaaacttgcagttagaaaacggacatagtggtgcagtcatggcttctaactcttcagatagatctgacagatctgacaaacttatggaccaaaaggtgacattttagttccgtttcttttcgtatacaatgtcacttaatcttgtgtgattaatttcatattgtattttggcatgcaatagacaattcggcggcttgctcaaaatcgtgaggcagcaagaaaaagtcggctgaggaaaaaggtactactgcagatttgctcttatgttcgcttttgctctgaataaaaaagccttgtttggaaaagcataggattaattctgtgaacttacctgtgcaaactaggtctatctaatttgaattgtcgcagttgttatctcttttatatgggatggcaagggcttaagtcaaatatgaatcaagtttaattgtttaattgcagtttttagtgatagttagttttgatccaccatgacatgtattttctctttgaacatttaaggcatatgtgcaacaactagagagcagtaagctgaagcttgcacagctagagcaggaacttcagaaagctcgtcagcaggtaaaatctttatggttgcatgctggatcatcaaaaaatagttttgaaaaatactaccttctgtcctcagagaattcttggatattcaattgcagggaatcttcatctctagctctggagaccagacccatgccatgagtggaaatggtaatttgtcatattttcatcgcttggtacccattaacattttgtgtcttgtgtacttacattgttttatctttttaacagtttatattaactgtttgctgcatgctttctaaaacattaagcttgtgttttgcaggggcattgacttttgacttagaatacactagatggctcgaggagcaaaataagcagataaatgagttgaggacagcagtgaatgctcatgcaagtgacagtgaccttcgtcttattgttgatggcataatggcgcattatgacgaggtattcaaggttaagggtgtagctgcaaaggccgatgtgtttcatatactttcaggcatgtggaagacacccgcagaaagatgcttcctgtggcttggtggtttccgtccatctgagcttctaaaggtgaccgcagattaaatctcaatattttcttatttgtctgatgcccctttctggtcctgtaatttatactgatttcaccatatggtacaaaatttcagctcctagcaaatcacctcgaacctttaaccgagcagcagttgctgggattaaacaacctccaggaatcttctcagcaggcggaggatgcactttcacaaggtatggaagcactgcagcaatctctggcagatactttggctggatctctcggttcatcagggtcttctgggaatgtggcgaactacatgggtcagatggcaatggccatgggtaaactaggaacgctcgagaatttcctttgccaggcaagtatcttcaccttctaagtgtcatcgttcttctgcctgacaacatggatttattaactggtgattcgtgtcagatgtcgcctttgcagtgattaaagcttagattttgactattcttttggtttcatttttgtcaggcggacaacctgcgacagcagacattgcatcaaatgcaacgaattctgacgatccggcaagcctcgcgtgctcttcttgccatacacgattacttttcacgcttgcgtgctttgagttcgctgtggcttgctaggccacgggagtaacaaaatggtcatgtgtgcctgtgacgaggttagacgctcattttgatggactgcagataattgggtttttccctgtacaattgtgtttggcagctgtggactaaagttaaaaactgtacctaaagtggtgtatgcaaataggtgaagcctctaagtaagttataacgattgcattattgtgttagcaataaaagttgggtaattcaggatgtgtcctgagttgttttgttgtagtagaagaactgcatgtagtggctggaaatgcagtgttgaatgtaactaaagctctgctgctcacgttgcataatgttgtgtagtaatagttagctagtgatgcccattttacctgcactcctctgggaagctgaaactgcaacctgaagcaaccacggtgcagaagaccgcatgcatggtaaatgattaaaaggatatatatgggctcaacatcgctgccaaatcctgagataatgaacaggcatgctaaactgctacttccacatgaaacctcccagttgacatgaagaatgagctgttcagttttatggtttctgtgttgcactgtacataattcctgtacgggtctgaatttatcctgaaatcatgctaaactgcagaagcatatgaaatctccagaccggttgacatgaaagatgaagtgtcccagtttttacggttcccgcgttgcgttgcacatgttttccgtatgtttaacgggtccgagtttatcctgttatagtattgacaattactgtaccattcacaggtgattgcgacctaagaagtcatgacatgtaacagtaacgaaacaagaagaagactggggattcgtgtgacaattttagaaaaccgtcggcagacaaggccgtctgccccttgtactctagaaaaaaattgactaattaatggccggttagccaaaatggccgggtctccctttcctgatgtgagtactgaagttaacggcaagacgatggcagcctgcagcgcgcggcggtcgctgtcccaggtgactcaatgcacacatatatactacgtatatgactcatttctacgtgctcatccaagctgagctgagccgtagtcaagctaggcaggaaacacattacacatagatggatggatagacggtggatggagtgctccttccattccaaaataaatataagtatttttagcgcagtgataagtcaaatattttcaactttaactattaataaaaaaataaaaaaatcaatcacgtaaaattgatgtcactagatttattattaaataaactatcataatatataactcttttatttaaaatatcttacttttatatagattttgttggtcaaaatagtatatcagaaactatgttagagtctaattttatgactgagggagtacctgatttgtcgtcgcccgagcggtgagggcgatggtgaggcgacgaatgaaggtacgtgccatggttaggagggagcaagacagtgttgacatgcatgcatcgcctactctcaaactctgttttgatttgatctgtttccttatggttttcgttcagcgcccttcgaattgcctcacgaattaatcctcaggcagccaggcgatgcttactttgaacctggcactatgacaagggggctactacttgctccctccgttttatattgtgcatcatatatttttttttaaaaaaagcaaactactctgtgcttcatttaatgtaagtatgtgatgaaaaaacataaaaagagacatactgacttgaactccctctacaacacttacattaaatgttcgcatgcaacatagatacaaattacaataagattacatgtgtcaaacaaaaggaccaaggccatagttcacgtgccaaaatttttctaagtatacggacacgtatttgaagtaacaaaacaaattacatattaataacaaaacaaattacagattccgcatgtaagctacgagacgaatttattaagcctaattaatccatcattagcaaatgtttactgtagcatcacattgtcaaatcatagcgtaattaggcttaaaagattcgtcacgcaacttacatgcaaactgtgccattggtttttttcgtcaacatttaatgttccatgcatgtgtccaaatatttgatgtgacggaatttttagaagttcgaaggaacctaaacactgcccaaggtaatattaataataactttagaaatttctatttttggataatgtgatgatcaatatataacggagagactactttactaaccgtactatttgttacttatcggatgatgcagtttgaattggttaagtggatcaccggtgcaattcaagcagcaaaagaaagaaaaaagaaacgggtggataattaaggtaggtagtacgtggacgtggttgaagatgaagggcgttggccacgtaccccgacaggtgtgcaaattcgattgcgactcaggagacaggagagtgcatgtgtcacccgtccatcgtcatttgcgcgcccaatttccaaaataagtgcagtcgtaaatatccgtacccaacgtttgactatccgtcttatttaaaaattttatgaaaaatttaaaaatatttagtcacacataaagtattattcatattttatcatctaagagtaataaaaatactaatcataaaaaaatttcaaataagacgaacggtcaaatattgaacgtgaacagtgtaaatgtgtacttattttaggacggagggagtagtctcaagttttgtttcggataaggtagcgtactcgatccatgatccgtcagccagtaattgaattgaattgtcctaagcgtgggcggtgcaccgaccaaaccaccccctctcctgtgcatgtgctgctgatgctgatcgatcgtctctggaacccattcttggcattcatgtcaattaacggcttgatgatgatcgctttccaaaccaaacgacatgtacatgacaacatccgaaattaccgcttcattctggatcaagacgtatctgatttccttcccttttttatactcttatcttctctttcatttttcataatatctcttgtttagatttttcttatatcatacctttcattctttaattttcacatcttaaaagaaaagatatagtctacaacacaggcctaggtacgtagttacatgttcagatcaggacgctaagttatcaaaatattgattgtcttcctccctccgttccaaaataagtgcagttttgcactatttacgttcaacgtttgactgttcgttttatttgaaatttttttatgattagtatttttattgctattagatgataaaacatgaatagtactttatgtgtgactaaatattttcaaatttttcacaattttttaaataagacggacggtcaaacgttgggcacagatattcacggctgcacttattttgagttggaggtagtacaattttataacttgacaatcttatttaagatttttgattctacaattctatatgtacttagagcttgaaacttttagttcagaatcgtgattttaacaacactgagaaagacattgacaatatcatagaagctagtacaaaggtatatagaagaaaaacctttattaactacaaaatgtatcagcagtaacgtacatgtatagtaggcagatctgtttatagttagaccaaccatatacgtacgtatttacaaactgaatacagactttgggtgttccctcgtactaaacaaaagaaaaaaaaacacactcaaaagtaagaccatgaccgatatatctgcaatactaaaatgtttatgcagatcatgtcccctaattaatcatagctagcactccttaataagcgccaattattattgtagctatcaagacttgacggcggccactgccggcgacgagcgcgcctacgcggcggagggcgccgggaagtacttgacggcgccggcctcggcgagcgccgtccgcatcggctggctggcctcgtcggcgttgtcctcctcctccttgtagtcgaggctctcgtcgttgtagatgtcccaccacctcttcaccagcatctttatatcttctctgttcatgttctcctccttcccggtgaacctccatggcttcgaaccctgcaatcaaatcatgccatccatcgctcgatcagataatcgatcattcaccgatcgattcatcgaattatcgagatgatcgatcatgtaatgcttaccgctgcacagtaatggacgaccttgacctggtcgaggtcgacgttctccgggtgcctccagagcatggcgagaacgaggttgtagacgttggggatgggcttgtactgttcgcggaagaacatgttgaggaagtcctgctcggcgaacggggtgggcggcgtgacgacgagcgcgtcgagcaggtccttggcggtgccgaggccgggctcgtggacgaacatgccggcgttgaagtagagcggcggcggggggccgagctcgcgctccggccacgccacctcgtcggggcgctgctggcagtagccgatgtcgtactgcggcgtgtggctccacgtcttctcgcagaagcagtccttgacggcgtagaaggcgcccttgtcgaggtcgaacaggtggtcgatgttgtcgaacacctgtatgtcggcgtcgaggtagaccatccgctcgtactccacgaactcccagatgcggagcttcgagtagttgatcacgtagtaggccatggcgaactgcgtctggctctccggcgggtacaccggctgaatctcccggaccacgcacccctgctcgaccagcttccgccggtgctcgccggggacgtccgggagcacggcgaccaccagcgggtacgccgagcggacgcggcggagccccttggcgagccccacgacgcccttccagtagtcgccgtcgccggccaggaacgtcacgtacgccctcctcttcgccgccgccaacgccttcttctccgacgacacgttcggccccatcatcgatcgatcaacaaacaagctttgcaaatgatctagctagatcgaaatttgcaagagaaatgttaatttgcttcaatggattggtgtgctgcaagattttgatgaggagttcgtagcgggaggaggagtttaaatagggagcctggtcgcctctacccgtggcggttttgcggttgaggacggttatctcgggggatctgggacgtacacgtgtccggcacgggagatcgaacggctgcggtggaaaggacgggcctcggcaggttggcgcgatatttctttctggatttatgaagtggggtccactgattaagtaaggctgggtgcgatgaatattcggcgtcatggtatggccggtgattacgtgagcaaaatcgaaatggataaagtgagtaaaaaaaggaagaaattattactgacctggttggtaaatgtaaattaaaggtaagaaagttaaggcggttggaatgtggtagatagctctctcgatcgaatattcgatcggatggtgtttttttttactgcctttatccgttgcagtttggaatgcaatggggatccttccatatttattgatttttctttccttttatttctggccagccttcaaaatttaggctgttgattttaatcggggcgggtttactgggatttgatcggaggctaccttcaattcctttttttttatctcctacattcaattccttcaattcctactgccttaactgaatgaaaggaaatgaattatcgaaaagaaaagaaaaagtaacggaaggagctagaagctggaatgaggagcactcagactatatggtatgaactttgggtatgttcagtaaatgggggtagaaaaataatatcacatcttttaaaaataatattaattgcatcatagttatttatttttcacacctcgtttaattctagtcattcattcatcgtcccttttcattcttatacatctcatattacctcgtttgccaaacacaccatttgtggtttagaaaatctggtgtccatttattcggaaatcaaaaaatggtctaagagacgacgattacgccatttgcataatatattataataattcggatgggataataaaagggaacacgtagtatattaaaaaaaaaagggcttgcatgtgtcgctggagtaaagaaccaacctgaggaaacaatattccgatggttcgctttatatatccgtgaagggaggcacgtggtgaaatgggaggggattgcatggaaagaatatgcaaatctcatcttcatttttttttggttggggataaacgtgcatggccggtatctgcagaagcctctcctccagtcttttaatttgtttctagagtattttggcaatctggctactagctagagagtaaaaattaagaaaaagaaaagaatctggaactgctgctggttgtagatgggcatatcaagggcagacacatgtacgtacgcgtgggtgcagaattaagaaacgattgatccattctgttgcaacaacacacgtagtagatcagctggtatacctagcttacccttgttgggtcaaattaaaggtctcaaggatgacatatgttgcgatctggtcggtgtgtgtgtgtcattcatattcggtcctgctatgctagctgcttctgcttcttcttctccttctccgctatatgcgcgtgactcgtcggcatggccgcgtgcgcgctgtcctgtacaatatctactgtccgtaataaatataaataatatgagcctatttagatcgtagctataataaatcttatcaagtttcggtaatattgttaaaattttggcaggatttcttacgtattgaccaaatttagcaacaaactaaatgtaaacattttttttaactttgtaaaaaaatggtatggttgaaatggtatcaaagtgaacatgccctatataatatagctagataatataagtttatataagttaacatggtttacgataatttaaaccgtatacataatgatgatccaaatgtaaaagtaaggtgatgtggctttacgagagaagaaaaaaaggaaggtaatttcgatcgtagcttaattaatcatctaagggttaaaaataattaagatgatatagcttaggggcatccacaatgtagtgcaaaagtagtccataagcaatacaatattttattcagccacctagcaatattgtggaactagtccacagaaaagaataaataataaatgctacccataagtatatgggatggccatagagaataaaatatgttatttgtctctactttctctctctcctaatattatttgctatatatatacattgtgaaggttacaatagttaaagctcatatatatatatatatatatatatatatatatatatatatatatatatatatatatatatatatatatatgggtcccatctatatggactagtttttctatatacattagtgttgccctgatgagagtataaaataagaaaaaaaattggactatagattaatcatataagggcttaaaaaaattgatacgttatggcttaatgagagaagaagaaaatagcattaactaagtgatgatgaactctgtaggtatatagagtcctatgaaaaatagtgaagaaatatattcaaatattatatgaattatgtgggatgatgattttatagaattatagataatacaacatacttgtatgatattttagaatggtgcaaagaaataacaaatcctatcatatcttataacccactaaattctaaagttcaacatgcaagtccttgcatgttaaactttagattgcatgttgaactttagaatttagtgggttataagatatccttgcatgttgaactttaggatttagtgggttataagatatgacaggatttgtccttacaaggtttggttcacttcaacaccgatccacatactatacacattttggctgtatatatccacacctgaacacattggcttctgggcatctcagtgggggtggctctgagcatgcgggataggagcttgactagcatgacgaggcagaatccccaaccctcacgcgcacaagtgaaggcgacattatagttgcagttgggacccagccgccacacgtgcacaggtccatgacgcgatcactcccggccgttgggagccactcacccgggggccttcgtcgctgagcttgtccccgatggctgccacccttctcccctactcattgtcggctgacctggaggttgcgttgagatgggaaggaggtggaagaagattgccagttgatatgcggggtctacatgggtcccacactgactcaaccgtcaagtcaccaaaactggagagcgatactgtcttataaccaaatgtgacatggttttacaagattctggtattccggttcaaggacgggtttaacactcgatgacaagataaaggactgcaggtgaactttttccgagatgaaaaatttccagcctcatgggcctgtgcatatgacccataggccataggcaggccgcaggcggcagcagagcgacttccccaatccatcatcccgtctccgtcctcgcccgccgccgccgccgccgccgatctccatcctgcgaggtggcgccggcttccgccgcatcatcgctcaccgttgagcatcctaatccatcccatccgccctcctcgcccgccgcttccgccgatccccatcctagccatcaccatcacgcacgccacgccatccgcctccatccctcgccgccgccgtgcaccaccgccgtcatccgcctcttcctcttcttcttgctccacaagtaatctcatctccctcgatctcctcttctctccatttctctccgtgtagagaaaggaggtggagacaggggttggggaacaccgccgcgtagataaggcccttcttccattcggtatgcctatcatttttcgattttgcgcaacacgtgatcaattgttctgattatatttcaaataattaatcaaattatccagctccgtaataattagggttccccactttcttcatttttttgtacactgataattgcttcaggtcaaaattgatacaacaaggcaaacacgcactatctttgcaatacattaattttaatactacacaaggcaaacggcaaacttctttattttagtaatcgtactacatttcagtgttgttctttcgatgttcttgaaaatcaccacaaatttagttttcttgaatgccagtttttagtaccgcaatccaaattcagactttcaatatcaatcatttggcaattaaaaaaaaatcacatatagatacaaagagattcattttactttgaacgctcccatatcatgatatggagctaatctgctagtcaaacacttctaaaagggattatgactgattaaggggaaatcaagattcagagccttaccaaattgtttggtgaatttgttagtgtagactatgacttcagtaatgtgcaagagtagcattaaagtagaaaagtacaacgtagagttctaacacctgtttagaccgtgctcaaatcctttcctcgttattgtggcatggtgcttatattataactgattcaatattctgaataaacctattccaggttctatcacagagatgatggctgtgacaaatggagtaatccatgcatcttctagggaacccttattttccttcggtgtcattgctgatgtccagtacgctgatattccagatggtcgctcattccttggtgtcccacgctactaccgtcatagcatcagcgtcctccaaagggctgtcagcacatggaacaaacaacacaacatcaagttttcaatcaactttggtgacatcattgatggatattgcccaaaggacaaatcgttgtgggcagtgcagaaggtccttgatgagtttgagaaatttgatggcccaacttaccacatgtttgggaaccattgcctctataaccttcctcgtggcaagctagtatcgttgctgaagatgccaaccgattctgatcgtgcatactatgacttctctccatgtcccgagtacagatttgttgtcctggacgcttatgacttcagtgcacttggctggccccgtgaccatccagtgactgccgaagcaatgaagttcctggaagaaaagaacccaaactctgacaagaacagccctgacggtctggttggcgttgaccggcggtttgtgatgtttaatggtggagttggtaaagagcagttgtcatggctcaatgatgtcctccaggatgcatcagcacgccggcaaaatgtcatcctatgcagtcatctcccaatggatcctggctcagcttcttttgcagctctcatgtggaactacgatgaggtgatggctattgttcgccagtacaaatgtgttaaggcatgctttgccgggcacgaccacaagggaggtcactctgtggactcgcatggcgtacatcaccggactcttgaggctgcattggagtgtcctcctggtactagtgcattcgggcacatcgaagtgtatccagacaagttgttgcttgtgggttctgataaaatggctgatactgagatgtgttttgagccctagagtgaactgtgtagcggagggaaattcatccaacttcattgttttgattaatattcagaaacatgtgacttcattatactcattttctggcagcataattacatgtatgtaatagcatggaaactggaggtggcagcagctgctatgcttgccgcttaatctcccctcctctctcccaagaggaaagaggcagcaagatgaaaagcaaccgaaaggtaaataaagtaggataactttttccatgataatatcacaaattagaacatgcttgtttcttgaatattggacaaatatcagaaaatagagtgtggtaattttagaaatgaatcaatccaacgattgcttcttgcctgttccctttgtttcacaaccacctatgggtattcaatatgctaatatttatctggcattgtttatgtgccatatatctcactgtaactgcaagatgcagagaatactatcttcctggggtggtaccttagcttttgcccagtaattttcaccgttaaccatattttcctgaccctgtttggatttgtaatgttttcaattttcctttaagagaattgaaatggttcctgtagatagtcttttctgtctctctacttgtgtgaactctgaaccaacattggtcaaacttatgcagccaatttgacgatcaagtgaaaagcttatcatgtctaatatgcatatttacacattgatgactacatcgccaaccaactgaactactatcaagtatcatctggcacttaagatacaatattgttcacatccttcgatgccatttgatcaagtgatcattatctacaaaagaattaattgatcatctgtccaattctgaattactgattttcttctccaggggtgagaagaccttctgcagtcacgaatgctgctaccaagagatgttcctttttgtaacttgtcaattcaattagccaggataat

SEQ ID NO: 63391 - DNA, 5199 bp, Oryza sativa
agatccgcgttgacgacggcgggccgtggccttgcggcggtggcgcggacgacggcgggccgcggcggacgacggcgcggcgcggacgtgcagcgccggcggatgatggctaggcggcggccatgatttcttgaatgtttttatttgctttcttctagaattgattcggtgattttggatgaaccgtggatgaattgattcggtgatttttggatgaactggatgaattgattggattggatggggaatgggtgggaactggattgggaacgggaagctaccgtcggaaacggcggtggctgcccattttttttagctctcgaagctattttcgcaggcagacctgttgcgcgcctgtgaaaatcaactattttcgcaggcgttgaggtgcaggcggatggcttgtccgcctgcgaaaatatgattcggccgactgggaaaagaatttttctagcagtgtctctccctctacaaataatgatctgtaagtctgtagtgcctcagtcaacttagaaactctagcttttccattctttaatatttaactagttttgattgtacaaacaacagttttaggtacactttcatatattctctgacttgccttgttaatttaattatacacggaactagaataagaataaccgaccatgcatgcatatatatatatatgcacaaaaaagttttccatgcgtccaaaaatgaacatatatccaaactgaattattacctatatatatatgtatgggctttcagctttctcgtgcatatatgtgctagctaggcatatgtatgcatgtgtttttcatggcacatgcgtgcgtcgcaaacaagcaaactaataacccgcagtttacacatgtaatgtaattaaaaaaaatatacacagcgcatatgcgtgcgtcgcaaacaagcaaactattaagctgcagtttatccacgtgtaactaaaagaaaaaaaaatcaaagcatgggatcgaatcacaccgtactagaaatatcagacatgaaaatatgcacgcagttcatgctagttctcaaccgatatatttataggggtaaacgaaatttgatgaaatatatttattttgaatgacttaagtattgtggatactgataagcattttcatatctttgatttagaaattttagattatatagatttgtgaatttcgttatagtatcttgccagatactaataatagggcatcatatttttgtacaccacactagtcacatcgtattttatatcaactcctgaattgggcaggatatttaaaattgttaactatattagggtatatcacctttataggatatgattagatgctttttggctatagctagaaaattgccttattctattcgtcgtatttagagcaccatatatcacgtaatttaaacggcaacatatcctatgcacacaggccctcacgtgtacacacgtgcacaccaactaaaaaatatcacaaaaaaatctagaaaaaatcatacacatactttcaattgtattacacctagggttaaaatcttaacatcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgcgagggcctgtgtgtataggatacgctcccaacttaaacagctataaacttgggctccttgcctttagaacatatggattttaaataaattagatttgttcccataaaatttctgcaaattcatctattccaaagaggccttagggtgtattctacactcctattcccaagtcccaactctactccctcattttccatgcgcacgctttctgaaccgttaagggctcgttcggttcacaagatttttaaaacgtagaaataggaaaaacgtaggaatactataggaaatacatgtgtaaacctatggattgaaaaacacaagaatttttcctatgttgttgagcaagccaaccaaagaaatgcaaacattagattggagtggattattttttcctatgcttttccttcaaaaatgaaggaatagaaaactttcctatagttttcctatgttgcattcatatgaaatgaatggtagtttaaaacctatttctattcctatgtttttcctttgcaattcctttgaaacgaataagccctaaacggtatgtatttttttcaaaaaatttctataggaaatttgatttaaaatatcatatttatccattttccaagtttttagctaatatttaattaatcatgccctaatacattgttccattttgtatgccggggaaagagttcccaaccctcagcgcccaacagagcccaatgtttctctgtctccattgttgatttatgaaaggcatgatagtatcactacttagtgtatattgtgttgttaatatttatatacaatatgtttgctcgcatttataagataatggacataggaaaaacactttcaaatataaatacagtgatagtactttggttaaacagaacagatatacctttggaatagagaaatatatacacgtactaactagtcgactgtctgtcaggggtggacacacccactgggtagggtgggtcaactagcccagctacaaagggccggagctagaacgaaatagaggagggtatcacttgtttaatttactctactttaaattgagtttaaactgatgtaggtgtcaatgtttatattaaagagggtgcatacatggtgaaaatagatgagatatagctaaagtagggatacaaatatttatggaaattcatgaccaaataaatgagcattatttctatacaagtggtaccatttttgtcgttctgattttggccaaacataaaatttgatttttttttctctttctttagaactatattacagtctactaaatagttaatttggtaaatatatatataaaagtttattttactccccaaaactattttggcggagcacttaaccccctaaatactttttttggggggtttatttcacactcccaaactattcaaggtggatcaccttactctgtaacaatatttcttaatttctttaatctctctatgcaaatcgtatttgcactgaaattatgtaggattggtatatccattataacctacctcttgaaatcttattaagaaatttttatcactgtttacataggttggaagaactaattgtgaaaatattttgaaactttgataatggtgttatttatgagaaatgttgttaagcagtaaagtgaaccattattaatagtttaagggtaaaatgagaaaaaaaatacttaaggagttaaatgatccaatgaaatagtctgaaatagtcttggggagtaaaatagacttttcaaaatatgaatgttttgtaaatcatttctaaattaataatttttgggttcgaccattttcatccctaattctcaatatgaggcttccattgccatctcatcttcatgactacgctcattgcctcacctatctgacgcagacgtttgttcgactgttaatctttgttaacttgcttgatgttcgtgagatgcgcctccgtgccagtgccataagctggcgattatggcttgtgtgcgatgtgccatcatccaattagggctagcgccttgctagatatcgccccatctatatattttaaagctgtgtctgccactgctgcctgtagaatataaatattcaatgaatcaacagtaatcatctcttcgagagggatctcgttcttctttctatataggcttaatatttcgagagagctgttctaaaatttttattcatagcttgtagtataacttaactattctttgcagatataattaataaatttaaactgtgggggacttccaagcagtattttggtaaaaaaaaatcagcagtaataataactgccagttcacttgtgtgctaagtttacttatacaccggtagtgacgtagggtttatagattcttggttctaaagtaatgcaaacgtaatttgaacaacttatattgactttgaaaagttggaaacatgtctttgacagaaggtagtaacattataatctatttttatctccctccaatcctcaagaggacaaaaatccttgtcaattattagggattggcagcatatattgtccaccaaacccatctaggttgccaagtctcccagcgacagagatgtcgtaaaacacatgtggtatagtataatatttgatgctcctgggacaatgagccccgcaaattataccggtgactttatgtgattcccatgcatgactccctatcctttaatttgcacactttgttagaaagggccttgagagatggatgtgaagctgtaatgcaaaaaaaggcgaagaggatcgatggatgtggaggtgctggtgtactgtcagaatgttgtaatgcaaaagaaaagccatatatgtacaaaaatgagtatgcaaggaaggttttatgtgggggttgtatattctctttactcacaatcatgcagccaaggtccatggccaaggccagcccagccatccatccatccattgtggtttagatgccccttccatcttgcaatgtccacacaatccgctggctagtgtacatgtaagatacacgcatgcacacatttgaacgtgcttcatcggtcgatatctaagtttgtgttactatggattcatatcctttgccactataatcagataaaaatatcataatagtctataacaaaacctccggttaactaaaattgtactatatatatcatccaccctcattgattaatcgtaaggtgcagatataattgtgcggacttgtgaatttttcctacatagacagagcacacggtagctagataaccgtcaacatcatcaaatgccagtggaacaatgcacatgcttgctctactatagcaagccagagagctcggatagatggctgtctagggtcgccgggttctcaatccaccactgatgatattatatatatgctaatataatatgaatgtaaggttctctatataagtccggagaacttgggccgttgagttgtcgatcacatgacggt

SEQ ID NO: 63392 - DNA, 636 bp, Oryza sativa
tgccagtggcggcccggcgcacctcccagcctcccctcccgttgcatcagccgtgacgcactacccgactcccgtggaactcatacccgcatgatgagcctatatcaatgccacattaattgccagtttgccacggtgcgctgaattactagattcgcacgagcaacagttagctagctatagccggcgccatcatgccctcgtcgacggccgtcgtcccggcagcggcggaggcgagcagccgcatcatcctggtgcacggcacgggccacggcgggtggtgctggtacagggtcgccacgctgctgcgcgccgcgggccaccgcgtccacgcgcccgacctcgccgcgtcgggcgccgacgcgcgccggctgcgcgacgacgacgcgcccacgttcgacgactactcgcgcccgctgctcgacgccgtccgcgcgctcccggacggcgagcgcgccgtgctcgtgggccacagcttcggcggcatgagcgtcgcgctcgccgcggacacgctcccggacaaggtcgccgccgccgtgttcgtcgccgcgctcatgccagactgcgccagcccgcgccccgacgtcatcgagaaggtaaaacacacatccaagaacactcctcctctgttctcac

SEQ ID NO: 63393 - DNA, 3951 bp, Oryza sativa
gggcgatataaccatatcggccattgtacatcggcaaaccacagccgattacaatacgaaaaacagctaagggcaatataaccatatcagccatctcaaggcgatgtaaacacatcggctatcatatatcaacaacatcagccgatcatgcattaacccaaacacttgggtaatatttcttcaaatacttgccatttagcgctcgtccataaacctctccatcgagtccttgcaacatgtaagctcctttagacaccactttatgaatttggaatggtccttcccaattcggcgaccacatgccgaatttgctatcccgagtcccaatcggcaaaatcaacttccatacaagttcaccttcggaaaaatctttaggtactaccttcttgttgtaatgccgagcaacccgttctttatccttggtaacctttgcgagggctcttaatctagactaaaccaagtcctccctttcatcggccataaggttacaatactcatcagctgttaaattatcttgcagctcagttctgcttgagccgattctaacctcgcatggcaaaacagcttcatgtccataaacaagcttataaggagggacttggatcgatccatgacaagccatccgataagaccacaacgcttcagccaaccgagtatgccgttgccgaggataatcagaaatctttcttttaatcagtttgttcaaactcttgttagatgcctcagcttgcccattagcttgtgcataatatggcgaagaattcaacaatttgacacccatgctgtcggcaaactgaacaaactcatcggatacaaaaattgaaccctgatcggttgtaatggtttgagggataccaaatcgatagattatatgttcttgaataaaatgtatcgcatccccagaatcaaccttcttcaagggaatcgcctctacccatttggtgaaataatcggtcgccaccaatataaacttatctcctttactcgatggaggattaatcattccgatcatatcaataccccatggtttaatgataggattcatagccgacgccggtgcttgctgaattgctccaaatttctagcagtcttgacaccctttgtaatatctgaaataatcttccagcattgtcggccaaaaataccctgaacgccaaagtaaccacttcatcttatgaggcgattgatgagtaccataaatcccttcatgaacttcgccgattgcaaccttagcctgatcggcactcaaacacttaagcaacaccccatcaatcgtccgataatagagctcatcatccaataaagtatacttcaacgccttatatcttaatttccgagaagccgattgagatggattctgtaaatattgatgcacatcagacctccaattatcggctgttattgctgcgacctcgaccttaacatctttgatcatcggcttataccccgatgccccctaggccaaatcattagcttcaatattttgttctcgagatacatgcttcaaagataaccaaccgaaattccttcatcaattcttggcacttctcattataaaccattaatgtatcattcttgcactcatattctcctgccaattgacttattgctagcaaagaatcccccatgatttcaatagcatcggcttcaacctccttgagtaactgtaaccctttgagcactgcttcatactcagcttgattattggttgcatacggtttgatagtataagcaaactcaaaattcgcaggggaaataataaccaagccgatgccacaaccatgagtgcacacttacccatcaaagaataaagtccacggtacgatctcaaccgagccgattgaatcatcacgatgctctacaataaaatcggctatagcttgtcctttaatcgcccgactcataccgaagatcaaactcagttaaagaaaatatccactttccaacccttcttttcaaaatcggggccgatagcatgtatttgacaacatcggccttgcatatgacagtgcattcattagactatagataatgccttaaccttgtacatgaaaaatataagcacaagcataacttctccacaggggaatacctagtttctgcatccaagagccgacgacttagataaaacacaactctctctttcccttcaagctcctgaatcaaaaccgagccgattgacttctcaccggccgacagatataaccgaaaaggtacccccttctggggaggaatcaaaactggaggagagctaagatattccttaatatcgtccaacgctttttgttgctctaccccccaagtaaactgttgatcggcattcaatctcaacaatggtgtaaaaggctctaatcttccagacaaattagaaataaaccttctaacaaaatttatcttgccgatcatctcctgtagttctatcttgttcttcggaggctgaatcttcttgattgcattaacactcctttgagttacctcgattcccctatcgtgaacaagaaatcccaaaaactggccagccgatatgccgaaagcacactttgtcgggttcatctttaggccatatttcctggttctctcaaaaaccttccttaaatcggctatgtggtcttctacctctttagactttacaaccacatcatcaatgtagacctgaactaaccagccgatcagatcgtgatatatataattcatggctctttgatatgtagcccaagcactcttcaagccgaaagtcatcacaacccactcaaacgagccgattgcaccaggacgcctaaaagttgtcttatggatatcttcttcagccataaaggtctgattgtatcccgcattaccatccataaaactcaaaattttgtgtcccgaggcagcatcaactagctcataggctactggcattggatattcgtctgtcggggtagccttattcaggtttcggaaatcaatacataccctgatcttgccgtttttcttgataacatgaactatactagaaacccactcagcatatcggcaaggacgaataaaacaagcatcatataatcgttaaatttcagcctttacgggatcaagcatatcagctttgcatcttctcggaggttgttgatgtggtctaacccctggtttgataagtagccgatattcaacaatcaatcggctgaggccaggcatctcataatactcccaagtgaagcaatctctgaattctttgaatagctctatcaacatggttctaaactctggagataaattcttactaataaatgtcggccgtcgtcgatcacctggactgtcgcgaccgggaaaattgccttttcccgaacgctagtgtattaatccccgtcccaggaaaagccggggtacaccatacaaacatgatataaaagacacatctttattacatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaaggggggagaaagatagagcaagaatgagtacaaccacagtactcagcaagacacaccggagaatgcatgattaatgcaagggagtacaaggagataataatacaggggttcagttttgcagtaaacagcatttaaaagtcacttagttgctcaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccacattttagttgtttgagcaaattttaagaattagaacactgacttgggtacattgctcggcttgcccata

SEQ ID NO: 63394 - DNA, 13519 bp, Oryza sativa
ggtgcgagtgcgactgtgcaagagtggggactggatttggggaggtgatggtggcacggacggctttggttgtctgtgaccgacggatcggacggctcacgcgagggatggttactgctgccctagaaagatgggggatttgtattcccgcccaccaccggaaattgggaatttggagggaaatatttggtttcattaaccctgattcgttttttttatttgtttgtaacgtgcagttgatttattattatatcactgaaacatatacttctcatggataaaatataatttcactccaataaaatttagaatgaaaatttttaaacttctaataggataattatagagtaagatttttatactttaataattttagagcaacataatggatcttaatagttcaattcctgacattgagtgaacaaaggacttaaaaccccttaaaaagtatctaaattttatatttattgcaatttataaactaaaaccaaaactaaaacaaactcatagtatcaactagcacataacaaattaatgtaacttagtatatatttgttcttttaatttctacgtgtttttacatatatgttcctacatctttgtttataaatcatgcaattcatataggtaagtattgatcaaagtataatttgatataaatataatttaaattcctttcatttgatttaaatgctatttgcccattcatctaaattaatataagtataatttaaagccagcatatggaagtagggtgatgtcaagaggagagaagcaacgccgatgcctctgtccaactgaaacaagactaagaatgtgagtatagcaaggcgacatgtcaacgcagttataggagcgagggcaacggatagaggaggccaatatggcatgcaacctatggttttctccacatttcctgaatgaatttgggttgtcttgccgatccaaagacgaaggaaggattagttgtcctaggctaagtggcggtcaaatcgagcccactagcaagatcgaacaatcctcgtgagttagcggcttcatgctattaacagaaagtcgtagaacttctttgcagaatcactgacatcatgtcccattgcctcagcttctcatcgagcctacatggtttagagagattaatatgatggatgaaattgagttctatgataactatggaaggcacaaacaaacgaatttaatactagtaagatgaaaagttaaattttaaataaacctaagaaatatcaatgaaaatagttatcaaagaaatcaaaccatcgaattgactaaatgcgtcgaatttcaagtatttcagaaaaccattgaatttttggaaagtggaatttgaatacaattttctggtttctgagtaaaacaagaacaagtttgaaccgatatcaatcaagatctgacaatttttattaaaaccacggagagaagacgtgcaccattggttttagaaagtgaattagttttatggaaattaaatttccatgtcatactccccaaattttagggcccctttgaatcgtagggtagaaaaaacagaggaatacgaaaaattacaggattctgacagaaattgaagtgtaaaacataggattgcaaaacacaggagaaacacaggaatggtcgtttgattggagcgcaggaaaaacgctggaatcggatgagagagatagactcaaagaaaatttttcaagaggttggagctcttgctaaatttcctacaaaatccacatgcaatgtgccaatccataggaatttaataggatttggaaagctttaatcctttgaatcaaagggccaaataggaaaatttcctataggatttgaatcctatgaaattcctacataaatcctatgattcaaagggtccttaaaaggaagatatgtatagaatccaactatttagaaacattatactttatttttgttttttcagtatgtaattcaatgatttctgcctcaaaagaaaatgctacaatcagcaataaataagttaattaattaattaacagtacaaaaaatactgctcattatatggcgtctgtgtatatcgattggtctgggtgagttttgctatgagtactattttttatattcttctggtttacttttcacccgaggaactgtagcagtaacggaaagtttttcaggccgttgattgacgtgtggccctaagtaccggctggtccgttagttagttggaattaccgggtgtgtgtaccagaacacacgataaacatcagattccgttagattcggccaaaaaaatagcattcgcgccaccgtgaatattttggcgctaacgcatttctgttcgcgccaacgaaaatagcttggctgatggatgtgggccccaagatcccgggtgtaattggtaaatctcctaatgttacgtagtgtttaaaatgaacgctctgtaatgacatcagttacggggtgttcctactatacactccgtagtttactcagtgctagatcaaacatacggtaacattctgctcccacccgggagagtctctcatcctggtagctccctcaagataaagacgaagccgagcggatctccagacgcagcaaactttatgtcatacatgagaccgagctgtacaagaaaagtccatcagggattttgcaacgctgtgtgtctttggaagacggaagacaattgctaagagataaccattcaggcatctgtggcaatcacgctgccgctcgaactgttgttggcaaggcttatcagcagggttttttctggcccacagctgtatccgatacagacaaaattgtgcgaacatgtgaaggttgtcaatttttcgcccgacagactcatctaccggctcaggagttgcaaaccatcctgttattttggccgttcgcggtttgggggcttgacatggttggcccgttcaaaaaggctatcggtggttatactcatctctttgtagctgttgacaaattttccaagtggatcgaagccaaaccagtcatcacaatcacggcagacaaggctagagcttttttcatcaacattgtgcaccggtttggggtacccaatcgaatcatcactgataacggcactcaattcactagcggagtatttcaagatttttgcgaggacttcggcatcaaaatttgttatgcctccgtagcgcaccccatgagcaatggacaagttgaacgtgctaatggtatggtacttcaagggataaaagcacaagtttttgaccgactgcatccctatgctggcaaatgggtagaacagttgccatatgtcctttggtccctgcgcaccacacccagtcgggctacggacagtcaccgtcctttctagtatatggtgcggaagcaatgttgccaagtgaggtagaattcgaatctttgcgatttcgtaatttcagcgaggagcgctatggagaagaccgagtagatgatctcaaccgactggaagaagcccgtgaagcagtgctaattcagtcggctcggtatttacaggggatgcgccgttatcacaatcgcaatgtttgatcacgagctttcttagtcggcgacttggttctgaggaaaattaagactgcacgagatcggcacaagttatctcctttgtgggaaggaccgttcatagtttctgaagttactcgaccaggttcttatcgactcaagcgtgaagacggtactcatatcgacaactattggaatattgaacatcttcgttgtttttatgcttaggcattactttttgtatctttctctttgactgctaacatcaagttcttccttgagttatcagtcgggggctactataataataatggagtgtgatttttatcaattcaatttgcttacttgatttatcattgccttgtttgattttttgacttagtcaatgaggactgaaagtttttaacagcttttgcgggttctaggctcaataaggtttgacaaaaacttttaagaaatcaggagctaagtttaaattatcaagcacagcataaatccatcagtattgtacaaattgtgcctccatcatcatcatcattgtcagaaaacaatatcaatcagtttcagtcttttcatcgtcagagttattagatccagtcggcctgaggtcgttgtcctggaatctctcaacaacatcagcggctatcttgtcagcagctttctacgcatcattaatgagatcaagggcagcttcttcacttgtctcgtctgcaaagccatcgataggatcaatgttgatctttgggtacaaggacttggtcatcgccaacgccagactcgctcccatgcttccagcttccttcatgttcttaaaatatgtttctggagcaattatcggcttgtcgaatattttggcagcatcaaatgaacatggcttggacgagtggtgcagcagcgttggcgacttcatctctagctccctcaagcctcttgattttgttaaccaagacgtcgaattgggcttgggatttgattttgtgatctgcacaagtagattcgcatcagcgagtgggcatgaagatgagagtggtttcttgaagttgcagctgtgagtaccttcgacatctttcagagccgagtccctctgctttgtcagttcgcccttatctttttccagagccttgattcgcctttccagctcggatatcttggcagtttgcactgtattgcttctcattggttagttgcacatggatagcaacacgaaacaagtcagacaaagttgggagttaccttttgatgaaccgctcagctcgaagttggagtcttggagctctgcgatccggtctctcagatcatgctcagtcttcctggcaagctccttggcttcacgcagctggtctttggtggcttccagggttccaagatggggaaccaatttttcgagggtcgcggtcttcgcctgatttctaagatggattctctgtgttgcaagtgcatctttattcagtaaagtggccgacaggatgattgaagctacgtataaagagacttacatttacaagacgagtagcttggccgagtgtctttttcagaagctgatcgtatccgaagaacctcttcttcatcaccgatcattggcccttatacattcatgaataatggcaaagcaattgaagaaagtttgtcggatcaaggaaagatttggaggacatgtttacctgtaataatttccggtcgaggacgagcaggtccttgcaccctaacaggagagttggttccagggccagcaccagcgtccgtcttgggagggctgttggcttgagcttttgcttctggcatatctctattttgttcagtacccgactggtttccagtcgggggctcctgatcagcaccgactccagcttcggccgactagtttctagtcgggggctcgttgctggtatctacattgccggttgccggttgattattacccgggcggtcctcggtagtcggctcagtttctgctgaaggaccattctccgtgccagtcggcatggggtcttttcttgatggatctatgtcagatggtttcctacaaatttgagacatgctatcagctttgcttcaatagtgagtgactagcgaaattgggggaattgctagacgacacatacctggatgacttcctgattttcggcatgggacgactggatgttttcttctttggattggcttgctttggctatttttcagtcatccttttgttgcccgcgtcatcaccttcatcgtcacttgaaaccaacttccccttatgagaatctggctggttagtggacttcgcggtgttgggttggacgtttgactggatcttcggccctccgctggcttggctagtttgccggcgcggtgagcagcgtttagcaattggaggatcggatttcatcaaagcgaattcctgtgcgtggtattccaagttttcagtcgaccttacagaagataaaagcatgctttgagaaaggctgaggtgtatgatacgtaccggtggaggagggttgaaggcattgcatggcatgactggcaataagtgtgaatagctgaccacgatggcattcgagaaaattttgtacattctctcctgcataattttgaattcaagagactctgtgtcttctcggttggggtcatgcttgccgtcgaactcgaaagctgttcgggatccttccttgattggtgccagccggctcttgataaagtgccgagtaatttgctccccttgcaggccctattccttaagcttcagcatgcgatccaacaggtcaagcgcttgggcagcctcttctcccataggaagtgagttcccggtatcgcgatatactggaggaagacaggagtacccaggaagcgctggctcggggttttgcacattgaaccagttcgcgtgccaacctttgttcaaggtcttgaatggcacggagaagtatttttggctctaggtccccctcagttgaaatccggctcccccaactacgcatggtttgcttttattaggctagggcttgaggaagaagatgcgacggaatagagcaaaatgtggcctaatccccagaaaggcctcgcaagcatggatgaaattggcgatgtggactatggagttggggtttaggtcatgcaaactgatcccatagaaatctaaaatcccccggaagaaacttgaggtcggaagggaaaacccgccatagaagaaatgggagaataccaccacctcgtatgtgtcgggggtcggaaacgtttcaccacatgctggacgccacccgatgatctccttcgccggaagaacgccgtgcaccaccatctccttcaggttctcctccgttacatcagagggcacccattgactctcaaagctttctctctcttccgccatggatacgaactggatgatgtgatttggttcgaaatgtggctgggaatggatgggagattgatgcggtggttccgtgggagatttttgtggagttttggtggctggattggagcgaatctatgaaccctagcttcgccggtgtggtctgacactgtagcagagaatggggaaagtggcgagagttttggcggggaagacgaaccgacgctttgcattcggtgttatttcattagggtatcgggagtactaatgggcctgggcctaaacagtacttcagcccaattaggctatcgacgtggctaagttgtgatccttagggacttaggcattttgctttggcaacacttgctcacaacggtatagcccaatgctgttaaaatcctttttgacgcagttagataattatttggaattactacgatgcaaataaaatggtgcccaacggaaaggtgttatactaattttgtaagcctttttaggctgcaaaagctgtttgggttttgttgagatgactagtttttgaatagtcattctctcgacatgttatatgcttattttgatatggtgcgagtcatagcttaggcaatttagactcacctattgtcatgatttataccacatttgatggatcttttttgagagtttttacttggattcttatcatatgtgttggtttatagacctttagagtgtttttcacgcgggactttatatatctcctttcctggggtatcaaagctaaagcagtcagctggatgttttattaacgtcacatatgcttagctatgtgataccatggatgatccggttgtaaaaccactcggttggatgttatttacaccttggttatatccttagtttttaactaaacacatagtcgaggtctacacctaattaggtgtatctaatcgatgcacctgattttctctatttttagcccttcacagtctttgattttggcactcgggagatcaaggcagaagaagtcggagtactcggattatcgtttggattacgggagaagactatttcgtcgactgtaaatgtctcaggggctactgtggagattatggatacctcatacccacacgacatgtatagtccgactgggtatggggtgccatgtgtagatagaatatctttaaagggactcggattaaattccaaacttgtatgttaaggaaatatccgggatcctagtcggttaccattgtaacttatctgtaactacctattccgttagggatatggattgtactttgtaatacggacccctccccctatataaggaggggtccgggtgcctctaagggcacgattttctcccagatcatacgatcaataacatactcggcggatcaatccccggataggagtagagtattacttcttattaagaaggcctgaatctgtataaaattccttgtctctcaacccatccacttttctagcttgatagccacccctttagtattgccgaaatctcatttcgacagtatgaatttgacatggtgggctacaaacctagaaccatatgtatttccgacttgtagttggccatcagtgtatatatatagaaattgagaagattagtatagattctactagcgatcatagtgatacatctaagaagtaaagctatcacttgtgggctttgtggaagggaataagaaaaaatatgaggtagcactataggaataagctattacgtttactagccaagaacatgtgtattgtaacggaaaatgaaatcagtttctagctcaattaggcacatatttagtcaaattaacacttttatgtttctccttattgaataagtagatgagttcgatgtttaagataaaccattagtgaaacgggagaggactcattggaggttggtgcaatactatagattgtagggcctaaatgtcagtggtagggggtagtgtgaaagaacagacaccaccactacagacatttgaagtagtatagattgaaaaagcaggtgatttcaaagtttaagataaaccaacagtgaaacgggagaggactcgttggaggttggtgtaatactatagattgtttggcctaaatatcagtggtaggggtagtgtggcagaatggacaccaccactacgaacattttaagtagaatagatgtactctattgcttaagtgtgaaagaacttacaaagttgttgatttatacataacagctttgtcaaatagccgtgagccccatggacaagtcagctcaggtttaaccgactactttagattttcagcaagctcataagctttaggcttatcataggtcacaacccgaagtgcttcgaagtaaagagcatgatcagtaagtattaaccttgccagcaaaggaaaagttgaaatccagtgatataaaaccgtaacaaggcaagttaaaaaaagcatgccagcatctaaacaacaagaaatcgtttctcctcactgagaaccagacatacctggccatgtcgaaatcctaacatgttcaagtactggttgagtcgtcaatgtttcatctatttctacaatcctttctcctctctgagaccgctggccagataaaatcaaggactcaaattgtcctttcattttcttaatctccctacatgagataaaacatactctcagtcctgactttatgaaacaagatccaacagaaagttatatgcttgcatatcctatcttcagaaaaacaaagggagtatagttgaacttattttggtaacaaaaattggcaaatatgttatcccatatttgtcgaggttacggataaggtataccctctatccttggataaacaatgagtactgatatggtatgcccgcgcgtatatggatagttcctatatgtgttaaggaaatctatcacgtgatagaaacataatccatggatggaaggagtcctactcggacgagactgggtctttaccatatcgtgaggggtccgatatctccgagttctacttgaagatcaacttacccgcggtataaaagggaccccctgggtaggagctaaggcattgaatatcatcgctaacacatccaccacagcctacgaagccggagcctacaggagctaagtcgccgggtgatctagtcgaaccaactcgactacggtctcgtcggtaccatcgagttctgttattctctttgtaatctgtggtttccatcatataatcccataccaactagattaaagctattacctacaaaggggcctgaactagtataatccttatcttctgtttgcttgatgtcgtactacatagatcctcataccaacataccccaataccctctatattcggtctacgggtatcccctgtcgacagttgcgcgccaggtaggggaatttggtgctcaaggttttactactatgacttcaagcctcctcgacaacagcgtcgaccctgggatcaaccaaggagcttcaacttcaacgatgctggtgtggactcaagtcggcgaaatcgtcttcccggtctacaccacgatgccgatctcgactggcgcagtaatcaccagcagcgagaacggcgtggttacgaccccggtcgactccatgtcgaaagatcctcccgcaggagcggagaacggaacatcgacaacatctgcgcccgagaagggtcctaacgcggccagttcttttcgttctgacaagaagcacgagccgacaaggacaacttccgaggcgacgaggatctggtgtcccatccacaagaccaaaaggcacactttggaagcttgctcggtttttctcgacgtacaagctgaaatccgtgcctgcaaagagcatggaatccaacgcacttctccaactcgtgatgtctattgtcccattcacaaggcaaagactcatgacctctcaagctgcaaggtcattctcagcgccatgaggacgtcacctcctaaggtccaacagtcacaaatctctcctagagatgcggacaaggaacgaggagcaacgaatatttaagatcgattcgtcagggtaatcgatattgatccccacgagccatctgtcctacatctgctcgaagaccaggcctcatcatcaacaagtacaccacgcaacatgtacgccatcggtgggaccagcacgtctggaggcggcaacacggaagcggaggatcaattggctacgccagcccaacatatcagaaccatcaacgcaatactgagggaaacctctaatgatcccgtcctgaatgctgatctcgatcagtggacggaacgactacgggaatcagtggccagcctcagtaacgcgttcgaggaggccgctgccagggcaccaccagaacaaccgccgaccggcggcgctaatggggaacagcctgaacagcggacgccacctcgtcaagccacccttccgccttgcggcaccagtgatctgcgcgaccatctgaatggtcgccgagaagcgcgacgcacgtgagacaacgaaaatcattccccacatcgcgtctctttgcgacatcacgagaacgaagaacaaggaggacatccgagcgagaaccgagaccgtgatgatcaccacaaccaccgagaacatgctaatcgcgaactgtggctgccgggtgatacaagttgaggtcgacgccgcaatgacgacgacgatggaggtcgacactgggaaaacaacgatggatgacgacgaggctcacgagaacccgagcgtcgtcctcggaaccctgccccaaaaccgagtgattcgtcatcgtcctcgtcatcttcatcatcttcctcatcggacagacatccacgacgagcacatgatcgccgacaacccaccgctcctggcggcgggtgcagagctttcactcgttccctacaagaggttcgatggcctgagaaatttcgaccaggagcaatagagaaatacgatggaagcaccgaccctgaggagttccttcaggtctattccattgtactctacactgccggagcagacgacagcgcactggcaaattatttgccggcggcgttgaagggatctgtgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacaggggaagactagggcgacgaccacaggcgcttgacggcaggcacgagctagacaccaaagccttcatcttccaggaactccacttctgggtttgggaaaaattgagcaagactgagtacaaccaccgtactcaacaagacacacccacaagtgcagaataaatgcaagggagtacaagggggttataatataaggggttagggtttgcagtaaacaggatttaaaagacacttagttgcccaaagatattttataaagacgatcctagagctatacaagattattaatcaaggccgtgaacccacacgaacctgccttaacccaaggcctacgatgattcagactgaattggcaaccctaccctgggtcccagctcgtcccaagccaacccaggccaaccattccacattttagttgttaagcaggttttaagaattaaaacactaacttgggtacattacttggcttgcccataaccgagggcgcggctattcgaatagattatactctgatcagaggtgtacatctttacccacaagacacatcttcctcacgtgtaaccacgtgccacataccaccacggtatacggatggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcatgtagccttcatttgccctagagatgtccatcgacccctgacttcatccatctccaatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacagtaaccaaaccattccatagtatccagatgatatgaatatttcccaaagtctatagttgaaaaaccacctaatgttacctaattaaattgcgaagcatctacctaaaactaaactagtggtgccatgagtagagtgtccactagttggggttttgtttgttctagggtgaacaaggtaataataacaataacaataataataaggtcataacaaaggtaaataggcatggctaaataaaacagtgataacgcgggaatttaaataaagcgataatgcaataatttaaatcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaac

SEQ ID NO: 63395 - DNA, 3354 bp, Oryza sativa
taccctttcatactcgcaaataataaaagattacagaggtagatagttcctctcaaaaaaaaatttcattctacatttccggtgctctgaaaattcaagtaaaatttgagggctccttttagaccaaggagaatttaacaaaaattctccgggccacatttgaatttttcttgcacgtattttagtgtttgccaatttcttttcgaattttaattaattctattattccttttaaagaatgatttttaatttcgggatgaatttatcaggacgtgacaaatccaccccccttacaagaatctcgtccccgagattcgaggaggctagcaagaagataggttgggcggtcttctcttcttgtctaacttcttccgctccgtcttctataacaaacttgcctaacaaaacttctccactctggactgcttggctcgatctcctgttgcagatggaatcttctcttcacctgacttttccctggttgtacctctagctgacttcgactgggatgcggcattggaagatggggcttcagttccagaacttcttataactcgtatctttggagtcaacctcatacaagttaccacttcatgtcatgcgtcaacactagcttgtcattactaggataccatgtttgtcatcatttagcattcaaagtattcctttacacattcagccctgacgtattctttttagatttctcttatcaatcacctttcgacctacttctttgcctggtaataaacatctttttcgatatctcctatcagtcatcttttgacctttgtcactaagtactcttcactccgagagttgtggatgcttctggtgacgaggtggtacttgagcctgctgcctttcagagaaaccttcaagtgattcgttcaaaagctagactggcggttgttgcctttgatccaaagaagacacatctgaaactcttagtccaaacaaaagtctctttggctttttaatctaacacaggtcgcttcactttcttttctatcaacaactaggttacttgatttatcatagattatgagcttacggatatgagaccctaggtctcccttgtcagtaaacaattatacacataatcccatatcagcatcttccgaaataatcctcatagcacttgtttttattacacatgtctcccttattacatgaatgcaaggcctggccttaaacaaaaagggaaggtgcttaacatcggtacattgcatcctccacatgaatcttccataaacataacaaactcattgtttataatcatgaatgtatttatttattacatgattgctgcaaactcccgattacacaatgataagtagcgaactgaaaatcacaaacgtggctgctcattttgattctggagagatatagctcgcattgttctagtgactgcatccttgattggttctgtgatgatgtggtaggactgcgtattgctatcattcacaggagaagcttccttctgattgctgtttgaagtggatgacggttttctgcttggtatcgccctcctgaggttgattgccctttgcttggcctggagtaggtcggggagagacacaacttcttccatcgacgacaattctttgctgaggctgtcggtgcagagaatggttggtgctgaaggtattatcgctatgatttactgcagagtcaggtgcagcaggaggagcattggtgctgtggatgatatcgtcgatgttgctgttggagctgactagctgatgagacaatcgtagggttgttcgttggatttctacggtcttggtcaacaacacactgagttggcaatccttgggcacatggtttgtaccttcgcacagaaaacatgtgaccttgcgggtgagacactcccctggtggatggtcttcttcacaatgagtgcagagtgtgagacacatgctagcaatgtgtccaatttccccacaacgggggcatgcttttgattccatctcttcctcgccgagatgtcggagagactcatcttcataatccgaggagacttgatctgacccttcactatcagatactctgccgtcatggcttaggaggtgctgggtcaactgtcgtgcacctcggaaagtatttcctctttgacgtctaggaatagttatcccagctggaggccattcggtgctggtaatagtcatcttacgtacttcttcttcagttcgcatcggcgcttttctcttctgattcttactcttcttgcctttggcttgcttagtacgtgaccccacgtggtacgaaaggctaggaggaaagcacttcccgggattcaatggattctctccattgggctctctactttgcacactaggctgcaagcttgacttggtgcgaggaggctggtttagcgatgtctgccctgttaaaccaaatgaaggggcttctctggcatatacccatggacaattcagggcatagtgtccttgttctctacaatcgtgacaaaaggggacatcctcttctggcattggaagttcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggagacatacccgctgacattctttcctttttctctgttaaacatctgttacaggaattgaggtgagagaggaaacaagctaggaaagaatagaccagaactagagataggaccttaaaggaactaactcttcttgttgatgtgttgtttgttttgcttattctgcaagttgattaagcaaacaacctagcatggttacatcacaacccaccgatgcaaaccacgcgctacacacacaagcaagaaacacacgactaacgacactaccctagagggtggcttaggttctgcgacgggttctccaagatcttcactgcttccttcactttactagcggatcctgcagccttctggaatttcgacaaacaactgacgatgtcttcttcttcactgacctgaccatctagtactagttgaaatccgaagaaggaagaagggagtaaaccttttgcagatagcacaggggaaaggagaaaaaaggaactttcacaaatagttttatttataaaataggtccttaggttatatccacttggcttatcctacagtcgagatggctcagataccagcttgtcgcgaccgggaaaattgccttttcccgaacgctagtgtattaatccccgtcccaggaaaagccggggtacaccatacaaacatgatataaaagacacatctttattacatc

SEQ ID NO: 63396 - DNA, 3517 bp, Oryza sativa
gttggtcgccgtcgtcgaccatcggggcgcgggtgcgcgccgctcccgtcggccgcgccgaagagcccgccctcgggcgcgccctcgcggctgccaagtgggcccgggcgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataatccgtttttaattaaaatttaaatgaagaaattcgtaaatatccatttaaagagcatataaacttcaaatggccatatcttggccatttgaactcggaattggaccgttcaagtctctaatttctccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattactaccttgttcaccctaggcaaacaaaacctcaactagtggacactctactcatagtaccactagtataattttaggtagatgcttcgcaagttaattaggcaacattaggtggttttataactctagacttgggaaattctcatatcacctggatactttggaattgttggtttattgtggaattggcctcacaccgccccctctattcaaaatccccctaaaatggttttaggctgggctcggggtgcatggttttgatggtagcacctcggccgtttaaggaccggtcttcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaagactacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacgtcttccgcccgtataccgtggtggtatgtggcacgtggtaacacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgattaataatattgtgtagttctaagatcgtgtttacaaaatagccctgagcaactaaatgtctttaaatgctgtttactgcaaccctaaccctttatgttataattcccttgtactcccttgcatttattctgcattcgtgggtgtgtcttgttgagtacggtggttgtactcagtcttgcttaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaggatatacgataccaaatatagatagaatatctttatgaggactcgggttagattctaaacttgtatgccaggaaaatacccgggatcctagtcggttacgattgtattttatctgtaatcccatattccgttaggatatggactgtactttgtattacggatcccttcccctatataaggaggggtccgggttcctctcggggcgattctttttctcccaatcatacaatcgataacacactcggcggaatcatccccggacaggagtagggtattacttcttgaataagaaggcctgaacctgtataaaattccttgtctccaaacccatccactttcctagcttgatagccacctccttttattattgccgaaatcttgtttcgacagttggcgcgccaggtaggggtagcgtcaagttctcgccgactaagtgcgatgggtttcttttctggcatcgacgacttcgccttccctcccgggcaggcgttccagttcggcagcctcaacttcatcaccaacgacttcggcaagatctctctccttgactcggactcaaaccagtcggggagagaccaggtccccgtggcattcggtattccgaactcggccgaggcctactccaagatcatctctcccgagtcggcttcaaaccactcggacgagatccaatctactcttccgcgaccagatcaagacgacgggtcctatccctcaatcctgatgaaacttcctgatgatttggccgttgtcttcactgccaagacatctcccacccgaagatctaggcgagctccggcttcggccccgatctaatctagatccagagaggttggcgttatactccaacctcttgggacagtctcaacggaagagttggatggttaccttagctcccccggcttcagttctcgaccaaccgagatcctcgactatgacaatttcggctaccactacgaccacggtgacctcgacaactttgacgacagctatgaggataactacacgcccctcttcttcaacgtattcatggctgacaacgaaacggaggaacagcgtcaagcccgagaagcagaccaagatagcgcacggcaagaagctgaacgtcgccgactagaggaagagcgacagcgacaggagcgagaacgactacagcgtgagcaacaagatcgcgaacggattgcaaaggaggctgaagatcgacggcaacgcgccttggaatctggacgctgagtgagagagctcattgggcaacaagacgtcgatggaacagcggtctttcgcaccccccagtagaacgcggttgcagctatcactctcctcgacaccctcgtcaaggaagacgtactcaaccaagctgatcatgttgtcaacatcttgaaccagacgaagaccatgatcgctgcctcggttccagccaact

SEQ ID NO: 63397 - DNA, 21188 bp, Oryza sativa
atttgttgcatttgatccttcctttgttaattgttatatcatgtccccttgtaaccatctagttgcgtctcgatattcgtgcaccctgtgcgagtatcgacggacgccttcaaaacttaaaatctgattaacaacttgggtaaaactttggttttacaaaagacttggaaaacccgacacctgggttggtgcttgcgaactaaatgaatttccaaaaccgcggaccggggaatgtaccgggtgtacggtttcccgctcttgcacttaaggaccgtttccttggaatttcatccaaacataagacaagtacgaccacatgggtggaatgggacacccctagctgagtaactagcttatcaggggagccttgatgccgagagacatgtggatccgccggggtggtgtcggggaggacccctgggcttcctggcacagtatggtttgggacctaacctgttgttggtctgggacccctctcgtcggcatatggtaaacctgtgtcggctttgaaaatgccttgtcatgaaagcttggaggtctcccgacgtggctgatccccacgggctgggtgatccgggttagtaaatgtcgtgtgggtaaagtgtaccccctctgcagaggttaacaaactgttcgaacagccgtgcccacggtcatgggcggatgtgaggtgtttcctatagcgtagatttgtttgcctgtgctttgtaaaaagttgttgtggtttgggaatcgttaccagaatcagtctatgtggcagaggatgacctgagtggtcaagaaacgaatctgtgtgattcgggatgtctgcgggcatcatagactaggcttcccgagtggaagcggattgttgtgctgctaggcagctggactctgggagtccgagaaaatgaaaaagctctgggagccgattaatcaagtgaaatggctctcggagccgagaagtaatgatctgacccgggaggtcggtacagtaccaattgagttgttgaaaagcatctcttaagtcgatttgagacgcaagtctcttttcgacccaaacttaaaaagaagtaaatcacttagtgatttcaaaatgatttcaaaattaaagatttgcaaaacaaccttgcctctcttccaagcttgcattaaacacctaaattcccgtgacttgctgagtacgaaagtactcacccttgctctatataaatatatatatatatatagttcctccgcctcgaagtgaagatgaagtgaagtgaagaatagggtttcgtcctggttcccagccttcgcctgtggtgttgggtgttagtccgttggttccgctgctgctgctgttgttggtgtttctcgtccacgtcgtcggttgcattctcgggctgttctgagttgcaacctaagttaaggtaaataagtcctctatttattttaaggattgcaatgattcatattcgtcaccgtgggtaccagcgctatgtcctgggactggtactgagatcgcggtttcgtaggaagcggttcgcgccgtttttcctacgacacgcttctattaggtgccgttctacggtggtgccagattggggtgtgacagagaggtgtaacatcccggcctagcgcttaataggattaatagaatactcatattaacaagttgcaacttcttttccagaagccgatctccaaagaactccagggttaagcgtgcttggcctggagcaatttgggatgggtgactgaccgggaaattcttttcccgggttcgcacgagtgaggacaaagtgtgtagaaaagacatgtgttggtctgtgagggcagtctatgacctatgaaagctgccagatgtaagtgggcccggcctgggagaggcgggtcgttacaaggtctgactcgtagtcgacaacagggtagccttcctcctcgaatccaatatggatacaatccgagtagtccttgtcgtttacatgtagaactctgttgtctttccttatctagaactctctcgaggtcagtttctgtataagacatggtatgtggtggatcgtggtggatcctgccgagatttagtcaactactattaggtatgtggtatccataaccctgacagtagcccccgacttcgatgcaaatgaacgagttcatattctcaaccgcagactttggaggaactgttatcgagctcacgtgatcgttctcggtgagtttagagataacattagatttcctttatcagcctcgtgcaggcaccgaaagggtttgtctaagtcaatctctaatgccgaccgagaaagtacagagcatacgactaagtctcccgtcttgctgtaatcgagaatttggattgaactcaagaaattttatctcggcgggtacaccatctcttcattccgtattccttgtcgagatccagcaaccgttctcgaacaatcgagaaggcgtagagtctgcgacagagctttgtcaacattggtcgtactcgccttagtcgatcttggtgtagcactatagagacatggagtcttcgtcaatgtcgcatagaattttcctgaaatcaatactcagaaaagaatatcaaatagaaatagcccctgagcgaacgctcaaagggtgacatgttataatatgtatggaaaactgtaaatgaattaaatttacagatcaatgttttgtatatgagtgtcttctctcttaccgactccgatcagtcagtttgtagagtcatacactctccctagcccccagccttgtcgtcagagaatcgttctcggaggataaggctcttggacccttgacctgccttggttgaacaagcactgatcctagcccccagccgtgaagttggaaagttaatttccgattacacggcttggttaatacgcacggcgagaactcttacatgaccaggtcttacatggtctttcgtctctacaggatctgacaaggccttatcggctctgggcgtccccagccgaagatcccttaggttcctcggaggccttgttaagacggcgtaaagggacaataggataggtttcaacgctaggtgtcatcgtggtaagggatctctgggtaaaacacttggcgatattatgtacctgctatcaactttgttgaagtagaggtagtaggagaaatcgctacaccgctggtcgaggaccagatagtagtcgtaactcgaccacttaaagtggaagtagtgggagaaacgctacatcgttggtcgaggaccaggcagtagtcgtaactcgaccacttgaagtggaagtagtgggagaaatgctacatcgctggtcaaggaccaggcagtagtcgtgactcgaccactccaagtgaggcgagagagatcactacgttttactggttcgagaaccaggagtaggagtctcttaatcacctataggggcgctaaagttggtttattacatgtgcacatcatgtggccagcatgactcacatacccaacttatagcatatcctgatgtctgctcgcaatcatgtcgggtgatcaagccgacgacgttcgcgaggaattatccattaacaaccttttctcgagtagtccagcgatggccggtgctatgagataggtcgtcggtcttcgttgataggttgggtgcgataactccgcatttgtcaagaatgttctcaataatggagtgtactcgaccacaacctactcgagtgctcaattgttcctgaaaattattttctagaagcaagacatatagcagataatatcgagtatgtactcaaaaactgcgtggatcttctagcattatcaggatataacgatcagattaaatatcaggcattatgtaaaccgtaaacaagcatgatttatacagaagagaacggagcgagcccccagcgttagactgtagttgacctgacatcgaaagcactcgcacaatagatattgtataaaaaacatgctctaggtaaacataataaattattgatctgacaatgctatatgatctgaataggtacgataaattgcatataaaatattgcgtacctgtgtagatatatgacggatatatctacggaattaatagattaatttaaaaaaccaatctaccaattaccttactgcgtactcattcgatatcatgtgatctgacatctcttggtacgccgcggagcttgaggcttggtcgatctcgagagatcgagttgttgatgacgatgattccgatctcgtcgggggacatactccggttgggttagatctcctatagccgaagttgtcgagtagtatgttgtcggagaatccatcttcttaaacccatctcgtcgaaatcctagatcaccaaaatccccctacctggcacacactgtcgatgtttggtgtcgcaattctggtatttgtatagtatggggatcgtcgatactaggatatacgcgagactgaggtaaaagagacggagacagagatttttatacaggttcgggcccctgagttgtcaagtaataaccctatatcctgttggccgaagccggtattgctcttattcaccataatcacaccaatacaatatgtgggtagcctatctaactattgtcgacatgtcagtctgaaggtctgactcgtagtcgacaacaaggtagccttcctcctcgaatccgtgcccggcgagattagagagcgctttcgtctctcctgactgtatccggagacaccataggaaactagccgtggctatccctaaagtcgatatccggcggcttgtcttggcgtatgtaggcttgtatgttgtcccgtgtattatgttgggtgttgattgaggtcgttgattgtctgtgttgatcgccccatggtgggtgtccccctgtcctcctaggggggcttgtatttatacccataggagtccccttgtccaagtagaactagggaaaccaatatggatacaatccgagtagtccttgtcgtttccatgtagaactttggttgtctttccttatccggaactccctcgaggtcagtttccgtataagacatggtatgtggtggatcctgccgagatttagtcaactactattaggtatgtggtatccataaccctgacaacagtcattgacatgtcggtcccacggttttcctaattttaagtgccacgtcaacaccacgtaagcgccatgtcagcctaaactgccaaaaccgtcttaggaccttatttgcactggttttgaaagtagagggacgtgtcatatctggtattgcggttaagggatgaatttcagactcgatgacaaattgatggacctaaattatacattcctattatatcgtcgacttctgtctacaggattttattggacctaagccgacttatgcggggacaccaatgttttaaatagcgggctaaggcatttagcagtttgcttcttaaacagctatagctgcagctatagcaggctaaatggagctatagcggctaaattgtacatgagagcaaatagctagaatccttctcaaacatctatagcgggagatttaaaaccctgggggacacctaactcgcgcgtacaataaaataagcgcttagcattaatcacactggtagctttataatataaaataatataaaataagttgatttttttctaatttaggttgaaattttttaatgtgagctgaaaattttaattttgaaataggatatttcaaatttttagttgaaagttttaaattttaaatgtaaagtttttaaatcttgagttgaaagttttcaaattttggtttggatgttttaaatttgacttgaaagttttaaaattttgagttcaaagttttaaaattaagttgaaagttttcaaagtttgagttgaaagttttcaaatcttgagtgaaaagttttagtttttattagaaagtttactcaaaaatttgaaacttttcaaacttgattcattttaaaatttataagtatattcatttttttcaattcattttgaaattatttacttctaaagtattattcgtttaagttactgcttattatgtgcaaagatatatactgttaacttgcaaatatatgcttagcagaaagacggactctgaaataaatattgaaatcatcaatcagtagctctcaattaggcatccatgcatacatcttttaagcaagagaaaggacatgtatgtggtcaggcgggcggtcaagcttgaagactgacttacacgttgaccaaaaaagcacgcctaaccaactcaccccaattaccagtataatccttccctccctaaaaagaaaaaaaaaacaattctgttaattgatgtacctcgcgggagtactaattaattgagcctctgcctttcaaaagtgtagtgatccagtaaacaattctatccagccaaggcatgcatgcagatgagaaatgcatgaatgataccatctggtctcgctgtctggctgtttgatgagccctaattaacatcacatatactatttaatttaagcaactgatgatgatggaatgaataacccagcatatagtagtatgtagatatgtatagtggagtactctagtagaagatgcatatgatggaaaaagaacaagggatttttttttaaagacgagaacaaggaattgattcagctaatgtagacatatatgcatgcagcatctagctagccaagtcatccatcacatcatcagatcgatcagctaaccttaccttagtagctctctggttaattaattaggcacacgtggggaaatgaatctgtcgctaaaacggagtagtagtagtaagtgcacaaaccaatcggccaaaaaaacggggatcgatcgatatatactctacattatagactccttaagtccttattatatgatcgatttccccacctgaagccggataatcatgaaatagtccgcacaaattaatttcagtttctagaatctgaatatacacagatgcagaatgtgcatgcacctggaattaatcctgtacatacgagaaaacaaataatatgtcacattttgttctaaaacactgcgaggtggcattttaacggaaaggcaatatgcgtaatattttatccggtgtattgatctagtgagtggtattttatccaaatcacaagaatggagtgacatatcatttgttttctcatatatattattaggtgacggattcagaaaactttttaggcctgggcaaacttaataatagataactagcacacacgataatccatataatttaccattgatataacacatgtgatgtagtgaggtttaattgctttgctaattttcttgttaatgtggtttcattagtttgtacatgagtttgattagctaattttcaaaacaattacatagagtattgtgtactccctcgattttacactataaaatattttaggttttaaataaattcatatatggatcatgtatgtgcttcgtatatgtatctaattttatatggatgttagtgaatttagataagagataaaaagatcaaaacatcttatagtatggatcaacgtggaactaagggagtacctactactaaagatcttgcatagtattttgataagatcattgacagtaaactaaggcctcctttgaatcaaaggaaaaaaaaccataggaattttagagcattttatcatatggaaaataattctatagagttctttgaaacaaaggattgtttcctatcctttttttttgaaattcctatgaaattgattttactagagcaattttagaggaaaataagcatgattcctcttctcatgttttcctctccatatgtctaagattcttgtgtttttcatttgtgctaatcaaacaataggaatcctcgtatgttttgtttcggatctgctcagttgagtcaatctgtgtctcactgtcttgttagtgagtgggtgtgtgagacagagaaaaaaaatcatttactggttaataaataatgaattactccaattaattgtgcaagttgcatggggtttggggagggggaaggagcagagcagtatatataaaagggcaaagcctccgtccatttattcatactcgatctattattcggcggcggctgcctctgcttgcttgtgactgtcgtgtctgtgcgtgtgtgtgtacgtacatactccagtatatatatgcattgctgcatgtcgcttcatcctcaccgccgccacggcgacggcgacgtcgacggatcagcatcaggatcaggatcagcgcgcctcaccgccggcctcatcaacttcctcgaatcgcgtcgcgccggcgccatgagcaccaccaacagctcatcctctgtctctgtcccagccatggacgcccatggacaggaggaggaggaggagccgatgcaggtgcagcaacagcaggcgttccgcggggtgcgcaagcggccatggggcaagtttgcggcggagatccgcgactcgacgcgcaacggcgtgcgcgtgtggctgggcacgttcgacagcgcggaggaggcggcgctggcctacgaccaggcggcgttcgccatgcgcgggtcggcggcggtgctcaacttccccatggagcaggtgaggcgttccatggacatgtccctcctgcaggaaggggcgtcgccggtggtggcgctgaagcggcggcactccatgcgagcggcagcagcggggcggcggcgcaagagcgctgcacctgcaccggcggatcaggaaggcggaggaggggtgatggagctggaggacctgggacctgactacctggaggagctgctagccgcctctcagcccatcgatatcacctgctgcacaagcccaagccaccactccatctgatctctactcgtattcctcacacgcgcagaggatgcacatcctctgcactacacttgtactagcagtggttaacatgtggatccggttccatgctctgattgttgcttatatttttcaaggaatataaacaaatccgatcctgagttaattagtgtaaatatatagattttgggtttcaggattaccatttttatttttggtggcaccatccagcttaacattgctccgattcacaaaaagaaaaagaaaacactcctactgtacatatacatatatgggcgagcaaattaaagcgggaaatgacgctgtgtttgaaatcgtctaatctgggcccttgttttggtttgctttggtccatggacagattgacggtgctgacgtcacgttgcatgaaagcgaaccgaacgcagatgttgacctggtcaagtccaaagtccaggaggcacgcacgtagtgattcacccacgtgcgtcaatttttttactcactcaaaagcacccagcaacctaaatagtgccctacaatataattatattccctctactatagcactactcctatgcaaaaaaagaagaagagagatattcatttgtaagattattttctactccagcaacttctcttttttagattatccattaccttaaaaaaacaacttttacagtaagtaagacaaatttgtaaaagataatagcctcaagattaaagacacgtggcaaatagatcatttcctccgttggtttgtttgcccaagtgcaatgaattgaaccagattgttgacgaatggggaggagtactggcgattaaaggacgatggatggatcagagttggcaactgccttttaattcatcacatgtggccttggtttgttgctcccaaaacaaaaccaaaagaaaaaaaaaagtcttgttgcctttgactcgaattaggagtattaacaattactagtagtaattgataacaatccttttgcttctgtaaccttctttccttcattctgcgtgcctgttatatatgctaatgctatcggtacaagtctagaagattgagaccgtaatactcttttatcttctctggcctctgggatgatgaatccggcagctcttccccaacttaactgtcatccagttcagtttctttaaagacgacctatctcactacacgtgcgggagttgttattatcacaaaaacataccgtcacggacaaattgtttcaaatctaaccaggcctttggaacatatatatgaatttcagaggattgtcggaagaattgcaataaatcctgcaaaagaatctataaaattcatatagtatttctttaaaacttattcctagcttattagtttgatgaatttcgtaagtatgtttgcattagaaattggtggtcaaattaagattatctaaaatgttgtgttttcttttggattgtgaactaatcgagtgagttgcatgctggctgctgtcttcatcaagacatgtataaaatcgatggaaaagccagaggtcgtggtgcaaaaccatcggcatggagtagttctcagtgtcacgtgaccaaaacaaaaaggatcatttcaatttcaataataataattataatactcctccttgattggtgattgcaacctgtccttgcttaccttggagacgaagagcatatccgttgagcttgcttggaattggatagcctaccatgcaatgcgtaccgctcctgcttccttgctgccgtaacttctaagaagcatccaattgaacacgtgcacgctagttgcacccttttttaaaacatttttaaaagaagaaaaaaaagtggactagtagtataaataatttctaggaaatacagtatatggtacacagcactagcattcagtttgacctgtacctagatcactagatggaggagctgtagtatcagattcatatgcgacaaggcatgatatgcagtgaaaagtggaaacgagaagtttgagcctcatcagttggcctaataagccaaggaaaaaccaaaatttgatttattttttaaacttgatttttttaagttgattttaaaatatttttaatgtattttattttagcgttaacttttaaatcgttacgaacaaatatataaaaaacttactaataaattaaatttttattcccttataaactgatgaggcttattagggaatatgggcaaccgatgaggcttagtcggttccatccattccttgccaacaaatatatactgtactatatacttgtgtgcagcgatatgtgtgcggtgcagtgtgtagcatgagcgttactaagtggtactcatccattgacaatcccaacatagtacattccatccgcgagcaatgctgcaatcgtggaatccacatccacacatgctgctttcttggagccgtcctattacgacttccctcacactgcaccagcactgccactacactcctatactagtagtagttctatgcatctactagacgacgacgactactactatcgaagtggagtagtatcaatgtatctcctccggaaaaaaaaaagaagagggttttgctgccatttctttgggctcttctcccctgatcccctccccctcccccggagaatcttctgatttagtactataattacgtgcattacagtaacaaaaagtgaatcccttgggcttggctttgccactagtatgctttactacagcagcggcagtagtactagtatgacaatcgcttcctggaagggacctcattgtcgcccgccacagcaaagcaatttcgtgccagggtcacagagagatgcatgcttgctggctgccaacatgaaacttcccctttgcatgcttgcttccttcacaaaaaatcacaatcacattgctttcgtcttgtgatagcacatgctactctcatctttcttcttttataaggggaacctccgaaaagggcaggaagttcctgtaatttcactaataagaagaaaatacttgattcagtttataagaaaaaccgatctcaaaaactttacaacagcacaattaattaaataaaaccggccaaaaccctgacattatcaaattgagctaaccacgcagacccagacccactgacaaagaccagcggtccaataagggaaaactcctaagatgaagccttcgagaaggacacaccgacagaatggcgagatcgcccgatccaaacggatataaggttttcacccagagagatccctttaggtggtggagaaggtaaaagatgcccaaggatgtcgttgctagcgtcggcaagccgcaaaggctttcgcctcagagtcccatccaaccaccgcgtccacgaagaaagccacttaatgccacttgcacaccgaaaaccaccacctgtacaacacggccactgaggcactggtgctcaccgatccgttgaaagcatccgtccgtagccccggtcgccttccaccaccacaccacaccatggagctccacagagagaagtgggctaaacgaagagcggccatagctcggcagagcttgccaagacgacctacgtcaccaccttgcatgtcccacgcggagctccacgtcaagccgcgtagctagattgtcggatccgccggacgaccaccagttggacagtctagcctgctagaaaacctggacctggatctagatcttgagaaaaaacggaaggggaaacagagagggaaggaggaaggggaaggaaagacagatgaaggatgagaggcgccgccgccgcaggtggcgagccgagaaaaatagggtcaggagaaaaatgagaaaaggaagaagggaaggaggaaagggaaaggataagggacgaagggagaaggaggcggggggtgggggggagcctactactcggcgttggtcacctcccgtgagtcgtcctctattcctcttgtctttcttcaattgttattattgtcataaatcaggagaacataggattatgtagggattattatgtaccagcccggccgggcagatggaaccgtctgtcgaattcagtaaaacaaagttccaggaagcagatataattcatcatggttaatactttgattggttgcaataaactggatggagttacatgctaataatttaaaaccgcaagcaatactagtacttgtttgcctcggctttggcggccttccaagggcaaacacattcaatttggtcctgcaaggccctcatgctctccgcgattgcaatgcaagtgcaatttcagaaatatactactacttacaagcaatactactcaggaatgactcaccagatatttactcaggccatcttttcggagctgattgctctcctccctcactaacattcattcgcttcaatcccctcagtgccactgcaacaagctaatgaggcacacattagattgcgcaacaagtgaacacagaaactattatgcatcaatcaaaaatacaattctatgtgacttcaccagaaaatataatgactgattgttcaaggaactctgggaaacagttccacataaatgtttcttactccaaaccatttcaggttaatttcttccaaaaaggaattggtctacagcattcaacctattgtgcctagtggttagagattatcctcccagtgacaattaacagcacgtcaaggatgtgctactggaaaaaaaagcatgacactgtacatgatctggatgcatcatcgcattgtttcgccatgccacaagaattgtagtactaatccataaagggattgaaatagtgagcactcaccctactgggaggttcattttgtagtctgggacttctccgaggctctgcattctggttttgcaaataggactgaccactttggagaagagacgatggactctggttttgcaaaagcgataccctcctgttcgagacatcagccgacagattctggtgcggcaaataggacagattgtgattttgcaaattgggtagattgttctggacaaaggatggcatggtctggttcttcaaatagggtggattggtcagggcaagagatggtagattctggttttgcaaaacgggtgatctgtcgtggacaattgatggccctgaagtgttatctgcatggttttccctagaaaatctttgtcgagtttcttcggttggagtactagtaatagcagtattgttgcgtgaatactgagtggcggcagctcgagctccggctatggcggcagtgacactgggagatttgtctagtgcggcggaccttgaggagtgaagttgaagagatccagggttgagagagaggggattggtggggtcagggagtgggaaattgacaggcagtggaccttgaacaggtgaaagacccctgactgctccctcatagatctgtgacatgacagaaagaagatgaacagattcattagaaggacaagtgagaaaattaagcagcagctgcattgtttatgcactgtgatctctcttatgttatttagaagagaagagaggacacacccgtctctctaaattgtaaacaccctggtaaccacgcatgtcgaatggaaccaccagtttctgcattgcattgcataattcgcattgcagcaaaaaaaaagaataatacaattaagcaaatttagaatgaaaagaagtgcagcgtgaaatactagtgagttgaggtgacctgtgggttttcacaaagccagcagaagtcggtcaatgcttcgagcctgacctgcaggtagtgaagaagatgattggaattgggaaggtgcaggtagtagtaatagagtagggttgagtagatacagattggggcacatgttcccaggaagcaagctcttgagaggtgacacagcctaccacctcgacgcatcctattgagtagtagtaggagtatgagaattgaactcctagcatggtagttgcagttagtagtagagagtagcgtcgtaccgaggaggcgggagacagggtagtggtgcgggaaggtgatgttggtgattccgtcgagggcgtaaatctccctgtagaactcctccatggccttgatggtgtccgcctcggggaccttggaagccgcgtggatccaaagccgccctgctttcaattcaattcatcaatcttaatcttattaatcttggattggaggaggaaggaaggaaagaaagggatagatagctaccggtgaggggcgatggccatgagcggccctcgacgcgcttgattccgtggacgagcagcgacgcccacggctggtgcatcgtcaggcaagggttccggagccttcccccgccgccgccgcgcatgccgccgccgccgtgcttccaatccaatcggaatcggaatcggaatcgggattgccgtcgaatcgctcctactcctacctactctttttttttttttgaactttactcctacctactcttggtcgaggggaagaaggatcatctcatctgtctgctcttgtcttgggccaactgtgtactgctatttgttagttgggccaaattaaggctttgtttgggcccaacatatattatatagactgtgagcgtctgattttttttgatagatagtactcctagatggtttcttcactcttaattaacaactggaactactcgtttcttatacaaagtgagtctaacttaactggctagattacttgtggtggaactatcccaccaagtttaaattctagatttaatacgagtgctcacgattacgtctaattatttatggcagacgacgtgtttgtagtgacttcgccaatcttaagtcaatcactggattatcattcaatggataagaaagctgctatattttttaaaaaaaataaaagaagaagaaagaaaatcgcgtgcgcctgaaatctacacattcgatgcatagataacatcattggatagccatagattaattaagatggtctccgcaaaacaaattaattaatactcatacatatataccggcaaaaaaggaaagaaagcagagatggaatcagttcacattgggagtaggtactgaaagtcgtagtcgtatggaatgacgtcgacgaggtgatggatgttgagacggtgtccggaccacctgaggcaatcaaccatggatttcctgagagaccaggacgtgggcagctggtcgcaaatccagcgaacaagcgagtccaggtcctttgcgaagtcgtgcatgttggagtgtatgaggcttgggatcatcagcctcctcctcgtcgatgtcaccaccagcgatgcctgcagatactccagcttcgccttctccagatccatcatcacacgatcagccttgtatattcgtagctgcaatgcaatgcaaatccattagttacagttgcattcaacagctagctagcagcttaatggagtagtaattaattaccgcgggagatgatctgttgccacagcagagtgcgaacagaatgttgggttctgagctgttgagcccgtaacgactcctcacctgctgttcttccacatccacctcgcatttccagaattcctgcattctcgaatggatataatcgttgccagagccagagccacgagaagaatgaatgaatgaaatgcctcacttctttgacactggatggctgtctgaggatgaaattctctatcaccaaggcgttcaacttttgccctgatacattcagcgtggccttgttcttcagtgcaagtagcttttcagggtttgagggtagtccattgtgcaaaatcccctgaaatacaaagttgatttaattgtcatcatcagctagacagtccgtttgtgcagagagaccgattcgattcaattattaataaatactccacgtacgtacgtgcatgatgcaggtgttgtatatgttgagccagaaggcaagcttttggtggtgagtgagaaacctcaaatccacatgctgcagtgcctccagcatccccctgcatatgaaatgctcaacttttaattactaattagtggatctgctgctaattagcaggtgcattatcaggtagtagcaaataaagtaggcaagcattagtgtaagtacctgagcttggtgagcaggggagaggtggagaatcctctgaggtcgaaagcggaggaagtgaagctgacgaggttcttgtaggggcctatatctctgacgatggaatccgggatggcgaagatgccgtagtgatcctgctgccccgaccggcaatcctgctgctgctgctgtttgttcattaccaggctggtgtcgattctgaagcttccacctcctcctcctccctgatgctgcctggtcagtgaaggcgatgaggaagaggacctactactagcgttgttgttgttgttgtcctgctgctgcagctgcaggtcggcgaccctcgaggacctgagcagtcggatgaagatgcagatgaggcacttgacgatcctctccgacagcttgttgggctgctgcaccatcttcttctttttgttactactactactagtatcatcgagtgaattaagctttggactgggagtgggaggtttattgctgacgatggtcatgagaggatgatgatggcggcttgtgtcgaggccgttgatggcctgactgatgaagaacatggacttgatgttggcatgatctcctgctgcagatcctccactattaacattggcattgacagtgtcgtcgtgggtgaggttgattgcattctgggtagttgtggtggccgccgccttcttcatgcttcggatctgggtctccaggcgggcaatctcctcctccaccagcaccagctctgctagaagctccttggcctgcatccattttcattttcattctcattcctagctactccactaactcatcgactctgcttctggcttctaccttgtgcgggatgaatgcagggatgttgtggaggacggatggagacgacaatgatgatgatgatttggtggtgtttgagtgctgaagggcgcggtttaggatatcatgcaccgcctcctcgttccgcagctgcttcttcagctcactcacctgcttatattttataatgtacactgcttattgcgtctgctgctgatccaacaaataaatttaagctaattaattaattacctcttgctcaagtctctgccgcagccgccgcgcgggcactgttcttctgctctgtaattgaaattaaacagctagctagccttgtcagatactacaatatagtacgtattttttttcagagaatggattaccggacactgtcatcgatatgatcgaatttaattagctacaatggcaattaaggtggatgggacgggatcaatcatcagacctgaggatgagggtgaggatgggcgtcatcgtgagacgacggtggtggtgcagcgccggtgccggagagcagctggtgaagatggggcggaggagtagtgcttcccgcggtcacgtactcctccatatactatactagtgcactgtacgatgggatgaactagctagcgatggttcattatattagaaccgtctggcgggagcaagctagctaggtgaagaagaagaagaatgatcgatgatggatggatcgaggaggaagaaaggtagagctagagcttagagagagcagatggttgggagggcgctgtcgtacaaggattggcaggtgaggtgcggccgaagtacgcaaactgctgctgctatgtttgggcgatccgatccagggaggggaggggattgatcaccgatcgatcgatcacctatcctatatatatgcaagcaaccaaacacttctagttctagcttatgtggtagtcgatcttgtgctagtgccatgggttggtggcgtcatcgagcgcgcgcgttacatcccatctacatttcccattccaattttattttaaatactactactacgactactttttttcccttccacacaacacatgcctatcttgccttgtaatccacacgcacaactgcatccaccatgtcatgtaatctctctgtttttcctctcctctccttgttgagtgcaacctactcaacaccgctaccttacctggcgccttcttttctctgcttattttctgtatcttagtgcagttgggtggaatcaacattttcatcttcactaaccacctgctatccgtacgtaccacgcatgggttttaccattttaacttttttttaatcatttatagctagcgtccgttatattcttactgttttcgacattcatctcaatatatacaagatggggtcctgcacatatatctcttctctgccatcttcaaagccaagtcatcctccttccatatgtattcccaccgtgtgtaacccatgcgctcgcggatcatacgtaattaaataactactgcatctaatgttttattctcaatcaccctcctactatatcctaatttatatgggcatggtccgttagaacgtatgagtatgttactggttacaacaaaatgacaatatatttcaagaggcctggatggctgcaaaatttcctaattcttccctctacaacgggtaggaaaggattattttcccttgttatcctataatttattgagtgaatggcaatttgggtcacattttattacacaagtttactttggaccacccttaaaccaatattttcactttggacccgagtaactttgttgttttctcggtttagaccaccccaaacaatttattcatcaccccaacctcaattaaattagttttgatacaccggtgaactttcccgtatatatcttcataaaaatggacggtagatatgaaccgtaaagagagttgggtggtccaaactgaaaatggtaaagttagtccaaagttaaacgattactttaaaggtggtccaaagtgaaactttacgaacaaaaggtggcctaaactataatttactctgatttattcatgcaagccaaatggcatatataaaaattaatccttataaattcaaattatttgttttctctgtgaacctaacaagccgatttgaacctaacaaattcaaattcctatctccgcccctctaccaccggcccagccccctcccccccccccaaaccgccgacccctcccggtagtcaagaagatcctcgtccgacctcggcaacaagagcgacttcctcctccgctctaaccccgcccacaagatccccgtcctcctccacgctagtcgagtccctgatcatgctccaataccatgatgacgccttccccgatacccccacctcctccctccgtcgaactcctcctcctccggcgaagccgacaccgcgtacgcgcgcaccaaggcaagattctaagcagactacgtcgacaagaagctctaccgctgcgggatcaagctatggaggctcaagggggagctgcaagccgcggtgcgatgcaagatggtggagatcctctggacgatggaggcgaagcgggagttcttcttttgtagcggcgggcttggcttcaccaatgttgcgctcgtgctattcacgacatggttctacagctacgagtggtgcggtgggttcagcatcaatgaggtagcgccaaagctggcgacgtgggcacgacagtgcatatagatcgactccatcgccaagcacctcccctcgccggagaaggtgcatgacttcatcagcgtcctccgaaataagtacgacgttaagtagatgggatctcaacatcgatcggtctccgtcgagtgattcatcgtgagatcgatcgatgcaaagttgcagggattgattggctgtttcgtttgctatgtcattggctttcccgcgctccctgccttgtcgctctctaggcacttactggtggagagaggagatagagatagagaaaaagagggtgaagtgaaggaagtgggtcctactattttttattttcttgtttgattgacataatgggccctacatattttttttaaaaaaatttagttttcaattttgttatttttttaatcaaactgcacgtcaatgtcatgtgggacgaagtcctagtcgaactagtcacgtaggagccagaaccggagacaatacaaccgaaggatttcatttgcactagttttgtaagttggtgttgtatatttttcggttcaagatgaaaattggactgagtgacaacttgaggagctaaagtgaacttattcttataaaaggccgtgggtttacccgcaaaaaaggggggccatggatcgttgggccgaaacaacacacaggtcatccggccgctctcttctttgggctggtggaattaattatagtataataaggaaaagcagaaagaaaagcgtggcacggcacggcgacggcgagcgatacaagaagaaagaaaaagtctcacctcggaacggaacagcagcatgtgggcccacaccacacgtctttcgtcgcaatgccacgccatcatcgatccctttccttcatcaggagttaa

SEQ ID NO: 63398 - DNA, 2059 bp, Oryza sativa
ccattgaaaatgttaaggcaatcacgacgaggggaggtaagtccactcgtgatccgccgtatcctaaccttgcaggaactaatgggatatcaaaagaagcgtcatctaatgactcggctgacaaggagattcagccagaaaagaccgtgccgcaggagtactgcgacacgcggttgctgctgtttccccaacggattaggaaaccgtcagtagacgagcagtttgctcgttttgttgaagtaatccaaaagattcacatcaacatgccattgttggacgctatgcaaatgccgacatacacccgttatctcaaggacatactcaacaacaagagaccgctcccaacaacggaggtggtgaagctgacagaacaatgcagcaacgtcgtactccacaagctcccggagaagaagaaagatccgaggtgtcccatgatcacctgctcgattagggcacaacaattcgaccaggccttgtgcgatcttggagctagcgtcagcgtcatgccaaaagccgtcttcgacaagcttaacttcatggtgttgtcaccgacaccgatgcgcctccaactggctgactcgttagtccgttacccggcaaaatattcatgtggtcgaagtggagccacccaagacggacagcctggtgaaattcatgcaaaacttcctggagaaggaaacaacaatgcctaggaaccgctattggaggacgtcggtaaaatcacctgtaccggccaagaagttagagcagccggctcagaagaagccatcttccgcaccaaaatcaaagaaggtgtggaaggaaaagccgaaaacgcccgctccatcacctccagagacgggtagaaaatccgtgaactaaaccaaaaggaggtacggtcttgcacgtcggactttaaatgacgcgaccttcgccaacaggtaaattggtatgtatccgcatatttgctttcaacaatttgaatttttgcatcatcacatatttgaatttcatatttgcatttaggatttttgaattttgaggaaattcttcaaatgaatttttcaaagcaaacaaaaaataaaattttcaacaaaaattgactgtgccacgacaacactgaccgttggaatccaacggccgaaagtggggccggttgggcccaccaggggttcggccgaaccggccaggcaacggtcggctgcctcactttttgaggcaacagctagtgggccccacaggtcagttttgaccgttgtgggtgcactacttaagccaaccgaccgggagaagggacttcaccccatttcaacacattttcatcccctctccaaagtttgctatcaagttcattcaagctttgatagtttccctcaaattcaaaatagtttagttgcatatataaaagttgctttggtgaaactaaccggcgggtgaaactcttatcattcctaacccccgccgagtttgcatatgcaattactctatgttatgacgatgatattatagtagtatctggtagtttaggcgtggtgtctagattacgggatatcattatttggggttatatattgcggatgagaggtgggccgctgatggtgacagctcattacgggtattcctccacaccggtatataatcctaagttaattccctggggagggtatttctccgtatttagccctggttgtatggtcatgacgggctgtcgtaaggaactcgacagtctggggtggcttctcgaagtaccaggagggcatcggatagagggtattagctagtatatcggttaaccagaatgtatgtataccatgtatattagaagtatagaaatagattatatttctcttttctgtccacttagcttagataatatattatgagaatgagtagctaaaacttgtgtgtcactctacccttgtattatcttaaccactgcttagaatatgattatcacaagtaatatataaattatttgtcaagttctctacatgatcttcccatgggataaaataaatacgatacccttggaatactctcggttgaaatgctacaatggtatatccgtgcgcttgcgaat

SEQ ID NO: 63399 - DNA, 850 bp, Oryza sativa
gatgatattagagtagtatcgggtagtttagacgtggtgtctagattacgggatatcattatttggggttatatattgcgaataagaggtgggccgctgatggcgacagctcaatacgggtattcctccgcgcctatatataatcctaagttaatttcctggggagggtattcctccgtatttagccccggttgtatggtcatgacgggctgtcgtaaggaactcggcagtcaggggtgccttcttgaagtaccaggagggcatcggataaagggtattagctagtatatcagttaactagaatgtatgtatactatatatattagacgtataggaatagatttcctttctcttttctttccacttagcttagatgatatattatgaggatgagtagttaatgcttgtgtgtcactctaccctttgattatcttaacccctgcttaaaatatgattatcacaagtaatatataaattattagttgagttctctctacatgatcttcccacgggataaaataaatacgataccattggaatactctaaggtgaaatgctacaatggtatatccatgcgcttgcggatgaactctgtaaccataatataccagaaatatttctgcgccattgttgggaattatatttcttgtaatgccgttaagaaataccaacaagcaattctggcgccgttggcggggaagattcataatagagattacttgaactaatactttatatttacctctgtataatcatttcctttgcaggctaaccttggttgttttcactttttgttgtgaaaacagagtagtgcatgactggtttcaacttgccggaaaactttaaagaa

SEQ ID NO: 63400 - DNA, 3364 bp, Oryza sativa
tccttgtgtgccatttcgtcgaacaggttgcaggcaggcggtattgcggcggtgggagaggaggcggcggcagcgtagaaggcgagcagggagcaggccaggacgggattggaggccaccaagccgcgccggcatgcctgggcgtgtatctggtaggccaagcgggcatcgcagcagcggaggagggcggagcaggcgagctcgtcggcggcggcggtggtcgggtggacggcgagaacgcggcggaagacagtgagcgcggcgtcgtggcgaccggagcgagcgtggtcagcgacggcggcggcccaggaggaggcagagcggcggaggcggaggcacatatcaatcgatcgatatgggttcattgaattcatttcatttcatgggttgggttgggtgggggattgcaatgcagactgcagttcccttctctctctccccctctctctctacaccttctctctcctcctgaaccttgcaggaactctctctctcaaaaaaaaaccttgcaggaagaactgaagacccaattcaaacaatccacattttgtgattttgatcaggtaggtcagtgctccagatcacctgaggaccaatttcttcgattcgagttgggaaatgctccctgattatccatcatttgcaaccttcaccaacatctctccaacaaatatgcctctccaacaaatatgcttctccaacaaattatgcttctgcagcgaattctccactcatctctctatcaaatgcctttgaactcattcctgcaacaaatactagtatgccttcatttattgtgcattttcctgtcgaacaaacaaatcgtcaattgcaaaccatatgcaacagaactgcagtagagtagcagcatcttctccattctatgctccgctcattaatccttgttcatgtatacagcatgtattatagtagcattcaacaaggatgcactcacagcatctcttacatacaaggcaccagtgcattctcatcttgttaaaaaaaggagaaaaggatcttaaaaacacagtgagcatacatcacatgggacaaaatgaatttccatatatatcctcttaagtctcttcctcctcttcctcagatgcatcatgcgcgccaaacagcctgttcaagatggcctggttccatcctaatcgtcgagctgagcttgagtgcaagattcttgtggtaaagttgcgccacttagaggggctgttgcgaccatcatcccctgatgactcaccatggcacacgccagatctgcgagtatctggatagtacttgaggaccacaccgttcttgtaaggatctactcctagttcccgcggcagtggaatccccactatttggacatgagatatgctgaaaattagtacatgtgccacattgtcagtgcaacgaaacaaagttcagaacaaaacaataactcaacagtacccaactcaccatatgtaatatagatcatccatttcctgtttctgaaccctaccaagaaactcaatcttcacaactccaccgatgcatagaactgcgcgtggaagcttaaaagactgaaggacactttcctggaatatggtacattatttacattcagcaagtttgcacacgagaactgcaatgatgtattgacctatatatgttggaccaggaacacaagatttgcccctctacatctagcacattcaaaaaactgctaccaggatatgtagggttggtttagtagggcaatatattgtatttggtttgttaccaaccaaagtgataaaaaaaatttgatgctacaaaattttggccgattttttttaatctaagcacatgcaacctcataattccaaatgtgagcatgtattgtcctgaattctgtttctaatcaaactagctagcaggcacaaagcaaatgatccattaacatgttttgctagtattacaattaccctttgctgatgcagcttctatgtgaaacaaatcaagatttgttagcacacataatattatgattttgatgatccaagcagatggattatatttcaaccggccgctacagttccaattttcaaaacgaaaacaacatccaagtcaaatatggattaagaaaaaaaaagacgaagaaagctcgagactaacggcatgacggcacggtgccctatctcgtaatggttgatccaaccaattgcaaatggtaataagattttcttttctgacgacaaacaatcaattagacctaaacaagtcgctacgagctagtgatttgtccaatgatcagcagccattagtttgttatatttcgtttgacattaagtccgatggaagaccactgcacacacatgtgggcttcttgattaaaaatagaattccatccattacctgctcatatttggaattagaaggttgcatgtgcttagatgtgaaaatttctgaaattttggtaatgtagagtgtgtttgatttgctagcaaaaattggtaaaccaacccatacatgccaaaaataaatcctgcatcaagaatgcttagtttttaggggaggcatgtgacggcatgaaaaacactgacctgcagcattggaaattgtggagatgtgtacgtccagatatagttgtcatcagcagccaactggccttcattatcatgagatacaagtaattgagatggtagaggtgtctttgggtaacccatctggaagcggacatattttgcggagtatattggatcaccatactggaagaaagctgggtgcaagagacaggtaatactagtatttagcaagaggagtaaaaagaaggaaggaggatgggtgggctgacctctgaatggctgtatgttgatttgttgaacgaggcatagatcggagcgaagcctgtaaaagaggcattcgggcacagcaggatcgaagtggccggcgctggaccaataagagggcctcatcatggccacccaatcggtgggcacaagggtgttttgtatggtctcctcagggaaattgtcggtggtggaggcaccgatgcagcggatgatgcagtcctgggggtcatccaagagaagggcatagctgagatgcatgtacgccctgtgctggtgctccgcatccgactcagaagcagaggcaatggcttgtttggtaataatacgggtgaagtttgaagcttcagggcaaaggcgcaggcattggatcttgctgaagccattccgaacaactgagggcaaggacagcaaaaccagttggtccaatatactactaatttataaggattaaggatggagaaatcaatcaaaaaattggagtacttggtgcaattaagaggatatattactactataccgagtatatattattgaaggatgaggaaagagaagagatgggggta

SEQ ID NO: 63401 - DNA, 3814 bp, Oryza sativa
atggtctccaactccaatcgaatcgctcgcgctcgcgctcgcgctcgcactcgcagtctcgctcgtgtgccgatttggatttgccgctcgcctcgcctggaactggaatccaacaacaaaggaggaagaaatggaaccaggcgtcactgacaattgggccccacccctcttctcttcggtcaaactgacttgccttcctgccttacctctccttcattccgcttccacccaaatactacttataaggtaggaggagtttttacaagtgatttataatttagagggataagactattaactgttttgtttaatttagatttagaaattataaaattttaataggatggagataaggaattggagaagaaactctctcctttccaatacctaggtatggggtgataattgggaaggaattcctcctttactcgacctaaacaaatcacaaccatccgttttcattaatgacttaatctccaactaaactccctatcaatttccctcgcctttaccaaacaagatattgagattaaaaaatcaaatttctatgatattgggattaaaaaatcaaatttctatcttaatctcatcatcaataaactcctaatcccctttgctcgagttgccaaacacgccgctactactcctataagtgtagttgtggtttttttttccaacatttcaccgtccatcttatttaaaaaaattatagaaaaatttaaaaaatagtcacacataaagtattattcgtgtttttattatctaatccgtacctaattaaaaatgtgaagcttccagtagtttttggtcttttttttctattttttcccgattacgttgtcggttttttctccttctgaattttgttcgctgttttttttgccttataatgatttggtatttttgtcatcctattttttcccatcgctgggttttcatgttcgatcccgccaccgcaggccaaaccctagcgccgccgcaacgtcaatatgtatccccgtgcgtttctcaaattaattgcaaaaatcaatttctcaccccctcccccattattttcctcatgatttccactttcaattcgactttaatttgctggatttaatctcatttgttgatgatggccggccggcgagcttccctggtcgtttttatcacgagttttgtggatttgcttcgattttgagaaaacgaaaataggagatcgaggggaataaaagccctcaatattttcggagttcgagaaagattcagtcggatttgatggggagtatcggctccggcatacgggcacgggactatcttccggtcttccggatgttaaagacggtagtcggctatgcgagcagggcctgtggctccacttgtgggcatggccgaagtgaggcagggcaagtggagggaggtagaactgagctagggctgaaatggaaggaaagaatgagcttttggccttaaaaaagaattgtcattaactttttcagctataatgtatagcaattctaatgtttcaatttatttctcacctcctaatagttgttgtatcactgaaaaaacatctttgcatgttgcaacgcatgagtattttttctagtagcaacaaaatcatgtacggttttggaacatagatttttttgaatagaacgaacgaccgtaacggatgttggctcaatccgagggaaattatgtggaagctttgcatcgattactaaaactagactttctcaatttagagacttaagagcagaagaaaagatggaaaaattcaaccatctcccaaaaagagatgtggcaatcttaaagagaaaattatctaccaaacaaagatatctcggcgggatcaaatatatgacccaattatgtatatacgtaagatttaagaacgaggtgttttaacgtaaggcagaaggcgcgaagagcccgggctgctgctgtaggatttgaaaagggagtcattgtatcgttgggtcggaggtttgctccagaaaaattcggaacaaaacgtctaccgcgttgaagcccacagccccatggagtccgattcaaccaggaggattacgccatgctaatgtgccggttcttattcgaagaaccttgccttttgtttagcttgagactcaatcattgtggctctagtatgaatctaaggttttaattgaattgattcataggatcgcaacaagataatttctaccagaaaactaaagattcaaagggttaggtttttctttttttttctagggtaataaattcaaagttataaaattcaaacaaagatactaatcataaaaaaaatcaaataaaacaaacagtcaaacattagacataaatagtgtaaaactgcagtccatctaggttagtaggattgaagcacttgtgcctatcagcatatccgatgaatatatttatctttttttaattgaacatatatattactcattattgtaaacacaatattatactttttctgtccccaaatatgttagcttttatacatggatctagatccgttgcaacttctctgaaaatattaatattactcgagtggtacttctttcccatgtttcaaatactcctgacaggacctaaataagttattggacattctcttaatggtttctattcagatgagcttattgacggtaccttttctagaaaaggtcaataaattccaaaatctatttcgccctcgagtagcaacaaaagttatgcctagattcgtgtacaaaaatgaacttgttttcggacaaagggagtatacctttgttttggcttccatggcattttacctgtggcttaagattagctaggtatatgatttcaaagtcacattagtagctttaattataaacagagtagaaaactttgaatctacaaaagacaatattggttgtagacgaggtcacccgcgaatgatacaggagctagctaggttaagatagagataataaacgatataatgccaccatggtgttaattaataggcttgatgatggcaatataataggaggcagaccacttagtgatggttgagctaaattgtggtggctagaattggaatgagatatatattttttttattacatttatgttattctttcttttcacacaagaagggccgctataaaagggagagttaaatgaccctagtgtgtgtgtaaatgtgtttttaagttgttggggattgatgtgtgttcccttgttgacatatacaccttctacatgcaatacttccatgtccttttatcttcactaggctaaaaaaagtaaagaacataggccaatcaaagctcttgacgcttggtcacattgccacccctcctctttccatcgccgagttgctcctcatattctctccaaaattaagtatacatcacaagttaggggcctccatttggtgttttcatacgatcgagggcaatgccagatcgtgagatttagctataatttatcaccctctttcttggctttcttgatcatcaccgtgttcccaaatattacagacataagttggtggtatcgattgcatcatgggatagaattgatgtctacaattttggctcgataattccatcctacgcaatggtaatagcttgtttccttattgttcttgtttctttgaatatcaaaacttattattgcatagcatctttcttttctaacatggtgttaccttgacttctgttgaacattccacatattgttagacaaaaaatatttgacaaataatgcatatgagtcgaatgcatttattacgctatgtataacaatttgtaccacaaaaattcatgtatgtgcattaacactttatgatgca

SEQ ID NO: 63402 - DNA, 27590 bp, Oryza sativa
  unsure (1)..(27590): unsure at all n locations
tggaccccgggggaggcaaaatagacttttgcggaggaatttgatttggaaggatttggattcgggattgaactcgacgatagatcggggatttgagatctgagatggcacggacactagacaacagcaaagaaacaaatttcgcaattagggtttttaagagataattttcccgctaggcgccacgacggaacgggcgctacatcagtgaaattcaataatattcttgagaatattatttctataaattccataaaccatttctcgtattccagaaaattccgataaatctttttcttgtccagaaaatcaagttaagcttccaaaattcatatctcccgatccgtaactccgattgactccgttacacttcctgtaattctctaaaattgagatctatctaatggcactattaattagtctaaatagggtttttcttttggtcttttgtttaggttttcgattgtttgcgtatagtcgcggttaccggatttttgtcgatcgtgggatttctcgaagattcgtgaagcttcgtgaagactttgagcaaggcaagtcaccctttgaccaattgctcctataattggaaaatcattattattttgtttgcaacttgcattattagaatcacccgtttaacttgcttggcctcggtttgcatgccaaaccgacggacctacctagtagtcgcactaattcctgtaggctgtactaccctgattccttgtagctccacctttgtggtacctcggtatccgtgctctctgagcgcgtataccaaatatcccacatacaccgttgtttgtcgaaaacttgggaaatgggtttgagaagccttgaaaacccgacatgtggtgtcggcgtgtttgaaaataaaataaattgtgaaaactcgcgatgcaggggttgtgcctgtgtggcactgtcccgtattcgcatataaggactgattcctgtgggaacttcatccgagcatataacaagtgcgaccacacgggtgcaatgggacgcccctggctgagtaaatagcaaaccagggaagccttgatgccaagagacatgtggattcaacggggtggtgtcgggtagaaccctcgggcttcctggcatagtatggtctgggacctaacctgttgtcggtctgggacccctctcgttggcatatggcaaccctgtgttggctttcgaaatgccttgtcatgaaagccttaaggtctcccgacgtggctgatctcacgggctgggtgatccgggttagtaatgtcatgtgggtaaagtgtaccccctctgcagaggttaactaactgttcgaacagccgtgcccacggtcatgggcggatgtgaggtgtttcctatagcgtagatttgtttgcctgtgctttgtaaaaagttgttgtggtttgggaatcgttaccagaatcagtctatgtggcagaggatgacctgagtggtcaagaaacgaatctgtgtgattcgggatgtctgcgggcatcatagactaggcttcccgagtggaagcggattgttgtgctgctaggcagctggactctgggagtccgagaaaatgaaaaagctctgggagccgattaatcaagtgaaatggctctcggagccgagaagtaatgatctgacccgggaggtcggtacagtaccaattgagttgttgaaaagcatctcttaagtcgatttgagacgcaagtctcttttcgacccaaacttaaaaagaagtaaatcacttagtgatttcaaaatgatttcaaaattaaagatttgcaaaacaaccttgcctctcttccaagcttgcattaaacacctaaattcccgtgacttgctgagtacgaaagtactcacccttgctctatataaatatatatatatatatagttcctccgcctcgaagtgaagatgaagtgaagtgaagaatagggtttcgtcctggttcccagccttcgcctgtggtgttgggtgttagtccgttggttccgctgctgctgctgttgttggtgtttctcgtccacgtcgtcggttgcattctcgggctgttctgagttgcaacctaagttaaggtaaataagtcctctatttattttaaggattgcaatgattcatattcgtcaccgtgggtaccagcgctatgtcctgggactggtactgagatcgcggtttcgtaggaagcggttcgcgccgtttttcctacgacacgcttctattaggtgccgttctacggtggtgccagattggggtgtgacagagaggtgtaacatcccggcctagcgcttaataggattaatagaatactcatattaacaagttgcaacttcttttccagaagccgatctccaaagaactccagggttaagcgtgcttggcctggagcaatttgggatgggtgactgaccgggaaattcttttcccgggttcgcacgagtgaggacaaagtgtgtagaaaagacatgtgttggtctgtgagggcagtctatgacctatgaaagctgccagatgtaagtgggcccggcctgggagaggcgggtcgttacaaggtctgactcgtagtcgacaacagggtagccttcctcctcgaatccaatatggatacaatccgagtagtccttgtcgtttacatgtagaactctggttgtctttccttatctagaactctctcgaggtcagtttctgtataagacatggtatgtggtggatcgtggtggatcctgccgagatttagtcaactactattaggtatgtggtatccataaccctgacagtagcccccgacttcgatgcaaatgaacgagttcatattctcaaccgcagactttggaggaactgttatcgagctcacgtgatcgttctcggtgagtttagagataacattagatttcctttatcagcctcgtgcaggcaccgaaagggtttgtctaagtcaatctctaatgccgaccgagaaagtacagagcatacgactaagtctcccgtcttgctgtaatcgagaatttggattgaactcaagaaattttatctcggcgggtacaccatctcttcattccgtattccttgtcgagatccagcaaccgttctcgaacaatcgagaaggcgtagagtctgcgacagagctttgtcaacattggtcgtactcgccttagtcgatcttggtgtagcactatagagacatggagtcttcgtcaatgtcgcatagaattttcctgaaatcaatactcagaaaagaatatcaaatagaaatagcccctgagcgaacgctcaaagggtgacatgttataatatgtatggaaaactgtaaatgaattaaatttacagatcaatgttttgtatatgagtgtcttctctcttaccgactccgatcagtcagtttgtagagtcatacactctccctagcccccagccttgtcgtcagagaatcgttctcggaggataaggctcttggacccttgacctgccttggttgaacaagcactgatcctagcccccagccgtgaagttggaaagttaatttccgattacacggcttggttaatacgcacggcgagaactcttacatgaccaggtcttacatggtctttcgtctctacaggatctgacaaggccttatcggctctgggcgtccccagccgaagatcccttaggttcctcggaggccttgttaagacggcgtaaagggacaataggataggtttcaacgctaggtgtcatcgtggtaagggatctctgggtaaaacacttggcgatattatgtacctgctatcaactttgttgaagtagaggtagtaggagaaatcgctacaccgctggtcgaggaccagatagtagtcgtaactcgaccacttaaagtggaagtagtgggagaaacgctacatcgttggtcgaggaccaggcagtagtcgtaactcgaccacttgaagtggaagtagtgggagaaatgctacatcgctggtcaaggaccaggcagtagtcgtgactcgaccactccaagtgaggcgagagagatcactacgttttactggttcgagaaccaggagtaggagtctcttaatcacctataggggcgctaaagttggtttattacatgtgcacatcatgtggccagcatgactcacatacccaacttatagcatatcctgatgtctgctcgcaatcatgtcgggtgatcaagccgacgacgttcgcgaggaattatccattaacaaccttttctcgagtagtccagcgatggccggtgctatgagataggtcgtcggtcttcgttgataggttgggtgcgataactccgcatttgtcaagaatgttctcgataatggagtgtactcgaccacaacctactcgagtgctcaattgttcctgaaaattattttctagaaggcaagacatatagcagataatatcgagtatgtactcaaaaactgcgtggatcttctagcattatcaggatataacgatcagattaaatatcaggcattatgtaaaccgtaaacaagcatgatttatacagaagagaacggagcgagcccccagcgttagactgtagttgacctgacatcgaaagcactcgcacaatagatattgtataaaaaacatgctctaggtaaacataataaattattgatctgacaatgctatatgatctgaataggtacgataaattgcatataaaatattgcgtacctgtgtagatatatgacggatatatctacggaattaatagattaatttaaaaaaccaatctaccaattaccttactgcgtactcattcgatatcatgtgatctgacatctcttggtacgccgcggagcttgaggcttggtcgatctcgagagatcgagttgttgatgacgatgattccgatctcgtcgggggacatactccggttgggttagatctcctatagccgaagttgtcgagtagtatgttgtcggagaatccatcttcttaaacccatctcgtcgaaatcctagatcaccaaaatccccctacctggcacacactgtcgatgtttggtgtcgcaattctggtatttgtatagtatggggatcgtcgatactaggatatacgcgagactgaggtaaaagagacggagacagagatttttatacaggttcgggcccctgagttgtcaagtaataaccctatatcctgttggccgaagccggtattgctcttattcaccataatcacaccaatacaatatgtgggtagcctatctaactattgtcgacatgtcagtctgaaggtctgactcgtagtcgacaacaaggtagccttcctcctcgaatccgtgcccggcgagattagagagcgctttcgtctctcctgactgtatccggagacaccataggaaactagccgtggctatccctaaagtcgatatccggcggcttgtcttggcgtatgtaggcttgtatgttgtcccgtgtattatgttgggtgttgattgaggtcgttgattgtctgtgttgatcgccccatggtgggtgtccccctgtcctcctaggggggcttgtatttatacccataggagtccccttgtccaagtagaactagggaaaccaatatggatacaatccgagtagtccttgtcgtttccatgtagaactttggttgtctttccttatccggaactccctcgaggtcagtttccgtataagacatggtatgtggtggatcctgccgagatttagtcaactactattaggtatgtggtatccataaccctgacaacagtcattgacatgtcggtcccacggttttcctaattttaagtgccacgtcaacaccacgtaagcgccatgtcagcctaaactgccaaaaccgtcttaggaccttatttgcactggttttgaaagtagagggacgtgtcatatctggtattgcggttaagggatgaatttcagactcgatgacaaattgatggacctaaattatacattcctattatatcgtcgacttctgtctacaggattttattggacctaagccgacttatgcggggacaccaatgttttaaatagcgggctaaggcatttagcagtttgcttcttaaacagctatagctgcagctatagcaggctaaatggagctatagcggctaaattgtacatgagagcaaatagctagaatccttctcaaacatctatagcgggagatttaaaaccctgggggacacctaactcgcgcgtacaataaaataagcgcttagcattaatcacactggtagctttataatataaaataatataaaataagttgatttttttctaatttaggttgaaattttttaatgtgagctgaaaattttaattttgaaataggatatttcaaatttttagttgaaagttttaaattttaaatgtaaagtttttaaatcttgagttgaaagttttcaaattttggtttggatgttttaaatttgacttgaaagttttaaaattttgagttcaaagttttaaaattaagttgaaagttttcaaagtttgagttgaaagttttcaaatcttgagtgaaaagttttagtttttattagaaagtttactcaaaaatttgaaacttttcaaacttgattcattttaaaatttataagtatattcatttttttcaattcattttgaaattatttacttctaaagtattattcgtttaagttactgcttattatgtgcaaagatatatactgttaacttgcaaatatatgcttagcagaaagacggactctgaaataaatattgaaatcatcaatcagtagctctcaattaggcatccatgcatacatcttttaagcaagagaaaggacatgtatgtggtcaggcgggcggtcaagcttgaagactgacttacacgttgaccaaaaaagcacgcctaaccaactcaccccaattaccagtataatccttccctccctaaaaagaaaaaaaaaacaattctgttaattgatgtacctcgcgggagtactaattaattgagcctctgcctttcaaaagtgtagtgatccagtaaacaattctatccagccaaggcatgcatgcagatgagaaatgcatgaatgataccatctggtctcgctgtctggctgtttgatgagccctaattaacatcacatatactatttaatttaagcaactgatgatgatggaatgaataacccagcatatagtagtatgtagatatgtatagtggagtactctagtagaagatgcatatgatggaaaaagaacaagggatttttttttaaagacgagaacaaggaattgattcagctaatgtagacatatatgcatgcagcatctagctagccaagtcatccatcacatcatcagatcgatcagctaaccttaccttagtagctctctggttaattaattaggcacacgtggggaaatgaatctgtcgctaaaacggagtagtagtagtaagtgcacaaaccaatcggccaaaaaaacggggatcgatcgatatatactctacattatagactccttaagtccttattatatgatcgatttccccacctgaagccggataatcatgaaatagtccgcacaaattaatttcagtttctagaatctgaatatacacagatgcagaatgtgcatgcacctggaattaatcctgtacatacgagaaaacaaataatatgtcacattttgttctaaaacactgcgaggtggcattttaacggaaaggcaatatgcgtaatattttatccggtgtattgatctagtgagtggtattttatccaaatcacaagaatggagtgacatatcatttgttttctcatatatattattaggtgacggattcagaaaactttttaggcctgggcaaacttaataatagataactagcacacacgataatccatataatttaccattgatataacacatgtgatgtagtgaggtttaattgctttgctaattttcttgttaatgtggtttcattagtttgtacatgagtttgattagctaattttcaaaacaattacatagagtattgtgtactccctcgattttacactataaaatattttaggttttaaataaattcatatatggatcatgtatgtgcttcgtatatgtatctaattttatatggatgttagtgaatttagataagagataaaaagatcaaaacatcttatagtatggatcaacgtggaactaagggagtacctactactaaagatcttgcatagtattttgataagatcattgacagtaaactaaggcctcctttgaatcaaaggaaaaaaaaccataggaattttagagcattttatcatatggaaaataattctatagagttctttgaaacaaaggattgtttcctatcctttttttttgaaattcctatgaaattgattttactagagcaattttagaggaaaataagcatgattcctcttctcatgttttcctctccatatgtctaagattcttgtgtttttcatttgtgctaatcaaacaataggaatcctcgtatgttttgtttcggatctgctcagttgagtcaatctgtgtctcactgtcttgttagtgagtgggtgtgtgagacagagaaaaaaaatcatttactggttaataaataatgaattactccaattaattgtgcaagttgcatggggtttggggagggggaaggagcagagcagtatatataaaagggcaaagcctccgtccatttattcatactcgatctattattcggcggcggctgcctctgcttgcttgtgactgtcgtgtctgtgcgtgtgtgtgtacgtacatactccagtatatatatgcattgctgcatgtcgcttcatcctcaccgccgccacggcgacggcgacgtcgacggatcagcatcaggatcaggatcagcgcgcctcaccgccggcctcatcaacttcctcgaatcgcgtcgcgccggcgccatgagcaccaccaacagctcatcctctgtctctgtcccagccatggacgcccatggacaggaggaggaggaggagccgatgcaggtgcagcaacagcaggcgttccgcggggtgcgcaagcggccatggggcaagtttgcggcggagatccgcgactcgacgcgcaacggcgtgcgcgtgtggctgggcacgttcgacagcgcggaggaggcggcgctggcctacgaccaggcggcgttcgccatgcgcgggtcggcggcggtgctcaacttccccatggagcaggtgaggcgttccatggacatgtccctcctgcaggaaggggcgtcgccggtggtggcgctgaagcggcggcactccatgcgagcggcagcagcggggcggcggcgcaagagcgctgcacctgaccggcggatcaggaaggcggaggaggggtgatggagctggaggacctgggacctgactacctggaggagctgctagccgcctcccagcccatcgatatcacctgctgcacaagcccaagccaccactccatctgatctctactcgtatttatcacacgcgcagaggatgcacatcttctgcactacacttgtactagcagtggttaacatgtggatccggttccatgctctgattgttgcttatatttttcaaggaatataaacaaatccgatcctgagttaattagtgtaaatatatagattttgggtttcaggattaccatttttatttttggtggcaccatccagcttaacattgctccgattcacaaaaagaaaaagaaaacactcctactgtacatatacatatatgggcgagcaaattaaagcgggaaatgacgctgtgtttgaaatcgtctaatctgggcccttgttttggtttgctttggtccatggacagattgacggtgctgacgtcacgttgcatgaaagcgaaccgaacgcagatgttgacctggtcaagtccaaagtccaggaggcacgcacgtagtgattcacccacgtgcgtcaatttttttactcactcaaaagcacccagcaacctaaatagtgccctacaatataattatattccctctactatagcactactcctatgcaaaaaaagaagaagagagatattcatttgtaagattattttctactccagcaacttctcttttttagattatccattaccttaaaaaaacaacttttacagtaagtaagacaaatttgtaaaagataatagcctcaagattaaagacacgtggcaaatagatcatttcctccgttggtttgtttgcccaagtgcaatgaattgaaccagattgttgacgaatggggaggagtactggcgattaaaggacgatggatggatcagagttggcaactgccttttaattcatcacatgtggccttggtttgttgctcccaaaacaaaaccaaaagaaaaaaaaaagtcttgttgcctttgactcgaattaggagtattaacaattactagtagtaattgataacaatccttttgcttctgtaaccttctttccttcattctgcgtgcctgttatatatgctaatgctatcggtacaagtctagaagattgagaccgtaatactcttttatcttctctggcctctgggatgatgaatccggcagctcttccccaacttaactgtcatccagttcagtttctttaaagacgacctatctcactacacgtgcgggagttgttattatcacaaaaacataccgtcacggacaaattgtttcaaatctaaccaggcctttggaacatatatatgaatttcagaggattgtcggaagaattgcaataaatcctgcaaaagaatctataaaattcatatagtatttctttaaaacttattcctagcttattagtttgatgaatttcgtaagtatgtttgcattagaaattggtggtcaaattaagattatctaaaatgttgtgttttcttttggattgtgaactaatcgagtgagttgcatgctggctgctgtcttcatcaagacatgtataaaatcgatggaaaagccagaggtcgtggtgcaaaaccatcggcatggagtagttctcagtgtcacgtgaccaaaacaaaaaggatcatttcaatttcaataataataattataatactcctccttgattggtgattgcaacctgtccttgcttaccttggagacgaagagcatatccgttgagcttgcttggaattggatagcctaccatgcaatgcgtaccgctcctgcttccttgctgccgtaacttctaagaagcatccaattgaacacgtgcacgctagttgcacccttttttaaaacatttttaaaagaagaaaaaaaagtggactagtagtataaataatttctaggaaatacagtatatggtacacagcactagcattcagtttgacctgtacctagatcactagatggaggagctgtagtatcagattcatatgcgacaaggcatgatatgcagtgaaaagtggaaacgagaagtttgagcctcatcagttggcctaataagccaaggaaaaaccaaaatttgatttattttttaaacttgatttttttaagttgattttaaaatatttttaatgtattttattttagcgttaacttttaaatcgttacgaacaaatatataaaaaacttactaataaattaaatttttattcccttataaactgatgaggcttattagggaatatgggcaaccgatgaggcttagtcggttccatccattccttgccaacaaatatatactgtactatatacttgtgtgcagcgatatgtgtgcggtgcagtgtgtagcatgagcgttactaagtggtactcatccattgacaatcccaacatagtacattccatccgcgagcaatgctgcaatcgtggaatccacatccacacatgctgctttcttggagccgtcctattacgacttccctcacactgcaccagcactgccactacactcctatactagtagtagttctatgcatctactagacgacgacgactactactatcgaagtggagtagtatcaatgtatctcctccggaaaaaaaaaagaagagggttttgctgccatttctttgggctcttctcccctgatcccctccccctcccccggagaatcttctgatttagtactataattacgtgcattacagtaacaaaaagtgaatcccttgggcttggctttgccactagtatgctttactacagcagcggcagtagtactagtatgacaatcgcttcctggaagggacctcattgtcgcccgccacagcaaagcaatttcgtgccagggtcacagagagatgcatgcttgctggctgccaacatgaaacttcccctttgcatgcttgcttccttcacaaaaaatcacaatcacattgctttcgtcttgtgatagcacatgctactctcatctttcttcttttataaggggaacctccgaaaagggcaggaagttcctgtaatttcactaataagaagaaaatacttgattcagtttataagaaaaaccgatctcaaaaactttacaacagcacaattaattaaataaaaccggccaaaaccctgacattatcaaattgagctaaccacgcagacccagacccactgacaaagaccagcggtccaataagggaaaactcctaagatgaagccttcgagaaggacacaccgacagaatggcgagatcgcccgatccaaacggatataaggttttcacccagagagatccctttaggtggtggagaaggtaaaagatgcccaaggatgtcgttgctagcgtcggcaagccgcaaaggctttcgcctcagagtcccatccaaccaccgcgtccacgaagaaagccacttaatgccacttgcacaccgaaaaccaccacctgtacaacacggccactgaggcactggtgctcaccgatccgttgaaagcatccgtccgtagccccggtcgccttccaccaccacaccacaccatggagctccacagagagaagtgggctaaacgaagagcggccatagctcggcagagcttgccaagacgacctacgtcaccaccttgcatgtcccacgcggagctccacgtcaagccgcgtagctagattgtcggatccgccggacgaccaccagttggacagtctagcctgctagaaaacctggacctggatctagatcttgagaaaaaacggaaggggaaacagagagggaaggaggaaggggaaggaaagacagatgaaggatgagaggcgccgccgccgcaggtggcgagccgagaaaaatagggtcaggagaaaaatgagaaaaggaagaagggaaggaggaaagggaaaggataagggacgaagggagaaggaggcggggggtgggggggagcctactactcggcgttggtcacctcccgtgagtcgtcctctattcctcttgtctttcttcaattgttattattgtcataaatcaggagaacataggattatgtagggattattatgtaccagcccggccgggcagatggaaccgtctgtcgaattcagtaaaacaaagttccaggaagcagatataattcatcatggttaatactttgattggttgcaataaactggatggagttacatgctaataatttaaaaccgcaagcaatactagtacttgtttgcctcggctttggcggccttccaagggcaaacacattcaatttggtcctgcaaggccctcatgctctccgcgattgcaatgcaagtgcaatttcagaaatatactactacttacaagcaatactactcaggaatgactcaccagatatttactcaggccatcttttcggagctgattgctctcctccctcactaacattcattcgcttcaatcccctcagtgccactgcaacaagctaatgaggcacacattagattgcgcaacaagtgaacacagaaactattatgcatcaatcaaaaatacaattctatgtgacttcaccagaaaatataatgactgattgttcaaggaactctgggaaacagttccacataaatgtttcttactccaaaccatttcaggttaatttcttccaaaaaggaattggtctacagcattcaacctattgtgcctagtggttagagattatcctcccagtgacaattaacagcacgtcaaggatgtgctactggaaaaaaaagcatgacactgtacatgatctggatgcatcatcgcattgtttcgccatgccacaagaattgtagtactaatccataaagggattgaaatagtgagcactcaccctactgggaggttcattttgtagtctgggacttctccgaggctctgcattctggttttgcaaataggactgaccactttggagaagagacgatggactctggttttgcaaaagcgataccctcctgttcgagacatcagccgacagattctggtgcggcaaataggacagattgtgattttgcaaattgggtagattgttctggacaaaggatggcatggtctggttcttcaaatagggtggattggtcagggcaagagatggtagattctggttttgcaaaacgggtgatctgtcgtggacaattgatggccctgaagtgttatctgcatggttttccctagaaaatctttgtcgagtttcttcggttggagtactagtaatagcagtattgttgcgtgaatactgagtggcggcagctcgagctccggctatggcggcagtgacactgggagatttgtctagtgcggcggaccttgaggagtgaagttgaagagatccagggttgagagagaggggattggtggggtcagggagtgggaaattgacaggcagtggaccttgaacaggtgaaagacccctgactgctccctcatagatctgtgacatgacagaaagaagatgaacagattcattagaaggacaagtgagaaaattaagcagcagctgcattgtttatgcactgtgatctctcttatgttatttagaagagaagagaggacacacccgtctctctaaattgtaaacaccctggtaaccacgcatgtcgaatggaaccaccagtttctgcattgcattgcataattcgcattgcagcaaaaaaaaagaataatacaattaagcaaatttagaatgaaaagaagtgcagcgtgaaatactagtgagttgaggtgacctgtgggttttcacaaagccagcagaagtcggtcaatgcttcgagcctgacctgcaggtagtgaagaagatgattggaattgggaaggtgcaggtagtagtaatagagtagggttgagtagatacagattggggcacatgttcccaggaagcaagctcttgagaggtgacacagcctaccacctcgacgcatcctattgagtagtagtaggagtatgagaattgaactcctagcatggtagttgcagttagtagtagagagtagcgtcgtaccgaggaggcgggagacagggtagtggtgcgggaaggtgatgttggtgattccgtcgagggcgtaaatctccctgtagaactcctccatggccttgatggtgtccgcctcggggaccttggaagccgcgtggatccaaagccgccctgctttcaattcaattcatcaatcttaatcttattaatcttggattggaggaggaaggaaggaaagaaagggatagatagctaccggtgaggggcgatggccatgagcggccctcgacgcgcttgattccgtggacgagcagcgacgcccacggctggtgcatcgtcaggcaagggttccggagccttcccccgccgccgccgcgcatgccgccgccgccgtgcttccaatccaatcggaatcggaatcggaatcgggattgccgtcgaatcgctcctactcctacctactctttttttttttttgaactttactcctacctactcttggtcgaggggaagaaggatcatctcatctgtctgctcttgtcttgggccaactgtgtactgctatttgttagttgggccaaattaaggctttgtttgggcccaacatatattatatagactgtgagcgtctgattttttttgatagatagtactcctagatggtttcttcactcttaattaacaactggaactactcgtttcttatacaaagtgagtctaacttaactggctagattacttgtggtggaactatcccaccaagtttaaattctagatttaatacgagtgctcacgattacgtctaattatttatggcagacgacgtgtttgtagtgacttcgccaatcttaagtcaatcactggattatcattcaatggataagaaagctgctatattttttaaaaaaaataaaagaagaagaaagaaaatcgcgtgcgcctgaaatctacacattcgatgcatagataacatcattggatagccatagattaattaagatggtctccgcaaaacaaattaattaatactcatacatatataccggcaaaaaaggaaagaaagcagagatggaatcagttcacattgggagtaggtactgaaagtcgtagtcgtatggaatgacgtcgacgaggtgatggatgttgagacggtgtccggaccacctgaggcaatcaaccatggatttcctgagagaccaggacgtgggcagctggtcgcaaatccagcgaacaagcgagtccaggtcctttgcgaagtcgtgcatgttggagtgtatgaggcttgggatcatcagcctcctcctcgtcgatgtcaccaccagcgatgcctgcagatactccagcttcgccttctccagatccatcatcacacgatcagccttgtatattcgtagctgcaatgcaatgcaaatccattagttacagttgcattcaacagctagctagcagcttaatggagtagtaattaattaccgcgggagatgatctgttgccacagcagagtgcgaacagaatgttgggttctgagctgttgagcccgtaacgactcctcacctgctgttcttccacatccacctcgcatttccagaattcctgcattctcgaatggatataatcgttgccagagccagagccacgagaagaatgaatgaatgaaatgcctcacttctttgacactggatggctgtctgaggatgaaattctctatcaccaaggcgttcaacttttgccctgatacattcagcgtggccttgttcttcagtgcaagtagcttttcagggtttgagggtagtccattgtgcaaaatcccctgaaatacaaagttgatttaattgtcatcatcagctagacagtccgtttgtgcagagagaccgattcgattcaattattaataaatactccacgtacgtacgtgcatgatgcaggtgttgtatatgttgagccagaaggcaagcttttggtggtgagtgagaaacctcaaatccacatgctgcagtgcctccagcatccccctgcatatgaaatgctcaacttttaattactaattagtggatctgctgctaattagcaggtgcattatcaggtagtagcaaataaagtaggcaagcattagtgtaagtacctgagcttggtgagcaggggagaggtggagaatcctctgaggtcgaaagcggaggaagtgaagctgacgaggttcttgtaggggcctatatctctgacgatggaatccgggatggcgaagatgccgtagtgatcctgctgccccgaccggcaatcctgctgctgctgctgtttgttcattaccaggctggtgtcgattctgaagcttccacctcctcctcctccctgatgctgcctggtcagtgaaggcgatgaggaagaggacctactactagcgttgttgttgttgttgtcctgctgctgcagctgcaggtcggcgaccctcgaggacctgagcagtcggatgaagatgcagatgaggcacttgacgatcctctccgacagcttgttgggctgctgcaccatcttcttctttttgttactactactactagtatcatcgagtgaattaagctttggactgggagtgggaggtttattgctgacgatggtcatgagaggatgatgatggcggcttgtgtcgaggccgttgatggcctgactgatgaagaacatggacttgatgttggcatgatctcctgctgcagatcctccactattaacattggcattgacagtgtcgtcgtgggtgaggttgattgcattctgggtagttgtggtggccgccgccttcttcatgcttcggatctgggtctccaggcgggcaatctcctcctccaccagcaccagctctgctagaagctccttggcctgcatccattttcattttcattctcattcctagctactccactaactcatcgactctgcttctggcttctaccttgtgcgggatgaatgcagggatgttgtggaggacggatggagacgacaatgatgatgatgatttggtggtgtttgagtgctgaagggcgcggtttaggatatcatgcaccgcctcctcgttccgcagctgcttcttcagctcactcacctgcttatattttataatgtacactgcttattgcgtctgctgctgatccaacaaataaatttaagctaattaattaattacctcttgctcaagtctctgccgcagccgccgcgcgggcactgttcttctgctctgtaattgaaattaaacagctagctagccttgtcagatactacaatatagtacgtattttttttcagagaatggattaccggacactgtcatcgatatgatcgaatttaattagctacaatggcaattaaggtggatgggacgggatcaatcatcagacctgaggatgagggtgaggatgggcgtcatcgtgagacgacggtggtggtgcagcgccggtgccggagagcagctggtgaagatggggcggaggagtagtgcttcccgcggtcacgtactcctccatatactatactagtgcactgtacgatgggatgaactagctagcgatggttcattatattagaaccgtctggcgggagcaagctagctaggtgaagaagaagaagaatgatcgatgatggatggatcgaggaggaagaaaggtagagctagagcttagagagagcagatggttgggagggcgctgtcgtacaaggattggcaggtgaggtgcggccgaagtacgcaaactgctgctgctatgtttgggcgatccgatccagggaggggaggggattgatcaccgatcgatcgatcacctatcctatatatatgcaagcaaccaaacacttctagttctagcttatgtggtagtcgatcttgtgctagtgccatgggttggtggcgtcatcgagcgcgcgcgttacatcccatctacatttcccattccaattttattttaaatactactactacgactactttttttcccttccacacaacacatgcctatcttgccttgtaatccacacgcacaactgcatccaccatgtcatgtaatctctctgtttttcctctcctctccttgttgagtgcaacctactcaacaccgctaccttacctggcgccttcttttctctgcttattttctgtatcttagtgcagttgggtggaatcaacattttcatcttcactaaccacctgctatccgtacgtaccacgcatgggttttaccattttaacttttttttaatcatttatagctagcgtccgttatattcttactgttttcgacattcatctcaatatatacaagatggggtcctgcacatatatctcttctctgccatcttcaaagccaagtcatcctccttccatatgtattcccaccgtgtgtaacccatgcgctcgcggatcatacgtaattaaataactactgcatctaatgttttattctcaatcaccctcctactatatcctaatttatatgggcatggtccgttagaacgtatgagtatgttactggttacaacaaaatgacaatatatttcaagaggcctggatggctgcaaaatttcctaattcttccctctacaacgggtaggaaaggattattttcccttgttatcctataatttattgagtgaatggcaatttgggtcacattttattacacaagtttactttggaccacccttaaaccaatattttcactttggacccgagtaactttgttgttttctcggtttagaccaccccaaacaatttattcatcaccccaacctcaattaaattagttttgatacaccggtgaactttcccgtatatatcttcataaaaatggacggtagatatgaaccgtaaagagagttgggtggtccaaactgaaaatggtaaagttagtccaaagttaaacgattactttaaaggtggtccaaagtgaaactttacgaacaaaaggtggcctaaactataatttactctgatttattcatgcaagccaaatggcatatataaaaattaatccttataaattcaaattatttgttttctctgtgaacctaacaagccgatttgaacctaacaaattcaaattcctatctccgcccctctaccaccggcccagccccctcccccccccccaaaccgccgacccctcccggtagtcaagaagatcctcgtccgacctcggcaacaagagcgacttcctcctccgctctaaccccgcccacaagatccccgtcctcctccacgctagtcgagtccctgatcatgctccaataccatgatgacgccttccccgatacccccacctcctccctccgtcgaactcctcctcctccggcgaagccgacaccgcgtacgcgcgcaccaaggcaagattctaagcagactacgtcgacaagaagctctaccgctgcgggatcaagctatggaggctcaagggggagctgcaagccgcggtgcgatgcaagatggtggagatcctctggacgatggaggcgaagcgggagttcttcttttgtagcggcgggcttggcttcaccaatgttgcgctcgtgctattcacgacatggttctacagctacgagtggtgcggtgggttcagcatcaatgaggtagcgccaaagctggcgacgtgggcacgacagtgcatatagatcgactccatcgccaagcacctcccctcgccggagaaggtgcatgacttcatcagcgtcctccgaaataagtacgacgttaagtagatgggatctcaacatcgatcggtctccgtcgagtgattcatcgtgagatcgatcgatgcaaagttgcagggattgattggctgtttcgtttgctatgtcattggctttcccgcgctccctgccttgtcgctctctaggcacttactggtggagagaggagatagagatagagaaaaagagggtgaagtgaaggaagtgggtcctactattttttattttcttgtttgattgacataatgggccctacatattttttttaaaaaaatttagttttcaattttgttatttttttaatcaaactgcacgtcaatgtcatgtgggacgaagtcctagtcgaactagtcacgtaggagccagaaccggagacaatacaaccgaaggatttcatttgcactagttttgtaagttggtgttgtatatttttcggttcaagatgaaaattggactgagtgacaacttgaggagctaaagtgaacttattcttataaaaggccgtgggtttacccgcaaaaaaggggggccatggatcgttgggccgaaacaacacacaggtcatccggccgctctcttctttgggctggtggaattaattatagtataataaggaaaagcagaaagaaaagcgtggcacggcacggcgacggcgagcgatacaagaagaaagaaaaagtctcacctcggaacggaacagcagcatgtgggcccacaccacacgtctttcgtcgcaatgccacgccatcatcgatccctttccttcatcaggagttaatcccctttctctccctcccggccgccgccccgccccgcccatcttgtcagatccttcttcatagttacgaccaatcctatccaatccaattgttttgagaaccaagggaattaaggagaagaatcgaggaagaagaagaggccatggttgtgtacgagcaggatccggatgttctccgatggagccttcaccttcttcttccacccgccgctgccctacactaccaacaacgcaccagcagcgtcgactgcgatgagatgatcgcccacgccctccaggaggagctttcctacgcccaatcccaatccctatcctcctccatcctccatctccccccctctggtattccctcttccctttcctccgctcttgtacactacagtattaatctttcttgttttttctacagctcctccactaaaggaagacgaacaagatgatgcgccaccaccaccacccccctttagttcttgttcaacccctgcagattatactaatactaataatcataatgcccatgactgcttaatcgagtttgtcgatgatttctctgctctagatggccaagttggcaaaagattacacgacatgattcccattcctgtaactaactctctactgcttattccccaccttctcttcacccattcatcatttaaatattcttgtcaaaatattaatccattaatgattaccttgcttcttcctcttcttcttcttgatgctacttgttggttaccctttccttccttctcttattgtagcatgttccaaaaactaacggggacattccttctgttgatgaagccttttcagatcaccaaagactccttcacaggtaataaattgccctcaactgtatttctaactctaccaatacaactttaacctcatgccaacttttctatgttcatgtcttagtaatgcgcgagtctcccataggtgtttcacttaatgttggttctggaaactgaccccatgcatggcgccatgtgatttcttatttaggttggagctgtatgatcttgctgagctcaaggttgaaggggatggcaattgtcaggtattacttcaaatatgtactctttttctctattttatgctctacttatctcttttagcatgtatcttatacacagttccgagcattgtccgatcaattttaccgcaccactgaacaccacagatttgttcggcaacaaatagtgaaacaggttattcttggtgaagtcatcatgttttcttgttacaactctacttcctcatctcatttttccctttttcaaccgttccacagcttgagtcttatccggaaatttatgcaggatatgtccctatggattatagggaatatctaaaaaagatgataaagtaagtatttctcgtttttattaacaagtaaatctttgctttatagtgtaacattaggcattttcactttgtggccacaaaatcgaccaggaacggggagtggggtgaccacgttacattgcaggctgctgcagactcggtaaagatgatgtttccacacttcctgacttattaaataattattcttctgtttatcggaattatgctgtatacagaataagagttatttgtattggacagcatggtctgggattcattaagtgatgaataatcgaaagaaatcatatatatctgaataatttaaatctcaacaaaaaaagaatggtattttctctagtttttattttggtaaccagcataccttaacaggtacgtagtatattgcaatctcatgcacatcattaatatagtataggtattgctccccctggacttggtcgtgttgcttttgtgctacttgatttttcttctctttgcccaacactcaaacttcatgattctcataggtggtattgtaatgtcctcccttatcataataccaggcctatacatctgttgtgttctcgtttgagattgagtagcattttgtgaatgaccaagtcatggatttcctagaaccagggataccgtgcatctgctccttgctatcaatgtgaaactcaagtatctgcattgttttttgcagtatggtgtaaagattttcatcctgacatcattcagagatacttgctacattgaaatccttcctgttgttcagaaatcagaaagaggtaacctttcttttcaaattatgttgctactgaattgtattactgaaattagcaactacttatattatccagtcaaacatagatgcagatcttcatcagttgatatgacccgccttatcattaagaatctctgcatgtaacttcattgttcttagttagtttgcatagtggattgtactttttcaatagatgtgtatctaatgtgtttctgttcattttttccttaaaaaacccagttatatgcttgagtttttgggctgaggtgcactacaactcgatatatccagaaggaggtacagtttgtcatttagataccgtgttcatctaggagtgtctctttggcggattgatgcggtagctcaccagtgcatgtttgtggtgcagagttaccagttatggagaacaaaaggaaaaggtggtggcatttttagatcagcaactggtgtacactccattgggctgggtacactccatttgatttgatttgatgttggttagatcagtggccattttgttggggctatatgtcagtgtaggaatgttgatttgtgagtgtacataacacatttagtcaggaggaagaatagctgtgacaatagatgaatgtatcatgtattggatattattgatgttatatagggtcacttagagttgggtttagaatagagtagctgggtgtggagctatctaaacctcttctctgtctctaatttattttgcaacatgtttggttgaaatctaactctacgagaggtgaagctaaagctttaccaaacaaacccatacgagaggtgaagctaaagctaaacccacaggagtatgttaagaagaatcgattcttttcttctgacgtaatgcagtttgcatattataccactcgctttaatcatagatacacgatggtcatacatatattatgattaggacagtcaaaccttcaaaattttaaacataaacaacttctgaaatacttagtttaaaaacaaaagagcggtactaatagatatgatactatgatagtacttttcaagacatatgcattgatatttttttagaggaagagacaaaaaaaagaaaactagcatttaaaaactttttatggttgatatctcacaggtttgacacaatctcttttaagctttaaatatttataactggaaagagtgtatttttgccaagagatacgaactagacactcttttatgttgatagcgctagacgtctaatgtgcacgtccaaattaaaaaaagaagcctgtctccacaaacttaatttaatttaattccagagaagattagaggccacaaatgatatatggtgctaccttcaacttaaaatatactagcaagttttttttttcaaatatatactacgtagttagatgttgccatattttaagacggatggaatagtggtgtgtagtttcaaaattgaaatcgagatcagagcgagtatatgcaacattttgtttttatttgactctgaatatgaaagtatgcatatgtaaaaggaagagtaaatttcataaaactacatactatattaccaaattattgtaaatctacaggtgtaaggtggcgtatcataagattacatatttaacattttatttataaacaaatatagttttaacactaattctctagcaccaatgttatgtttgagttataaacatgtaatagttgtgattaaattgcagctgaacttgtagttttgtgacaactttgcgattttcatcattaagtctgcagtgctataataaattaggttaggtattaacttcctatagctatataatacatcacgttgaatctgtagttttatgatagtttggtgcaagtaaatctgtttattcttaggttaaaatctctcctataaatgcttcgtccatctcgaataaacaaaacaaattcgaaatgtgacacattgaagtactacagtgaatctcgacatgtgttttagggttgtttattttaagacggcgaaagaatttttaaaaaaaaaattttaaaaaaaaaaggggaaaaaggggaaaaaattttttaaattttttaaaaagggaaaattnttttttgggtnttccgttncaatatgcactagggttgtaaacatatattatggattcgactcgatcatcgtatagtttttgtaaaaaatattccgtaaagaaaaggaaaaggttttaaatagaagcgtgtggtaggtgatggtgaggaagaagaggagaggagacacgcttgaaacggcggaggccggcccggaatgttctggaaaaccaccttttctttctcgcaggagtagtatttttgagggtttggtttcaaccaaaaaaagtccaaatctgaaaacaagagagagatcacagcagccgccgccatcgccatctctcggacggaaaccctagacgagcgaccatggccaccatgccaagcacttgcgcctcctcctcctccctcttcctcctcctccgcgtacgtacaccctttccttcccttcctctacctaaacccctactaaaccatggattggattcattgattttgctgctgtttccagagggacaggaggagcagcaggagtgccagcctccccggacccgcccgccgtttgggggttgtgcgcgcctccgccaaggagatcgccttcgaccagggatcgcgatcctccctccaggccggcgtcgagaagctcgccgccgccgtcgccgtcaccctcggtcccagaggttcttacttccttaccctttcctcaaatactagtcgctgtacaccatttgtcccttgatcttgttggtttctttctgtatgcaccttattaagccttttgtccttttttttcattctgctgcaggcagtgtctgactaattcttcttgtggtattgtaggaagaaatgtcgtcttggatgagtttgggagccccaaagtggtcaatgacggagttaccattgctcgagctattgagctcgctgatccaatggagaatgccggtgctgctttgattcgtgaggtaacaacaatcttgctctctctctctctctctgagctaaacattaacatacttaccttgtttcttctaatgcttaaaccgtatgcattctctgaatgtgtctactttctaacaacattcactcatttctgtcaaacaaaaggttgccagcaagacaaatgactcagcaggtgatgggactacaaccgcatctgtcctggctcgtgagatcataaaattgggcctgctgagtgttacttcaggggcaaacccagtatctatcaaaaagggcatagataagaccgtgcacagtttagttgaggaacttgagaagaagtcaaggcctgtgaagggcagtggtgatattaaaggtgagccgccacataggaggatttcggtcctttcttttgtataaaccacatagctagctagcgccctccatgatgaaggaatatctaatcttgagcatttctcctctgtctttccctgttttagctgttgctgccatatctgctggaaatgatgacttcgtcggtaccatgatcgctgaggctattgacaaggttggccctgatggtgttctttcgatcgagtcatca

SEQ ID NO: 63403 - DNA, 619 bp, Oryza sativa
gaagtatgacaggtgggtcccacatttttttataaatagaatgctgactggactgccacgcgtacgccacgtagaccaaaaccactgcggattgggtcgaggggggtaatttatccggtttgcatagttgggggtgaagaatgtctggttttgtggtttagaggggtaatttggtcgaccgcgattgttgggggggggggtaattcgtactttttcctttcttttaacatatctgtgttatctcattcgtgactaactacaccatcaattccttaccatgtagcaaccattacatatgtttcattatcaacccaaagcacggctccgtggcagtccttgacccccttgattataatcacaagacatacaaacaatttccaacaatctgttattctgatactattgcatgtctaattattaatgcattacaattaaatctcctccttaatacgaaacggtaaaaaatccatactgtgcatacaactactacaagaagggtggagagcggattcaaacaagggagaagctgctagtacatacatattggccggtaatagtctacacagtttatgtattccaattatttaactattaaaaaattaactttttccttctatga

SEQ ID NO: 63404 - DNA, 645 bp, Oryza sativa
gagttaggaaagagaagaaaagaagtcagccttagttagttcatcgtatggataggtatgatatgatccctcagaatcttttttgcagatgttatcggtcggttcagttcgtcagttgggttatatatgaactaaaaaggatcagatctttttttacaggatttgttgatttctcggtttggtaagctaacagatacatacggatccaaggaaaggttcacaccgaaaacaccgtcctacaaatacctcagtgagctcgacacagacataacggaaattcgggaacgaaatttcaagaacatctgaaatttcaggaatttccatcctctgataggatattctttcgtccgatatattcaaaaataaataaattaagtcaattttactcaaatttaaacaaaattttatcgaacttcaactttccccctctaaataccccgagatttctgctttttatttccgacgcatcgagctttttttttttttcattctactacaggagcatgattgctcgagcaaaatgaatcgaaagggctgccaattggagtgaatccttgttgggaaggcaagaaatggaggaagaagcagcagtgaggggaaagcaacctggtcgaggaggaaaacgacccacgagcgggacaacgt

SEQ ID NO: 63405 - DNA, 2812 bp, Oryza sativa
  unsure (1)..(2812): unsure at all n locations
tttacttactttgctccagtgctagtagaaattagaattataatagtcttctctagttcttcaagtcttccggagatttcgggtatggatctagtatctgttccctctcttgtaagactttatccgataatgaaatacttttctttatctagttttggtcctttactatacttgcataattattcgagtacgaactttagctcatacttgtctcgtattaaatatgtagttagcttaccagagatatgcaatagtattgtctaagtgtctatttatatagttgctctatgtcatctgtagagatgtagagtaatatttagtattgtaagcgtggtgcttagattattagatatcattaagtggtgctatatgccacggatctgtagaggtaggccgctgatggtgacagctcagtatgggtattcctccacgtgcgtaggtagggctaagagaggttcttgctgtgggtactcctccgtatctttaaccggttggatagccatgacggattgtcgtaaggaacccgacaatatggggcggtttctcgatataccagggggggcatagttagggagttattagccacagagttgtacaatagtaagtgtatactaaatgactatatactagaagtgcataaatgatgttgttctaatttcttctctatttagcctagacttataatttagtgagagtattctaaactgaaccttttatgtgtcaaatctatccttatcctcaattgattaatccctgcataagactttgatctacataagtatgataagaatttatagcatattactatcctaccatatcttcccttgggattaaataaatacgatatcttggacgtacttccgggtgaaatgctatagcggtatatccatgtgcttgcggaattatttctttaacccatacgattaccgtttaatatttctgacaacattgcttgggactaagttcctagtaatgttgttaagaaatatcaacagccatccctaantcggccaaacctagtcgaagccgctcgtgccaacctgcacctgggtcactgcctagtgggtcttcatgatggtgtacggtggatggccttaaatatgttggttttactctgatttttgggccatccaatctgtgtattcacgtctgattagtatatttcatcgcatgtcagacggttttcctccataattcacatgcatacaaatattcaccaagacttgtggaactagttagtaatatccactacctctaagtttagtattcaattttatattctttaattttctttcttgcaggaattggcagtcggatttgacacttaaggatctacaaacatcgcctcacacgctactctcctgttgatgtgcgcaccgatgccgtgaggcaagagaagtttatgtttggtcttaatgatgaactaaccaaccaggtcatctatggagattatactgattttgagaagctatttgacaagttgatttgtcaggaggatcagcgcaaccagatggatcgcaaaagaaagggagctagttcagggcgcgtcaggggaacaaccaaaagcctcgcttcatgactgataaatttttaagtttagatcagccatgcaaagatgataattcttctaattttagtaaaatttaaggctagatagaaaatgaatctgtgatgtgttaatttggggatgaacaattgaaattccgcacgaagcantgaactggctgttgacggctgttaaataccaaattctcgccgtcaatacctacataaaactgaaagtataaaatatctgaaagtataaaatatccaaaatagtggtaggatatatttctaataatttccacgagtgttgtgtatattagatgtaggtgacaaactacttaagttgagaagaaatatacataaggaggagatcaaactcatattcaaacttaggagtttggacgaaaacaaaatcaacacctcaaatgggnccaaccnnnncacactagaatgaggtcacaattagtgnnnngagaaaaacggggccacggaccggccagggtcagccaccctacaagccacacgcccccccccaaggggnggcccaaagttgagttcggtagcaaccgctccccaatgtgggtttctaccgttttcggctctccaactgtcatccaaatagacgcttggcttgaggagagtgaagatgctcatatgattccatggagggtctccacactccgaaggcacctccaccaataaataccactcctcatccttcattccaactcacaccaagatgtagcttgagctgaattataagaggctctttgtatgatttattttacacatagaatagggagagtatggtagaagaaatcggacgagttctggagttgtcggtaatctcctcttactttttgtacattgttaattactctggtttaatagaattatcttcctgagtaattaagatttacttcatgtgaataattcttggttattttctaattagcatgcgggatcattgttcactaaagtccattaatttattgtgatcgctttagaatttagctagcactaaagtagttattaattgaatagacgcagtatctgggtaattaatttccggtgattccttcgtatcccacagtaggtttgagatcggtgtagaggtggtgatagccctcaagtacactaaagtcctccatgtacgggtatgtagtagagtgacatttgggagtagcgagctggccagtgcctgaagtatcgcattaggattaaactgagctttctgtagacaccgtttctcactaggaaatcatct

SEQ ID NO: 63406 - DNA, 590 bp, Oryza sativa
gggcaaaatgtggcctgatgcccaaaaaagcttcgcaggcatgtatgaagttggcaatacgaactatggagttcgggtttaggtgatgtaaactaatcccgtagaaatccaaaattccccggaagaatcttgaggttggaagagaaaatcctccatagaagaaatgagaaaataccacgacttcatgtgtgtcgggggtcgggaatgcttcgccgaatgctggacgccatccaatgatctccttcgccggaagaacaccgtgcgccaccatctccttcaggttttcctctgttacatcggagggcgcccactgacactcgaagctttctttctcttctgccatgaatacgaattggatggtgtgatttggtccaagatatggctggagatggatggggaatcgatgcggtggttgcgcggaaggtttttgtggagctcaggaggatggatcggagaggatttgttaaccctagcttccgccagtgtagtttacactgtagcagagaatggggaaaatggcgagagttttggcagggaagacgaaacgacgctctgacttcggcgtttattttgctagggtttcaggagtg

SEQ ID NO: 63407 - DNA, 1719 bp, Oryza sativa
attgaccaaaacttggaattacatgaaattatcgggaaccagagggccagaggcccctatggctcagtacatatgtaagccagcccatgggaagatattgtgcgcactctctccatgaagaaattaacagcccatgttggcccactaaatattctactacctctgtcccaaaataagtgtagccatgggtacccatgtccgatgtttgactatccgttttatttaaaattttatgaaaaaattaaaaagaattaatcacacataaagtactattcatgtttatcatttaataacaataaaaatactaatcataaaaaaatttcaaataagacgaacagtcaaacgttaaacatgccggtaccaagttgcacttattttgagacggaggaagtatattttaactctttcctttcagacgactataactactgtgattaaaaaaaaacacttgaccgacgcgagaatggacgtccccatggtttttcattaagaataagcctcaacacccggactcaccacctatggatcaattcttaaccgttactttgaggcccttgcttccaacacgaggactcaccctatataggtcgaatcttaacacatgtttttatgtgggatcagagagagagatttttttttaactaggtctgaaattcaccaaggaacccaggaaaaaaagtgatgcttaagtgctcttgtggcaaagctcaccaagtatattaacataaaatgtatatgcattttggagcaattttttttataagtaaaatacaaacacaggcgctcacaatgcgctcacactcattcctatgaatacacacgcacactctacctctatgaagtcctcatagaatcatttgtgactctggtacaactaagatagtctctggtttctgtttctgtaactgtagttctgttccatatggttttactgaaatcaaccaacatgttatgttagtgaaggctgtatttgtatcaattagagatcggccagagattaattggcatgaaaaatattcttgcaaaaccaggacacatatatgcaatatgtagaacattaatgtttgccaacacatacatatttgtatactaaaatctgtatatatacaaacacaaccatgggcgtcatcatcagagggaaaaaaggttacgttcagtttataccatcgaagtttaattttctcatccttcgccatctaaccaatgcatgcagggatatgcatatatatatatatatatatatatatatatatatatatatatatatatatatataaacattgattgttaatggctttgggagagaatatggtgttacagcactgatcagtgagtgtttcactgaacaggccactacttgagcccagtgcctaagccttgtcttcacaagctgagggttgtcacctgttaagttgcatgcatcacaatttcacatcatcttagcagacaaaaacagtgacataaattaacacaaatagaatcaatattccaagagaaaggggataaatattgttcttttttttctttacctggactgcaaatcttccacgagtccatgaaagaagaaggtgcgacggggctacccgggttcgatgtgccaccgagggtagaggaggacgacgtcgctgatgtcggtgatggcaaggagctagtggacaaacgcatcttgggctccgagagctgccggttgacggcgaagtagaggtcgagggcagggag

SEQ ID NO: 63408 - DNA, 656 bp, Oryza sativa
tccttttgacttatacggctgagattttctctaatctctgtaactgtgtttctttcctttcctaattaaattactagtaccaaagcagcagaccatcgtttcccctccagagccgcgatagcttcgtctttgtcatcaaactttagttcagctatggtgataaaattggcatattgttcttcattgcctcaaacagtcaaactgaagattcaagggtattccacccaccatctccacctccaaccatggtgaagaacataatgctaatgtttatttatatggttttgtgatggccagcgttgttttattgatactattggtcggagaataatcatggttatggtgggaagtacttcaaaaaaactaaatattttcctctaaatctatatgattaagatagttgattagaagaagagtaggtgccatgatcccagccgtagaagtcagaagaacggttaagattgagccaaatctaccggtggagttggctccaactccaggggatctagacccaaattttgataaggtttattttggatacaatctgagcaacccctatattgattggagaaaaaacaacaatgtatgatatatgtagatattggttcattctacattttggtattacttattcaatgaataatggatcgagccaa

SEQ ID NO: 63409 - DNA, 3723 bp, Oryza sativa
gatatacacagcgcatagctaaaataaatagttggttagtagatcaaatatgtctaattacagcattagtagcggattgacagtagcataacacagctaacaaattgtgcttccaaggaaagaaactgtacaattgtttcagttttcctgagctccagcagtttaattagccggctggccggggtcattaattaagcttttgctgctggggtcattagttataaaatactgaacaattcacttgattcatcgaatgccatcgggtcatctgaccccgatgatagtacagctccgcccctagccgccgagaagaagcgcacgcgcgccaccccgggggccggtgcagctacggctacgcgaccatcgtcgattaagcacccctaggcggtgggctctctgcttcaccgcgccaccacacgtctacgccgaccaccaccaccgtctcacgttctcgaacgttcccggagcaaaagttggtaagcgtgatcgttcgcacttactcagaagtactatggatgttagtaattgtttggaggtcgatcaacctgcacatctgtcgttttagaatttcaaaaagttattttagatatactggcagcacagtacgaacgtacgtaacatagcaaaatagaataataggattcatttgaaaataataagagaatattgatctctattaaaaagtcccagtatatacatgatgcataaaaggacccttatatatataagagtttaattgttaattttcttcatcatgccggacaaatagtaatggagacatgacactcaacgtcggtcataaaatccttatgtttatatctcttctctatcgctatttattataaaaattaaaaatgtttttgtcaagattttgggattttgatgcgttatccgtatttgagttgatttttaagttcgttcgcttttagaaattcagatccgtgtttgagttggaatttaagcttattttcttttggaagtataaaaggattcgtataagaaatcttttggaaaaaaaattcgcatgctaacttgaattgaaatacaaactactaattgcaactcatgattttcttaagaaaaaatccaagtctattccgacagtgaattttactctagctaaaccgtataataacaataaaattaaaatagtatttacccgttgcaacgtacggacattttttagtaaaaaaataaaattccactctctttgtgattagttggaatatttgggttgctgagtcagatttaaaaacacctgttatgttacatgaaatgtatttttaaatatgtcctaaacttgaaaagatgcatacaacttttgatcaaacagtaatccacagacaaccaacatcccggtccagggcttaatatgattaatagaatactcgtatcaacaagttgcaatttcttttccggaagccaatctctaaagaactccgaggttaagtgtgcttggcctgaagcaatttagggatgggtgaccaacccggaagtgcatgcacacgagtgaggacaaagtgtgcagaaaagatttgtgttggtctgtgagggcaccaggactgggtgcacacgagggagcaatttagggactgtgagggcaccgaccgagaagtcccgggtgcacacgtctatgacctacgaaagctactagatgtaagtgagtccggcccctgagagggcagtatatgacctacgaaagcctgtgagggcaccgggaagtcccgggtgcacacgagggagcaatttagggatgggtgaccgaccgggaagtcctgggtgcacacgtctatgacctacgaaagctaccagatgtaagtgagccgaccgggaagtcccgggtgcacacgtctatgacctacgaaagctaccatgtctatgacctacgaaagcacacgagggagcaatttagggatgggtgacagaccgggaagtcccgggtgcacacgtctatgacctacgaaagctaccagatgtacgagggagcaatttagggatgggtgaccgaccgggaagtcccgggtgcacacgtctatgacctacgaaagctaccagatgtaagtgagcccggcctgagaggacagtgtatgacctacgaaagctaccagatgtaagtgagcccggcctgggagaggcgggccgttacaaagtggtatcagaaaaggtctatgacctacgaaagctaccagatgtaagtgagcccggcctgtgagaggcgggccgttacaaagtggtatcaggtcgttacaaagtggtatcagaaaagacttgtgttggtctggtctatgatctacgaaagctaccagatgtaagtgagctcagcctgggagaggcggaccgttgtaggtgggctccacatgtcagtgactgtttgctcctgcgacgacgaatctgtgccgaccttgtttcaccgcctccgcctccgattcgacctccgcggccgccatgaaattggagcttccgggaggaggaaatctcgagaagtagagagagaagaccacagcgtgggcgagcgcgtcggcgtcattgattccggcgacatgaagcccccgccgcggccgcggccggcaacagggctggtggggtggatccgtcgataccgcggttcaagtgccaggagtgccaccgcgcgctcgtcgtcgtcggcgtggactccttcgccgccgataagctcccggctcaggccacctctgggcatgtatcctctgttcatggaagtattatgggagctagcaggatggataattcttatgtcgtgctatccaagcaaaacaaatctcatggccatggaattcccccacgcccaccgagtgcagcagccccacatatcgaacctaaccagccaacaagagcgatggagggttcatatatagtgcttccacctgctgctgcttccatatacaagacatctacttctgaaggaggtggtgcgcagttgccaccaccaagtatcaattccagcagtttgttaacaggaaatagttttcactctaacgtgactgtattaaaacgggcatttgagattgctacgtcacaaactcaggttgagcagccaatgtgtctgggctgtatgaggttgctctctgataagatggataaggagattgaagatgttaatgctgacattaaagctcatgaagtttgtcttcaacatttggagcaggaatcctacaatgtcctcagcgatgctggttttcaggaggagaaactgaagattgaagaagaagaaaagaagcttaacgctgctattgaagaagctgaaaagcaatattcagaaattagttctgagatgaaggatcttgaaataaaatctaaagaatttgaagaattggaagaaaggtattggcatgaattcaatagctttcagtttcagttgacatctcaccaggaagaaagagaagcaattttggcaaaaatagaagtttcacaggttcatctggaattgctgaagcgaagaaatgttctcaatgatgcattctatatttcacatgatggagtaattggaacaataaacaacttccgactcggacgccttcctaatgtacaggttgaatgggatgagataaatgctgcttggggtcaggctgctcttcttttgcataccatggctcagtacttcaccccaaaatttgaggtccggattaagattcatcctatgggtagctacgcaagagtcacagatatccacaaaaatacatatgaactttatatcatgctaaccag

SEQ ID NO: 63410 - DNA, 956 bp, Oryza sativa
ggttcattttattgattcactgccggaggtatatcctgtagttgaggaatgggtggaggatgttcttatggatgaggggaacgcaacaatatttactctcttcgcttgccttgtaactgtcctatatttgcgagagcgtcagaggcgtcaagctgcggccgccaaccctcaacagcctgatggtgcacccatctaatttcaacctttgcatcatgatgctgggattgaagtggacgttaagcttgaggtacatagtcatttattctcagccatatcataccatcaaagttttgtttgatgtctgaagtgttaatggaatgacaacgtccatactgtcatactggaaaagcgggtccttcaactgcaaaatgctgatggctttctgaggttaaaaatcggggtttaaaatgatagctctccttgacatctatgtacactaaaattgactaggataagaactgatcatgactgttggatattgagatcatgttgtgggttctaacagagtagtgcttgtaagtaacgacggttgttcaagaaaacgtatactccctccgtcccataatataagggattttattttttttttcttgcactgtttgaccattcgtcttattaaaaaaattgtgcaaatataaaaaaaacaaaaagttttgtttaaagtactttggataataaagtaagtcacaaataaaataaataataattctattttttaaaaaaaataagacgaatggtcaaacagtgtaagaaaaaaattaaaatcccttatattatgggacggagggagtatttaaaaaggctatctttcttggcttttgcatatgggatgcatttctgttgacggggcatgcactgcaatcagtccggctctcaacttttcatggtcaacaacctgacgacacaattgtgtgactagagaagcgtgttagtgggtagaagttcaaattttaccc

SEQ ID NO: 63411 - DNA, 5014 bp, Oryza sativa
cttcttatgaggacctaagcacaagtaggtggtattgccaatctcccaactgttggcgcgttcttcttctcctcctcttctttagcttcctctgctaggttgaggacatgtatgtagtcgtcgaagcattcgtctattgttctgaagggaatatcagggtaaaggcttgagatttcaatgtctctaggcccgtctatgtagaaatgtgtctggcaaccgtttataaaaatgtcatgcgtcagtgaagcgactatgctctccgggatgatgtcatctgcagtcaaaatgatgaatagatcatacaccatgacaaaattccatttagagcgcgagagtattcttttaggtggccaaacctgcagccatggcgatcaagtcctcctcggtaagcgtcacgcgtggcagtgtccggccgatcttgctctcccacagcgacgccatctcgttcgtgctgaggagattgcaggcgggacggaagtgcacgatcttgttgatgctccgggcgtcgtaggcagccctgatggtgaacttaccaatgtcgcttccagccacgaagaaagctgcacgcgcgcgcatgcagcacaccgttggcaaaatcgcatcgaaggtgaatttcatcatgcggcgcaagcatgagcgtgtactacgtacctctgacgtcgccgtcgccgtagatctggaagcggtcgagcggcggcggcagctcggacgggtgcgtgctgtcgtggtagggccagccggcgatggagttgcagcagatgaaggtgtacggcacgcccgacgcctccgccgcccgccgcaccagccgcttctcctcgtagaacctcagccccgcccccaccggccgcgccctgtccacgtcgtgcccgaactccgacggcagaaacctctgcacccacgcacacgcaccgcgcagaccaaactttacgtgccaaaaatccgagttgtgcgacgcgcgcatgcacgcgctcgtatgtaaaatgtgtagtgtacgtactttgaccgtgcctgcagctcggatggcctcgatgaggccgagctggtcgaggatgctggcgccgcccatcaccgagatcaccacctcgacgccgcgcgcgcggagcgccgcctccacggacttcctcccctccttccccccgacgcagccctgtcacgagcacacacgccatgaatccaaatatgtgttcatttccgcgcgcttaactaagttggttaattttaaactctaatcacctcgatgacgacggcgcctttctggcggagcgcgtcgacggaggcggcgcgcgcggggcaggcgttcccggggcggacgaggatgaaggtgtcgcggccgctgtcgaggcaggcctcggcgacgaaacggccgatgtagccggtggcgcccacgatgagggccgcgccggtgcggcgaggctgcggcacttcttgcagcagcagctcctgagcagcaggcgccatggatcgatcgatcgaccgatgggttcttgctggctaacacccagagctgaaagctgatcgagtgcttggtagatctagcagcgcccggccgtcttcgacacacacgcaatgagtgtggcagtgtggctatgtatggcttttgtaccgtgccagaaagtgtggaggcaggagagaacagtaggtaaacacatggccgccttcgtgcgacgtacgggtgatagacggccaaaactcaagagttaggtggtgaataatcccagattttcctggatgatatctacctagctaggacggcgcaccagcagcgaggcgttaatcaagggcccccgttgtatgcataaaaatgcctctacagaatgaaatgcgccttaaatccaacaaaatttccactccagatacagaaacatgtctcgtgctctgcctccgccaccgctttcctctgttcttcgtgtctctcgctggtcgtcttctcgtctcatctcatctgcccccaactgatatgggccggaaatttgttgagatctcagtgcggtctgggccagtggctatctcgtacgggccgcgatctgggcctcatgtgattagcacacggcgtttaccaccactcctgagcatcgcagttgcgttgctctctcccctctgatctttctctatggaataattgtctaggcatctgtcgtatgatttttaagaaaaaatcactcagatttttttctccccttatatttgcatccaaccataaaaataaagtacagagaaaccgttcaggtagcttgtgattgtattggttactagagtagtatttagtagagattaacacaaatgttgcatttataactaaaattacagtgccttataactaaaattacatttgtaaaaaagtagatatggtatgtaagtacactgtaattttagtacaaatgcactgtaaattttggtaactataatatttatcgttttagtacaaatgcactgcttgagaaaccgtccaggtatctaaagtgttaaatgttgcatttataactaaaattacagtgctttacaactaaaattacatttgtaaaaacagtagatatgacatgtaagtgcactataattttagtacaaatacaccgtaaattttggtaactataatatttgtcgttttagtacaaatgcactccttgaaaaaccgttcagatgtctaaagtgttaaatgttgcatttataactaaaattacagtgctttataactaaaattatatttgtaaaaacaatagatatggcatataagtgcaatgtaattttaatacaaatgtgctgtaaattaaatcatggtgttcatattttggcccgtgctcatcagtttgtttgtattattcattgtgtgcccggtaaagatactgctaggtggtgtcgtggtggtagggggataaatcacgaccgtcaaattaaaccatgcccaagtgatccgacgaaagcaaattcggtgatttgacgcaaaaaatctgtcgtgagacgtatagcaaaatcgttctctatctttgcagtaaaagcgctcggttaatgggtagtagtattttggcttatcggtgacttgacgggcgcgttacgtcagtggaggatatataaggccgcacaatccgcgccgccatcagttcgctctcgccaccaacaccaccgccatttccactcgctcgagagcaccagattagcggaggagataggggtccgcgactcgcgagggagaggaaagcaagcggagttgaggatgcagatcttcgtgaagacgctgacggggaagaccatcaccctcgaggtggagaacagcgacgccgtcgccaacgtcaaggccaagatccaggacaaggaaggtaaccctgctctcttactgctcgtgttgcgagtttgagactgcggttgcatatcgatctctctgcccccatctgcttgttgcatttgcccgatcagatcagtagcaaagaattcgtggatttgggttggtcggtgactggggtttttggctgactaattgtttctgtgcttgtaggtatcccgccggaccagcagcgcctcatcttcgccgggaagcagctggaggatggccgcacgctggccgactacaacatccagaaggagtccacgcttcacctggtgcttcgcctacgcggcggccacatctggatcgagccctcgctcagggtcctcgcctacaagcacaacatcaacaagatggtctgcaggaagtaatactactcgcgcaccgctcccttcttagttcttacatcgatctatcgcaacctgagatgttgttgagttggtcgtgcttgcttagatgagttttgttagcgatgaacagttcagtattttagttggatgcattctattacgagtcagctatgatcaatgtgagcaccttgtcgatgtctcaccaatccaccatactggatcgttttaatttcagtttttttttctaacagcaggggcactaggccactggcaccacaaaggcacaaagtcctctctcactgtgatatactgttgccgtcaggtttatgtttattcacgtcatgtagttagttggatcgatataaggttgataggcaatgcaagcaggaaggttcaattgcgaaccagccagatcggcacacatatacattctgtttcgggtgtgtcagtttagtcatcaatacttttgaaagaatttacaaattgtaccatgctgcaagtcgtttgattactttgttcactctttgccctttctatggcttggtgagagctgtgctgttactcgtttacgttattgggacggttgtttggtagaaaaaatgatcgatcgatccgatgcgcaagataagctgtgtttcaaaatctctcaatgtgcatacatatagtctccctagtcctttatatttggtcagctataaggcaatttggtcgagaattttgtgcttgcaaggtttattgcacaatttgtctttttttgttcacccctttgtcttgcaggtgctatgcaactctgcctcccagggctacaaactgccgcaagaagaagtgtggccacagcaatcaggtgagccttatcaccataaaccatgttttcagtcttagtgatcatgtcctaatatgacttttggagttatgatgcatgtttcattgtttgcaaatggtacttagtagttcttagcgatcttgtcccaatatgatttgatgcctgtttccttcttgtcaaatatgagtagttaacataatggagtttgatgttccagttttggttctgtggtatatgcatcctatatatttctggtgtaccgtgtgctgttaccgtatctaaatcgtttgcatatgctgacaatatgaaacaatgagatgtttcagattttgtcagcttctaagcaatgacatcctcagatgaatatttctccccattgttctgattatgtacttttccaatccattctttttcagctgaggccaaagaaggtgaggtggtgcaggtacttcaacttctgaagagtcatctcatccatcattccatcagtatcatcagagtcaccagcgttcaagcgttatcaaa

SEQ ID NO: 63412 - DNA, 3240 bp, Oryza sativa
ttatttttgtttgtcaggcctgaagtgcctttgtaataatgtaaatattatcgatataataaagatgtgccttttgtatcatgtttgtttgatgtaccccggcttttcctgggacggggattaatacactagcgttcaggaaaaggcaattttctcggtcgcgacacctagcgtcgtgtaccctagcgccgctgtcgccgccgttcgtccagctgtgcgccgccgttgctccggtcgtcgtcgtcgctcgggaaggccgtcatcgtgatcgtcatctcgtcgccgtcctcgtccgcccctccgtcgtcgccgtagatcgccggagccccgccgtcgttgtcaagccgaaggtcaccgccgcttcttcctcgacgttgtcgccgtccgttgaccttccgccgctgcttcggtcaccggtgagttcgccgtgtcgcccgcaacccggaggtgtcctccgttcgcgccgtcgtgccgtcgttcgccggcgagcatgtgccgtccgagccgtcgccggtgacgacgtcaccgctgacgtcatcgacgccgtccgccgtagaccggtcgtagaccgttagatcttgtccatccgttttggatagatcgatctcggccgtttgtttctgtgaaccgccgccgtgcacccggtccaccgtgagccgagtccgctgacgcaataatccccttttccttttcaaaaataattcatgagatatgggttcagctggatattagatataattacttagccatgcttagaaacattagcacatagttgggataacttatgcttcactattatttaatgatggcttaatgatagctcatgatggttaatcatgattggttaattaattaatttgccaactaaaacctgataatggtgggttgtgagcatatggttttgatggttgtgctcatgacaattaaggaccggttcacgattttcggttgtgaaacatttaccgtgccaaccacaagccagcgtaggcaatggctttactttctgtatagtatggttcatagtagagcaccagactgtgaagtggcagagataagcccacgggggtcgctgggtagtccataccttgtttataagggggtgattatgatccaggaacagtgcactgctttgaattgtattatatagagggtattgtcacaatctatattcgggtacttgttaagtatcgcgacgcatggttgacatgatgttgaggttgtgtcttgtgggtacagtgctacacctctggccatagtttaaactattcgaatagccgtgcccgcggttatggtcgcgtctaacaatgtctttcgtgattagtttcacattcatgcttgtcaggaggtggcaaggatcgccatgggggagctccgcgaaagctacaatgatcggttggccgacaccgagtatcgctaccatcctcgtcaaccccaaggaagtgaccgtggcagctaccttgaacctgcagggattgagaatgatgctaccacaaggcatttggttgagatgctgtgggccatggatgagacccgcggtgagattgtgatagcagctcaggatcgcaaaaccggaatcgcggcaagatttgcaagctggaggacaaggtggatcgtttagagaaggagctagccgcgttgaagggagaagcaccaccgcaaaaggccagggttcatcttaccgcaaggaagagagctctattcgttcctcgctaccagttggcgccaaaggttcgtgtggtggaaaaagaaactatcccagccccagcggatcctccggtcgtcaacgtaagtgatgatgatgaagaagaatccaagcgcacccattccaaggtcgagtggggagcaactcaagatgatggagacgcaccgaacgagccttcaatcaactccgatgcccggaaaacctagaatgccttgtcaagtcgttatcttagatcgttgtgttagtttgcttgtttaagtttggttgtgtgtgtgggtcttgcatgtggtttacatcagtggtgggatgtaaatgcatgcctttgtttgcttccgagtgttaggaagttggtgagtttagtggtgtgagagtcttcagttttgtaataatgaaactcagttaagatcaataaaagttaagttagtaaaaattaattccctgtcctaagtagtttttcccgtttctctttttgtgttcctatctatgccagatgttgcttactcgcagcaacgggaatggccccaaccccaacaacaacaacaacaatgcagagaatcccacgcttgctcaagtcctggctcaacaggcacagcttatgaatttgatgatgcagcaactccagaaccagcagaaccaggaaaacaaccatgcacctcccccaaataagctggcagaatttcttcgcgtgaggccgcctactttctctagcaccaccaatcctgttgaagctggtgattggctgcacgccatagagaagaagttagacctgcttcagtgcacagatcaagagaaggtttcttttgcttcacaccagctgcatggccctgcctctgagtggtgggatcacttccgtctcaacagaactactgctgaacctatctcttggcttgagttcaccgctgctttccggaagacgcacataccatcgggagtggtgtctctcaagaagaaggagttcaggtcgctcactcagggatcccacactgtcaccgagtatctgcatgaatttaatcgcctggctcgttatgctctggaagatgtgcgcactgatgaagagcgccaagagaagttcttagagcacccgcaatggtaaagtaaggtgctctctataaaacatgtacatctcagcaatagactagattaatagtaaaccacctcaatagtatgtctacaacagtatctatagctctctcatgcattgcctcggttttctctatagactatctctaagttagtagatagctttgctctctctcttcatttaatatcttccaaataggaaaatatgctgacatggatctcttgtagagagcctatagataaccattgtgggtgccctaaagggctatatgatgagctttcttacccactcatgactggggattatcatgatttccagaagttagtggataaggctattcgccaggaggacaagtacaaccgcatggagcagaagaaacgccgaattgctcacttcaaggctcagcaggggaatagtcagaggccgcgtcttgctatgggacctcagtcagtgtcac

SEQ ID NO: 63413 - DNA, 1059 bp, Oryza sativa
cgtcatcactccaccaagtcgccctcacatctctcgcttagaccagtgcaacgtgcaacacgagctagctggcttcgctttggtcgtgggtctccatcgtcgccggggctcactagagacacgaacgacatgagtacgtcgctcatggctgtgttgtgatgtcattgctgttgctccgggtggtcgccatcatggactcatggttcactcacttgaatcagaaaagtaagggctaatgggcctttttttttttgacaacttctttaagggctcatatcatgaaaaactaaaatcctaataacctaatatttttgtatttgttatatttttattttacccgttgcatctatttattaaaatgtttaaataataaaaaaattctcgatcggtcccctcttctctgtttttctctttgttcctgtctgctctttttttttaaaattttttttcccctcactgtctaatcgtctttcattttttttcatgtctactaattaatatttgacttcaaatataatttgtaactcaaaacaatactcactctcacaaaaataaaaagattgatttttacgatttgttaaactccacacattttatttcagataacatacacaggtatattcccatagtttcttgtggtgaaaccagtcaatctggattcaaatctttgatttgacacgtgtgcttgaggcttccgtggtgacttcgtcaatctcaatgctcgtgttgtgagagcgtttatgtgtttcttaaaaaaatatatattctcgaaattcaaagtacatcgagtacaaaaattccactcgtattttatcagacttacctactgtggagattatgggtaccccatacccacacggcatggttatccgactagtaataggggataacatatatgtatggaatatgtaacagatcatgacttgggtattacgttttcttttatattatggagcggcctaaagtcctgatttgataatattgtaaagtagatttaggaagccgataccgtgttggttaaggtttctatcttgtaatcctgccccccaccctatataa

SEQ ID NO: 63414 - DNA, 696 bp, Oryza sativa
caccgtccctttttgtttaaggcagtgcctcgtattcatgtaatgagggagaaatgtgtaatacagacaagttccatgaggattcttttggaagatgcggatatgtgattatgtgtataattgcttactgataaaggaaacctagggtctcatttcagaggaactatgttccaacctcgagttaataaccaacctgttgatggaaaagaaaaccaattaaactgtgttgggttaaaaagccaatgagacagtagttggggataggagtttggatacgctttttacagatcaagataaggattgttggatgaaacccataagggtacccgccatgcctctacatagataagttcggatatacctgcaaacagttaagaagatccaggagacatcaatatttgagaacataatagtcgatggttggtaattagtctatcaggtatcagaaaagggtcaaaggtgatatggcagaagaacaatttggatgctccccatctcgaggcagcactaaagatgaccatcggcaattaaaccttagtggcatagatacagatagcaagcaatgtatttccctgaaggtagtcagtgcagctttttggcgaaccacatcaaggtttcaccgaaaggcagcgagccaaaggacctcatcgtccccagaagcgtccgcaatccacattagagaataccacctgttag

SEQ ID NO: 63415 - DNA, 1556 bp, Oryza sativa
acgcccaacagcggcggcataataggccagccgtgtaggcggaggcaccactcggcggcgacggaggcaggccggcggtgaagtcgtagacgcccaacagcggcggcataataggccggccgtgtaggcggaggcaccactcggcggcgacggaggcaggccggcggtgaagtcgtagacgcccaacagcggcggcataataggccggccgtgtaggcggaggcaccactcggcggcgacggaggcgggccggcggtgaagtcgtagacgcccaacagcggcggcataataggccagccgtgtaggcggaagcaccaatcggcggcgacggaggcaggccggcggtgaagtcgtagacgcccaacagcggcggcataataggccagccgtgtaggcggagacaccagtcggccgtgacggtggcaagccggcggtgaagtcgtagacgcccaacagcggcggcataataggccagccgtgtaggcggaggcaccactcggcggcgacggaggcgggccggcggtgaagtcgtagacgcccaacaacggcggcataataggccagccgtgtaggcggagacaccagtcggcggcgatggaggcaagccggcggtgaagtcgttgttgatatcagcaatggcggtggcgaggacaagccggcggagtggactcgcggccgattgaccggaaagctgagatgccttgagtccatgaccaacatcgttcgcctcagtagtgccgcgtaattatatgcgaacaacaacaaaaaatagcaagaaattaatctgagtttagaaatcaatctaatatatattgattattgataacaaattgaaacgaaaaactcaagtcgagcagtgaggctggatcgtgggtgatagccggcgacgcgccatgcaacatgtataagccccggcaactaactgctaactcgatgttctttcggtatgacgccattatcggaggtagccggcggagcacatcaaccgtcatacatggaaacaggaatcgaacggcacatgtgtacatgcaatagaaagcaattagtagattaattccagtctgcatatacgtgttgattaataaatcaacagatgcgtgtgtttaatttgctcctggcggcctgtgctactccagcaacacgtccaactgcaaggaaaggaagagaggagcactcggacacggcaagggcacccgagcaggcgacgatgatggccgtgtctcgatctcatcgagtatatgaaatgcatcaaaatatcaggaaatcaaacaacgattaaaaatcaatctaataaaaattagattggaacgataaacccgattaaagatttgagccgtcgaaattgatgagattgatctccgggcttcttctgaagttgattccatcgcacttttcgacaggtaattcgacgcatcccctacctggcgcgccaactgtcgaaacatgaattcggcaataataaaacggggtagcgcacgagacctaaaagtggatggatgcagagacaaaggatttagacaggttcaagccctctcaatgagaggtaataccctact

SEQ ID NO: 63416 - DNA, 1757 bp, Oryza sativa
aggtacactatattaccaaggcttcgtggggattaaggtcacagatatcaaaaacttttacatgcacagcttctttctgaccaaagttcggctctattgcccttaccacctgtgggttaccatggaggcttcaaatatgaaacagattagtgttttggtctgtaggctagggaaatatggttgatccatataacagataaactaaggaagatataagttgaacaaagaagaagcatgtttatgtgaatggaaagagtgcagaaacagatacctgcttatgagagaaattgtttcctagattggtgcattgggataccacctacaaacagtgctaccttgtagggctagctggtctggcaagcatgaaagagtacattatttaagcaagaacaggcaaatatgtaaatgggagaggtgataatagggtaagaatttatttcttaccgtctcggaatttaacagttaatccaacaaacaatataacaacaggtccatggtctggttgctgctgtaagttttcagcgtggaactgtgtagcatgggcaccccacaatgcaacgacagcagtttcgctgtaggcacatagaagaatgaagaggtggaaaataatgtgcatgaattaagctagtattcacatttgcaaataagagagttgtgaaacaatgttgatattataaacaaaaaagaaggattgtacatgtgtaaaaagaaactgacaatgcatgtgcggacaattaagtcattttgtatttaatacaaaagcagctggaacaattagcggattaacgcatacataccttccattggttatgtggacattaagcaccgctttcataacacctccacaagaaacagtttgcactggtccaatggctgtcattatacctatagcatctacaggagtagtataagggataaaatttgcacatgagtaagtgagagcagtaagcagggaatggacaaagctaataaggaatgagatagattgatctggaccaaacagagtcacctgaaagaatatctttcctgtaagcacgacctctgagttcatcaaaagaaagaaccttgtaagcatgagatgggaatgtggatggtgcctcagtgtcttctctaacggttgtgtgggcagtgaattttgccatgaccatccgatcaataggcctgtactgggggcgcgcctcagcaacttcgaagtacttgatgtaatacacagcatcctccttcagcaaaggcttgaattgagaaacatgacgtcctgggatctgcgcatccatcatgtacccttgttgatgtttggatgtgtaagagacaaatagcatggaggtaaaataaggcatgaccatgtgcttattgctatacctgctcatcaagcaggactaaatcaagtcgcagaatcttgtcaggttcatttgctgtagtgaactgcgagaagcgcgtgacccgcactcggacttgccaatggtgtgattcctgtgtcacattccttagcatagtgtaatccatctgcaacacataaagaaggcattacataggttagagggaaactataataataataatactttgcatgatatgaagatataaagtcctaattgttgaaggaactgtggtgcaggatatatctttttctttttcgaggtgggaaatgtttcccaactgacagtgtttcaagcaggcatgtttaaaagcaactgattgcatccaagagaagaatatgcaaaaataagaaagaacaattaataagcagatatggaaga

SEQ ID NO: 63417 - DNA, 1291 bp, Oryza sativa
ttaccaataaaaccatatcaccaaagcgatcatccaaagtattgatccagtagaagattttcgatttaattcgaccagggtaattgctaatggatatatcacaggaaataccatattggttgctcacatactgaaggactggaactcttgcattaggaatgaactccatatgtctagcaatacctaaataaggaatgaaaacagataagaatatcctgtaaattcaacaaaaagggttgcattgaatgaagtacggaacaaaaagaagatcgtgaatagcttgatcaaaacttattcattacagtgacttcacctctcacaagatatattgctttcctttttttttttagataatggataacctggccgctgcatcaaagacgcgcaaagcccacttattgctttccttggtgcatgtatatgcatatagtgactatttgtttgatcacaaagaacacacaaccaaaacttctatcatttcggttaaagctgttttcattaatcgaaaagaaagtttacctcgcttttgcaaagctctccttacttctctcagggtatcttgcttctttctcttacttatagggagattcaaggcattgaacagctcaactgacacatccaaatcacctgattttgcataaagttgtgatacgaaggatccaaaaggttttacagaagcacctataaaggaaagttaagaactcagaaaaagaaacactaaaataattgcactggtgactttctctaaacagtacccttttccaacatggcaaacttcataaataatatatgcattgaggaagacactatccattgtataacaagagaatgtaaccaaaaaaaaaatccagtaaaaacattatgtgacatttgagcagctccattctggctatgggtaaccattcggtttgaacaattaattcggattgattctttggttttctcgaattttggccatccgaaaatcaagaccgaaattcaatgcaaaatcataaaggccaagctatttggttttggtcattttggttcggtcctaggtcatgaccgaactgattgatcaatttcaggacatgtttcggtagtaaaaaatttggcagcaattccccagtttcaggacatgtttgacagtaaaaagtcacaaaataaacaacaaatgatatagaacacaaagatagcacttgcaacttaacatcaaaattcaactgttcaaacatgatacttaataggcttaacaggttgattttgcgcttattaactatatttcggtcaattcggttaacccaggcctaat

SEQ ID NO: 63418 - DNA, 3885 bp, Oryza sativa
aagtactgagcaatacttacagagaaaagcggcttatgaacaacaatgtcgtgaacaacagagcgactggcgggtgttaactatggcactccctccatgggaagcccgtccaagatgcaggtgtggtgatcgttgtcaggttcttcgttccataaatcctacaacattgggtcgaaggttctttgtttgtccaaatattcttgacgacgagttcatggtaagaatattttgattacatgaatccttattttctcacaacatttactaactttgcttgctttacatctattctttcctcccaggaaccaccaaggagatgtcaatacacagaatggatagacaccagaagggttctaactccacctagccgtgttgtgcagcttgaactaccagagaaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaggcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactctccagcgacccccgtggacttctcgccacttctcagtctggcgcactataatgaatcacgctatacaaaagataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccactcggtgacattcgaaaataaatgcacagttgaaataaatagagaatttaaatataggatcaacatgctcaaaggattgtgtttaggatctgtgtgacttgccttgcaataatcggccttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgccggagatagagcgaccggctgcggatttggaggacatgaacacgtagaggacgacgagacgaacccaacgatactcaccctcgtgccaaacgacgaccgacgacggccggcgacgaggaggcgacggcggcggctcgggttgcacggggcggcggagctccgatgaccggcgacgaaaaagaaagggtggccgagcttcccctcaccacggcgcacccaacggtggtgacggcgaccggcgacgacgatggagacggcggcgcggcggcaccggagatggccggcggcggcggtttgcttggcggcggtggcgacggagctacggagcacggcagaggacgggagagggggcaaacgaaagtggaggactagggggtcctatttatagccttggattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagaggaatatttcccctcaacaaaattggagaaaaagagcaacggggaggcgagaattggaaggaagaggcggcggcactgtgcacggcacggctggctcgggctctgcctgagttggaagatgaacagtagcgcagggagggaaagtagacttttccggctgagctgagaggagaggaggcggctcaggttgggccggcggaagagagaggaaggaaaggaaggaatgggccgaaaatggcccaagctgaggaggaggattttattactttcccaattaaaataatcacttaaatgatctttgaattattaaaaatacttccaatgctcaaataatttcaagaaaaatcctgaaaatacttggacactcaaagtacttaaaaaaattacaattagaccatttaatgattaatttaatatgtgggtaattactgaaatgctctttgtatgattaaaaattaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctattattaatttattaaacaatttataaatcctgaaacgaaaatcaggatgtgacaatctatgtaaccgcaatgcaaatagttgtatcatgttcaaattgtactactatttcttcatgttacataattctcctagtttaagtccatataatgtttctacgacccagactgcgataagcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtactttttcatctgggtcctttgccgcccagggacccagatgaaaaaagtacggccgcaagctctttatgggcggccaaaattgcaattagccccttg

SEQ ID NO: 63419 - DNA, 1329 bp, Oryza sativa
caggtacttgacttccgtaagcaaaagaattatctttggttatcaagcacccacctccttagtccttaccttaccatatgtatctttcatggccttattgttattatatgtgaatgcatgccgcagcaaatagccaaggtcctttttaaagaacatatattaacaggtactgatcaaagaagctaatattaatctcttggcagctttctgatgtatctttacacacagttactaaaattatgcttttacccactaaaactgcatgagagttaagcatttgtgtgtccttttccctttttcttttaggattaatcagaactatgcttattaactttgcaccatggatattctatttttaacttgtgacagttgcgtgcatcaatttttctagcacctctcatgtttatgcggataacttctatcttggtttatttatcagaaggttgtgggtcaaggcttgacaagaacagcatcgattgctgcattaaatccacagctacctggatcgtcgacaaatgggccgatggcacaaatgtcccttcctcagaaacagcagcaggcagcatggttaaaacaaatgcaatcatcgctgggatcacctgtttctccacaacaatttcagcatcaacaaaggatgctattaatacatcaacttcaacagcagtcaggattgaatcaacaccaaatcgcacaaacccaacaacagcatcttcatctcaatacccagcttttacagcagcaacacattctacagcaacttcagcaacaacaacaatctccaaggatatcagcatctggttcccagaagtccatgaacctgacaggatccgaaccgggcactcctttatcaggtggaactatgactggtggaagtgcaagtcaaggagcagaagtaactaatcaacttcttgggaagagaaaaatacaagatttggtttcacaggtaacaaataaccttctgggttcattcttatgagcttctgtatcactggtatgatgtgatcgtatcatgatctttgagatttttcttgaaatattagaatcgcattcccatttttcagaagcatattctctttgttggttgaataataatattttgctcttttggtcgaataatactttactcttttggttgaataatactttgctttgtctttgaattgtgaactcctatttacaggtagatcccctgggcaaggttgatccagaagtggaagatttgcttttggagattgctgatgacttcattgattcggtaatgtgtttgttgtttgtaaatcatgcttttacagcacacttgctcttagtgaatttctatttggttgaaaa

SEQ ID NO: 63420 - DNA, 860 bp, Oryza sativa
gagctgaaatacgcacctgtccgtacttgttccatccccagcagaagacctcgccttcatctgcataaatgtcaccacattttgtcagtagatgttagaccaggaacagcactttctacgggcatgtttaaacaaattgtcagggaggccaaagattaacaagaatttaagtacttcaatcacacatggaacagcttattgtagaattccaactttccaagcacaagttactgataatacgctaataactacagtgactcataatatgattacacatcagaatatctaggaagattcaatagggcttgcttatatggggattaggctcagtacgttcggttggcagacagattaaactaaaatactcatggctttctaagggatcgagtataatctctacctcttcaacaaaccctaaaggtcttgtttggataattgggtttattcaacaaacccttgccagaaatatttccttgatttaaatgagcatgagaagagcattttattaatatgcagttatattagacagataggatagcaaattccttctaggggaaaaatactagtacagtcaaaggtaccagttattattgcactatgacgagctccacaagaaacagctcgtgcattcttattctccaagcttgaggcatctaccagttttggtacagtctgcataaaaaaaaaagcaatatacttatggttatcacttactgagtaaacatgcacctcacatacagctaactccattttgggaggcaatcattatgttaactgtagttattttccctaaacttactttatgtaattaacctccattaacatcgaaaagaatagaattgagtaaagtgtacgggcgg

SEQ ID NO: 63421 - DNA, 735 bp, Oryza sativa
taaagaagacaccatttaggagacttggaaagcgtgcgaaaaaaatccaaaatatggaatcgggaaaaaaagagagggccttaaactccctttatcacccttgtcgtactaagagttctattgatattcgtcaatattgcactcacatttataacataatgattcctttcacctgtacggataaatagtacaaaatccaaatacgacataacacaaatacattataattattatgtaatcaactctcggtttcaacttaaacagagctaattagtgttgagaaaaacacaacccatggtgcttaattattctctcgctgcatcacctttaattttatttttatgttattaacaaaattaatcatcttcatatatgatttgatatgtggcaaagcggtagcgctacagcggttgtgatcaccttagatgtcttagacactacgctttgtcacacgtgcgaaaggccaaggtgcagacgtgcgttgtgcagcaggcaaaaagagaatttcggacgctttatttattagcaaacaatagatccaatgattataataatatgtccaccagttctactgtaagtgtaaattagttaatatagattttaaattgttaatataatggatacacaatataatggtgtagaccttattttgaaacagtgcattacctgagaataatagaccaatgtaaaaaagtagatccgataatttatataatggggccatcagtttaagtg

SEQ ID NO: 63422 - DNA, 1683 bp, Oryza sativa
ctcccagcacggaaaccgcccaccaactttcgccgcatggcgccggtcgccggggcggcgtctgagagggcgcccgcacggcgcgcggcgcgggtcggaagcggaggagggcgatcgagatgagggagctcgccggcagccccgggacgtggagcggcctctcgctgcgggtggggcagctcgtcttcgccgccgcgtccgtctgcgcacggcctccgccctcggcttcgccgcatacaccgccttctggtgcgtgccgtcccgccccctcttctccccacccttgtctcgacgtcatcccgtacgagtagacgagtagtctgtcgctcgattgctacgagcaaccctcgctgcgtgccttatgcgtttgcaaatcgattggggatgctctggtgacggcgtttcgcgtgcttgggcagagtgatttagtgcggatcataggcatcatagtatcatacacgcttgaacaatcatgattgagtcggccaatttgctgattgatagagtagcttattaaaatttggccggcatgtcacgccgccctgcaatttgctgattgatatgcagctttgttgctggataatcattgttgtggctttattctatatccgactgcttgcttcctggagccgtctgctactgtaattggggatggaagttttgtggcaatgaggtttcctttgtgcattatattattcacaatttcattgacagaacgattcatttcgtaattcaagtttgtgcaatttggatcatcaaagtaaatatattgtcactgttgctttgaatataagttggccttaggcttttggtctaagtttgtagccactgatagctgtaagatttgaatagacactccttcaaaattgacaatcagttaaaactattcagtgactgaggcatctgtttcaagcagtagaatggctttgttcatcttcgggtgcagcagccggggatgttgttattccgttatctaaatgtttgaagcactaggagagaccaaaggtagtcaatataatgaaatttaaaatttttatgttgctggaacattgagcaactttactcatatccaacattcattgtttaagtagggtaggcatgccaatcattcatgataatctgttctttgtttgtttgtcctatttattactctatttaatttgatgagtgacataggaagtctcagtgttgtctgtgctgttaagattggtgtgttcattttgtggaaggaatctggcagtcgtttgcatatgtgaacattcgtctatgcatccatcaaagcaaaaccatttgatctgcactatgacagaacttgcagattgaatagtatcctgttaagtaaccagtttttggtgaactctcaatttcagttacttgattgcatcgatgggactacaggcactctggagcttgggacttgcttgccttgattgctatgccttgaaattcaagaaagatctccacagtgctgttctcctgagcttatttgttgttggcgactgggtaattattaatgattttttttcatctcatgtattattcacctcagtagttcccacaaccattgaaatggataaatatttagaaacaaatcaagtaaaaatttaaatttctgaaaatttctctgccaggcctgtcaaagcataagtattatactcagatagaactcattataaaaatatc

SEQ ID NO: 63423 - DNA, 2991 bp, Oryza sativa
tttctcttggccatatgtatatggctacccatttcagggagctattttgtggagtagaaaataatatggaacactctcgtcctcacaatggcttgcaagactgaggctgatggaagaacaagaagcatggcctaggatggtttctcatctcgttggcttcagttgctccactagctcatttggtttattgattgagatactgaagaacttcagatccataaaccatcactcatcggtatacagaaaatgacaaggcttgaattgccagtacagatcgaaatcaccaccacaaatcacaaccgcaactgcgaagctcagcacagcagcatgagcaaattgccgtttcatacttacataccagtagttctacttttattttttctttttctagtttttgcgatgagcttgtacaaataattggcctatagtttatatggatctgcctgatccttattattatccactttgcatcatttgctacaaattgtgcaatacatcatgggtctgttccatatagcagtatatatttgtttcaaaaagaacaaagtacaaggctgatcctcttcttttataggaaaaagagtttcttctggtcctcttggtgcagggttgagaactttactggatggtccaaatgaaggtacaatcaaatatggcacactgaattctcattgagaagcagttttcagaatgtgagtaacacacatgctaggtcaacatcttggaaggatcacaggtataaactaaagatactgcataaaagaacttgagtataccataacataaaaggagggttagttcacatgacaatctcaggcttcaggatgcttgacttgatctctttgtgcgggagaacaacaccgccgttggtatagacctcatcacctacatgtacgtcctctcccaggatagtcatattttctatccgtgcccattgtccaacagttgagtgccatccaataatgctgtttgatatgcaagcatgcttcttaatgtgcacgccacgcatcaccgtgcaacgggaaagcctcacaccatcctccacgacgcatccaggaccgatagcaacatcaggaccaatcagacagccttcgccaatcttggcactctcgtgaactagcacattcccaacaatgtgtgctccagtggctaacctgttggttgatctcttcctaagtgaatccagataaaggcgcaagcctgtaatgtaatcccttggttggccaacatccatccaaaaacctggaaggaccagagcaaagagctttgcatcagatgcaattcgaggaaagacctctttctcaattgaagttggcttcagctcgatgcggtccaggacagatggattcaacaagtaaattcccgcattgatcttgttgcctacaaatatttttggtttctcaacaaatttttccaccattccagtgacctcctccataaccacaacaccatattttgatggttcgtccacctatattgaaataatagtcagtatacacagtacacaagtttacaattcaagagagtggtcaaagaaaggatctaccttggtgaccataatcgttgcctcaccaccatggctcttgtgaaattttatgagctcagcaaaagggtattcacttatgacgtcactgttgaggacaaagaatggctcaccagatccatccacaagcttgtcccttgctagagcaagagggccagcagttcccaagggctcagtctcttgggaacacgtgattgtgatgccaagcttatcctcaaagtccttcaggaaattgagcattacctaaaagacggatcagagcaaaccaattagaatgtgaagttagttatacttataccatgagacaacagtaaaagattatctcctttttacctccggtcggtagttgatggctaaaacaacttctgttactccaacttctttcaaggcctcaatctgcataaatcggaaaacttttaattcagagctcattactctcctcaatcctcatgctcatgtttgctggagccaacattttggatataaatcaagtactcttgataaccgattggaattttcgaggacagagaaaatttggtgtgataccaaaagagttttccaaaatcatgtaaccaaattgataactaaggaaagaaacaattgaatagtaaaaaggtgcattcaatcacatccaagtgcaacctaccatggatttttagttgttacaccatgtttatgtgggagtaataaacaaatcaaatagtattaatgttctctgaccagtttagcaccctctccctcctttcatggagaggccagtgccattgttggactgttggtaaagaatactgtactataattaacttgtgcccaattcatccattggcactgcaaataagtactcttattactccatcagagtactagcgaaaccacttattacctgatgcagaatcatgggcttgttcgcgaaatcaacaagaggctttgggaaactgagcgtcaaaggccgaaggcgagtgccgaagcctccaacaagaatgagcgccttcatggtgaatcgccgcctcctgttctcccctccctaatccctactccggcggggatcctcaagcgggctcgggaaggagaaagctgccattgcaacagtcaaaatcaaatccgacactaggttggagcatcaaagaacaaagaaagaaagatttcgatttgatcgctcgcggccgcggcaaagctccgatgagtttagggcttccgtaccaataggagggatcagcctggaagatctctcttccttctccacgaccagcggaccagccctcttggaggtaggtagcgcagctgcggtggaaggaggagggctttgtgctgcgctggattgggaatcgagaattgggtgggactttatagagacgaagtggagaggcgacgcgaggggaggggaacgagagtacgagacacgacgagaggttcaggctttcagaattcagataactacagtagagatg

SEQ ID NO: 63424 - DNA, 572 bp, Oryza sativa
aggcggcggcagcgaaggtgggggcgaggcattggcagtaggagaagcaggcggcgtggaggcggcaggggtggggatcagggaggggtcgaagagaggttggcgttgggggagacggcgacggaaggggagccggtggagaggagcggcgaggaggaggaggaggcggtggaggagaagaagagcaggcgcggggaggagtcggaccagtggtagccgacgaggaaggcggcggcgcaggcgaaggcgagggccgcagcgcggaggacgcgcgggccgcagagcaggtcggcgccgtgcgcgcccaggggcttcatgctcgcctcgcctcgcctcgcgtcgcgtcgcgtcgcggtgcggagagcggtcggcgcggcggtgccttgccgatgcgggagggatgggatcgtgcactgccggggactgaactgaactgaggggcactgctctgttatttttcacttgaaaaatctatccccttcttggagtactactgtataataataattcttccaagtgggtcctctttgtcagtggacgcccgggacaccggcgaattgaagtcggctttg

SEQ ID NO: 63425 - DNA, 560 bp, Oryza sativa
tacctcccctggtcctcatagggctctccgcgtagtggagcagcagccgtagccagccccgtcgtcgtcgtacgcccatggcagagcactatcgttgctccgtcgctgatggtcagataggggatggagaaggggcacgcgtcgagaggatagcggcgaccaacggatgatccagcgcacaggaaaaccaggacggagcaaggtcacggcaccgatgccgcgatgggcctatgagcactaaaaggctgccgtgcattgggccaaaaaatcagctggcccatatgtcacgtcccaaaacgactctaaaatatatcccttaaatgatgcctagaataattaaaatccgtgtgaaagcctccaacaattaaaatgtgtaaagttaaaagccaaataaggcttagaggatttttgtaaatctcctaaaagcctaaaatgcgtaaataaattttagtggaattttcagacgcaaataataattattaagaaataaacaaagttaaaatgattttataaaaagaaaaaccctaaaagtcccccttccctcccttgggccggcccgg

SEQ ID NO: 63426 - DNA, 21453 bp, Oryza sativa
cttacttggacaatattatatgacgtattatgataaaaataaaccaaagacgtcactactaagtggatatgcatgggtacaagagactctgaggactccaggagagagtcaccacatgtttcgaatgaatacagacctcttctacaaattgcatgacttgctggtgagtacctataacctgaaagcaaccaaccacatgaactccatggaatcagctgctatctttcttttcatacttggaggtggtgagtccaatagaagggttcaaaataggttcaagcattccggtgaacacaattagtagaaaattagaagaggtcttattgagtgtggttagtatgtgcaaggattacatatgtcccaaagatcctaacttcccaagggctcatagtaggattaagaatgacaaaagattatggccacatttcaaaaagtgcattggagccattgatgggattcatatcacatcaaactcacctcgtgaagattatgttagatacattggtagaagcaagagtcctactcagaatgtgatggcagtagtcgactttgacatgcgatttacatattcttctattggacaaccagggtctatgcatgatactagcgtcctttatcatgtgttagatgttgataaagatatatttccacaccctccacaaggtatatactagctgaaatcatctacactttgctttatcttttatttgtaccatataacattgactcgatgcatatatcgtaggtaaatattatcttgttgatgctggctacccaaataggccagggtatatggcaccatacaaggggcaaaggtaccatattcctaaatggagaagaggtcctccaccaagtggtgagcaagagtatttcaaccaatgtcactcaagtgcacgcaatgtcattgagcgcacctttggtgtgtggaagatgaaatggcgaatccttttaaagatgcctacctatgcaatggacaagcaagaaatgatcattgcagctaccatgtgtcttcacaactttataagacagaattcgacaactgacaagtattttcgtaggtgtgatcgagatccaaattatgtcccaactataccaacaagatatgcaagatatgttgtttcccaaaatgcatcagatacttctactccaaagtctagtgataggtctatggacagatttcgtgatgacctagcaactgcattgtggcaatctagatgaatgttctcatataagtgctgttaggaatatattttggaagaactctccatagaaatatgtaactgtggtggttccactctccttagaaatatgtaaccatggtattttgcaataactgagtcaatttgagtggactattattataatggatattgtctttgatgccatgcaatgtacgtgacgtgttttttaacttctcatatggaagcttggtatttttttacaagtattgtgctaaaatatttgtgcatattcatgagtacttctaacaaatattaggattgccatttcagctatatctcgttggtacagaagttatatagaccaaggacgtctttggcttcccccattaggatcttaatgtttctagccaaacacctaaattaactgattctgattctcttcagtatctgattcaggaagaatcagaattagaatcacagaatctgaaaccctaccaaatgggcccttgctccctccgtttcaggttataacatgttaatcaaactgcattaagtttgattaaaattataaaaaaaaaataattttttcgatctaagataaatttattataaaaatatatttaattattaacttaataaaaataatttggtaatataaatattactattttttttaaggaaatatttgtttataaacttattcaaaattaaagtagtttgactttaaccaaagtcaaaacatcttgtaacttgaaacggagtgatacgtagttatttcatgggactgtctgtacattaaccggctgaaaatttcagctgaaattttcatcaatcgattggacacgtgccaactatccaacgtggagcgcacggagctcacgtggagagcagagcacttctctacgcacgttgccgagtaggatctggtttggccatctggcctattaagatgtttgtgcagcccattgtattacaagctcactctatcactggccaaggctagggtacagatggccataaggcacgaggcccgaaggcccggcccacggcacggctttgcccggcccaagcacggcacagcccaatttgggtcgggtccgtgccggcccggcacgatgggccggcaggccaggcccggcacacaaagtatagggactaaaaatagacatataaatatcactgtccaaagaatagggaccttaaatagacttatttagctatttatataccacagaccaaagaagaggaacgaaaaaggactttttttagctatatatatgtcacagcccaacaggagggaggaaaattagacttattctgagaaaaagcacaatagcccatcgtgccttcggcccggcccggcacggcccgaggcgtgttgggccgtgcctgggccgtgagtgcggcacgtgggctggcacggcacggcccggtgcgtcagtcgggccgtgccggcccgacaagcctcggtccaggcacggccgggcctaggccgtgccatgctgggcggcccacatggccatctataggctagggcttatttccttcgtccaaaaaaaacaatctaggaggggtgacccctcctaatacaatattatctagattcattgtattacgatgagtcacatcccctgacccctcctaggttggcttttttgggacggaggaagtagctcgtaagcatatctctggaccagtgtcgaaaacatacttagcatgaaacagccagaccatctgccactatattacatttgtgactacaaaccgagacttcacatagataaattctgaatgcatgaagtctctaatctacggctctgatcgtttgcctaacccatccattcagcacggaaaacagagcagtccattagtgcgtgattaattaatttttgctaattttttttcaaaaatagatccatataatttttttaagcaactttcatatataaactttttttaagaaaaaacatatcgtttagcagtttaaaaagcgtgcacatggaaaacaaggaggaggagttgggaaccttacatacaaacagagccttatagtaagcaatcaacgagactttgatcaatctcagttgaagacaaagcatcggtcaacatcctgcataacaaccaaacaaacaaagctcaatgatttaaatagtttatatagggtgtaaaaaggatcataagaaataattccatggttctcactcaactcaaaccttgcagccgtgcaagaaaaccgttagaaatacaaaagagttccaagatatgtgaattgtttcacgtctgagcttacgcaaatagggatggcaattttcgacctgccagtacctgcccctccggctccaggggaagggtgaattctcacccacggatgagcgaaggcagggccccgtaaattaccggggataggaacggggattggaagtaacccgcggagtgacccaacagggcaccggagtactctctccgggctgataatattagtcattttggataagggtaaagtcaaactttaaaatcttttactacaaataatttctaaagtattcatcttaaaaatatgaaaatcatatatgtagattagtcttaaaaagtatttcaataaaatcatatatttgttgatatttctatatatattataatagaaaatagttgtcaaagttactttttgaagaccgggccattatccaaaacgataagtattatcaacccggagggagtatgatttttggaaaaagtacatcgaaggtccctcaacttgtcattgagttacaaaatcgtcccccaaccgtaaaactagataaaacacatttctcaacttacaaaaccagtccctcggcggttttgaccccgattttgtccgacgtggcagctgagtcagcgtgggacccacgtgggccccaaatgtcaggtgcctcatcagcagattctcttcccctcctctcccttcctcctctctctcactcttctcttctcttctggcaagccggccggcggctggggcggaggccgccggggcgaggcgggagaggaggaggcggcagcggcgacggctacgatgcgggagaaggcgagggcagcagcggcgacagcggctatgatgctggagaaggcgagggcggcggcggcttagcttagcttccatcgatcatgcggcagcgggcatatgtccgggctcagcgcgcttggcggtgcgccattcttcaagtccggcatcgctggcagcgacgagaggcaaggcggccagccagtagttgggagcgcttgattcggcggttgttgtgttcgtctctgcttgtcaggtgtggcttagcattctcacagtactgtggcactgtgctcttgtcttcttttagctactgttcttgagataacactattaattagttagtctgcgtgtgtgcagcaagcgatgcatggattataatgacgttgttaagttgctaaatatggcgcattacgtggtgctaatttcgagcttaatttgtcgccagccaatcagtcatcctataattctctgaaactttgattgcaatcggcctttgtacttgacttaattcctctacacacttgtgttcattaagaatccgagcctgtaggctctccgcctatccacacacctaaatgaatgtgccaatatcggcattaactgaaaaaagttcgccgcgcgagtcacgaaatgagattttgctacgaccgcacccaatacactccaatatatccaaaactcaagttttggtgctttttgaacattttggtttatgtatataacatggcacacacgtatgccaatatcggcattaattgacaaaagttcgccgcgtgtgccacgatgtgagtttttgccacgaacactctcaatacactccaatatgtccaaaattatgttttggtgctttttgaatattttggatctggtatataacatggcacctatgtgtgcaatatcggcactaactgacaaaacttcgtcgcgcgagtcacgaggtgagtttttgcaacgaacgcgtccaagacactccaaaatgtccaaaaatcatgttttggtgctttttgaacattttggttcctgtatataacatggaaaccacgtgtgacaatatcggtattaactgacaaaagttcgtcgcgtaagtcacgaagtgagtttttgccacgaacgcgcccaaaacactccaatatgtccaaaaatcatgttttggtgcttttcgaacattttggttccggtaagaaacatggcacccacgtgtgccaatatcggcattaactgacaaaagttcgtcccgcgagtcacgaagtgagttttcaccacgaacaccccaatatactccaatatgtccaaaaatcatgttttgatgcttttcgaacattttgggtccggtaagaaacatggcacccacgtgtgccaatatcggcattaactgacaaaagttcgtcccgcgagtcacgaagtgagtttttaccacgaacaccccacgaacgcacccaatacagtccaatatgtccaaaaatcatgttttggtgctttttgaacattttggatccgatatataacaaggcacccacgtgtgccaatatcggcattaactgacaaaagttcgtcccgcgagtcacgaagtgagttttcaccacgaacaccccaatacactccaatatgtccaaaaatcatgttttggtgcttttctaacatattgggtcccgtttataacatggcaccctcgtgtgccaacatcggcattaactgacaaaagtttgccacgcgagtcacaaagtgtgtttttgccacgacagcatccaatacactccaatatgtgcaaaaatcatgttttggtgcttttttaactttttggttccagtaaaaaacatggtacccacgtgtgccaatattgacattacttgacaaaagttcgccgcgcgagtcacgaagtgattttttgcaacgaaagcgcccaatactctccaatatgtccaaaaatcatgttttggtgctttttgaacattttggttcctttatataacatggaaacgaatgcgcccaatacactccaatgtgtccaaaagtcctgttttggtgctttttgaacattttaggtccggtatataatatggcgcccacgtgtgccaatatcagcattaactgagaaaagttcgccgcgcgagtcacgaagtgagtttttgcaacgaacgcgcctaatacactccaatatgtccaaaaatcaagttttggtgttttttgaacattttggatccggtatataacatggcacccacgtgtgccaatatcggcattaactgacaaaagttcgtcgcgcgagtcacaaagtgagttttttccacgaatgcacacccaatacactccattatgtccaaaaatcatgttttggtgctttttgaacattttagttccggtaaaaaacatggcacccacgtgaaccaatatcggcattaactgacaaaagttcaccgcgcgagtcacgaagtgagtttttgccacgaatgcacccaatacagtccaatatgtccaaaaatcatgttttggtgctttttgaacattttggatccgaaatataacatggcacccacgtgtgccaatatcagcattaactgacaaaagttcgccgcgcgagtcacgaagtgagtttttaccatgacagcacccaatacagcccaatatgtctaaaaatcatgttttggtgtttttttgaacattttggttccggtaaaaaacatggcatccacgtgtgccaatatcggcattaattgacataagttcgccgcgcgagtgacgaagtgagtttttacaacgaacgcgcccaatacactccaatatgtccaaaagtcacccacccacgcccttcgccatagtaccaataaggtacggcgtcaagggctgcgggcgaagaggtttcgccacatgccacgcccttcgccatagtaccaataacgtacggcgtcaagggctatgggcgaagaggtttcgccacacccactccattcgccatagtgccaataagctacggtgtcaagggctgcgggcgaagaggtttcgcccacccacgcccttcgccatagtacaaataaggtacgacgtcaagggctgcgggcgaacaggtttcgccaacccacgcccttcgccatagtgccaataaggcacggcgtcaagggctgcgggcgaggaggtttcgcccacccacgcccttcgccatagtaccaataaggtacggcgtcaagggttccgggcgaagaggtttcgccacacgccacgcccttcgccatagtaccaataaggcacgacgtcaagggctgcgggcgaagaggtttcgccacacgccacgcccttcgccatagtaccaataatgtacggcgtcaaggactgtgggcgaacaggtttcacccacccatgcccttctaccaataaggtacggcgtcaagggctgcgggcgaagaggtttcgccacacccacgcccttcgccattgtaccaatagggtacagcgtcaaggactacggacgaagaggtttcgcccacccacacctttctccatagtaccaataaggtacggcgtcaagggttgcgggcgaacaggtttcgcccacccacgcccttcgccatagtaccgataaggtacgacgtgaagggctgcgggcgaagaggtttcgccacacccacaatcttcgccatagtaccaataaggtacggcgtcatgggctgtgggcaaagaggtttcgccacacccacgcccttcgccattgtaccaataaggtatggcgtcaagggctgggggcgaaaataagagtcttccaagttgggaggctacaaggccaccctagcctctggagccttttgccacacccacacccttcgccaaagtacccgcaaggtacggcgacaaggactgtgggcgaaaatgagttgcttccaagctggagggctacgaggccaccctagcctctggagcctttcgccatacccatgaccttcaccacagtatccgcaaggtacgacgacaagggctgggggcgaaaatgagttgcttccaggctgggggcgaaaatgagttgctttcaagctgggggtctacgaggccaccctagcctctggagcctttcgtcatacccatgcccttcaccacaatactaataaggtatggcatcaagggctgcgggcaaacaggtttcgccacacgccacgcccttcgccatagtaccaataaggtacggcgtcaagggctgccggcgaacaggtttcgccacacccacgcccttcgccacagtaccagcgaggtacggcgacaagggttgggggcgaaaatgagttaaggagttgctcacaagagcagccgaaagagatttatcatttttcaagatgctccgaggggccgacaaactcaattggatacctgagtgtcaagccgccttcgatgggctaaggcagtaccttcggcactagtgtaaaaatccgttcagaaaaacattttctgctgattcggtgtgccaaaagagttcattaccgacaataacaagcggtttgactccgagaagtcaaaggaaatgtgcgaggggctaaaacttgaaatcaagtttgcattggttgcacacccgcagacgaacggggcagccgaaagggatgaatggcaaaaccctagtagcactaaagaaaagaccgaaagccggtaacagttaaaaaggtcgaagtactaaaaagaccaaagccggcaacggtcaaaacgatcaaagtacctaaaaatacctttccaaaggcaaaaaggggaaagtacgagccgaacagccgtaacacgcaccacacctcatttatttgccaaaaagcacaagttacagataaattccattgcccgccaaaaggcattcggactttacatccgattcatcagcaaaagcagtcctcaatggcgaaggactacccccttgagcatctttttcatcgctagttgttagatcaacacaaaaaattttaaagcggtgaagaaggaaaaacggggattatgctgtgtcgacgctgggtaatggcaaaatgacgctcagtcatataaaattcatgggtgtcttcgccttttttgtgtatgatatttcgtggaaaaaccccaaggcaaacgtttgatcgacgaaaacgccaggggggtgatatgaatcggccaaagcacaactcaccgaacgttgaaaccgcgacaactcgttttcggaaaacataccgatcgtcgctacactcgacttatgcaaatacttaagcgtttttggacgcatatgccaaaagtcgagagcgaatgatgagggctgaaaagtcaatgtgaattcctttcgctaacacgcaagggggccgacacgcttcgcccttccgaacgtacaagttacaaaatgcgatgatagcgaaaagaaacctaaaaacatgcacaagctccatcgggcaaaagcatatacatgttatataaaggagcaaaaaattttataagtatattacatcatccgtttcaggacattttcgcctcgcccctactaagtctggcgaacacggttcatcatctatattgtacacgaatttaaggggaaaaggaggcgaaatacacaccgacgtcaagcgatagcagctcgacgattagtcattttgaagtctgaaaaaagtgtggcaatgtcatcgcggcactggatgtggcacctatcgtaatcctctaaggttcgaccaggatgtcttcgcctccaattcgccattttgacaaccacatagctacataaaaggcgaacgcttgatcgacaaaaacgccaagggggcgaaacgaatcggccgaagcatcgctcgccgaacgttgaaactgcgacagcttgtttcagaataaagatactgaatgccgttacattcaacttacgcaaaacacaagcgtttttcccagcgcaaaatgctacgaatcgaaaacggaagtcgaaagttgagaagtcaacaaatcttttcaccaatccccgaaagggggccgaacgcatgactttcggcgaaatccccgctaaaacaatagggaaaaggggaaagaaaaaaaatataagtcaagaatcgcgcaaagcagacaaacttggcaaaatataatcacccagtgttataatacagtttcgccattctcgaaaggcgaatgctagtgttcatattttttctgcaggagtctaaaaagaggtttcggcaggaacattggccgaaagggggcgcctcatgccataccgtatagtttgcacggtctcggccgaagctccttactcacccttgcccgtgaggggcttattggaggcatgccatgaagcccttcgaccggacctgccgaaaccatagtaccagcaaggattcaagctaaagacgtcaagaccattcaggcgaagccctatggcgaaagccataagcgaagatggcaaaggctggaaagccgcgtcggtactccgaaagtaaaggcatcttgagcgaaggcatctcgggcgaactacaaagacttcgccatgacgagttcggcatcaaggaggcccaacaggccgcccccggtcttttaggcccgttcaccgtagactaggcccagcctatcagcccattaaaggcccatatgtgcaaatgacactgcgtacccatgtaaatgtccctttcataagggcaaccatgtaaaatcccctgtaaccccaaaccctagaaggtgcaagcttgtgctaaagctataaatagacctctagggccatgtaatggggggatccccaagaaaaattctcaattcaataaactttactttctttccaaccactgttgagtaaccacgtctttcgacgtatgcagttgtcgttttgacaacaagggtagttctccctttgttccaatcttgatgaaataggtccaaccctttgatgttcatgttccaatcctgtgctatattgttctagcaaattttagactcaaatgtgtagttgtgaaaatttttagatgcttgaacttgtgggaggtggtctgcccggagccacaggcggtctgaccgtgggtcagccgccggtctgaccggcgtgtgcgcccggtctgaccggccagcagacgtcggtctgaccggccaccagtgggcggtctgaccggtctgatgccgtcggtctgaccgccctactggctacggtctaaccacccctccacaggatataggtacattttcacctctccaaattgtttctaaaattattgctaatatcctatcatcctttgctctttgacagtgatgcctccccgcactcgccatggtcttcatgcgcccactccggatcccgtgagtgagcctgaggagtcgagcggagaggattacgctcaagtgatgaagaggttgaggaaaatgttgagggggctagtgaggaggaaagtggagatgatgtcagtggtagtggggaggatgaggatgaagaaggtgatgagatgcaaattgatccctccatccagtttgtggtgaacatgagaaatccagtataccatctcgaggcatcatgatcagttcttgaggcctcgggacaccccggatccccggtttcacaccgctttgcagaagactgtgtatgagcaggtttatgcagggaaagcttttgcagagcataagtggatttcttggagagacatcaatgagactccagagtttgagagcttgcatgatctcttcaagatagttggcattgactggattgtgaccctcaagcaagactacaatgaagatttgatccgacagttctatgttacagtgtgggtggctagagactatagtgagatgaagtggatgtctgacaccctccagtgttctatctctcggaggcagttccggcggctcctcaacattcacttggattttagagatgatttgcatgaggagcacactcacaatccgctctccatagactatctctctcagttctatgaagatggagtgcggtacacacatgagaaggttgacggcttgaggactatccctagtgtggtcaacaggattgtgagagccactatcctccctcgccttggcaacaatgatgacattaggggggtggcttggcacgtcatcgatgctatcattcagggtcgtcagttcgacattgtgtctctcatgatgcaagagattgctatctccaagaggacattcactcagggaatctattatgccccttacatcatgaggttgattcaagacaagcttggggctgctgggcaaaatttgaagaaaaacaagcagtataagccccgccttcagcttggagctccccgtgctcctaggacgctaccctcttctcaccctggagctagctcaagctcagcacctcctcctcctcatgggtatgatccaaatgctttcttccatccacagtatgcttactttggaatgcaacccaatgaatacttcaacccggtacttggggctattaataccctaagtgaaagcattcaacgcttgtctaccgggcatgaagcattgcatgaggatgttcgtggcttgcgcaccaatgttggagacttgaatgcttccgtgggaagattgcacactagggtgggtgtattggattcttgagtccaaatgttggagagcacccaagcttttgtatatcatcgccgccatgatgctcctcatccttcatcttcggctcgtcctccttctcctccacaagaatgaagaccttttttggtacttgatgccaaaagtgggagaaaaatgtccttaggtgtgctttatgtcttgtgggttgggactagtggtagtgaggttagtcacctcatatctaataggtaaggtgttttgggctatattatgtatgggtatgagctattaccttatcttgtgtattatttttcgtcttgttaaactctaggtcatttggacccttcgtggtcttgtaatagcctatgtttatttgtgagcccttttaggatgatttgtgacttatgtgatttggatggttaagtgatgtgaacttgtgcgatgatgaaaggtgtatgtgatattgatatatgtgactatcttatgctcatggatgaatatgtcttgaagttcacattaaaatattgcttatgtgtttgtgcttgttgaaatgtgaaattgaaatgtgcattggctctatatttgttgattgtgattgttatgcacatgtttagggggagcttttgatttccattgcaatatatgtccatctgtttcatgtttgattatatatgtttgatttccattgcaatatatgtacatatgtttcatgtttgattatatatgtttgagtgtttgtcatcaattgccaaaacgggggagattgaagcatctaggcccccattgttaattttgttaattaatgacaagcgctaattgtggactaaccgttgctattgagatatattttaagttagatccacgtcatgtgtgcgcatggatgattatcgatggattaaaatttgatggcacgaagcaaagaaaagaaaacggtaaaactagtgctttagtttaaaattgatcgaggtggagagcgatcaaatttgctagtttatttttagtttcgccgtactatcaaggggggtaatgacctcgcaatgagatgattttaattgccacattaggtcattatgcatttagacttgtgctcacatttcaccacacacacacttctcacatcccacacagtttcactgtgttcggcctgaccaggggcggtcagactggccacatagtggcggtctgaccggagtgcccaggccagtctgaccggccacaagacggcggtctgaccggcgcataatgccggtctgaccggcgacaaatgagcggtcagaccggctctctggtggccgggatggtgccgctcggggtggccgatacagagccgacggagccgtattcggtcagaccgagctgatggtggtctgaccaagctgaggccgatctgaccggccactcaacgtcggtctgacctgccaggccgatgaggccctctgacagggctacaacggctagttttctagccgttgcagagtagcacggtctgaccggccacatacctccggtcagaccgacatagcacagagttgggggatttcgcccccaacgactagttttggttggtgggagtataaatactccccctccagcaataagggggctctcttggcacccaattcaattgcatacaccccttgcacctctctcacacacctttgagctagtgtggtagaggtagaggttgttctagccaagagtcaagtgcattgcttccatttgtagagctagtgtggcacttgattgatcatctccacgccgggtcattacttgttattcttggaggttgctgcctcctaaacggcttgtggaggagttgcccggtgacctttagaagattgtggaggaggtccggcgctggtttgtgagtgatttggagttcaccaccttcggagtgaaggaagaactaccccgagtgatcgaggcttgggtagtcctctccgtgggccgactcccgccttgcccaccccttgacgaagggggcgtgcggtggcgtggttgagcggtggagttgggctcgcctcaatggggagtaggaaaccggcgaatttccgaacctcggtgaaaaatctcttgtctccttgtctcatttgattgcgcatttacatttgtgcaatttacattcctagagacattctagagatcatatcaccctaggattgcaaaacattgatataagagtgtgatttactttcctagagaattaattgagccactatcaccctaggtttgcaaaacataacttagttgcttagttagacttaaccctcaccgagcctagcaacctaggttagttttgtttaggtgtcatttatttttaaatcgcctattcacccccccctctagtcgacatctcgatcctacagatggggggtgggttttgcccccttgggggaggggaggtgggttagagggagggggcatagaataagggttataagtttcatagtaacatagtgtgttactgcgattatttgataacgttatggcaagaatatgtatagtaagaaaaaaaaggtgcagtaacatatagagagatgaattggctcggtttactcatagggcaagggtagagagaactttcaaagattggtcttttgaaatttaactctccacaagtagtaatactactccctcctaggatgggtctcattccattctaggttgctatattctgaaacggagggagtatatcataagtgttgttactatctgttgtacgttactacaatcctatcatgacgttactatgaaagtgtggtaaatattataagttttacagtaacaaagcgtcttctgcaattcttgaataatgttactgcataaagttgtggtaatgtgtatctgccatgtagtaacacttacacttttgtgcagtaacaaatatatggttagcatgtagacttttaactcatatatttttgttttgattcctagtttactaccgtttcaccacgatgttactatcaaaagtacagtattttatagcaacgtgacgtgttactttacttatacgatgatgttactactgaaacatagtaacttgttatgagttttttaataacatatctatttttcttctactttgggagtgaaagagattagaatcagtcaccatatttctttctcacaaagtgagatacaaaagaaacaagcaataatccttaaaacaaataatatcattggatggattggttagaatagcattggatggattggttagaagagcttgctatgaactatgagattatgggttcactagtaatcgtgcacgtgcaatgcacgtcatgttaaacttatttattcaattttattaatagttaaaaacaaaaaattcattctaactaacatgaaaaataagtgacaaatgagggacttcttcggtgaagaacaaggaaaaaaccctccttggtcccttttgtttccgctaccgtctaaaagaagtttcagtactcacttcattgaaagaaacttttgcaagtgccaccaccatttaaatcatagcaactaatttcatcataaataagcaactatatcccctcaccataacaatttgcgaccaccggataaaaacaataattcagttaagggttaaggtaatcaacatgtttcactgtcagttctgtccagggatgaatttgctatatatggtttaatactatacaattacccccattgtgcatttgatgtatatggtttgacaaaaccctacaagtgtaaataccatgtgaaaaatgggcgcacataacacaatcatgtcatagggaatatagaattttttaagtgcacaattatatcagagcacaacatcagttcaaatgaattcatgtaaaaaacaactattgcaatcgagcccaatttgaagaggaattggacggatgtattcacagtaagggaaaaaaactattgcctaagaggtcagcttcgttcgcaagaaaatattgagacgtcagtttgacaactgtgacacaaagaagtacgtaaaactgtgacatcatgagctcaaaaacctcctttgcagctttggttcctcctaattaatgaagccaaaacatggatgtcactacaaattactgcatcctcaatcaccaagccatcaacctatggaagcaaaacctcacatatcacctgaaaaaaaaggaaagttcaagagtcaaatcatcaagctactgctgatcatgggagaacaactggtggagcatgtatatccatccaaacaatgttgcagaatttttcttctaaaggaatatatctgcatagagaaatttagcaagaaaatttgcttgcttaaaccaaaacgtgtcctcaagtaaaattgatagaaacctagcttaaaggaaacagccagtgcatttaaccataatacagaagtaacctcacctgactattcattgcttgtcattgcttttggtatttcaataccaagaaatcaaatttgatgattgaagaccagtctctctcaatgtagcagttaccttgaaaaccaaaggagaaaatagattatacaacattcatggcatgtctttcctttagtgaacagcattcgaggcttcaagcttgaataatagtgggaataaattttagggagtatacaaatatttcaaccaaacaaaataatttatattaaaggagaaatcaaaatctttgctgcttctcaccttatccaccgagcagtggttgtcaggtataaactttgttgtcatgaatttttccttagtagttccagagggaacatgaacttgattgatgccaatgcttgtgatgagttcattcacccatgcgaccagtaataactccacaaggtattctcgatgcattatgaaattacgtttcactggagctacttcagctgtaaattacataaatatagtttggatgcaaacactcaaattgtaattttgtgagagtaaacagttcagaccaacttcagtgaagtctgtctaatttacaagcaaactgagcaagacattaactactgagttccactaagatatgccactgaaacacccaaatcgctcaacattgcagaaattcctagttaactaaagtgccaagacctaaaagaaatttgaatccaaaggaaaggaaagatgcatgtgattcaatagattgggagaacctgagactgagatgtatcatgaatggatccccaaataaagcacagtaaggagggggaggaggacacaactgctcctaccattggtgagggtcgccgctggaggtagagattgaagagtggcgtgctccctccgtcgcgctcacaagtctggctggcgactatagtgtatcaatgcatgacgacaatgaccaacggcggggcacggctcgatgaacagaattaaacaaataaaatttctattgaaaatatgtcgagtgaatttaacattggccaaacaaatttgtcctcattgcacctgttgacggctgctgacctgatgttccaagtggaatttggataaaattcaaagcaatttggtaagcatataattaagttaaacaatcatatataactaaacattaatatacagctaaacaatcgtaatggccgtatatgtagaaaaaatgaggtcttgaggttcagaaattatctccaatcctagacagctactattatgttcctctgtaaactattcagcttgaactgtacatgttgtcatatagtgaagcatttgagatctccaaacctatgacaaatcaggagtatggaatacagggagaaaaagcattgagctggaagaagcaaccatcagcaatacaggttgagatctattagaagtatatgacaaatcgctataaaacagaatacaaaaaatacattgagcagtaaaaaacaatttgagaagcaaaccatcaaaattttgcgagatcgagatgatatcaagatatatgagcagtacatacatgtgacatctgttctcatccaattagttagctgcaaaaccgatttgcaaatgaagcaaaatatggagtgtattgacctggccttgcagtaggtccggatgtagagcttactgcattgaccatggaagtgggctgaggggaggagccgattgacctgaataacccacacaatagatgaattgattaattgagcagtcaattgatcgatatcctcgctaacaagaaaatagacgtaggtgggcattgggcacgccgatgggtaaacacattctacttctgtccaacgaccaccgtaaacctaaatggtttgcattatgtgcgcaaataagataaatctaacaaagacactataggaggctggtgcatgaaccgaacagaaaccccctccaaatcatgagcgcaaaccccacattcccctccatagacccgcaaatcaactatcacaactctaatttcgatcggttatcctgagcccaccgaacggcaattgagaataaccggaaacaatttaccatggtaagacctagctgattgtgtagctccagccttctggacctattgaagataacgtgcatcaaatcaaacacatgtactgcaaattattatgtgaaactgcacatacttgattcagtaaaatgtataactgctgtgaattattagttagattaaccagagacattcaagtacatttcctggagataattcaaccactggagatagttcacatggtcacatgttgttgacatcaataggggaattaaagtggaatcaaagacagaatgtatttgagccacattcaaagtcattgaaaaattcacaaaatataacctgtggcagtttggcacactttttcagacattttcagtaagacacaaaatgtaagtcattgaaaaattcacaaaatataacctgtggcagtttggcagacattttcagtatgtcacaaaatgtaagtcattgaaaaatttgcagacattttcagtttttcagtatgcaagtaacctgtggcagcgatggagtttgacggcggcgccggatggggacgacgtcggctccatccgcggccgatggggaagaccacggctgctagctgtggagtgcgcggcggcggtggcgatggcggtggaaggggccggtggtggcggcggccgcggctggcgaagaagccggctctggtgaggctgcggtggcgcggcgttagtacatgcgggtaggagcgaggaggcgaggaggatgagaggaggagcgatgggacgatggcgacgaagaagtcggctctggcgtgtccagcggcggaaggggacggcggtggcagcgggggcagaaggggtcgacggcggcggaaggggtcgacggaggcggcggcggcggctggcaaagaagacggctccggtgaggctgcagcgacgcggtgccatgcgaggagcgaggaggaggaggaggaggagaggataacctagacgcgagtggagaggcgtagtcctcgcaccgtcccacgtgaattgagatccagtgcagtccatcgcacacgtggagaggctgtgtattcgcgtggtgacgtggtgaaatagtacggtggagatttacatgatttgaggatgcacggtacggattgatacagatgatttggcctgtagcattggaagggtgcaacttctcctttttatattagtatagaagtatagatatagatgtcttgaatttaccaatttattttttagttttctaaaaaagagagaaaagataataacacatgtacttagcgatgttcatgtcttgaatttaccaatttattttttagttttctagaaaaagagaaaagataataacacatgtacttagcttcctacaactatgtaactttgtgtgtcctgtggagtaataacagtttaggtgttttcacagtaaccaaatgtgttactaacatttcttctcgaagattggtcttttaaaatttctctctccataagtagtaatactaaaccattattgttaccacttttcattgtgagttactaccattccatcatgacgttaccgtatgtgtgtaataacaactataatttataatttttacagtaacattgcttgttactgcaattttttaatagtgttactacaataacatgtggtaacaatcgaacacagatacaagacctaccacccaccttgaactagtaaaggtaggtgcaagtgatatctttttgaattctcatctttaaacaatgatatctctcacaccatattatatttttgaaccgtttacaccgtaatgctttaaaaaatgagctctacaaaactagatccgtcataaatatattttaactatatttcatcagtgttactgcaagtaacttacaacgttactgcatggtggtcatcctattactgctctgtttatacgagacgaggacatcaaataggtgcacgtggaaggaagttagcatccgggtttaactgacgtggcagtgatttgaggtcctttgaccatgctttgatttgggtggaaggtggattataagtcatgaaagaagggggaggtgggttgggcccttcagggggaggggggttatgagcccaatgaaagaagggggaaggtgggttagacccttcaggagaagaggggaggtgggttatgagcccaatgaaagaaggggaggtgggttgggccttgttgaaggggaggggtatagaatagcctcacccttattaattaatggattataaataaaaaagggacaatttcgtttttgcccccactttcatctccaatattgattttgcctctactttttagggcttttgtttttgcccccactttttttgaaccgaaagaggcttttgccc

SEQ ID NO: 63427 - DNA, 924 bp, Oryza sativa
ggcgtatgaattttgcattagtaacatgggtgataataacagaagaaaggcacaaaaaaaagtatttggaaacttctactccttcatttttatatttggcaaagaagattcatccattttatatatatggacagtgaactattagtactttagaagggagtacctatacatctttcgaaagatttttataatcgtatcacacagatttttaatctttggattaaaatccgatagatataataaaaagcaaaaagcaattaagaaacactataatggacactaaattaccatatcctcaagaaaaagaccaaatccaatacaaaatttaaaatttacatgcgaagattcaaaaattacagtgtaacttacaaaagttacagtgtaagtttcataaattacactataacttacaagaaaatgcactgtaaatttgagtgagaaaatcgagtgagagataagaaaaaatctttcgagtgagatatagcaaaatcgctttagaaaggttgatgacaccttcacaaaaaagaaggaagaaagtaggggcagatccgctctacttttagggcatgtataatccgcactactcaaaactaagtagcacttacccttcttgcttactaccacgtgctttacacctggtccaatattatctcgtttcaagacaagtaatataacaaacaattaacaaacacattttgggttttcaggtagggttggctctgaagaagctatttgaagagggtgtggtcaaacgcgaagatctgtttatcacgtctaagctatggtaacctcaaatttatgtgtgattggcctgtaattatgtctttgcagttgaattggaattccagtgcttgcttggagctttacttcaactgatcagaggtgatgggtatgtttgtcaggtgtgatcatcatgccccagag

SEQ ID NO: 63428 - DNA, 24515 bp, Oryza sativa
taagttgcataaactagaaatgttttggcatgtgacacataaccctaggtattatggttttagtttcacaaaacctcacttttaactaatttgagttgctactataacaaaataaagaatgcttaactaggtggctaattgatcaaaagaatacataaattccatatttgattttagaactcataagtatggtggtcaaagatcaattggtcaaaggtgtggttttatgaaacactagaaccataatacccagggttatatgccatgtgctccttgtgattttgtgtaactatgacataatacaaggggtatgtgaattttgctctagaaactctgaagcatctgtgcttgaacataaacagttgataggtcaaatggacatattcacaaggattatgtgaaacccttatgtttgttactacctccgtcccaaaatatagagtttgggttatacctctacgttttgtaaccaagacacgggtaaattctccaattggtggtcaaggacagtgaatggcttgcagaaaagcaaggggctcaactcgttgattattttggtcacttgggagatttggaatcatagaaacatttgtgttttcaatggagcaaaccctagtgtggtgaatgtgctccatgctgtgtccagtgaggccacgctttggtgtttggcgggagctttgaacttcgaagctccaagacctgttgtctaaggcttgtagttcttgcaccctaggcaggttggcatgtgttatctttgttcttagagtgggcgtgtgttgtgttcctataagactttcaattgatgggtgttggggtttgtttaaatcctacatcccagccttcctttctatcttttaatgaaacgatgcgcagatctcctctgcgtgttcgaaaaaaataagagttcgacacgggtattaagaaagtatgtggaattaattggggagatattgtgattggttgagaagaggaattatgaagataatttaaatggtggaaggttgtgattggttgattggttgagaagaggatgtatgagagagattgttatattttgggacaagttttgaatgctataagttgttatattttgtgatggagggagtagcttttagtgcatttcttactttgatatactaaataagaggttctcttccaatattattctttgacaaaactcagatgcagatgcaaaggtgaatttccaatcctatccccgcttatgggattagttttcatacctccctctgtagagaggtacttcccaagtagtgggagactgggatgtataataccttccttccaaggaaaggagaacacatacatgaatagcagttttcttaatccagttctttacaaaaatggatcacaacagccaacttcacatataaaatgaatataaaatttcgaccatcagatgtgataaacttgaactttactcacaaccttctggacagaagaattatatatattcataataagttaatatatataaaatcacgatgcgatggacctctgtaatatcaaaagaaaattagtttacttttcttagaataaaacgagcagtcgttgtttactcattttgtctaatatgaaggaaaggaaggttgttttgttatgcaccgagggctgcaatctgtggattttctcaaataaccacaaagattgagaagctatgagttggcatgatatcttttctttcagttagcttgtaaatgcttttgtagtaacattgaatttattattgtgtgcacagcaaaggcataattgcggagtgctagaatggacatacatgtttctagttcattattcagtagtcttgtttaaatttaggcatgtccagtggatacttagggatatttggatggatataaacaagtcatgtagcagtgaactgaggaataatggctctagaatccttcctatataggatacggattttagttttagaggatttggggtcccctactacccaagaattgtatttgtcgatgtgttttcttatcttaatagtaaacaacattttactgtaatgtatttactgcactggatttgtatttctgtgtaatattaatagtaatattctcatattactagtaattcaggagtatttgtgctttatggccctaaacttgtgccggaatttcacatgggtctctgaagttgagaattgcatatttagggcactaaatttgtaggtataaatcttatgttctggtagccagaactcatgggctatagtaagtgaaatctcttctattgtttacctatattcgacattattgccatccgctgaaattctttcgagacggtaggtagctctagttacaacatgccaaaacaataaatcattggcattgaccaaatattttcatcaatgtgaataacattgcttatttatgtagctgggtgctatattgtgatatggggaatgtgttttgtgtttaaaactattgaagtttcaagagttcttttggtcaattttaccattgagtcttggacttgtagcaattaaaaggaaccattgatgcattgattttcagtatcatataagcgggctaaaatttgaagtgaattgcactgtattgcagggataaatacgtttgattatacacaaccggatgaatggtttcaaatgaatgctgttcttcgtgtcagccttgggaacttcttgttttttgcaatatttgctctgatgatgattggtgtcaaagaccaaaatgaccggcgtgatgcatggcaccatggtggctggattgcaaaaattgttgtctgggttgttctcatcgttcttatgttctgtgtgccgaacgttgttattactatttatggtaagctttttatttgctaatcatctatacgtgtgatttactgtacacccattattctttcccctttctctgttggcgtgctactattaatgtaaagaaagttctggttgggtgagcgatggcaatggttttggccttttggtgcgggtaagtaagttgttaggtgggcagtgtgggtgactgggaaaatattgcagaaggaaatgcacctgttttccctataaccagattttggaaaaggaaatcttgttaaattgagttacttagttttaactaagccagtaacgagctggtggtgagctctggtcccaatgctaaaattgcatggagagagtgcctatttacccaaaatagaaaggtatatgcagacttgtttttgaataatgttagatacatatgtaatttttttagttggctattactttcatgcatatgcaacagtagttcttgtaccctggattaaaaccatccaacagacagcagtccatgtcatgatggaagattatctaaactctagaatttagaatttttaattaaatcgtaagcaccgtatataatcttttttgcctcactatacacctggttttggcaatgctttcgttttgcaaccctcgactgttattgcagtttaaaccacccgaaacaaattaggggtaaggtctggtccaactcagtccagccagacacatgttatgcgatatggccaatcttctctagaatgcatctgcaagcaaaattaggtatggctgattactcctagtgtgcttgagcaagcgtacagtgcaatgctcagtgaaatgtggaacaaagtgaaatacaaggcacaatgcttggagcatcagcaaattgcaatttactccaagaattttaattgttcggtaggtaacaaggtccaataattgttgaaagctaatgcattgaaaccctgaaacaagcctaaatttgcatggttgttattcttctagtaacaaaaggatgccaagataattacacagtgcagtgttgattagctttagttctaatctatttctatttaagaatttgaattatattagtttgttaggcctctgtttggtacaactccaacttcaactatttgggggttggatatctctatctcaaagaaaatcttcgagtttagctgggactataatagggttgttagggtaagacatgttaaccttgttgcagttaattgttggttcacacaacatgaacctcctttttatattcccagatattagtaccacgttttcattggttcttatgaaccagttatcaacttatcatcatgcctcttgtgtttctctaatttgaagattgtccattgcagaggtactgtcaaaatttggatccggcttgtttcttctggtgcaggtcgtgatgcttttagacttcacaaacaattggaatgactcatggattgagaaggatgagcaaaagtggtgtgcacgctagtcaccatccaatgattcttgaaccaaaaaatttctttcctatcactaattctggtatgttaatcttcatgtagggaaattgctttgttggtagtaactgtggtttgctatctctctacatttgccttctctggtttgctcttcacgtggttcaatccctctggtcatgattgtggtctcaatgtgttcttcattaccatgaccattattcttgcttttgcattcgccataattgcgttgcacccccaggtgacacttctacccacttcaagtattctcatgatgcgctctaattgtattttttggtttaactagctataaatgcccgtgcttgcaacataaattaagtaattacttagatcatgatatgttttagagcctcaaaagcaaaagaaaatcattcttgctgatcataagctcgcatttataaaataatttgtacatgtatgtggagctaaacattaaactacaccgttgcttctaataatagaaaatgaatctaaattattcatattctactaatgtcatattttattgtagttttattttcccaccatttggttcaaataaatactctacccattttttctaacttgctacggcacccctccccactattcccaggccccaaacgacggcaatggtggtggtggtggtggtggtggcagaacgataaccaccactactctcttttgaacgtagtatagacattgagcatgcaccattccttatgggtatactaggacaaagtatgaagaatattcacatatgtgttttggtaaccatcacctattagtaatagctgccaagcagataaatttatttaaacaacacaatataaaaatgtttagtaatgttgctcagatgtacttcctatccatatttgtaactcgatgacagtctgctgtattcagtcttgtcagtttgcatagtgaacctgaactgcatttagttcattcctgttgatattttgtgattctaataatcctatcaccaactatggatctgctgggtccactcatatttttctactgggtcataatattgattacgcttatgtttacatttataacagacgtgggattgaattgaatgcctctgatgaaacaaatatcaaatacattagttatctcctgctttcgttggttcctgaagaaataatgtgaacttgtaatgtttccttgcccaggtcaatggaagtgttatgcctgcttctgttatttcagtttactgtgcatacctgtgttacactagtctctcgagtgaaccagatgactatgcatgcaacggacttcacagacactctaagcaggtttcaatgagcgctcttatactcgggatgctcacaactgttctctctgtcgtgtactctgctgttcgtgctggatcttccactacatttctttcgccaccatcatctcctagatctggtacgtaactgccaattaccaaatacccagtctccatctgtgtgcatgctggctatcttgctaatcaacaatgcaataggaatcaagaatcctttacttggtgatgataacgtggaggcggggaaaagcaacagtaaagaaattgatgcgcgccccgtgagctattcatatacattttttcacgttatctttgctcttgcaagtatgtattcagccatgcttctgactggctggacgagcgctgcttcagacagctcggagctgatggatgttggatggacaactgtttgggttcgcatctgcactgagtgggctacggctgcattgtacatctggacccttgttgctcccctgctatttccagaccgggacttctcataggcatgtcaagcattgttaaaaacgtggttaaaccatgaaattatatatatatatatgtttgtgtgtgtgtatgtacgtacgtacgtacgtacgtacgtacgtacgttattcgttgtgggaagccagtagttatgtataaagtccttattgacatgtacgccctcccgtttttttaaatatttaatgcaatttgatttttggacaaacgttaactatttgcttcattcgaaaattttgtgtcaatatccattcattttattcaacacttttgtgtaaacacaaaaaatatagggttaacagtgcttgaagtaactttaatgacaaaaaagatcataacaaaataaatgactataataatagttatgtaaattttttcaataatatgaatggtgtcaaacactaaatatgtatagggaaattttgctacagtacgctgctattgtgtggttttagccctaggacactgcaaaaaattaacttttagggaaaaacactccataattgtggcattttgccggtggatgttggatagtataggggaagaggaatactgcaaatattggacacattgtatggagcctcgggagctagtatatataggagtatataaggaggagataaggaaggattatagatttggaaggaatccaaacaaatcaatcatatcctaatacatctctaactaccacatactctaatatccccccgcagttcaagtgttcacgtcgaacacttggactggagaaaaaaaaccgacaagagtactcaacacgatgatagccctttgtgccgtagtcgatgtagctaaaacgaaggagccgagagagccgtggtcgatgaagccgtgcgtagagtagccgtggtcgatgtagccgagatagggaagcctatgatgtcgaggtagctgagccgcaaggcgcacatggggcgccgtagagtggtcatggacggacgggagggcgtcgtggaccaatggtgtgcgaggacgcgctggagacaaagacggtgacacaatcgcggtagtcgttgaggaagatgacgccgaagagccgatgtaatcgaaccgtgatggacaagacatcacgccgggtttgccagacccgaggacaactcgggacgaacacgcgccatggtgttgccaataccgcgcgggcgaggcaggagaccactatgaatcatacgccatgtcggaggagactagcaaagaaggcatccgggacggtcgcgacgcgagaactgtgtagagggagaattgccggagcagcacgcagttgacggagaagagcgaactgtagtcgaggaagatatggcgacgttggcgatgagacatgttggacaacgaagaaggcaaaatagcgggaccaacggcctagacggcgacgtcagtagccatgtagaggttgctggaccaccggcctagagcggtgatggtggcaacttggagattcgacggcaatgctcgaagttgaggaagaagacactgagcggctgacaatgaccagtgtgcacaacgaggttgtcaatgcgcgaacggcaatgaagacgacgaaagtggcgaagctgcggtccgagagggcaacacagctacagctccatgtcgatgcagcggtgagaagttgatcggtgatgtagccatgctgaggagggcacctctcagcattgcaacaaccagtggaggtgttgaccacaggcaacggcactatggcccaaggggggcgacgtagcggcaacccgaagcttgatggcgtagacgcatagccgaagatgatcggcggcaaggtgtcgccgtagccgggcacttgaacgggtgatcaagccgatgttgcacacagcggaacgacgaagttgaagccggagttgatgccgatgtcggagacgcgtagatgtcgacgaggcattttgcgacgcaaacccgatctctaatcgggaaaaaaaatacgagcaagcaacagcgctcggtggcatatggtcccggtccctagaccaagtccagcaactcccctgcctcaacagtaccagcagcagcaacacatgcacaacatctgtctcctcctggcctccacagccagccatgaccaagttgtttacaccaaaatttagcacctatggacgaaataggggaaaattgccaacgtttggaaagtgccgggtttccttcacagtgctggtcagaccggaggtatgtgggcggtctgaccgcggcctaaattccggtgtgaccgcaggtatgtggccggtcagaccgtgagggtccgagcctgagtctgttttcgtcgggtcttgggtttccttgcttgggaaagcatgtttcgggtttcctttggtttatatcccgagttggacgtggaggagggtttgtagagggcaagaccaacccctatttaagggacaaggtcagttcaattgtaatcccctgaacacacaatctacttgaatgaatcgctttttctttttttttttttacttttcagccatgttttctattttaccttaattttagttcatctttgtcgattgtccgccgccgctgcgagagtgcgacacctctttgtgggtttatgctgaaaaacttccgttttgctcacgagacgggtagttatcctcgtattgatctaaattggcatagaggctgattttgatctctaaatcggctctgctagccggtttagccgttttctacaaaacccatcttgatttggccttttggctaaatcgaggtggttggcgtttaggtgctgcgatcgtgtttatcgacttgtcacaaaaagttgccaacacgatttttggcgactacgttggaaatcgaaacttctggccatccataaggccgaaattaatctacatattaatcatcagagaaagcgccgaattaatctattcggcggcaagattttgtggttattcaggaaatcaatctacacaaatccatagctgttgctattcgatttacatctgcaccatagccggcgtcgtcgttgtctgcgttgaagccgatcgatttgatcggtttgatagcagtagacgccgagcaacagcagcaggtcgtgtaggtattgctgtagagcacggcaagaaaatcttattcaattcggtttgctgagtatacgtgttctagagaaaaaaaaaatcaggctatcaaagcccgaaaagggtagttagcgaatgttcgccatcactagatcacacgaatcagttagaagagggaacgctactttcatggacgcgactactccgcgcgcggtaccgcaatagtcctaacgcgcgacgccaaactttccaaaaataggagcgcacttttttccccacgcatacacaccttgccgaaataaagaaacggcacgttcctttccccacacgcgtgatgcttctataaaaaaggtggtatgtgttccccattctgaactgaggtgcaggcgatgaatagtgcctctattaaacaaatgattgaaaatagaaatcaaaacacaaagaggaagagattaggaacaagtagagaaggtctagggtttcatacccaaattcaaatttgaggtccatcaaaaaaagcatacccaaatcacaaacttcacatgtaagcttatattccccacaaattcatagatctgtgatgaattcttgaaaaaaaaaaaaccacaaacaacccctcaaattggacttcatacactaagctgcatcttcctttttctctttctttgagtccctaaaatgaattttagttcggatgtttacaattgagtaagctatctccttttctaacactgcatcaaaaaaagtcaaaagggtaacatgacataagttacaggtcagaaaattacttctagaaacatataaaattacttcatcaaaacatgaaaattacttcccataaaatatttaagttacttaccaatcacttttgaaatactacaatggttaacaagaaacttagttacattagctatggatccataccctaagacttcacctcaataacctctcagaattttcattctgatatttatacattcgtttggtctttaagttactaaaattacttcaagtgcattatagaacatatatatatatatatatacatatatatatatatatacatatatacatatatacacatatatacatatatacacatatatacatatatacacatatatacatatatacacatatatacatatatacatatatatatatatacatatatatatatatacatatatatatatatgtacatatatatatatatacatatatatatatatgtacatatatatatatgtacatatatatatatgtatatatatatatatgtatatatatgtacatatatatatatgtatatatatatatgtgtatatatgtatatatgtatatatatatatatgtatatatatatatatatatatatatatatatgtatgttctataaatcttgtctaaaaatgcactttattccttaagttgattgaatataacattttgcaactttatctctaatgttgtttatactccactaagcttcatctccatcttttatgataccgcattaaaaagttaaaacgggaaaatgcataagtaccggctgagttacatatcagaatgaatttccacaaaaagttacttctaagtccatgcaaagttactttcttaaaacataaaagttactccccagtaaattttgaaaataacaattgttaaacttagttgcaatgctatgaaaacatgcaactatatacccagaccctcaaagatctaagagccgagagagggctaccgtatttatcatactcttctgctcaagactcatgtgggcatacaactttgtaatttccgtaggggaagctctagcattttcttgcagccaatgtatgaaaataaaacgacacacattggcatcctttatgaaaccggaatagaactaactaaagtattattagttgtactatactatataagttaattctacaacgtgcaaagttacttccacatcatgtaaagttacttctacaacatataaagttacttctgcaacatgtaaattatttcccataaaatatttaagttactttgagtttaaggcataagtatcggctgagttacatatcagaatgaatttccacaaaaagttacttctaagtccatgcaaagttacttccttaaaacataaaagttacttcccagtaaattttgaaaataacaattattaaacttagttgcaatgctatgaaaacatgcagctataaactcagaccctcaaagatctaagagccgagagaaggctaccgtatttatcatactcttctgctcaagactcatgtgggcatacaactttgtaatttccataggggaagctctagcattttcttgcaccaatgtatgaaaataaaaagaaacacattggcatcctttatgaaaccggaataaaactaactaaagtattattagttgcactatactatataagttacttttacaacgtgcaaagttacttccacatcatgtaaagttacttctacaacatataaagttacttctgcaacatgtaaagttgctttcataacatgttaagttacttctagaacatattaagttacttatgtaacatggatagttacttctacagtaaaacaaaaaaacagaaaaaagttggttgtttaatacttactttttgcacttttttgagcaaggatgctctacatcttctacataatcttctctcaaatctctcttcttccatgttgtactactctcttccggttttcagtttttctcgttagttgcagcgcggtattgattgtttcattacttgttaacccttatcaatgttgccaaacataagtttaggtacctttggctttagtctaaccatcctagttttgtattcacttagttttccctgattcctctctagatgtagtaactgcaagaaaaaggaaaagtgaaaagcaatcagtacttgaagcaggtttatagaaaattacttctataatatgtaaaattacttctcagtggcatgcaagttacttttgaaaattgataaaattacttctcaaatacaaaaactttgcatcatgtatatgattatctgcatccgaaacttgaaaagaagatgattgagctatagtgattgtacaccaagattaataatcatattacagggaccaaatatggatttaattactattctacacaacctagaactcatcatcttcagaccagacttcaccagaataggtaggaggtttagacctacataactgcatatttgaagtctgctaactcaggcagaaactgaggcctataagcctgctaccttggaacccgaccaagtccctacttatttgctgattgagcttgaatatggcccattagaccaacatgctgctaatctaggagcagcctaattttcagggttaatatagattcacataagctctgactacgagtactctgaacattttttgctaatagagaatggttagcgaaggctagaggtaatggtcacatacagcaaagcaactaacataatcgtcatcaccaaagtttgctcacaagagttcagtgacttaattaacctcgggtaaaatcaacaagcagtaacaaataactgagaccaaaagtcgctgtgtttcacaacaaatatttcattcgcgagcccaggaacaaaacaagataatccatctagagaaaagagagatagagaagtgatgaaaaacaatgaaatacttgcaagcacttatgaagcaacacttgcaatcagctatcagaataattgtctgaaactaagaaaaaatgcagttttttttgggaggtgctgatgataaacgaactagatccaagacgaaatggaagacactgcatctttacctctctcaaagcttggccctgcactgacggggctccggacgggcacgggaccaacactgagctgccgctcgggggccttgagctctctcggctaggagaagtatgtacgaggacgaggacgtgggtggagattaggaggacgatgaggagcgggaggaggtcgaggagccaggggtggagcgcgacggtgtcggcgacctgcgccatggtcatgtgctaggagagcacggccgggtgccgcaacggccggtggaaccccaccaccggctccagcaccaccaggttgttcgagcgccgacgccgtcgtcgatggcatcgcggaatccaccaaatcgtcattgcatttaccggattttggagcgctcgaggggacgggatgaggaatgctcgacgatagcagtcgccacgccacagcagaagcccacaatcgtcgtcgccctcgccggatttgtgggagaaagactcgccgtcgcctgatttgtgagagaaattcgcagtgggatttgggggaagaaactgtgttggagtgtcggtctctcttgggtgtaccggagtctgccacgtggcttccactcgggaatcttctcagctccgcccgcgcctggatcggatggctacgccaacgcgctgggctctcccgcgtgtcgggcgatacgacgaaatcgagagcgatcttgaattagattttacgtatttttatatgttttcagttttctttttccttcttttacgcgattgtttcgtaatctgttacaagtattctttctgtgttttttcactttctttttatccgatttcattttttccgttatagtttttatagcatttcagtttccgtggaaactttcaactttttatatagagaatttatatatgtaaattatatatacataaactttgtatatgtaaattatatatatataaattctgtatatgtaaaactttatatagtaattgcatctgcagttagaaagttaaatgtataaattttactagaaataataaaatgttgacggattttttttaaatgaacaatttactatgaaactttctatatagactttctattgttgtcgaaacgacaactgcatacgtcgaaagacgtggttactcaacgatggttggaaaaacgaagtgtattaagttttgaatttcacttgggggatccccctgttacatggccctaggggactatttatagccccattacaggttattactactagggtttaggttgtacaggggaatttacatgattacccttacgaaagggacatttacaggggtacataatgttataggggctcatgggcccctaatgggccgtctggcgatcgccggccctatagcccttaggcttgatgggccggaaaggcttcctcgaccctcgcggggctaacttgccatggcgaagtcgtcttccttcggcaggtagtcttcgccttgcacccttcgcccgagacgcctctggcctggcaaggcactcgtacgactcttcgccttccgccgttcttgctccatagcctttgccacgggtttcggcagattaggtcgaagggcctcatgccatccgccatcaagcccctcacaggcaagggtgagattggagcttcggccgagaccgtgcaaaccatgtggtatggtatgtggtgccccctttcgaccgatgctcctgccgaaacctacattatccctgccaatgaagtttgttacttgtgcggctggtattattttgccgcgcttcgcctcgtgcgattggtggttatatatattctcttttcccgggccgaacggaacagtattgggccttcccttcatgggctttttactgtgccgctcggacggtgggaatttaccgtttcgcctacccttgtgacacgtggtgctttattattggtgggtaggcgaacggtcgcctgggtgagctatatattcccacccctctttccttttcattggtacgcttgccatttttaccgcgcgcactctcttcctccgtctcttccttccacagcatttcttgacccctcaggtgtttcgcccattctcttccttcgccaccgcatatacgccgttcgccatggcccctcgcaagccaaacccagcttcggcgaaaggaccggatcctggccgggtcgatgacgacagcaccgcctttttgggggtctctcttgtggacgacgtcgagctggcgaagctggtcagctctggggcattggttgaggggcaggctttcgccgcggggaaagccgtggtgccgaggcctatcgacaactggacagtggtgttcgccgtcttttttgaggcggggctatggtttccgtgcaacgtgttgttgccgaagatccttcaccttttccaagtggagcttccacagctgagtccgtcggcgctagttcggatctccatctttgactgggcgtgccggacttccgggtttgagcccagcgccgagctcttcggcgccatatttttcgccaccgtgaactcgaagacggtgattaccccagccggaacgaagaagacagtgttcgggagcgtgaactttaacgttcgccccgagcggtctgatctctggccggtgaacactgccatgtcgaagtgggaccgccattggatggcgaggtggttctatcacaccatccccttcgcagctggttctgactcggcaaaagccctccggtgccggcgtagggtgattgcgccgaatcggaagcctaagatcgccgtggacggcgctatggaggcgcggttcgtcctactgtgcaaggtttgctcccgccttagctgccgtggcttggtggaggagttctgtatgcttcgcatctttcccctctcccagtcatggcgggtcacggtcgagcaatgcgaagaggctgatggtttgccgaacttggttcttcctgaggggatgaatagtaagaccgttcttttgctgtacactcctgtgctttgttattttgccttgtctgacctttaacacagctacaccctttacttttgcagtgtcgaccctcgatcaggctgaagccgaagcccgcaggatgatcggcgacgtttcggtcgtcgagtatagccagctgctaacacgacaagcagctaggcgggcaaaccgggtttacaacggtgaattgcctccccgggtgaatccccaaaaagccgacaacgatgcagggccttcgcgaaagcggatgcgtggacaagtgaagcttgcccccaggaagcgaagggttcttgcttcgtcggactccgacgccgacgatgaggacaatgccgaagaacgtgacggcgaggaggaaggagaggaagaagaggaggtggaggccgtggccgataaggccgcgaacgaggcgaccgaagaccgcgtcgacacgcccggctacactcctaccccaagtctaggtcacaacgagaccggggtggagtcgaacagctccctccttcgacgaaaggatttggaaggggcgaaggccctagttgcgttctcgtcgggcaaggcggcgaaaggaggtctggtcaagaagatctcaaaaaagaagggactcgtcgacatcgctcgcgttttcagtgacgacgagtcttctgacgagactccgacctcacctgctggccgcagtttggacctttcgactgctccccttgctccgctcggcgttgctggggccggcggtagcgccgccgccggggcttccgcctccaccgaacggatcgtgtcggctgcggcgagggttttcgggagccctgtgcgcaagccagccatttcgccgctggtcaaggcgaaggggaagtgtgcggccgccgaagcatctgcctcggagtattcccttgcggcgccccacttcgcccctggtgacttcgagacccgggcggaccttattccctttgtggagggagtaagcaatcttgtcttgcctgccggcaccccgagcctgttcaccgaatttaacgagttcgacgaggggtgttccaccattaaaagtctggcggttcgggtatgccttttcttccttcttcgttttcctcttccctctttttttttacgtctcgcaattaaccttttgtccttttcgtccgctcctatctttcatctagattcttgcggctcactgttcgacggagcgaaccgtgcgggcccgttttgacggttttaagagccgtcttcgggccaaggacgacgaaataagccgcaagaacctggaggtggagtccctggcccgcgtactcaaggaggcgaagactgaagtcaaacgccttcagtccgaattggacaaggggaaagaggcctgggccgaggttgatcgcctcaaggccgaactggagaaagagaaggcccattcggcggtgctcatcgactactacaaccttactgagccgaagatggaggctctttgccagaaggctagcagggccgaggcgagcgccgcggaggagtcgcagcggttttcgtgggagaaggcgaagatcaccgaatccgcaagaacggcttgccaaacgctccgcctcgccttaccgacatgggcgcgaaggtgcggggggtccctgccgaggatgcctcagccttcgacttctccgagtggacccagcaggctggcggatcggtttcggactgcgccaccgcgtatggcgattgctgtgcgcgtgtatcggcggccttcaccttaggccttctgcagcagttcggctgcgagcacatcgccgagttccctacctatgtaaggggggactgggagattagtgcgcagaacatttcgccagctcttcgcgcgtggcgaaaacagttctggcagaaggatggccggtccgctgccaaagcgtgcctcctggagcaactaacgaaggcggaggcggcagatcggggcgaagaggaggaagccgcgggcgaagaggttggaggcgatgctcaggatcacccagaggtgtgaggccctccgccctttccttagatttttgtagttttcctccctcttttgcgtttgcctggagaggcgaatgatgtatattcggcaggctgccgatgaaccttaaaaaaggcttttttgtacatttggaatatatgacacaatcttaattgctttttgatgatcgaggtctttggcatatttttatttcgctcatttcgcattatgccatacctccccctgcttccgcctattcttaccatgtaagctgtgttttgctatttctgcgctgtctatcagggggttcgccgaaagtcatgcattcggcccccttccaggagctggcaaagtcaaaacgagaaatttgtggcaatgaagggtctgccgaaggtgcgatgtccatttcggcctgtttatcgcgaaatggagataaacggtcgcagctacaaggttttcaaggttgccaactggctgcgggcgcaccccgggtgaacctgagaagattacgatcttgttcattcaagaccctcagaagacgtttggaggatatggctcgtttttggcgaaaccatcagaagactaatcgtcaggaaacgatctttcagcgtcgttacagtttagtctgtgtatcgccccctactcctcttaaggttgtgtatgatattagtagtgatgacgaacctagtttgccttatcattccttagggagggatagtgattacgggggcgaagatgtaatttacttgtaaagcgaattgtatcgtgttgtgaaccttctattcttcgattattttttcgaagttaataaagaacgtgctttatttccttttcgctatttttcgcattgtcacattttgtgcttttgttaggtcggaacatgccggcccctttgcatatatgagcgaaataggtgtactgacttttcagcttttcgtcgttcgtcttcgatctgtagcattctgtgtcgaaagaaacgcttttgcttttatgctgatcggacgtaacgtcgttcggctatttattttccgagacaagctgttgcggtttcaacgttcggcgagcaatgcttcggccgattcgtttcgccctcctggcctttttcgctgatcaggcgtttgccttggggtttttccacaaattatcaatcacacgaaaaataaaaagaaggcggaggacacagagattttatactagttcgggcctccaaggtggataatagccctacatccagtttttttttctttttcctctcttctcttttttttctttgccgaaaggcttacatagtgccgaagggcttacatgacagtatgtacatttttacaagttggcgatttgggtgccacccattctagacatagaagcgcttgagagagacagcattccaggaatggtcgaactcctcgccttcgagtgtcgctaggcgaaaagatcccgtcctggacttatgtttgatgaggtacggtccttcccactttgattcaagcttgccaaccgctactgggttcaccttcttccttaggacgagatgaccaggcatcagctctgtgggtcgaacttttttgttgtaagttgccgaagtgcttgtggcgtacttatgcatgtgctcgagcgcttcgactcttaccccttctaagagttcgagcgatacttcgcgcccctcttcgcccccagagaacatcacccttggtgagttagcccctagctctgctggggtcattgcctcatcgccataaagaagcataaacgggctaaacttggttggtcttgtgggggtcatctgaagggcccagagaaccgatagcaattcttctggccatttgcctttcgctgccccctcgagtcttttctttagtgcttctaggatcttgccatttgtacgttcggccgccccatttgattgcgggtgcgcgactgtcacgtcctgataaattcatcccgaaataaaaatcattttctaaaaggaataatagaattaattaaaattcgaaaagaatttggcaaacactaaaatacgtacaagaaaaattcgaatgtggcccggagaatttttgttaaattctccttggtctaaaaggagccctcaaattttacttgaattttcagagcaccggaaataattattaaacaacaaaaacaattatcaaagtttattaaaaagaaaaacctaaaaataaccctccttcctcctttgggccaagtctggcccaaagtcctccctctctcccctcggcccgtggccgaagtctccctttcctccctctctttctctccctctccttctctccctcctcttgggcccctcttcccctcccggcccactccctcctcctccctctctcccccaggccgcctcttcctcccttcccgcctgggccgcgtcccggcccaaaccgcgccacctagccgccccggcccaagctgagccgctcccctcccgcgcacgtgcgtcgcacgcgcgctgagcgcgcgccccgcgtggggcccacgcgccaggccggccgtcgtcttcttcctcctcccgcacggccctctctctctcccgtgaaaaccctacttcgttcctccctcgaatccgcgtgatttaagcgttggattccaaaattaattggggggttttaatccccattgaatcctcttcaattccccccaatttctcccttgattcgtgccttcaatcgccgggaacgcccgcgtcttctccggctgtctcccatggccgccggccgccattcccgtcgccgttccgccctctcccgtgctcggttcgcttccctccgctataaaatgggatcctcatcccccgttctctcgttttagccccctcccgagcctccccgtggtccctagccatctccccgccgccctcctctctctcccacgccgccggccgcctccagccgcctgtgccgcctcgcccgcgcaccggccggccgtgccgtcgcctcctccagcgtcgccgccgcctcctcttcgccggcctaccctctgtttcccgcggagacctccggaagtgcctccccgccggcaaccgtggtgttgccgccacgattccgcctccagccgcctctccctcctcgccggagcgccgtccggccgcgccgtcttctccctcggcctcgcagccacctcctctccctcggtcagccctccgtttcgcggggaaagcaccggagacgcgtcctcgccggcaaaacagtggcgttgccgccactgttccacctccggccgccactgtcgcgtttcccgtgcgccggccgacgtcgccaccacctccctcggctccgcgacgccgccctcatccccggcatcacctcctcctcgcccgaagctcgccggagtggcctcctcgtcggcgtccagtacctccccgcctccggccggctcctgtacatcgccggtacgccgatcgacatcgccgcgttgtcctctcctccagctgctcctctgtttcgccggacaccgtcgcccgtgctggcctctccatcctcatcgttgccgacgtcccttcggccgcccgttcatcctcgccggctcgtcgtctcgcggcgccgcctccgtcatcgtcattgcagcggcgtggagcacgccgtcctcgtcctcgtgcagccgctgccggctgtcctcgtcgcctccttcgccgtcccggtcgtcgtcgtcatcgtcgtcctctcgtcgttcccgggcgtcgcggcgttcgtccctccgtcgagccgttctcgtccgtcgtccgcgttcgtcaagcgagccgctgcagccccgtcgtcgtcttcgtcctcggctccgcgtcgtcaagcttcgtgccggccgcgtctcgccttcgtccaaggatcgccgccgaagtcgttccctcgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggactccgttggtcggccactcgcctcggttgacacacgggatccgcttccgtcgacccgtggaccgtctctgtgtactcggtctgccgcggtcctttttgttgacatgtgaggtccgcatgtcaacggcgcagccttcctgtcttttctaggctagcgcttacacatgttttataattgcaaagcttaattataataacccgtaaatctccatataacatcattaaacttcggatgatcatatcttggtcatacgaactccgaatcgacccgttcaagtctcttaatgtttgttataacctaaagaactctgtgctttctttttatgtattgttattgcttctttataggcttgtagctttgcttgtgtgcttcgcgtagctttcgtcgttccggaggttcccgaagcgtggttcgcggccgtcgccgaaggttcggaaggccgttatctctgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtctgtataccgtggtggtatgtggcacgtggttgcacgtgaggaaaatgtgtcttgtgggtaaagatgtacacctctgatcagagtataatctattcgaatagccgcgccctcggttatgggcaagccgagcaatgtacccaagtcagtattttaattcttaaaatttgctcaacaactaaaatgtggaatggttggcctgggttggcttgggacgagctgggacccagggtcgggttgccagttcggtctgaatcatcgtaggccttgggttaaggcaggttcgtgcgggttcacgaccttgattaataatactgtgtagctctaggatcgtctttttaaaatggctttgggcaactaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaaggtgtcttaggtggagtcctggcttataccccagttgagcgcctgtgaagatggagccgtaggcccgctagtccgctgctgtttattattgattgtcaggccttaagtgcctttgtaataatgtaaatattatcgatataataaagatgtgctttttgtatcatgtttgtgtggtgtaccccggcttttcctgggacggggactaatacactagcgttcgggaaaatgcaaattttctcggtcacgacagcgaccgacgcgaacctgatttccaggttaagcccttcgcacatttctctgaacttatcagagtcaaactgtttgccgttgtcagtaatgaactcttttggcactccgaaacggcaaacaatgtttttccacacaaacttctgtaccgctgccgaagtgattgccccaaggggttcggcttcaatccatcgagagaaatattccacagctacaattacgaatttatacccgtttcgcgccaccgggaacggcccaatgatgtccagtccccatctggcgaagggccatattggcgcaatgggctgcagattatactggggcgcggcttggcttcggccatgacgctggcaactttcgcacttcttgatttgctcaacacagactttcaacacagtgggccaataaactccttgtctaaatactttggaggccactgttcttgcagcctggtgcgcgccacatagcccctggtgtatctcctttgccatttcttcgccttcggcaaaagagatgcaacgaaataagggttgaagtaccccggagcggt

SEQ ID NO: 63429 - DNA, 661 bp, Oryza sativa
ataaacaaggaaagaacggcaatgcatgaatgaggaataaaagagcagctgtcataaatctaaaaatgcaaacgacaagaacaaatatgaattcgtcatgtgggaaaataccaacagaataaatgaaagactagtgtgtttcccccacaatggaacaaaaattactaggggtacataggaaataatgcatacctttccatgcttcttgctgagcctcttcatgcttataaacaggctgtgctgcccaagcaaaataaccgccggctctgagcattctattaacctccagaagcaggattccatctttaaagtggcaaatcatggcaacaaaagttaagcaaattggaagtcagggtgctacaaaaaacagttatctttgtgttgatattttgttgaaaacaatcattggatgaaaaagcgtcttcacgtgctaaaaataacacactatctttgcaatgtttgagtgccttgagcatgtctatttttctaataaaggaacttccagtcattatttgaataaaatatttttcttatgccgtaggaatgaattcagactagctccttaaatactccttaaatatgttgcctttgctcaaacgcataactaagaaaaaaaaaggtagaactttacatcaaagtgagtgctcaccatcgtgggtcc

SEQ ID NO: 63430 - DNA, 686 bp, Oryza sativa
actcaggcacatcctctggggcatgacaatcacacctgacaaacatacccatcagcaccaatcagtttaagtaaaagctcaagcaggcactaggtaatccaattcaactgcaaagacaagacatatttacaggacaatcacgcaaaaggttaccatagcttagatgtgataaataattcttcacgcttgacaacaccttcttcaaatagcttcttcagagctatccccacctgaaaacccaaaatgcgtttattaattattactcgtcttgaaacaagataaaattggggtctagtgtaaagcatatagtagtaagaaagacaggtaagtgctagttttgagttctgattgccagcgcatggccctgagtagtgcagatttgtcttttactatgtaaactttttttcttttttctttttttgagaaggtggaagatcatcaacttattatctaaacgagtagttcactatcagtccatataaaatggaggaatatcatacaagtttccataacagtaggttgcccaattgaatcaagaacggaaatcatctgttttgtgccgctgatctgttttcactaatgctgttaatgcaaaattgatacacgaatcgtttcaaacaaaaacatagacgagaactaggaggaccatgcctacagaattctgcagtgataccccagtaatgcgg

SEQ ID NO: 63431 - DNA, 593 bp, Oryza sativa
atcaaaagattccagtggctgcccggcaggatcgactctgattatggcccaatcgaaggaggcgcactgtcagtgccacggcaacagcttccagtccaccttcacgaagagcagccatttgatcatcctcagtcgcaggctatatagttttgttgcgcctgcaaaagaaccaaaaatatatatatatgttatgtatcctctgttttgctcactgctagagctccttggacatgcaatgcagcatgactacccctgttgtactaacctttcagctttatatccatctgctattactaagatcctccaattctatttgctttgcttgaatgccttcgccataaaactctaaaatactgcgttagctctatagccctaaatgaacggtggggaggcgccgcgaagcgcgccgaaaatcctagtgaagtagaaagcaacaacagtggtggcgccagcgaggaagcacggatccagtggtggcgcaagcaaatccggtggcaacgaccaagccatccacttcttgtcctgccgccagcttggttgagctcccgacaagccaccggcctcgtcgagctacagaggggctgatgctgtgt

SEQ ID NO: 63432 - DNA, 1083 bp, Oryza sativa
ttgctgtcatagagaccagcattcctctgagaaacttcttcacgctgaacagagcacatgcctggctaatgttttcaagatatctctacagtcttttgttcccatgttggatgaatgcatctcaaaccaactatgctctaattacttgctcttggaagcaaacattggaatgcatgggcctggcatggtatagcagacattctacacaatcatgattcatcctgataataccaaataccagcagatcagatcaactattatagctttctcaacccgtaattgcttgccatggctgatattctgtgcccatatatcgtttccacgcaattacgtccacatagttttcaatccaatctttacagctcaaacgtttcaaacgaacatcggtagcttttagaccaagcgttcatatatacgataaacaacacagtgcgttctccaaaccaccaaatgtgccaacccagctgcacattgaagagaacataaacgccctatctgctcacttgcccacttctcttgaaaagactttgaaaagacaacatagctagcaccctagcaacctgtctatcctcactctttaaccttcttctacctctatccgttctctcagccagacctctctctctctctctccttccatcaagaacacatcctcttttccagcttcacttcctccttcggttcttgcttgtgatctactacattgagcagaagaagaacggctcattgctattgctgctctgatattcatccataccaggtaccacagccaccgcatctcattctccaaactgatttctacacatatattatgctttcctcgcttatcttatcaaataaacataggtacaacaaatcgattagtaaatacaacggcagggaaattagatctgtttatagatagaacagtttccctacatgcacaagccaagcacattcacagccatatttttcttttatttttgcagcaacatggaacacaaccagacagggaggttactaggccaataacacaaccatcgacctatgtgaagaaacggccactagcagcagcaaaattttccaatagaaaggagacgtccc

SEQ ID NO: 63433 - DNA, 5661 bp, Oryza sativa
ataaaacattcatcccattcagaagaacaatactttactaatgtataagatgaataaattcaaaattctttcagtttgatagtacctgatcaaatggatcaggcatcacctgattctcgagaagttcaggggagatgtaattttctcttagagatgaaatgtcaacagatggagcttttccaattctcacacacattgaggtaccgggatatggaggaagatgaagcttatatttgctcacaataggtgggggaacaaatctacccccaagaaaatggtgtggaccggtaaatttttttgcacagagctttggtgcagtcaatgatacctaggcacaccataaatcgcattacaaatgaaatttgcatgttcaaacagcaatatcttatactactatattgattcaaatccagaaagcttctgaaaaggatgctaagttgctaaccagcatatcaggtttaaaccctcctccattgatatctccctcttcaacgtgccaccccgaagggatatcaacagaaacaattgctggtcttttagcagaattatcaatagcactcagtgaaacaagcctgttgataagatcatcaaatggtggtcttggtgttcctgcattgatatttcccaaaagaaaaaaaaaagctaaaataaatgaaagcatcactgagctcaggaacagactcactgaaaacccttttggaacttaaggccttttctcaattcatgtggtacatgaaatgattcttgtgaattaatcctataaattcctgcgttgcaaatgcaatgggggctaactctgggatctgggctcaatccaatccaatttaatccaaatgatagcattggcagcattatcttaatgcacaaatcattcttgctttagtaaaacagtgcagtaaactatgccttagttgttcactcatacaaatctgtcaattgtcccattatcaaaagaaaaaaaaaacttgacatataacaagatcgatacagtatatttaacaaagtctcaaatacaatttgcgacaaaagaactagtaatatattacatgacatcagctgttattcataccacagttgagctacatcaattctcacttgtttcattcctaagttcctgttgataaagagactaccacactacagtctaacagagaatctatggccttactttacaaatcacatcatacagaatattcataaggaataaatatataagtagcaggcactgatcagttccctagtaccagcttcacatcaaaattactatgattatgataagatattggatagcatgcacataccatgaaacgaaaaaccaaacattgcatcaataatgatgtcaaactcctccgataaatttgcaggtaggtcttcaacaggaacgaaagggattgttagtgattcaagctgaaacaaaagagtggctcgaattatattggaaaagaggaagcatttggcacgccaagaaaatggaacaggatatatcagtttacctgagtacaaaggccagaatacagaggcttgggcgtgcgttttggataacatacagaaggcttgtacccaaagtgatgaagatgacgagcagctaccagaccatcaccaccattatttcctggaccacagattactagcacccttgtatgttcacccaacttgtaaacctgtgattttttttggggggtcaatacaataaagtatcactaattaagactcataacagtaacaaacaggtacaagaaggaaatccaaagaaagaaaaatgtgaaccacatgatgacagttccatttttttaggtctgaccagatttcattttctctactcaaagttagtggaattacacaaacccattaaacagttaaatcacttcattgctgtattggctagtccattctttgacagcagacagccaggcacaagatgattagttgcatttctcatcatgttcagcaacaacaggaaacagcatgataatgcggtagtgctgcattccaacctagatgattatatgcatgattttttaaaaaaatcttgaaacaaaactgcagagcacgagtacaccagctacagtaacaaagccaaaaagttgtgcaactcctcgttgctgattagagtcgctaatttacatgcttattaatcaaactaccacgtcttgaagaaacacaatactccagcataatatcaacacattcaggtaaggcagttacgtattgggagcacaaattcctttcgagattcagcgatagtgaatcaattgaacgcgctttgaagatttgttctacttttggaagaccttgcgttatgtcactagatatcgctttctcgtatataaacgtaactaagggggtgtttagatccaccggcaaatttttttgccccgtcacatcgaacgtttgaacacatgtacggagtattaaatattgacaaaaaaaaactaattacacagattgcgtgtaaattgcgagacgaatcttttaagcctaattgtgccatgatctgacaatctggtgctacagtaaacatttgctaatgacggattaattaggcttaataaattcgtctcgcagtttacatgtggattatgtaatttgttttgttattagtctacatttaatacttcaaatgtgtgtctatatatttgatgtggcccagcaatttttttttgccggtggaactaaacacagcctagcctatcccctttgtaaaggttttgtccataatgaccatgaacagttgctcctgtagtggccaaataagtagcaagaaacgattgaaaccgccacagcaaccaaaattgaaaggtactgaaacccatcacacagtaaacatcatcacccaaatcgggggaaacaaagcctctgagcgggtgcctttacctccgcaaccgccgccgcaacgctaagccccgcaagctcctgcacacacacacacaccaaacccaagggatggatgagtcagagaagccgagtggaggccgggggagggagggaggagtaccggaccatgagctggtcgacgctgaagccgagcgggcccatgagctgctcgtcgatctccgccgcctcccgctgcgcgaggtgcgtcacctcctcccccgacgccgacgcggacgccgagacggccagcgacgccatggcccgccgccaccgagggtcctgcgcggcggtgacgagggcggcgcggcggggtggcgggagcgggaggcgagggcgagggctagggctccgggggagagaggaggagtgaggtgggggaggaggggtgggggaggagaggaggaagggcatagcaagggagaagcaggccgcggcggtggattttttgttgttgcggagtgcggagccgccacggtcagcatcgtcgccccagttgcccacccgtctgtctgacactctgactcacctggtcactttgtatgtatggccaggccagctgggtttgcttgcgtggctttagcaaaaccaattgcttgcttggttgttggttgctttcttgctattggattttctttttctttttcaattttttttaaagtacgtacgatctagttgtacaactcatatacaactaaagacatgtaaccatatatcaatcaaaaagagcatattcatatacattgtagttgttgcaactgatgatttgattcactattatgtgagtcaaacggttgggtcgtatgcataataaattcatttttttaatatcattatggtatgactagtgcaatgtttcctttacacgtcatgttatttaaaataataaaatgctaaacaatttttcagaagaaggcaatggtactccaatactaacgtgtgggtctctattatcagtgaattcatgtgtttccgatatttgaacgctcccaactgccttaaccggtttaactctagcgcggttgtctcgctcgtgttcttaccaccactagcgcttcctcgtcttctgcccctacccaagctcttggctcactacgagtctcctctagtctagcacatagtcaaccccctcatcatccatgagctatccctaccctctttgcacgccaccatcaccgctccaactgtacatcattgccaactttctcaaatgcgatgcaatgtcctccaaatcttgtgatgatcctcatgcagctgaatacataggccttgggctacccaagtcatggctcgcggcttgggattcaatctctgctgcaaaagtctattttcccatcatgtaaataatgttcacaacccacgttataataggccatccctggtcgtggcctgatcctaggcccgctccaatcctcatatacctcctatgccccctctccacaccaagtgttgaggtcactctcatgtgttggctgaaactaaggcgaagaatgtagagtcagtggagactactccagctaagacagaggcaacagaggttgagctgatgactataaagacttagactattattgctacccaaagatgaaggtggcttcggtcgatgtggctaatgaaagtgcatgagagtatttatattaacttcacctacctcctttttgaatggttggttgttctctacatgtgaaaccttagggcttgttcggtttagaggaatttcaactcataggaataggaaaagtggatgaatagaaatgtatgcacgcatcaattcataggaatttttccaaaaggtttgagtggataaaattttttctatgtttcctctctacaacttgaatggaaaagaaaaattcctttggtttcctattcctcattcctataagccgaatggcacatgtaggaattaatccttaggatccaaatcctttgtttttccttcaaaccgaataagaccttaattcatgcctttctagacttcttccatgcctagggtttgaaaacagttctaggtccaactcactatacgtacatttctaacactattgcgttttgttcttgcttcatgaaaaaaaaaagtccgaacggtactccctccgttccaggttataagacgttttgactttagtcaaagtcaaagtactataagtttgactaactctatagaaaaaagtagtaatatttataacaccagtatagtttcattaaatctataattgaataaatttttataatatattagtcttgggtgaaaaatattactacttttttctacaaaataaaacaaacatatagcagtttgacttttaccaaagtcaaaacgtcttctaacttgaaacggaaggaatagttaattgctctaggaataagttcatttggtgaccctcaaaagtgattaaaatctaatccgtgaccctaaaccacaaaatcggatatcttgacccccaaactatcaaaaccgatgcaatttgactccctcggcggttttggagggtggtttcgctgacgtgacggtattgacctagtctgtgtgctgacatggcgcttaggtggcatttcaattaaaaagttatacatgggacccgtttgtcattcactcacaattgtggggcccactgacatgtgggtcccacatgccatcttctccctttcttctcccctcccttctctctttctttctctttctcccctacggctgtcggcggggagtgagcggcggtggcggcaggagctagctggagcggcggcggcggcagcccgcgggcggcagcggtgggcggcaacgggagg

SEQ ID NO: 63434 - DNA, 713 bp, Oryza sativa
aaaaaaacatggtaaattatgatgctgacaagctagctagctactacaaacaaaataatattgtcaaagtcttgagcatgcacattctgaacttaatttctgataagatgttcacgtgaaatgagtagatcgagtgagtatgtacataccaatggggtcatgaggcggcagaggagtgatctgaagatgccctggttgggcctctcgtagaagagctgggagaagcgagtggagtagaagaggaagaagggcaagccccagattgagtaggatggcaccacccaatgcagggtcctcaccagcatcgtgcacggctgccctccctcacctgcaaccaaaccaatcaatcagaactgaacaagcttgaaattaaaggattaataattcttcagaattaatgacagatagtttttgttgctgcatgatcaacttggaattaattactaacttgatggccaaacaaaaggaattaatatactaagctagcactttgatatggtcaagtacacagtcaaaatgttggagtgatcatctctgcgcagtttcagagtagaaaaaagagattgacaagtggaacgcgtagctagcatataaaacacttcagcttgaaaagtcagagcatatatgcgtatgtgttgtgtttagcgtactttgaacctgtatagagcaagaggaggcttggctacatgtggcataaaaagaaataaaattct

SEQ ID NO: 63435 - DNA, 2777 bp, Oryza sativa
cctcacccgcccgccggccctcgtccctcagccgccactcgcaccgccgccggttcccctcggccgcccactgccatgagtcgccgctctcacccgcccgccctcccggcgctgccgccggcccccgcctgccggttacggcgtcgaagacctggtcgacggcggccgagctcgccataccgcgcagcgtgtgcctcccgccgccgccgctgtggtcttctccgtcttcgccgctgtggagctcagcccgggcgccacctccgctcgcaggccaccgcgcctccgccactcgcaggccaccgctcgccgccgtcttcaccgctcgccgccgtctccgcccgccgcgggatagagagagggagcggcggggagagagaaggaactgagggaggggagagagaagggtcacgtgggtcccacaatctatttttggtgtcaatgacaaatggtcccacacatattttttaattctaaatgcttcctaaacgccacgcgtaaaggagacccggtcaataccgccacgtcagcgccacgtcagcgaaaccgccctccaaaaccgccaagggagtcaaattgcaccggttttcatagtttgggggtcaagatatccggttttgtggtttagggtcacggactagatttcaatcacttttgagggtcaccaagtgaacttgttccattgctctaagcagagcaaactctcttaggttgggcgaggtgggccaacttttcctacagtaacaaatgtggccactatacagtgcccggctgctacagtacagtgcagtactaggctgcgttttgcttctgctgttgggctgtgctgctagcttagctttgctcttcttgctgttgggctgggctgagctttgctcttcttgctgttgggctgggctgagctttgctctcttctttttctttttctcaattatttgcggggcgtcgtattctacctatctagctagttctacctctagtgcttcctctttagggattggtgtagagagatttggaagtgagtgcatgagagactaggctagcttttatcttgggcactcaagattggcatcgagctcgtttgtcactgtatttgttactctttgaggttctcctgttcgctagctagtgaggtgtcgctcacgagcgccggtgaagtttgtgaaggattactttgtctctctaaaaggaaaagaggtggcttgagtagataccgagcttgatctttgttgttgctttgtgagattaatttggaattaaagaaacctgactttttggagtccctcaatgaaaacgaaggataatttggaatccgaagttcggtgaaaaatcagttgtcttctcctttatccctcttttcttttgtgcataatcatttgtatcgtgttctaattgttttgtgctagctagctcgctagtttcctgcttctttagttttcatgttgctagttgtagctagtgaattaaagttgtgcttgtgagttgttttcccttcgtgggcttttcctacctaattggaacctccagtgttcttaagcagaacttccagagcctaccggaagttccgactataggaacaaaaaatacagatccctgtcaagtttaggactaccacgagggcatttgggtctctttgcgtgcaaatgtggcttctctctcgttacgatgtcttgtagcaaaatttctcctttttattgcatgaaagaatctagctgggagcactacaggtgagaagattgctgctcatgtaggatttgcctcaatattttattagagaaaaattcatggcagagtttatttacatacagaatatgtggtaatgtggagcaggaagaattgaacaatgcatttaaagaaacttagcctgccaatctgccatgtcattcattggtgaacggtgactttattttatctgaatgatataagctgccatcagagtttactaaaggacatggcagccccatctgttggccttgggtgtggaaggtaaacaacccctgcatcaggattcaacaactcccatctggaagaaataaattgagccattgaaaaaaaaatacagagggtgaattattactgagaataattgtacacatgtactgttaatgaaggtttggaagtttagtgaatacttgtaaccacaagagagatgatggagcatgatggtgagctgcagccttgccagcatgttgccggcgcagatcctctcgccgccaccgaacacctggtacgtgcctggcttcgctgctttctgatcaatcaatgcacttacgattaagttgacaatttatcatcaaaggaagaacatttacttcgatcgagtaataaattatgtacatgaacgaccacatatgtttagttacgttttctttcaaatttaaaaatagttatcgttttgataaagatacggtctccacaaaataagttttcactatttctattgtaatatataaaaagtatcagtaaatatataacattattgaagtacattttaagattaatctatgcatgtgttatatacgtatatcagtaattatttatagtcaaagtttttaagtctagcattgtagcatcaatgttttttttaaaagataattatttgcaacctgaagggagtaaatatatagcagatcggcactcaagtcctcatttataagcaagttttgtgggcttggcccataaaattggtttataagtggggctcctagtttaaataggattactttaaccgatcatctacttgattatagtagtaattaaagaagaatttttaagaaaac

SEQ ID NO: 63436 - DNA, 589 bp, Oryza sativa
cttccaaaaacttttttgctctggtattccaaagacaagggacggaagacattgaaacaatctctagtctctacctttacatctcccttgtaaattctaattcatatttcgtagcatcacaaatatacaagctcaatagttttcaggaaactacgttcagagtttaaacgctgttggaccttggaggaagtacccgctaagacataagtctgattattggcctaaaataaggttgtattattagcatatgtgatgtagtatatacagacatacagttcgtagttctggtgattttgcagaagctttcaacgcttcgctgccaaatggccacttcaaccatgcactcttttaatctaatgctctcactgtttccaattttcagtgttggcgtggtggattatttgaatttcctcctaggatcttctattactctcatagtagtaccactgctagaaaatgttttcttaaagaaaaaggtactttcagaatgctacatgttttggatagccatatttccacaacctgactgacgtctgtggttactgattacctaaccagataatcaaatccatgtgcctgcattactcaa

SEQ ID NO: 63437 - DNA, 1137 bp, Oryza sativa
gcgtggtaacgtatatacacacgtcactgcatacgtaacatcgtactcatacacccatgttcaatgaagcagaaactagcgagacatcctaaaattttattaaaacttgaaagtccatcagtttcaaaaatattttggggttggaacggaaatatgctagggccatatggtattatggcaagtcgtctcgtttccattttaacatttttagcttacttttaattcttataggcatatgggacaaggagctataaacttgtaacttggacgtttatagcttgatcataacattggtgctaagaattttaactataaacattatagttttatgataattttattgttaaatatgtggttttgtaatacttaatcttaaatcaatagttttgtgacaaattcagtgttaaatctataatttaataatacaacatcttaaatgtgaagttttgtgatagtttgataaaaatatattaagttttgtaaaaattactctattaaaaaaaggaaatgtgtgctatgctccctatcttgctagtccagggaccaaataaaacacatatacttgaacaactatcagtccattgcagcaacacttaataaacagccaccaggttaattcaagtagcatatgacagtataaataatagaatcaaacgtagataagttcacatatcaccgaactcgcgtacactggttcagtacacatgtctcgcacaacttttatggtagtctatggctcataaaccgacttgctaatacaccaacacaaattaatcaagcttgaaccttaaccggcatcgcatgccgatcccgtcttttgacgttgcagtaattttccgttcattagcctctgcatacttaccactgcagcttaagcgttcatgcgagccgggtactgctcgacgcagtccagccacgggctgcgcgccgggcggcgcacgcggcggacggcgcgccacacggcgctgttgcacttgaacccggagccgaaggcgagctgccacacgcggtcgccgcggcggacgcggcccttggcctccaggtacgccagctcgtaccagatgctgctgctcgacgtgttgccgaagcggtggagcgcggtgcgcgacgcctccaggtcgccgtcgcggaggccca

SEQ ID NO: 63438 - DNA, 6982 bp, Oryza sativa
acgcttacgttgcatcagaagtcaagagacaattcaagcctcgaagcccagaaaagaagattcctatagaccccagtgttaggaacttcttcaggggtatgtctgcatctgtcaaggaggccatcaagctatcggactatgagcgaacgctgaagaaagcatcttctagaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaacctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctcttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgtggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgatcatatatatatctatatacatatgatttgcataacatatatatgtataaatacatatatattatgcatgtatatacatataatataatataatatatatatatacatatatatatgtatgcatatatatgtattgaaacatatatatgcatggtttatatatatatataaaccatgcagcaacaggggcatgcaaaaaaaaaaggtcagctcgatttttagtcccggttggtgttaccaaccgggactaaagatcgatctttactcccgtttatttcacccgggactaaagatagcgatctttagtcccggattggtactcccggtttggaaaccgggactaaaggggggttacgaaccgggactacaaagggtttctccaccagtgaatggaccctttaagatacgagagaaaagggaagaactaaaaaatgtctggcagggttttgaatttctaaatatgtgtttttttgccggtgttgacaaaaaaaaccgagaccaccgaaattttggtaatctcggaattttttgaccgattttttttttgttttttaatacattttgactgaatttgaataaattttgatgaaatttacaagtgtttgagaaaaaccaaaaatttcgaggagatttgtgcttgccggtgggggctgaaattttaaaccatggtatgtctggtgggctgaactcgggcgtaaacttagcgagccaaaaacatgggcgaccttcttgagtgacgcgtctgcgccaattagcaatttcgcaattactcacccaaaaccctatatatacacatctagcttctcactactggcaatgcaaccaacacgtacgacacgacgcctacttcacactgatatagcggctatggctgtgcccgtggagatcacacgcagcgagttgctcagaccgtcgccagcgtctgcgtcgggcggcggcgagagggccggccttaccgccttcgaccgcgccgccaccgacggccacatcccggccgtcttcgcgtgaaacgcggcggcggcgccgttcaacgacgatatcacgttaaaattagaagtttggttgaaattgaaacgatgcgctggaaaagttgaaagtttatgtgtgtagaaaagttttgatatgatagaaaagttggtagtttgaaaaaaaaaattggaactaaacactgccatatcgacggccaaatcgattaatttccagacgcgtatgctcatctatacggccggcacgtacgactacgtgtgcacgtgcgtatatactgttcatgctgatccagaccagccacgtacgtatacgtatatacgtagagcgtctcccaaaatcctatactactcaattaaattggcgcgcacgaaggtacataggccaaatctgggctccctgccacccgctggttggtgggccggccgggctcttcctcccgcccaattactcggggggaggctgacaagtcgagcacacgacggccagatgtggcgttcccgcaccgcacgccaacttagtgctaatcatcatgtgtttagtgctaatcacgcttagtaacttttaattggtaaaagtaatcgctacgttgaaagtttcaaactataagttgcaagatttcaaatttagggttgaaagttttaaaatctgatttggaagtagttttatattttgagttgaaagtatcgaaattcgattatatgtattagaagttttaagttttggttttccattaaaaaaatcaagttgaaaggttcaaattttggattttttttttttaaattagaactgaaagatttatctttttagtttgaaagttttaatttgaaagttataactgaaagatttatcttcaaattttaacgctaacaacagcgttggattagggttagggttttttttctttttttgtttcgattttttttctcagtgcgggcggcttaagcacctgcacgggaaaatcggttttcgcgtgcgggtgcgtctcccgcatgcgaaaatcgtgattttcccagacgactgggtgcatgtgggccacccacccgcatgcgaaaatcggctcgcccgcacgggacaatcggtgctgtagtagtgatacagatagaaggttgtgatgtatctagtgagggatattccctccgtttcagattgtaagactttctagcattgctcatattcatttagaagttaatgaatctagacacataaatatgcttagattcattaacatctatataaatgtgggcaatgctagaaagtcttacagtgtgaaacagaggaagtaatttatattgttcactaacacctaatatttttctgggaacgcggtagccaactaaaactcattttagcatcttctcatccatctatccccatgttagatatttttggtgtttgttccgatctatatataaccaccacgaacctaaattattgaggtatataatacgggatcggaatatgtacaacctacagtaaaacataagataatgtgcaaaacaactaatgggatgctttgctacagtgtttaatcagaattataaatttcagtgtcatgatttacgaaacaccttgatacgttgcgagaatctagctgctagcgtcttgattgctccaactctctgtttaaggcagatctgaaaggctgaaacagatgattggtaacataagccatggtggtaagaacaaactgaaaaatatggactatgcaatttcagaatattggtaaaaccataaacaacaaaaagaaatagattttatccaccttcctgacttgtaaaagaaagaactgaagcaagagataagtggacacaaagcatatcattttcagatttgcatcaattgctgatcaaccaaacacaaaccctgattactcatttggagtcatagaaatgccatccaatgaacagtgcaggataagagaatgaaacagggggtgatggccggaccaattaatcgctacaaagcagatcaaactaactcagttacctgatggaaagttttctgcaagcagtgataagataacattctaacaatgtgaaagaaacttcaagtaatcagacgatattaaagaatgcttcataaaagatagaactgattgaccgaagtatcagagccaaagatcatatacaatcagcgcttcatgaattaggggatctagaactgatgaataaatatgggctaccgagcgaagcaaagtgtgcagatatattccatcggttccttgcatcagcgtgttgatgtgacggctcacctggttgcctttatagatgggtgtttttttgttgagtcaaattctattcccatctagtggcaacgattcccagaagaggaagcggaggaggaggaggaggtggtggccgactattcacacaagaggaagcggagagatggaggagaaggcggaacggcgcggggaggagaagcgagcgtggctgagatggcgggcctgcagcgagcacacgcgggatggagaggagaagacggctagagcgcgtgagcgagggatatggggaagcagcgtggcggaggaggggaagtgagcgcatccggggacggcggcgactgtatgcgatgcggaaggtggagaaaccttggaagaggagatttttccctatgcgccattaagaaagatggtgtctgcctctgtgccactaaaaagttcgagccttcttctctaccatcgtcgaactatatcgtgccctccacaccattccgtccgtttttggtcgtaacagtgggtaacggcgctgcgtagtgacttagttgcccttaggcttgagaggccatttgatgaagtttgtttccttctgtgccattcggaagcagccacatgcctgtatttttggcaccaaaggctatactgttggcggcaaaggaagtgttgtttggcacctactgagcccttctcctcctatataaaacacatcagcccttgtacttccaactcctccatcttcatctcattcacctctcttcttctccagccatttcccaagaatctagcagctatggtggtagggtgaagcgggtgctttgccgcaactgccatgtgcttgcaaaccgattcatctcgacaacagaaaagaataacaattgtgcatttcacaagtgcccttatttagcagtttgtgtttcattctctgctcacatattgtctttgggttttttgttattgtttgctcacaatgtgttgatggtttggctttcagattggaggctgtcagtattatcagtggaaggatgaaatgttggacactggagtgcggacacatcttgcccttgctccaattcatgcaggtcacctacaggcagtggcaccacttggtggtttccctactgcagctccacaggctatcatgcaggatcgggctgctggagttgtaggcaatgcacaagtggacattagggtgatgtagcagcttaagtggcttgaaaagatggtctatgtttgcactttcttactttttatgctattttcaagaagtagttgggtgtttgtgtgagtagtcatagataaatggatgtatggaaggatgaatgaatgaatgaaatgaattttcaatgatgaatggtgaaagtgtaaatatccagaatgaatcaacaccaaatgtcagcacataacaacaccaaatgaaacaacataacataactagttgtttcatcacataactagctgtttcatcacatgatagcaccaaatgtcaacaacaaacatgacttagcaaaatacattgctccacataccaacatgccaaagtaagagaccaaaagaagagtgtttcatcacatggcagaagtttttcaccatcacagaataaaagaacagttatgccatagaccaaaagaaccacagatcaaaagaacaagcacattttactgcagcttgagcttctttctcctggtatttctagcagggctgtctaggcttgatgtagtggttacgacttgggctttcttggggtaagcttcctgttgatgcatatcttccttcttggtgaagcctgggacagcacaatctgcagtggctaggtctcttgggtctcctaggtctcctgttgagtggtctcatatagagctaggacttgggccatgctttctcgggccagcccaaggcacgatggcccagcacgagggaaagcatggcccaacatgacacggctatgggccgggctggtacggaccatatttgagctgtgcctgggccgtaagttgtggcacgctaagcggtacggcacggccattgggtcatgcctgggctaacc

SEQ ID NO: 63439 - DNA, 2813 bp, Oryza sativa
cttcattatcttgacaacaatcggtcattaaataagacagtcatagggttcaaactcatgacgtcacacacaggagatgccatggccacgacaatcctagaggtattgagagaattcaatttacaatatagggttgtttccattactcttgacgatgcatcagcaaacacaatggccatgtcgattttggagctggatctacgaagttatgttggaggcttcgttattcatcagagatgcatttgtcacatcatcaatctcatcgttcaaccatgtactaatgtttattaatgatttattgattttagtgtatgcggcatattgcttatttattttaatgtatgcaacctatttgttttgcaggcatgattgttctggagaaattgttaaacaaaatttgccgttatgttcgtatcatagcaggtaacacagtggtcaaagcgaggttccaggactactgtaaagcgaagaagaaacctgcacggatgtttggcattgatgtcaaacataggtggaacacaatgtacctattgttgcgacaattaaaagggtatgaggagttaatttatgttttcatcaattcgatgcatgtcagaatgaaggatatcgatgacgacggtgatggtgagatttttattctcaccgatcaggactgggagatcgctacacatgtgcgtaaatttctgaagcccttttataatgctacagttcaattatcaggaatttactatcctacagcttgtttggtgcttaagtggatttggaagctggcacttgtttttgatgaaaaccagtctgatcgtattctgtcttccattgttaaacccatgaaataaaaatttctcaaatacttcaccggtatacctcacctttattgctttgctttgatacttgatcctcgcaaaaagttggaaatcaccaaggttgccatgaactcaataggtgatacagtggggcttgattattctgaagcttttcaacatgtcaatgatgagctctatagggttttccgtctgtaccgaaccaagcttggtggtactccccgagttcctgagcagacctcacaaaagaaagcaagcaagtcaagtgcagtaaatttgtgaaagcagtatataggcaacgaccaagcctctccatcctcagagaaaaaatcaacatggaacccgatttagagcttaaccactacctcatcacaatcatactgagcatgatccgacgcttgatggcgacggtgtcgatctccttgggtggtggaaagagaaagagcgaactcttccagtgttagcccactttgctcaagatattcttctggttccggcctcctccgtctcttccgagcaagcattcaacgttactggaagaattattgaagaacgaaggtcatgcctgacacctgagacggttgagttaatcttttgacttaaagactagatggaagcagatgaacgaacgcaacactgtctacatgatcaagagcttgccgatgcaatggaagacgcattggcggaaatttgccttaccaaagatgatggtggtgttgatccggagtaattgatgctataatgtaaaatagttgttgtactcttttttccttacgagggaaccatactctagggcgtaaggtttttaacgaggcaacaactgtctatgttcaacagctggaaaaatttgactaactccattcgactgcctgcccacaaatatgtgttgaatgtcaggccatctagggtacctattgcttccttcaatctctccataaactagactcagttctcattggtctctgagttagtcacaacaatagctactggatacatccagttgtgcccatctactgcacaagctatggacaactgccccctaaacctccctattaaaaaagactatctagtgcaagatatggtcaacatcctctaagaaatccatcaacacatgctttcagtgcgaagaatagcctattaaatctaatcttcttgtttatggtgtgatgatcaataacaagaaataatccaggacttgattcttctaactgggccttaagcctatacaggttattgaaactcttgtcccagggcccataaatcttatccatgacaagatatttacctttgtacactcttatagggcaccacaactttatagtgttccttcaacctcctccgcagttctgttgcgtcaatattttcatcttccttcggcccatcaaggacctgactgcacacctagaattgagttacccccacacatattccttgcctcctagtgctcagacatgtatgaggttttggaactcttttcacctagaaaccagtcaagcaattcacaagttagaatccacaaaattgaatgaaaactggtagcaatcaaataaaataatttagtaacacatcacctaaatagtgtgtccatcctttcctgttgaggcatgaagtctccgcaggcagccatcattcttttgtgcgcaattcaccctgtatctccctgtatcattcttctcaatgtcatagttgtactcatgtttaacagcatggctagctaaagcaatcttaaaagaatccatatatgaataaacagttcctactgacataggagggtccttcttatcataaaaagcatcaagcatattttctggctccctgtctttaatttcatcatcaatgtcttctacttcattatcagatgattcataataaaagtcagtctcatggcattcatcatcactagaactgtcacattccctttcttcactcccaccttggttctaaggattagaaggagtaggggtatagttgggctccatatcaatgtacaga

SEQ ID NO: 63440 - DNA, 720 bp, Oryza sativa
cagcacatcgaaatacacctacagctagctggagggactaagctttcccaatcaaaacaaaacagaactaatatgagatgatgggtttgggaaggggatcaatacctggttggcgagggagagggagtggtactgcatgcgcgggctgcgcccaatgtctcccagaactaccaccgccgctcgcttcctcctccctgcctctagtgccacggccattgcctactagccttccgagtttggaaatttcagattcaaccgccaccaagaagtgaggttcctgaaaaggcatttaatttagctaggtattagctccaaacatccaggaagggaggagtagataaaaaatggacaacggttctcttggttatttttctgttcaccgcatttatgctcaattagagaatacgtctgtactattttacatcaatacaacaatgttctgttgacggaacaagaatgtagggatgcaatatatgctagtgagtttatactcatgtaaattaattcgttgtttcgcatattgttgaacgcaactggagattcattagtttgtacgaatgattggcaaccaacactcggatagtatcggtactgtgtattccacagttctacaagtagcaaaggggactagtcctaatcatcagcaatcgcttaggaacatacatgaatttcattgtcctaaagtcaagtcaggttgttctgacattgatctggatgggc

SEQ ID NO: 63441 - DNA, 1312 bp, Oryza sativa
gctattgtctgagtacatcctacagatgaacaaggagcacgtaatcattaaaccctaacacggatcggtagcgctgggcactaaacatcaatatatcaagggaggcaacaaaggtggcctaagactgagaaatcaaaggggacagcagagaactcacccatccagaaaccaatccgggcgctcgccagcgccattccacgccatgcctgctcctcctcgttcctttcgatgcaagatcagatccacgctcccatgctccttcccgttgccgctaaggtttcaccgccgctagagtttcgccgccgcggagagaggggaatcgagggagaacagagagtgacactgagggggatgacgataagcaccggtcaacaggggttccaatatgccagcgactgaaagggcaagagtgacatttttcctgcctaggccgacatgtcagagctgccaaacggataatcccaaacagaatagcgacggaatagtgtggagttcatgataaagttcgacgatggcagagagggaggctcgaacattttagtagcacagatgcagacaccatctttcttaatggcacacagggaaaaacctctaggatatgggctgtgttgggcttagcttcaagcgctagaaataaacgggtgacgtggcttaacctcagcccaggaaaatccttagggtgtgtttgggattgggaaagggaaatggatgaatggctaagtttaaatgaggtgtgaaaaatggatggctaggatacaatattaccctttgaagggtgggatattatttctctatctcatttgccaaacaaaacctaataactacactaagtggggatcacttgtatagtattataggattagtttcctaattatcacggctcaagcgcaagaaagacacgcacctatggccacaactaaaactacaccaccatcagtctacaattttacaattttagtaggaaagtggaactgatatgtgtaaactcaaactcaaacgcatacacatatacatctatcacggcagccatgcatcattagcaaactgataatggtttcttaggatacacatacacatatactccctccgtcctattttaagtgcagccatgcttttccgtgctcaactttgatcgcccgtcttatttgaaattttctttaaaaaaattaaaaacataagtcacgtataaagtattattcacgttttaccatctcataacaacagaaatactaattataaaaaaatttaaataagacggacgatcaaagttgggcacgaaaactcatggttacacttaaaatttgacggaggg

SEQ ID NO: 63442 - DNA, 7383 bp, Oryza sativa
tcctgcagccccctcctgttgttcaccgtcttatgtcgaatttgtgtatttcgggaaatattagaacaaacacacgaaactttaatttttaaaccattgttcaaaataagcgatcagtaaccatggatgtgtagagctcgttgagtagtataaagtagactaggtaatcgaagtccgaatgaagtctcgatgtggaccgttagatctcttttctagtaactacctgcttcactaaacatactagtacataataaaccatacacgttttagtttattagctgattgtagtgggtcaacgtgatgacggagtagatctactaggtatctctagctagacaaaatatatgcaattaataataatgataattaactagcgcgtattcgagtgatgacttgtcgacttaaattatatttatatctcataaaaaaaacttttcatactagaacttcttttatttgttcaaattcgttgggaaaaaaatgaaggaattcctcaagtaaccataaatgatcataaaacactatttgttcaaattaaggttgaaaacggggcgggtatttccagccctcccgcccggccatattatttcgggacaaattcgggtacccgcgacttttcacgaatatcgggttcgaatacgggtcttttttggcggatatgagattgggttcgggaacatggtatccgacggatacgggttgtccggtaaaaaatcagggtattacccggataattatacggatattacccgtattatgtttttgcgaggtactttttggtaccatgtattagttctactatgatgtattgtagcctatttatttcctaaggtcctaatggcctaatataatcgtattatggatatatagaattgttaaatggttattgtctatgtgatatataagattgttgcttcgacatgatatcctaataaatattcgtaaccgatagtgcacgtatctattttggtacgtattcgtttcgtatttttgcccgatattatccaagtttgtatctgtattcggcactatccgtatccgacccgattccgattataaaatatgggttaaggtatgggaagggtgagatccgaccgaacccgacccgttttcacacctagttcaaattcattgggaaaaaaatgaaggaattcctcaagtaaccacaaatgatcgtaaaacacgaagtgagcgtaactcacctgtcaattagattccttgggtgaaaccaacccatccggattcaaattctagatttaatatggatgatcgtatttacggctaattattatttcattggtaggcgatgtactccacgatagcgaggcgtcatggtaacttcgtcaatcacaaaatataaaatgtaccggcacagtcttacgatgtgctcatgttagtaagatgcgcacgtgttgtgatcgcttacgattgactgtgtttctttaaaaaaaatcataaaacaaatgcatgcgcacatatttttgaataaatcggcggggaaggggtgccaaattgatacaacgcgttatttacgcactgattaggtcttcgtgatttgctccggtcagctcgctttgctagttgctcgtgcaaaatagtccacgtgcacgtctcttctttgattttctggaagaaagtgacgcctttgggatttccatgtgtctaaaaagctttcgcgaacgctttgacctatttctcatatggcacagggatgatatgatggtgacatataaatagtgatgtactttcttcatactccctcctccctgaaaaactactttcgggtttatatgcaaacccaaaagtaggttttttttgacggaaaaagtatttatataaatatgtgcactggcatagaaaacattcattcgtaagttatatataagttttatataagttacagtgtaatctctcgaaaaaaattacaatataattatatcacgattatattataattatatctgacaatttttttatgataaatgtatagatatataatccccgtattagtatctaaccgatagaagggtagtttagtaacgatgtcgggttcggaatcctacatgtggcctgccagttcagaatccagcaggaaatgccattcgtgtacttgtgatgatattgttgaattcaatcggtctttgaccgtaacttcgactattgttttatattaaaacatattgataatatgtataaccagattataattagtattgtaaaatttctgatacagaaaaatcttctcatatgtattttattttttcaaagtcaatatctggacaactattaataatcaaaattttaaaaagtttggtcaaataaaatcgatattttcatgtatttaaatacagagaaagtatctcacaccgttaatattccaaaatatgctctcagtaagtagtattacgaagagatttaatttggagggagataattaaactacaaaagtttcttacaattttttccttgtttttaacactactacgttaaaataactatagattttctagctagaaaagaaaatcaacgacgtaattaattaaaaccacgtatcagtatgtactactctatccgtattttatattttaatgtatgacgctattgattttttatcaacgtttgatcgttcgtcttattcaaagtttttatacaaatataaaaatatttatgtcatgtttaagagcatttgatgataaatcaagtcataataaaataaatgataattatataatttttttagtaagacgaataattaaacgtcgataaaagtttacggcgtcatacgttaaagttaaagtatagacaaagtatatcacaattcgaatggaaggtatgaacttaactggaaccacatattttggatgtgcgacgcgatgcatcgaacctgttttacttgttagattttcctcgtagggggttggtgaatggtggtgacgtgtatgtttttttccatagtcaaggtctaaactcttggagcgaaaacgtcacaaaagtcaggcgagtcgagtcgacggcatgcgtacgtgtgttccgccgtccatcatccgtccttgtgacgtcgacgtctgcttgctctttgcatccgattctactgggtccgtattatgctggaagtgccagccatatataatttgtacgaaagtatgtatatgtatgcagtgacggacatgtgataaatagtacttccctccgttttaggttagaagatgtttttgactttgaacaaagttaaactgctttaagtttgaccaagtttatagaaaaaatagtaatatattttatacaagataaatttattataaaaacatatttaagtattaatttaataaaactaatttggtaatgtaaatattactatatttgtctataaacttaatcaaatttaaagaattttaattcttataacctgaaacggagggagtaccaggattattacatactgctccctccgttataacctgaaacggagggagtgccaggattattacatactgctccctccgtttttgaatttatttttatagttatttaattttgagcaaatttatataaaaatataataatattttcaacacataacaaatatattatcaaaatatattcacggttagatttaataaaattaatttgatattttagatgttgctaattttttctattaatttgatcaaatttaaaaaaagtttgactagaaaaaaagttaaatgacttgtaatatgaaacggaggaaatattattaactagaaccctaattattatagcctaatacatgtaaaaattggataagctatctaatgtgtccggtgcaccaggataggtagctaccctatcctagggcggtacatattcccgtatgtacgtgtgtgtatacatgtaatataatcagtgataaagcccggaaaattttgaagtccataaatattttttaaaaaaatgtaaaacagcagatgctctgccgaatacatcaaacaaggagaaaaatccactagaagcgaaagcccagagtttcagatcacaagtgaaaacacctcataaaatggttgtttgaggggctacatgcgaagaaaaaccaaagatgcaagcaaagaaaacactcggctatagcctatagtaggtactccatcaccagataagcgcgattttggtggagattttggaagacttcggcgactcgagcactgctcaatggtgtgacagactgaaatacaaacaccctagattgctgggcaaatattacgccaggtggaccaatcagaaaccgcggcagtgcctaaaggtctcgttcctcccaactccataaaaatctaacagtcacgaaagaagaaagtgtgtaactataatattatactccctccgtattttaatatatgacaccgttgactttttgaccaacgtttgaccattcgttttattcaaaaattttgtgcaaatataaaaatatttatgtcatgtttaaagaacatttgatgacgaatcaagtcataataaaataaatgataattacataaattttttgaataagacgaatggttaaacgttgaacaaaaagtcaacggcgtcataaggtagtacgatttttagaagatcaatatatctattaaatatcaaagggacgcatggtaaattcgttggaaatccacaaaattaagctctcctaatggctcttgcgttcaccacggtgaaaggggtagttgaatgaggactcaaaagtagctagcgagccagagttgacaggacgatatcgtaagaaaatttgtgcataacatcgttcaacatttatgagttggaagcttgcagcccaaactaaattttacaagttgtgcatgactatggacctgtttgggggagctttagattctgagaagcagctgtttggtagccagtttctgagaatctggaaaagctctaaaacccagcttctccagcttctggtttcttatcatttttcagaaactgtaactatagattctcagaagctgtgaattatttggggcagcttctagcagaagcagcttttgcgaaaagctgcagctggataagctcccccaaacaggacctatatggccctggcactcgaggtcctggtgggtctcccttggccccggaatggccctttcatgaccaacatccaaagcagaataattaattatttgctacttttacgagagtggtgataaaggatttaccactagatctacatgccacaaacacataagggttcacatgtcatagatagcgagtggaaaaaaattaatttccacatcttaaaagtggcaaaaagttaaatatccctctaaagcacccctacttaatatatgcaaaattcacgaaattcttaaactcttgtagcacaagtttggatccacaggcaacgaataatgcatctcaacaaatttctaccaactactaagtatcataaagctgcaaaaagttattgtgaagcacttcatctcaccaatattttccgcggcaatgtgtgttaaaattaaggcacaaatcttatagggttaatttgatccgtgccactgtaaatgtgtctattcagataaatgctattataattcatctattcatagccatgccactcaaattttacaaaattagaatcatgctatcgccgtcacgttttccatcctcttcctcaatcacatgtgacccacccgtcagattatcttcttcacatgcggcgccgagccaagagtgcacaatgctggtggctactttggtggacggagtgggttggttgggtagagttatggaggctgagaagtggtggaaagagatgagaaaaaagagaagaggggaggatgggggaagaagatgaatctgatgggtgggtcccacatgtagatggggaagaggatagaaaacgtgacagcgatggcatggttctaattttataaaattcgagtagcacggctacgaatagacgaattgtaatggtatttatttaaatagacacatttgcaatggcatggataaaattaaccatttgaagtaactccggaaacatcttaatatcggttgataataccaactggtactaaaaatatctttagtatgggttggtgttacaaaccggtataaaaaagcatctttagtaccggttggtaacattatccaggactaaagattcaccagcattagtctcgattggtgctatcaactggtactaaagatgcatttttaataccggttgataacaccaatcaagattaaagatgttcctagagacttggaattttagaaccggtactaaagagctttagtaccggttctaaagagctttatcaccggttcttaatctatgcaagatatttgtgtgtttggggtattggataaaagataagttctctagtagtggtatatctctcttatttgtggatggcgcgagaccgggtatttgtggatgacaccagaccgggtgaaaggatacctcctagcgcgtactatgaggcccgtaattattacaaactttacaaatggctttatccgattttttaaaaatattatatgaaagtttttgcaaaaaatacaaaacaaaaaagttcggagttaaagaaaagaatacagcctaaggcccattttttttcttaacttcaaacttcaacttcctcattttccgttaacacgttttttgaactattaaatggtgtattttgacaaaatgtttctatgtagtagttgtttaagaaaatcaaatatgtgctaatcagttttctcgtttagcattgtcttctgtagttcactttgacgtgttggtgtaggatcaatcggttgacgagagcgttgtctaacttcttgagagggatgcttcccacctgcttctacttgcacctttgctttagcaatgatggtatgtgcggcatcaagttgtgccccatcagcagccaactcaattaccgtgttgacacctgcaatcctgacatcaaagatcatcgagtcctgtgatgtggttacctctgtctcctcctgattcaccattggagcagcatctcttgtgctaattgacgaggacaccaagtcctgagttgcatcgactagcaaagttggagcatacgcagccactagcccaccttgtccgactccatctcctgagctgcattgtctatgacaatactccctctgtccttaaatataagggattttagttggatgtgacgtattctagtactacgaatctggacaaggagtatgtctagattcatagtactagaatacgtcccttccacccaaaatcccttatattttgggacggagggagtaggattcagcagtcaaggacaaagttgcagcctctacttgtgttgatgatgctcccatcgaggcctccgagattgatgcacaacttgccggttccatctcgctcacatctgtcaattg

SEQ ID NO: 63443 - DNA, 1720 bp, Oryza sativa
tagccttctggtaatttacataggcgctaatctttagttgtaaactagagcatatcatagtgttgacaccgttaacacttaacacatagataccaatctaagtgtaaaatattaatcttagaacatacgtagtagatactaaactttaggtgtaaattagcacttggcaaactggttttcccaaaggagcaatcaaagcggtgtgacatataaactgattagtaaccggtggtgtgacaagcaaagatgtttcagcaataataacatagctaaagcatgtataccttgcagtactttttgggcaaaagaagccagttctattactgaagtacactcttcgatttaactgttctattactgaggtactcttcgattttgtggttgactgtaacggtaatgctaatacttgacataattaggtagagctctgaggagctacatgagatgtcaatactttgctcttatgcccaccatttcacccgcggcaacgcgcgggtcccggctagtttctctagttttcctttgccttaaaggagccctagatcttgtttgggatggttcaaattactgccaattcccgaggatgtgcaaaatcctgaccgaactggcgttatgtagatttattggtgattttttgaggattaatcatctcaacttctcgagtcagcgaaggcctcccacatgattttagattttcaatgacaataactatatcttgattgaattttaaacataattagtaccatcaagtactgactccccttagtaaataaatatttatatttctaactccaccgctgttcttatgtgtggctttgactgtttgagctacagataatgagcccaaaaaaaaaactaatagaggagcacctctaaaaaaagtctttatattctgtgaccgagcaataaccgaagcaactctatatacttcatgagtacaacttttgtatttatattaccagcggctttaaagttaatataaaaaactcaaaaagtatcacctgtatttttttaaacaacccatacaagatagtatgatatttttatttatatagcagaaaaaaaatacaagacctgggaaactatatttatggaaaaaaatactacaccccacatatacgtctgatcctgctactgaaaacaaaataacatcccataggaaatgtaacaacataacaattatgcctgacaagcttgagacgctaattaacctacaccccccccctcctcaaacaaaaaccgaagcaaaggccagattatccactccaacgaagaaaaatatgtcaaatattaggccttgcttagttcctaaattttttttctcaaaaatatcatatcgaatatttggacaaatgcatggagtattaaatctttacctattataaaagtttaagatgtttttgtccagaaaatttcgtacgtcactcgcctgatttttctccctcgcgcgttccgtccaatttttttttcacacgtggtttttttctccggtttttttccgcccgatcttttttggtcgtgacttttagatccgttttttccatcgcctgttgcacacgttttttttcttttttttttcaatccgaatatcttagatccgtttttttcctttttttccatcgttgctttttttttgtcaatttggatatcttttctgccacggtttttctattgcgcatgtgtaaggcttccgagcttttatccacctggtttatttttt

SEQ ID NO: 63444 - DNA, 4784 bp, Oryza sativa
ttcctgcagcccctcctccaagctagatagcagccatgctatccgccaccacagccaaagtcaaagcagccacaacctcttcatttgcagccaaggtcaccatgttctgtctgatagctaggatctccattgagattttttctggagccctgttcatcaccgttttcgagttgaaagccacgcacattgctgtcaagacctccttagtttgctgctctattgcggtatcatcaacaacagtgagcaacccagtgttccctgaaacacaacattaattaagctataagtctgtagctgaacctcctcttaatgacatagaggatgaccccactccatttttcagtcggtttgggtcccgatctcccataatgacatcatcatcattcctcttttgttcactgtaatcacactgattatcttcgagagaaggccaatggaggcaattgtttagtggcttggaaaagagtgtgccgtcctctcatgtatcttgggatcttgaatttggagtatatgaattggtgtcacatcctgatttttgtttcaggatttataaattatttaataaattattattagaatttatattaaatgttcattaatttacaagtgaagttaaatgtgggaaataaaattttctaaatataaagcatggatgtatttaatttttattaaattgtccatggttaattatactctctggaattttctcagatttttcggagctcaattcctaattttaatcatacaaagagcatttcagtaattacccacatattaaattaatcattaaatggtctaattataatttttttaagtactttgagtgtccaattattttcaggatttttcttgaaattatttgagcattggaagtatttttaacaattcaaagatcatttaagtgattattttaattggaaaagtaataataatcctcttcctagtcttgggccctttccggcccatctccctcttttgtgtgcacggccgtgcagccctagtcggcccagccgagtttcccccttctctttctttctttgctttgttttcagccagcccaagacgaaaagtctaatttgcctccctcgacactgtttatcttctacctctagcagccgaactgagaccgatttggctcggtttttctcctccaaatctgacctttccccttgtgtttttctaaaattagttgaggcgaaatattcctcttatcctcctctatctttacccccaaaaaatcggagctaatcgttgagtatctcatccgaatcgaactcgttttcgagtttatctccaaaaccgagtttttgatttccccgatcgatttcttgcgggaggagtccgatctcttcaatccaaggctataaaaaggaccccctagtcctcctctttcgtttgccccctctcccgtgatcttccgtgcctcgtagcgccgccgccacgtgctccaccccgccgtcgtcgccggccgagctccatccgcgtcgcgccgtcgcctccgtcgtcgccgccggtcgccgtcaccgccgtaaggtgcgcgggagggtggagaagcccgccgcctgacccccgaagccgctgatcaccggagccccgtcgccgccgtcgaccgaagccgcgccgccgctagaccccgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcagaaattcataactaaatcatcttagctcggatttagttggttcaagtctctaaatttttctaaaattgagatgtacatgttaaaaatatccacatgtactgttcatgcttgtttatgtgctgttttggtgtttttgctcttttctgtttagattccgacgtttccggagagtccgttttcgcaggagaagaatttgaagagttccaaggccagcaaggcaagtcacacagatcccaaacaaccctttgagcatgttgaacctgtttaaagctattgatttatttcaacttatgcattgttttcgaatgtcattgggtggtgagcctttcccctttaattatggccgaagatgactttattttcctatgggttataatttgactagcatggaccttatatattggattggttcagctagatgttatttatagttgcttagccatgcttagaaacaatagctcactaatgggataaatcatgcttcactatcacttatggatatttaatggaagttcacgacggttgatcgtgattggttaattaattacttgtcaactaaaacctgataatggtgggttgtgagcacatggttttgatggtcgtgctcatgacaattaaggaccggttcatgagtttcggatgtgaaacatttaccgtgccaaccacaagccagcgtgggcaacggctttaccttttgtatagcatggttcattgcggggcacccgactgagaagtggcggagataagcccacgggggtcgctggggagtctatgcctctggtttttgagggggtgattatgatccaggaatggtgcgctgcagtggattgtgttatgcaaggggtaatgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcggattgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattaggctatcctttggtatccttgtgcacttgcatatttgttgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtgtaacgttattattatgatggatttgtatattaaattgtcagtttgtgtaccttggctgattcctggacgaggattttatgcacaaataagttcggaaattactagtgaatttccgggcgtgacaattggacacttcgaatcaggtggctttggttccaaaagacagatagcactcgtgcttggcagggaatgcctgtgcaagttcctcgcatggcacctaaactttttaaaatggcaatgttttcccatgggggtatggactctccactctctttgggacaaacagatgtcttgagggaaagtctatcacggaaatagctccaaaccttttttagttgattgctaaaaggtggtaaagaacttggtcaaccaaaaatgggtctcggacatcaaagagcctttgacagttatggttattacggaatatctccatgtttggatagcattgcaaggggtaatcttgtatgaggagctagatcatcgccaatagaagcatattggatctggtgtttacacttctaaatcagcttatgcatctctttttgttgggaccatccggtttgccccatggagaaggaattggaataattgggggctatacaagctttttatgtgacttgcggtttacaatagatgttggacagccgaccgccttgccaagtgaggcttgcctcatccagcggcttgccccctttgtgaccaagatgatgaatccatacaacatatttcggtcaatttgtgttcagtagtcaagtttggacttcgattttggaaaggcttggtttatattccacacttcccgatcataactctagagttttctctagttggtggtcaagagcagcgaaaggccggttgagaaaaaatgggctcaacttgatgattattttggtcgcttgggagatttggaaacatagaaatgattgtgttttcaatggagttgtccctaatgtggaagttgtcctccaagctgtcgctagcgagggcgccctttagtgttcggcaggggcatcaagactagtgagttttccgctatggcaataatgctagctccgtagagaggttgacgtgagcatgtgtttgtgtttttttagttttggtgttgtctattgtaagatcttgtgggggttaaacccgccacttttcttaatttgtctcttaatgaaatgatatacagatctcttgtgtattcggggaaaaaaaacactgatcatcttcatctatcttttcatttccgattcctcctcgggcatttccaattcaaagaaaacctcatagctatggatgactacctcagttctaaagtgtaatgacttttaactatgtaaaaaaataaagatatgttcggatacagaattagaaattgttttattttgagatgggatagtatttagtttattggttataatctagtttcatttctttatcgacttctctttttttaatgtcctctaaatattcaatgctactgctggtgcg

SEQ ID NO: 63445 - DNA, 680 bp, Oryza sativa
cctgccgccgccgccgccgccgtcgtcgtcctcgcctccggtcaccaccgcctgagctcgaaccagcagcctgagctcctcctgcagcctgtcgagctcgtcggcgcccgccgccgccgtcgtccacggcgtgccagaaccatgacggcccttcggtccccctaacgtgcctatggcagcatcgccgccgcccagccgtcgtcgagctcgtcgccgttccggtggagatcaccggaggtatgagcgcctgcaagagatcaaagattcagcaacaattacgtgactgaaactctgaaacgctgggaattctgaaaggagaaaaaaaaaaccatcgtcacttacgtcgagatgacactgcagtgtgatcttgtttcctcgtcccgtggagccttgtctgcacccagttcagagcctgaaaccgaagtagaaccagcagcagcaacgattgctgaattagcatttgtcattcgatgtaaaaaagttcagaagaaccagagaatcgagtgtgtaccctcatgagcagttctcgtgacctcttgtgtgcgagttcagaagaaaaatgtggatgaatggactcaatgggaagaagaagatggatgatgatccaagactccaagttcactatatataggggtaaactctgatcttgttgcaactttacagaagcatgcgtatgcagg

SEQ ID NO: 63446 - DNA, 2468 bp, Oryza sativa
tggccgagtagacgaccgcctccacaaccgccttcggcaaccgacctccgcggcctataaatagacgatgaggtcgccccttttcccctccacaccatccgagctcttcgagctctgtctttctctctctcttcctcaagaccggctgccgccaccgtcggccgatctctctcaccggagcaccactaaccaaatcctctcaccaccaacattgccttactccggcgaatccatttttccacttttccccttctctttcgtcccatttcaagccccaccggagctctctctctcctgccggttcacggtcttgagctcgtcgttccggccattcccttaaccccctctgccggccactaccttacctaggtgtgctgtacccgggaacaccaccggccgtcggcgtcgccgccttccgattactggagccccgacgcccctctcctcctcctctctgttcgaccggagagaagaagaaggaagagacgggaagaagaagaagaagaagagaaagaaaaagaaaaagaaaagcctgacaggtgggtcccctgtacagtgacttttctcattttctctatttaattcaaatcccaaactttagaagcccatgtctcctaaaccgtagatccgattccagtcaaacttggacctaaagtcatctaaattcaaaatctatattttgataccaaatttgctattttaagattttatttagatttccttaagttatttaaatgtcatttgcttttcaaatatctccttttattttaaaataccctttagccactaaaaagccgccggttggaactttacaccttccatggggacgttcgcgtggtctacggaccccaacgtcgaaccgttggttgtaaagctcggcataaaccaaacccaagattgaagtgctgctcctggcaccctacgcctcactgcgtacaatggtcggagcttgactatttcctcgacctccacagcacgctacacagttcgctctcaagctctgtgtgattctagccgctccaccgccactcacggttgtcggagtaacacttccaccccactaaacctgcacccacctcctatctttctacccgatatgatgtctatcgacaccagctagaaatgataccaaatctagtcgctatactatccaactctagcgatgactagcaaacacccaaacccctaaccgatatttatcctacctcaatattcgcctaaacaactaaactctagctaacaccttgttggttaaaacccaaccgtcatccaaataccccacctaccaatatcgcctatccattatactcagccacctactctcctagaacctatacagagcctaaccgatatgcttccctactccgtagtcggcttaaatataaccaaaccctaggtattatactacccgaacctaccaccaaccaatactagccatattccaactgaaccagttcaattatccaatatacatcctatccttttagcaaccaagcattcacatgaaatataagcaaccttagttgcctgatcccctctccaccttagccttcaaccctttagaaccctatacccctttaacggagatatttataccccaagcctagccattcttgctctttatcactttcttactatttcatgatttttattgaatttggttcttcgtctttcttagtagagtctattttattttggatggcaacctgtggtatttcgaggatcggataatcaggttgcctatctcggatttgtttgcgttggagcaagggaagttattattccctccctttgagcataatgatcctatattcttatatctctattctatgtattagtcatacatgatttcaaatgcataacttgaacatatagcaaactagatatatgctagcttttgcttagctctgcctagttagactgcataaaatataatgaacttagattgggacagtacggtagaaatagttgatttccgggtggctagtactgttccaaccgacataagactgccaagtacatgtgaagaacatatgagtacgaccgcaattctcgtatgggcatggacctagctgattaagttatctagcaaaggtggtacctctgtatagtggttcttcttaagtcctcgcacaggaggcaaatttatgccgcgaagggcaatattgtgatatttaccgaggcgcaggtaaatatttatttgagataaatcatgatcatgaattgtttgtgaaccctaattgcgaagacatggtgtcatacaatcagttctctctaaagatctcgggaatgccagaactcctctcgctgctgataacgctacgttcagagcgcatggggactagagttcatggaacaggtaccactgatgttagtaactgaaaagctttgccatgataaggctaatgtgtttggcacgtcatggattgcaggtaaagcgtacatctactgcagtatgaatattatta

SEQ ID NO: 63447 - DNA, 1269 bp, Oryza sativa
ctttacccgcagtccacgactgccaaatattcattagcttagtcatggcccagtattaggttattaacaattgtggtacctgttccatgaacttatatcctcatgcgctctgaacgtgacgttaactgcagcgagaggagttctggcgttaccggggtctttagagaggactgattgtatgacaccatgtcatcgcaatcagggttcacaaacgtgatcaaatatatctcaaatacatatttacctgtgcctcggtaaatatcacaattgccctactcggcgtaaatttgcctcctacacgaggactttaaaatagaaccactgtacagaggtaccacattgctaattaacataatagctaggtttgtccctattctagaagctgcggtcgtactcgttcgtttgacataagtatttggtataaacttatatcgactgagacagtactagccacccggaaatcaaccatttctaccgtactgtcccaatctaagttcattaaattttatgcataatctaactaggcagggctaagcaaaagctagcatatctggtttgctatatgttcaggttatgcattgaaaatcatgaatggctaatgcatgagatatcagagatatagaatacagggcatttatgctcaaaggagatgaataataacttgccttgctccaacgcaaataaatccgagataggcaacctgattatccgattctcgaaataccaaaggttgccatccaaaataaaatagactctactaagaaagacgaagaaccaatttcaataaaatccatagaatagcaagaaagagataaacagttaggagggctagggtttagggtatagtctatctcttttatagggtatatggattactgtgctaatatcttatgcggaggttctagagagttggaggctagaggggattaagcaactactatcgcttatatttcatatgtgggtttgattagtaggaggatgggaagtaactagtttggataatggtattggttaaaagggtatgtggttggtattcattggcggtagctaggtttaggtcgtatggaaactaaggtctagttgtcctcgagtcgatactgaaataggatagcatatcagctcggctctataattttatgtgtaggttctggtaggtggagagtaggtggtggagagtatggtggataggcgatactggtgggtgtggaatttggatgacaactggaatttgactgggaaggtattagttagggtttggttatatgctag

SEQ ID NO: 63448 - DNA, 7613 bp, Oryza sativa
attagatagatggtttaagtctatagcaaaacagcaaagttagtctattccaaagcttttgcgcactagttagccacaatcttgtaaataccctattactttatgtaataatatctccttcaaagctatgtctaaatgtatgtaaagacgatccagattattgaaattgtatcaatctactgatctagggcttgatacaattttaatatgtcggttaccgaatcattagttttgggacccgacagtttcctatatgtaggtaattttcagggcaacatattggcttcgacagtgggttcaactacaaaagtatgaggaagatggagttttcctgaatgttgcatgtcgtaatcttgaaacaatggttatgcaacttttcgccaactatggatggagattcaccaatagactggaatattgttttccttgtcatgttaggtcttctttaaattttggttggttggcttgctttattttggactacgtctttttaagtttgctactttttgtaataattagctgtagctcttcggaataaaggccgggatgttacattccattattaaaaaaaattatgggattaggaacatattgggcatgtgttgatgatgatccaaggacgtgtgttgttccatgcctaaaccaaccacaccaacataaaatgctcaatgcaaaaatactcaagttttatttggtttgttgtcaaagatttgacaatggagtcattgtagtaaggctaaaggcccctttattggtaggaaaaacataaaaaacttaaagttctataggaaatactcataggaagacctttaaataaacgattgagtaatatactttcctttgaaattcttatgaaataggtaattttatagagattttaaagaaaagtaaagaatgaactttaacctcttaaaaattacctttaaggttatctcactcatccgatcgagcagtttttcttactgtctatttataaacgagcatcctgtctaatccgaaatttgacaaaatgaactttgcctaacagaaatcctctgtgtttagttcacgataaaattaaaagtttgattgaaattggaacgatgtaacggaaaagttggaagtttgtgtgtgtaggaaagttttgatgtgatgaaaaagttagatgtttgaagaaaaagtttggaactaaacaagggatgaagctattgcttgaggtgttgtttggatctgacgaaaaagattaagtgatagacacgtaaaacgtgaaagccattaatgcatcattaattaaattttaattattacaaacttgagaaaatggatttatttaatattagaaagcaacttgtatataacgaaatacagtttttagctgtttgaaaaatgtgctaatgaaaaacaaggtaaaatttatatttaattaatcaagtagatcaaggccgtagtactatcttttacggtggtactacctttacaggctttctttggttgaagctgccaactcaatttccttgttttttacgtgcacactttttaaacaattaaatcattaaatgatacgttgtttacgaaaaaaaatatacacaaaagttgtttaaaaatcgtaataatctatttttagaaagaatagccagtacttaattaattatgtactaataagttgctttgttttacgtgcacgatggatgaattcccaacccaaataacaaactcaggcagtagtacagacagtgtttagttccttcaaacctctaaaaattccgtcacatcaaatgtttggacacatgcgtggagtattaaatatggatgaaaaaaaactaattacacagtttgcatgtaaattgcgagacgaatcgtttaagcctaattaagctatgatttgacaatgtgatgctacagtaaacatttgctaatgacggattaattaggcttaataaattcgtctcgcaatttataggcggaatctgtaatctgttttgttattagtctatatttaatactttaaatgtgtgtagttgaagattgaactaaccaacataaaagaaaaaaaatatcggagagagtaactttggcttgcagagcacaattaactctggcttgcagtgtactacacaattccaagaagccccaatccaaaataaaaaaaactagagaggggccaatccacaaaagacacaagactattgttgaccagttgaccgaccccccttcctcggcgacatcgtctatattacgatttgcccccaaaaacccccaactctcccgcttcatcgtttccaccggagaaaaaccctcgaacgccgcgccgcccatggcctccgccaccgccgccggcgacgcctccgccgcggcgttctggacggcgtgcccgcactgctgctacgtccactcctacccgcgccactacgccgggcgccgcctccgctgcccgaccgccgcctgccgccgcgccttctccgccgccgagctccccgccgcgccgcccatcgtcccgggcaccgacatgtacttctgcacctgggccttcttcccgctcggcccccccgccgccgccgccgacgggtgggcccccttcacccccttcaactccgccccgaccccctcccctccccccgccaccgccgccgcccccgcccccgcccccgctcgcgccggtggccccacgtcgaggaagaagatgtgcgtgtccctcaaggggagggcccgcgtggaggcggagcaggaggaggaggaggaggaggccgcggccgccgccaccatcatcgatctcgagccggaggtgcaggagggcgggattggcgagaagggcttcaccggcatcaacctcaacgagtcggtggagctgagcgagctggggttccgcgacgacgagatcgagctcttcaccgccatgtcctgaattcgtgatcgctggggaaggtggtgaaaaaggttgtgcgccttctgatcataatatcatatactcaatgcttagtactactaactgctcaacatggtggatggtttgaaaaaattgggatagtaaccagtaatataatcttcgtatctgtgtagttatcaaggttttagtttcttatgatggaatgtaggcctttagggcttagcaatgcatagtttttggttatcttaatggcacaaggctatggtatgaaggtgatcgcgcatagtggtggaaatggcaaatgtggatccttttggttggacttggaagtgtaaagtgggttttatgtcttttggtgctggaaaatgtccactttatggccccaatatatataaattttagtttttagtttcagcttgttctgtttgtgcacggttttgtcggatggtgatatcaacttgagattatcctctggtttattgttgttgatttaatcactagaatggaacacaaagtttcatgcttgcttgcactcatttgcctttggtgtgtgagtttctgatgccctgaggatttctgatgatcagttcgttcagttcttgtgtcggagccctgcagctgaatgcgaccaaattctttcagtgactgttgtgtcttaaattggatatccaaggtgctatgttatccaactggggataggataacacagcgccacaattttcagtctgtgatctttgacatcttcatcagtagaactgtcaaattttgcaggccaatgttgtgagtttgatatggccaccattcactcaccatttatccttgttttcactatttgtatttcgttgtttcaaaaaaaatatttgtatttcagctagtgagaaatgaatggtataaaagtatagtatggccaaatcagatataatctttccagcataattcacaaaaagtggggggatacaatacacagttctgcttcagattagtatagttggtgcttttttttttccaccacttgtgactatttggctagaagttgtggctttaaacaatgtgcttcaaacattgtgtataggtgctagtggggaaaaaaatggagctatgttacttcaattcctgcctgtgaaaaaatatttgtttcctcaaaatctgatggtttaagctgagccatcatttcactgtctgactcctgagttacagagtggagctagaacttctggtacgcaaaaaccacatggaattcactaacatgtagtaccaatgtacattatgtagtaccatacaactcgcatcgctttcattatggacatatcttctgtgttttcgctgtatccattctgtcaggacaagaatccggccaaattaaaagccatgcaaactgacaagagtatgatctgtcgtaaatgttcaagattttgttttattttctctgctgtgattagagtcattctccattcttgtaatggggtgtacatgaactgcagcctgcaggtatttattttgttcagtgtgacgtataaataatgttggcaattaccgggtcactgtttatgatttttcagtgctgctagatcaagtttgctcttccgggctagtaatatttgacgatttcttcagttgtttgtgtaattctcgtaaaaacctgtacaatttacaggaagcaaacaccgcttcagatcgcatggactgggctttggcccatgcctaatgaataattatacctacagtgggccagatttggcccattgcaaattgttactggcgaaagcataattagacttcggacgtcggcgatggataagttgccgcaaaatttgtaactttgttttttggatttttctacacgtcttaaattttcttcagtaacttggttaaacacaaatacaatataattacattgtaacttacattttactatagtataatttttatatataactttaacatagttttggacagttagatttgctcagattcatgcaaatatggaaagaaaatattaatgtgttcaattgctcatggatgaggactttttgggggaaaaattcggatatataagattccctccgtcccaaaatatagtaatttttaggtggataggacatattctaatactacgaatctagataggggtatatccagattcatagtactagaatatatcacatccaaccaaaagttattatattttaggacggaggcagtagtccctttatttactagtaactccaagagggctcaacaagaaaattataccttcgtctaagttgtgagataatcgggtactactctactataacaaactctgtattttctggaccatagggtactgataatgaccatagggcactctattaaccttaggaggctgtgataattatgtcggccatgcaggagatgagaaccaaaacctaattttttttcataccaacaacatttatttttatacaccctcaacgaaagaaaatcccaatcatcagatttgctgtgattattctcaacatacacgaatattaattttactatcttacagtgaaacgagcgtaacttaactggttagatttcttatggtggaaccagtttatccgagtttaagtcctagacttgatacggagctcagatttatagctaattgtaggtgatatacccgtcaataacgagatgcccatggtgaacttagtcaatcttaaagtatgccggtctagtattataaaggtgctcatacttatgcccgtgatctcaaaatatgaaaaaaaaaaatcagctcagacatccaaaagtactcgtaggggcaagatatgcgtttgtgccttcatgggtgagtccacgcgtattacatgatttttattccctatgtcctaaaatataagggattttggagagatatgacacctaaatatgaataatctgtctagaacaagattatgggcatgtttagtggagcttaagattctgagaagcaactgctaagaagctagctggtgagaatctggagaagctggaaaacccagcttctgtcttctagttcattttccagattctacatctatagattcttagaatcttggtaaaaagatgggttgttagggagagcttttggtagctagagattataggagaagatgcaactgctaaaaactcctttaaataggtccttttagtaatgtgtcacgacctctaaaatcgcttacattttgagacggataggacaagaaaaagcctggaaaatcagaaaaaaaaaaggaagagcgaaaatgacaagattacccctccgccccttccaccttctcgcagccacacctcctcctctttcccctctcctccctctccactccacacgccgtactcgcctccgtcttcccccccgatctgcgggcgcgcgagctcggagcgtccttccccgcgcgcgccgccgccaccgccgagagagtggcctcctcctcctcctcccttccttcccgcgtggcctgggcctgcggttaccccgcgcgcacggccgacgacgactgcgacggcgacgaaggcgagctggtttcggaggggggcgcgacgcggccgacctgctcccccatctggttcgaatcgaaaggtatatcctcgttcttctgtccttggcccttgttccactccaaccttctcgacgccgctggatggatgggcggcttagattcggaatccgtccgatttgggattgggtttcttcccgtcgaattaacgcatccggttctttgtgcatttcgttttattttatgcgtggtagagagtactagtagcatcttgtagcgtgtgtttccgtgaaaacaaaattgatttggttgggggattatgtgatggtgaagccatgaagctcgccgaccactgtcacagtgtgactgcagagagatgggtgagagagggggaggaaagggattgatgagctttccctctgtaggctacttgcgctatcgcaggagatggcttcaaatggatccttgttccattgcaattgttgggttactggagatgactctggagaataagatctgaatgagtaaaatgtggttcgtatcgtgccccttgggtaacccggccatcgattggattgatgttaggttttgcaaaagttgaacttcattttgtagtttaattttgattccctttgtttggcgtgaatgcagtcgtatctctggagaatttttgctgaaacgttaaatgtgttagagcaatcgaatgcttgtcgtggtttactttgtgcgaggatcttttttttgcctcatgctagcatgtgaactgcttatgaaatatgaaccattgctatgttggtgaagaaatctggttataacttttgttgaatgcaatttgtaggtctagtggtaaatgtatgacctgacttgaatagtatcttttcaggtggatgccaatcggttggtcggttaaaaacaactaatttagctgatcctgtggggaagaagtaatggtactgccaggctctaaggagtctcaaaattatgatagcaacaaccagaaggttcatcctcaaccaattgacgaaaacatgaatcagaacatgggctcaatggacaccatgattggaaggatattcaacaatatatcctctttaaagtctgcatacattcagctgcaggaagctcacaccccatatgacccagacaagatccaggctgcagatcagcttgtcatagaggagctcacgaagctctcagagctcaagcatgcttacagagaaaagaatcctaagcctgtagcggcaaca

SEQ ID NO: 63449 - DNA, 1047 bp, Oryza sativa
gccagaaacactccagtgagggagatcgacgatggccggtggtggtttgacatgagaagagagagagagagagactgagctcacggctcggttgtggaagaagagagggggcttcaccggctatttataggtgtcgagaggcggtagagtaggtcggttcggatggagaacaacgaaggatgcacggcaatggcgacgtggggaagagacgacggcgccggcttcgttctccaattggctgttagtggcggcgcgtacacgcggcgaccgcgggaggagttgggcagctgggaagggaggacacggcacggcgtcggcgcgacttggcggcgaaggaagggcagcggcgacggttgcttggcggaggaggagggcaaggcaccgcagcggcggcgcaagttggcggctcggctgggtgttgggccggcttggactgaggaaaggaaaagaaggaaagggagaattcggcccaaacgtagaaggaagaaagtctaatttttcctggggctgaataatttgatttagaggagaatttttatttggaaggaatttgaatagaagattttgaaaggaaaatatatttggagataatttgaatagggaaggttgaaaggaaattatatttggatctaatttccaaaagagatatttctaatttgagtgcaatatttttggaagtggaatatggtggaatttaatgcactcaaatgagaggggaattaacaatataattcctcaatatatatatatgtttggaggagaatggttggaggtaaaataaataggatttgaatcctaaatttgatagtagaagtatttgaagaattatttgtggctaatagggaaagttgagtgaagaatataaattggtattttcttagcacaagagcaattattcacaatatttgcaataatactattcttgtgccgaagaggaaatcaagccacaggaattaaatcagtggctagatcaaaaggaagaatttggatcaagaatcaaaggatgggtttaagatcaaaggatgggttaataattaattccaataa

SEQ ID NO: 63450 - DNA, 661 bp, Oryza sativa
cagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttattgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgttagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaacttttgagtgtggaaatggtatttggaaaaagccatg

SEQ ID NO: 63451 - DNA, 670 bp, Oryza sativa
atgttccagtctaagcatccgagagctcctggttcagctcttgatgatttcccactttgttgctgttagatatgtcatattatgtccagttattcagtgcttgcttatatgcatctatctttcttccatatttctatagtagctcgtgcctctgttctttatgctttccctctccattatatattcatccatatgtttttccgaatgtgtctatattttgctcctttcgtttcttggtgtatagaaatgacatggagccatccagattcgttcgcatctgcccgcggaagcgtccacatggtacttggtgatatcattatagtttcgtatgcaagcctcggagttagcaaggccattagcgatcctttttttccctgattcacacttttgctcaccaatagatgggtcctccatatcatctgctgccaataagcacttagagctcacgggtggtgtgtcatgtgccataggtatgtacgctcaatagtctgagagttagcgaggtcattaggataattgttgtttttttgtttcctgattcgcaattctgccttctgatagatgagccgtcatcatcccacggtgccactgggttctcaatgctcacgggtagttcatcatgcactataggtatgtacgcttgctgtagtcgctgctgtctcaatgttta

SEQ ID NO: 63452 - DNA, 39209 bp, Oryza sativa
ccctctctcccctcggcccgcggccgaagtctcccattcctccctctctttctctccctctccttctctccctcctcttgggcccccttcccctcggcccagcaccctcctccctctctctcccgggctgtctctccccccccctcccggcctgcccggcccaagccgcacccccccctccaggccgagccgccctcccgcccgtgcacagcagccaaagaaatcaagtacaagatgaagaacccgagcgtaagaaagttattgtctgttacaaactgtagtacctgttaaggaagcagacatgccaatcgccaagtggtcactggagcaaatacagtacctgataagcctagcgctagtcagaagcaaccataatactcttatatcagtgttcaaatacttttgttttatagttgttccccgtcaatcatgtaataacagagaaacatgagataatgaatgagtttgataagcttatgaaggatccatgttaagagtgcaagtgctgtgagttgtgcacattttgttgttgattagggagacctagggtctcatttccgtaaacccataatctgttaggaatcaaatagcctagcgattgatggcgaagaaaatcaagtgatcaaccaaagaggcatttgtttggactaagagtttcagatgtgtctcttcggatcaaaggcaacaatcgtcagtctagcttttgacgaactacttcaaggtttctctgaaagacagcacgcccaagcacctcattgccccagaagcatcctcaacacccggagtgaagagtacctggttgagaaaggtcgaaaggtgattaatggaagagatcggaaaagatgtttggttactgggaaaagaagtaggtcgaaaggtgattgataaaggataacgagaaccatgatttgtgtcactcaaggaagactcccgatagcaaacaaccctacaacagttgccctgtcattaaaataggtgaattcacgagtaagagagatgaccacaggtagaagtacttctatggggacaaggatggaaacttttgtgacatgaccaagaagtcaataagtaaaacctgaacagtggaatctaaagctcggttcaaccttgggctttgtatcagatgctactagaatgaaagcacttgcactagtatcgctcaacgcactttcctaccaatcgatccatcgagaaagaacacatcaaggcggaaggtgcaaaggaatatgttgaatgctaaatgatgacaacatgaagagaatagtgggaagtgaaccaaatgtaaagaaagtgaatccgagttgcttgttcgtgagagctattcccagttatgaaccaagtgatatgttcgaagataatctacagaggtcagattaaaatcgcatctaacaacgaagcctcagatttggcaggataatgattagacaacaacaaatccagcagtaaagccatttgggaagacgtcaaagtatgtcaagtgggataagttggttctcttgggaaacataattcaaaggcaaagttatcgacccttgcatcaaatagcagaagtagttatcacccggagactaggaaagctaatatgaggcagttggtggcaggttagaagtaaatgacaagcatgatatgctcatgatgacaagcatggtatcctagtaatgacgagctgatctcgacgcataacgtgaaatgggtaacttctatgaggttgacgccaaaaatatgaactatgcgaagttctggaactgaagcaccatcttcaagtgccgcaacccagtcgaagtcagctaaaggttcaaccagggacaagtcaggtgaagagaagattccatctgcaacaggagattgagccaagcagtccagagtagagaagttttgctaggcaagttgttataaaagacgcgacggaagaagtcagacaagaagagaagaccgcccaacctatcttcttgctagcctcctcgaatctcggggacgagattcttgtaaggggggtggatttgtcacgtcctgataaattcatcccgaaattaaaattcattttctaaaaggaataatagaattaattaaaattcggaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaaaggttttataaaaagaaaaaccctaaaagaagtcttctttcccccccttcccttcttgggccggctcggcccaattctctccctccctctctctcctctcccccgcggcccatcggctcctccccgcgcgcgcgccgctgacaggcgggcccgcccgccaccctcgctgacgggtggggcccacctgtcatcgccttcctcccgccgctcccgccgctcgcccgtgccctagcgccgccgccgccgcggattccgccgcatcccgccgtccccgcgcaccataatgaggggggaatcattccccgcgattccctctcccgattcccccactttcccctctctctctccctcggattcgtccgattttgtgcccgcgatcctcgccggcgcaatcaatggcggccgagatctccgcgccggtttccatctcctccggccgctttccctctctcccgacgctatttaattgttccccgtgcctctctcctccgtttccgccgttcgccgctcgctctcaccgtcggaatcgcgctcgcgccgctttcctctctctccgccgtcgccgacgagttccggttcgccgccgccgtcgctccggacttcctcccctctcggcgtcgcctccttcggcttcgccgcgtcgtcgtcgaccccgtccgctcctccgtttcgctcgccgaccgtcggagcgccgtcgtcctcgtcgtcccgaaccgcgccgccgccttcctccgtttcggccgccgttcccgtcgtcgccgtcgaccggggtgagccgaaggccgctccattcgcttcccccttccctcctctctctcgggtgccgctccgccgcgccggtggtcgccggcggtgaccatcggggcgcgggcgcgtccccctcctgtcggccgtgccggcgaggctgcttttcgggcgcgccctcgcggctgccaagtgggcccggccgtcagccgcccgcgcccgcgggtgcggctgacgcgtgggtacccacggcgccggccgccgccagccgcgtgctcccggtccaccgtggaccgagaggctgacgcgtgggccccactcccgtggacccggtccgcgcgccctctccctcggctgacgcaataaacccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttagtagagtaaaagccttttctttttcgttagtcgtgtagacgctgcagcttcggaagatccgctcttcgtggaagttgaagccggtgtttgggaaagcgagcaaggcaagtcacatcatccttgagcatattgaaccccagtttataaaattattttgatttaaattattgcattaccgctttatttaaattcccgcgttatcactgttttatttagccatgcctatttatcgttgttaagacattattattgctattgttattattaccttgttcaccctaggaaaataaaaccccaactagtgggtactctatttatggttccactagtatgaacttaggtagatgcttcgctggttaattaggcaacattaggtgattttataactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttttaaacaaaagtacacggattggagatggatgaagtcgggggtcgatggacattctccagggcaaatgaaggctacacgagctgcggcccggtagtcgagatgtcgtggcagagggttggtgcgctgctgcttggggctcagtcctgcctgcctgtcccgggggttccggccgtaggcaggattgggtcggtactcttgtctatggctaggatgggttggaaactatgtcacgtcttccgtccgtataccgtggtggtatgtggcacgtggttacacgtgaggaacacctctgatcagagtataatctattcgaatagccgcgccctcggttatgggcaagccgagcaatgtacccaagtcagtgttctaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataaaactgtgtagctctaggatcgtctttataaaatggctttgggcaactaagtgacttttaaatgctgtttactgcaaaacttaacccctatcttattatccccttgtactcccttgcattaattatgcatctccggtgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagaagtgtctcttatatcatgtttgtgtggtgtaccccggcttttcctgggacggggattaatacactagcgttcgggaaaaggcaattttcccggtcgcgacaccgcccttcctccccgtcagaatcgagcccgcgccgtcgcactctctctccgccgtcgccgccgagctccggtccgccgccgtcgtcgccccggaccatctcccgccccggcgccgcctccttcggcttcgccgcatcctcgccgacctcgtccacccctccgcttcgctcgccgaccgccggaacgccgtcgaccccgtcgacccgagccgcgccgccgccttcctccgctccggccgccgttttcgtcgtcgccgtcgactcggggtgagccgtggaccgccgtttcgtttccccctttccctcccctctctcggccgctgctccgccgtgccggtggtcgccggcggcgaccatcggggcgagggcgctgcctcccgccggccgcgccgccgtggctgccttcgggcgcaccgagcggctgccgcgtggggcccggccgtcagccgcccgcgccctcgggtgcggctgacgcgtggggcccgcggcgccggtcggagtaagccgcgtgcacccggtccaccgtggaccgtgaggctgccgcgtgggccccactcccgtggacccggtccgcgtgcccctcccctcggctgacgcaataaatccaattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcatcgctttatttaaattcccgcgttatcactgttttatttagccatgcctatttacctttgttatgaccttattattattgttattgttattattaccttgttcaccctaggataaacaaaacccccaactagtggacactctactcgtggtatcactagtatgattttaggtagatgcttcgctgattaattaggtaacattaggtggttttaaaactctagattgtggtaatattcatatcacttggacacattggatttgttggattgttgtggaattggattcataccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggttcgatggacatctccagggcaaatgaaggctacacgagctgcggcccggtagtcgagatgtcatgacacagggccggtgtcctgctgctagggggctcagtcctgcctgcctgtcccgggggttccggccgtaggtgggattgggtcggtactcttgtctatggctaggatgggttgggaactatgtcacgtcttccgcctgtataccgtggtggtatgtggcacgtgattacacgtgaggaagatgtgtcttatgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcctgggacgagctgggacccagggtcgggttgccagttcggtctgaatcatcgtaggccttgggttaaggcaggttcgtgtgggttcacggccttgattaataatattaaatagttctaggatcgtgttttaaatttagctttgagcaactaagggtcttttaaatgctgtttattgcaaaacctaacccctatattataactccattgtactcctttgcaattatgctgcacttgtgggtgtgtcttgttgagtacggtggttgtactcagtcttgttcaatttttcccaaacccagaagaggagcccctggaggatgaaggctttggtgtctagctcgtgcctgccgtcaagcgcctgtggtcgtcgccttagtcttccgctgtttttcgttgtctttgagtgtgctgggccatcgctgcccatgtaataaataactatttacgcttccgcttgttacactctgaattgtatcaacttttggtgtaccttgcctcctaggacaaggaataatacacgcacgtaaggaacgcccgttgggttatttccggtcgtgacaataatgatctaattataattgttaagtgcttttcttgtttaaaatccttaaattataaattgttgtttaaaaggaattattagaaatgattttaaaagcctaaaagagaagatctaattttaatttgttaaatctcaatataaaattgggctagataaaattttgttaaatactttgcttaattctataattactagatttttctgggatttatttgagctaaggaagtgtttttaataaatggaattgcatttcatgaataatttaaattgaaaaaggttttttttttttggctttgggccgaaagccggcccaaaaccctccctctctctatctctctccctcctcggcccagtccggcccagtccgccgagccgccactcttctctctcagccgctgacaggtggggcccgtctgtcaggcctgtcttcctcctcgcgccgccgccgccgcccgaaaccctagcgcaagcgccgccgtctccttccaaatccggccgttcctttccgtttctggtgaaattgattgaggggaaacgatctccgggatctcctccaccttttcccctttggaaacatcggctaaatcggtttggaatgtgtttgattcgagttcgaatcggatcggtctctttccttcaaaccccgatctttccttctcgtcgccggcagccgtgggccttcaccgttgcctcttagcccctttataaggatccccggtgtctcctctacccgccgccaccctcgcctttgcctctcgtcgtccgtagcgccctagctccgtgtgccctagcgccgccgtcgccgccgtcgctccagccgtgcgccgccgccgttccagacgtcgccgtcgctcgggaagatcgccatcgtggtcgccgtcgcgtcgccgtcctcgtccaccgcttcaccgccgccgaagaccgtcggagcaccgtcgccgccgtcgacccgatcttctccgccaccttttcctcgacgccgccgccgtccgttggtcttccgccgacgttttggtcatcggtgagttcgccgcgccgtgatctacgtcttggtgccctccgtttgtgccgtagagccgccgttcgccggcgagcatacgcgcccgagccgcccgagtcgccgccggtgctgacgtcatcgctgacgttgtcgctgacgtcatcgggaccgtccgccgtgagccggtcgtggaccgatcgatctcggccgtccgttttggatagggttgatctcggccgttcgttcccatgaaccgttgccgtgcacccggtccaccgcgaaaccctagctgctgacgcaataatcctccttttccttttcaaaaataattcattattgcgtcataattcaattaaaatccatataagtgttttaatccgatttaatctttaaaaattcataactaattcatttgaactcagtttaatgtggttcaagttgcaaaaattatataaaataaagatctacatattaaaattgtccataaatagaattaaatttatttaattctttttaaatgggctttaattagatttaatcttgtaaaattcataataaattcttatgaagtcagaatgaggccgttcaagtctcataattcatctaaaattatgatctacatgtttgtttactttatatgtactgtttatttggtttttattagtctttttcttcgttttgcgtgttagcttgtcgtttccgtcgttgcgaaggttcgtgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgacaagttgagctttatatattggttcagctagatattagatatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttacctttcgtatagcatggttcattgcggggcaccagactgagaagtggcggagataagcccacgggggtcgctggggagtccatgccttatttataagggggtgattatgatccaggaatggtgcactgcggtggattgtgttatgcaaggggtaatgtcacagcccctttccgaggtaccgtggtggtactgaggcacatggtgacatgatgtggggctgtgtcttgtgggtacagtggtacacctctggccagagtaaaactattcgaatagccgtgcccacggttatgggcgggttgagcaatgtttttcgtgattagtcccacacttctcacaataattatggatgttatatctggtaataatttgcttagctcctggattggagattagatctgtacagccgggtatggttgtttcagaatggttgggcctgagcagcatgggcgtgttgttcagtgttgattaaaatttctgattaattactccactgttttacttctcttaaatgttttgctaaatgctgcttttgcaaatgagcctatattatgccaacctttggtatctttgcgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagatttttttttttccgctgcagttttcttcatggtgaggactaagtgcctctttagtaagtatttatcgttttagatattttgatgaatctgtatattaaattgttagtttgtgtacctcggctgattcctggacgaggattttatgcacaaataagttcggaaattactagtgaattttcgggcgtgacaacttacgccatggagtaatcttaacaaaagataatctgattaaaaggaattggagaggaaacaagtctagttctttctgccacaaagatgaaactattaatcatttgttctttgattgttattttgcccgcgcggtttggtctttaattcagtttgcttcgaatattagttttatctaatagtacaactcatatgtttgggcattggataagaagacaatcacgcaatttgagatctttggtcttattaggtgcaactaccactatttggtctatttggcttttcagaaataatgtggtttttgaaaggaaaaaacatatcttctcctttgcaggttatctttttgattacacattggctccgctcataggctatccttcagaaggtcaatttgcagggtactatcattgcggtttgtcaacaattagagttagtggccatatagtagttttctaccccagcacatgggtgacgttctaggctacggttagcgggctcctaaagttctttttgtttctgctattttggatgatgagtttatcttttgtttctttcttgttggctgtgtgtactctttggtgcagaagccgaatgtgctctcagaataattgtatcacttgatgaaatttactgagattaataaagcttccattatgtaaaaaactggttctgaataggctaaaaaaaacaccattccacaatgctttgctgaaagggaacaagttaataaggtcaaagaattctcctactaatgaccatgaaactgtgttaccagaaccataaacaattacagttgctctcatctaaatctaatactgcttaatcaaaactgtaacataacatatgatgaaatagagacaaacgaggttagctccacaatcatttgggtgttgctccttaatcaaaactgtaattctcttgaaaaaaacaagctatgtgtggcaaatggtttggtcatcactcccaataaagcaacgtacagaacatccacgatctaattactgcaaagttactgcaaagtttccataatgccaaggttaggcttgttgcgcacagtaagaaaagatggcgattgtccaacatgttctagcaatttcttgttttttcccatcggatttgattttttatcattgttcaaatgactttagaatgtgtatctgcacttcattgttcaaaagagagtagtggtggctcgctagatgatcaacagtaacaacgaacaggtaaaaaagagtttaaatatgaacaactgcagatgaaagagtaaaaaacaaaggagttgggacatcacgtcttaccttgggtgatcagatgtagaatacttgtaaatcttggtttgattcttctaatctcttgagttgatccttcaggtcgacgctgcaacgcattgctagtagttttttcagtgaagctgggatgccctcctcgggcaacgatctgatttcaggacatccgacgatgcctaatgtgcagatagaagaaaggagatgcaacccttcgggaagggactgcagacggtggcactcatagaattctagatttcggagggaggtgaggagctgaagtgcctgctcctgctcttttgtgaaatttttcatccacaaatcataagtgaacctcaacctgtagagggtggaagcgaggaggctgcaaatgggggcaacaaacaccgctgagatgctgtccacctcaagcttcttaagctgttggaatgaaccaacaggtattgccttcgtcgttgacaccgctgcgaacaaatgtgctgctacggagcagcgatgattattatcgtctatatctggcttattataaatcaccaattcactgaggctgcctgtcatgacaggatcgaacccaaccactgttaagttatcacagtctactagtcgcagacgagtgagagatgtgaggcttgagagcacagccatcgactgcacgcttgactcgctgtaaatagtgagttccttaaggggagccaggaagggcttgctagtgtgatgagttcctgcctctaccatgaaccacgaagcgaaaatcttgccgcaacgccaaaattcgagttcttggagtgaggagaaatcctggaaactccctccaacctccataggtagaaccaggttctcgtagccaaagatcttgacatagcgcaacagtctgggggacgggaaacgcagttctgcttcctcaacctcttgagcttcaccggacctgttcaactcgaactttgtaagagctgggaaacagtttaatagctttgccaaggatattccggcaagatgacacttatagagattgagctgctcaactgaatggaagataacaccttcgtctacttcactgcacaacaagcttttgcatcctatgatggtaaggcttgatagggagttcagcttctggagatcggtccatgaaatgtgtgacatcttttcaattttcatgttttctactttctgtaggttatggaaggccaaactaccaccataaccatttacactcagtatcttttcttccaaatgcaacacttcttgataatctccttccacaataatatgcgttagagtggaagtatgaggcatggggggcagtgataacttggggcaatttcggatattaagagaacataggttgggaaaacaagtgatatttatatcttgtgcatgagagatacagcgctcagaggatggtggtagtagcatagagagattgggacactcttcacactcaatgcttgcaagctttgaaaacaaatggcaatgagctcccccaacccactccacaagttctggcatggcaacaaatctaactttcttcaggtgtaagaaactcctctgtgtaacaccaccaaaatctggtccgaactgacgaatgccagcaatattgatcaaagtaagttcctctagatatatgaattgcccgaaaggtggaagagtgccccaagagatgccctctagatggagagatctcaatcctttcacacaaatatcatcacataaccaactaggaccagtggaaccaccatgatttcttattccaaatgctctaagattagaaggtggctgaagaccttcaataatctcagatccactattctgctgctctgcaccccaaactagttctagtgtctttagattccttttcaacatcaattcagcaccatttgcttcttccgttgttgctatattttcaagattatttatttgtagtgctcctccaagctctttcaaataccccaattctctaagttcaaacccagtgcgctctttcttaacatggaattcttgcagcctccgtaaatacttcatctttccaatcccacgaatattggaacaaagttcttttttggcaaggaaataatgtaaattggctagacgattaatgtcgtcaggcaaaatataattaccatggcctaggtccaaaaacttcatgtgataaaatctacatattgtggctggcaaagacatttctaagttatgaggtacttcaagctttaggtatcgaaggtgaatcagttttgaaaagttgaaagggaaagatttgatagagtttacaaacataaatagaacacgaaggcattttgttttttttgaatatatttttgaaaaatatagccatattgtcattgtatcgtccaaaaaacatcaaagtccgtaaattttctatgtctatttttctcttcaaattttccatttctctctcaaaactttggccatatttatgatgtacagtgatagatatatgtcgaatagattgtgggatgttatcagatctaaaactttgtggacttatatttagagaacttttacggtacattctactgtaagtatatacttgcagtatatagaaaggtaagtttggtatttgtgaaaaatatagaaagggctgtttagtaatttgaatttgagatttatttgcacccggagttaatctcggacgggttgtttagttggtattagttctggatctcgtagtacgttctgctagagcagcagcgcttcttcggaatacattgtgcgtggcggcgaaccgattgtcgacggacgagcacgcgtggaggcagagcgattccttccaattgaaacagtatttagtacatcgtagttcagatgccgtaagccattaacgacacacatctacctccatcttgcacgctagcctgaactctgaagaatgaccaacactcgttcaactatctcagagacacacagcaactgcagagctgatgttgctgctccagtgctctgtgctgcttccccttcctctctccccatacgtgatagcatgcgagtgtggcggcgtttgatcatggtggctgtcagcggcgagccggggcgcgacgtggtggctgtcggcggcggcagtagcgcatgggacgagtccctttctcactatccagatctgactaaagaatagaatgcgaaaatacaaaaatatcccccgcaaaaaatatagaaagacaaatatacccttcacaatctattatattattaaagaaatagaaaaatgagcctctacgttcgctctcatggcctagaaattctcacattaattggagaaaaagaaaaagcagagtccatataaaaatacaatttagaaatagctgaaattcggaattaaaaaataaagaatattagaagaggagactagagttcatatagaaatataattagaaaatagctgaaattcggaattaaaaataaggaatattagaagatgagtatagagtccatataaaaatataattaggaaataataaaaattcgtaattaaaaataaggaatattagaagtagagtatagtgtccatatagaaatacaattaagaaaaaaaaagaaattcggaattaaaaaataaggaatattagaagtagagtataaagtccatatagaaatacaattagaaaataatagaaattcggaattaaaaataaggaatattagaagtagagtagagtccatatataaatacaattaagaaaaaaaatagaaattcggaattaaaaaaataaggaatattagaagtagagtataaagtccatactaaaattcggaataaacataataaaattaaaagtagtgcttagagtccgtataaaaatataatttacaaataactaaaattcgaaattaagaaaaacatgggaagaagagtttaaagtcaatataggaatacaatttagaagtaactgaaatttaaaattaagtttagagtccacgtagaaatacaattagaaataatgaaaatttagaaattaaaacaataaatattaaaagacgagtctaaagtccatataggaagaatatatataatttacagataactaaaatttaatattaaaaataattaataactaacacgtatgtaaaatacaatatgaatattacacattagtgatttcgtaaagttattgcaaaatttaaaattatgttgtcattttaatatatttgaataatataatgagaaaacatatgtgctattatatgagagaaaatataatgatactagccgcacaatctgtacgggccaccatgctagtttatactgtaaaaagaagattggatgaatccacaccgttagattatttatactgcaagtatatattgcaagtatattgtaccgtaaaactcctctatatttatgcactcttgtgacgaaacattttgtgctagctcatgtagcaaatcatgcattacataatactgactattgcgatcagttaccttcatgaggaaaccattacctattagctcatccaaatacttcaatcctattgcttcagctctatcgttttgatatccagaatctataatgcctattgcttcccaaaaacaagtaatttctaaattattaaaccggtggtcctcagggtaaagggcgcaatacgaaaaacacttttttagatagtaaggaaggtagtcgtagctaatttttagtgctggcataatgtcaacgttactttgcagatttttccactcatccatttccagaacttctgtccaacattcatgggaaaggttgttcttcaataaacgatcaacagtttttgctgctagtggggaacctctcaatttctttgaaatttctttcgcaataccaatcaagtcgcgtttgtaacactcaggtttgtcttgaccaaatatacactcttcaaagaatgtgaagaattcactatcctcgagaccctgcagttgtattgtctcggttgttttcaacatttgtgctatagatggaaatcgagttgtgacaagaataacgctgcctttggcttccccttttgtgaatggagctactagatttttccactctgcctcactaccgcatttccacatatcatccaagacaagtaaaaacatttgtgatttcaatctttctgcaatagctttttggagctgatccaaattggaagagttatgcaccgcttcgcttcccgcgcttttatcgtgaggtatgcactttaggatctcctgagtgagcctaagcacatcgaaattagtagacacacaaacccagaccttgatagggaagtaggcatctgttcttttgtcattgtagaggtgttgggcgaaagttgtttttccaattcctccagggccaactatgggcaaaaccgatagtgttccactcggaatattgcagttagtcaagtcatgaagagtttgtctaaagattatttccctcccaaacaatttatcctgcgtaatcgttgagctagtgggaggccgctccagggatgtatcccattctcctgcagtttggttaatttggagcaatctagatatacacgtacacaagtcatgtatgccctttaccactgacttgattttattggacatgtctactcgattgaatggcaagttgccaacctggtcaatgacgtcaccatgggagttggctgtatcttgcgagtcgtcggcatcatgtcgtgctcgtgcagaagaacaaaaaaagcatgaaaaccagttaccggcagtatgacgaagagcatggcggccgtggagggcatgacctcggaggccaccatctgcctccggtatgacctcatgggtgccatcaatctgatcctggatgatgaagtagtggatctcgtccaatgcatcctcggcctcgtcggctttcttgcttagatcctgcagaaggccctgtaagccaatgttgtccctgatgtccttcctcccctgggccatgtgcaatagcccttgtgtgtacttgaggtcccttttgatctcctccacgttaaggcctagctcggtgctggcaacgtacgccgccaccaagtcactggacaattgcgtcaacaccttaccgaggagccagctcgccacgccgacggccgcctccatggaccagctcgtccgatggcccggaaagttgctggggttgattgggtttgtgtattgatgggtataatgctgcctgcaggagcccggacttcagacgaggtccggatgactccttttctactagcttgggctcattcacaatgcaacaaaagaaaattgatcagttttgtctgcctcatcaaccgcccggcgcccatagattgagatgccatcccatccctctcatgggtaaggtgtaggatggtgggtttagctggcaagaatcaggagaaaattaattaacaagtcccattagagccaaattggccattaatgacttaattatgaaatccttcgcttggatgcaaccaccgtggttgcgtctggggctggttatacgtgacagagttttttaaactgcccgcgcaattgcgcggctagcacccatataaaattatatattttttaatatgattttacttaagatttattaaaaatttatctcgatatcttgagattttgaaagaccaaatcttatcatcctcgtgtttgtaattttatagttcttaaaagtcacataagttgctaccacttacttctgtcatattattctttattagcttgcttgatctaccaccgtttctattcattcttcttagaacctttaaaaattagatcttaaaaacttatagtttttagagtttatcgtcctattagggttcttttgtataatttttagaagtcccattaaatgctgccattatactcctctacaaccgtccactgcatcttctctttattgccattgctattttaaaaatcaaacataattatcgttggtttttttatattttttagaagttccaaacctttaaaaattggaccttatagtttttagagtttattattaatttttagaagtcccgtcaaacgatgcaactatactcctctacggcccgtcaaatttcggattttttaattaatctactattgggttcttatatttactcttatcaatattgcttatatttaattccaaatttaagttaattttaaattgtatttgtcgacgtttgatgtcacgactacggtatttgcatagtatggggatcgttggtaccaggatatatgcgagacttaggtaaaagagatggggacgaggatttttatataggttcgggcccctgaattgtcaggtaataaccctactcctgttggccgaagccggtcgttgctcttattcaccaaaatcgcaccagtacaatatttggggtagcctatataactgttgtcgacttggcggtctgaagtgctgactcgtagtcgacaacagagtagccttcctcctcgaatctgcatccggcgagatcaaagacatcgttatgtctctcctgatagtatccgtagacaccgtaggggactagctatgcttatctctgaagtcgatatccggcgtcttgtcttggcgcatgttggcttgtatgttgatcttgtgtcttgatctattgttctgtgtcccctctccttctaggggaccttgtatttatacccataggtgtccctttgtctaagtagaactagggaaaccaatatagatacaatccgagtagtccttgtcgttttcatgtagaactctattcatccttccttatacggaactcctcctatatccgaaggttttttccgtataagacatggtatgtggtgggccctgccaagatttagtcaactactattaggtatgtggtatcaataaccctgacagtattcctacttgaactcttcttttcttttctttcttctaatttcggtgttttttatttttttattcggaaatttaattaatcttgtattggattcctgtatggacttttttaattctgaatttaagatatttttaaattgtattccttctcgaactcttgtttttttttctttttctaatttcaaaatttattttatttttattccgagttttaattaatcatgtattgggttgctatatggactcctctttcaataatgcatatttttaattccgaatgttagctatttttatatttgtatttctatttggattcttcttttctttttctatgattaatgtgggaatttttagcctccacagcgaacgtggtgcctcctttcaaggctgttttaataatataatagatctcagtccactgccattagctgtcggatcaacctcgcgcatgtaaggggggctaacgagccgattcggcttagctcggctcgtgaaaactagtctatctatctattatatactagaaatccattaaacttcctacaaataatcctaaaccgccatatgacactcctacaaacgctcctaacttaccacatggtactttaataaatactagaaatctattaacttaataaattaatagaaaaagaagcctccacgtttagtactctcattgtctagaaaatcctacattaatagtagaaaattgaggaaaatataaaaatcgaactatagtctatctaccctataattcaccaactcactcttacacctacattactcattcatcaaatctaacggtccaaatcatccaacgcttctagatccaacggtaccggcgcacgcggggtcacactgtgggagagagattgcgcgcacgcggggtgaccggccgaaaatcacgcatgcgagcaaatcaatcgctgcctcttcccacaccttccctctgcacattgccatggagcgcgcccgcgcccccgtcccgtccgtcgcccagatcggtgccgcccctaacctgacgctcgcgctgccgcactccgccaccgcctccccctctgattcatcgccatcctcatcttccccctcggcccaccacggcgccttatcctatgtcacgccctgaagtttccccttttccttgctttaaaaattgtttaataaattgcccgaagaaattgtttaatgaacctagagctaatccctaattaataaatgcaattaataatcagaaatggcgtggtggaatttttcttgagttccccatgccctaatgcattaacaagatttttagtggaattttcagagccttggaaataattttaaccaatttaaaatcaccaaggtgcaatataaatcccaggaaaaatcctttttcttttttttcttcctcctttttctcttgatgggccgttggcccatctctctcctgcgcccctccctcttgctgggccggcccaagccgcctcctctcctcccttggggcgccgacaggtggggcccaccagtcgggtcgtccctaacctctcgccgcccgtgcctcggcagcaaccgccgctgccgcccacgccgctcctccacgcccatcccgcgcctctcccgcgctcgtgcccacgtcgccgcccactcctccacctcccccgcacgcgcgcgcgccccacaccgactgggattcaaatttgaatcccctctctctctcccttcccatcttcccacgtcgccggcgcagtagggtggtttcccggcctcgtccgctccctctcacacctataaatcgctcccccgagccccctctctcgtttcccactctcgccaccctttcccgtgcctcctaccaccgccgcgccgcgttcgccgagctttgccgctgccgctcatctccggccacataccgtcgccgctagggccgccgccgcgccaagccgccgccgccgttagcttcgccgccgcaagagctttcccggccgccgcctcacgttgctggaatcccaccggagcgcctatctcctcgcacaccggtgagtcgcgctgtcctccccatcttcggccggggtttaaagcgccgtggtcgtcgtctcctctcctaacgcctctccatcttctcctagggtgtcgccgccgcccgtccgttcctccgcatcgccggtcgtcgccgccgccttcatccttcgcgccggtcgccgtgctcgccggtgaggaaccccctctcttcctcccacctctctctcccgcatgcgccgcctccccgcacgctcgccgccgcttcgcccgtgcgctgccgccgcttccgcgccggtcgccactgcctcctgcgccgccgctcctcccctcccgcaccggtcgctgtcgccccttcggtgaggacccccttttcctccccttcctctcctctctcgtgcgcgccgccgctccccgcatgcgtgccgtcgcaccgcgccgccgtccgcgtcgccggccgttgccgccggccggtcgccggtcgccaccgtgcgccatgcccgggctggcctcggtgccgcccgtccccaaccgcccgatcggccctcgcccgatcgtggccgtccatcccatggcccgcgtggccagccacgtggtgccacgtcgacgccacgtgatacaccaccaccccggccccgtggacctggtccacggtggaccaccccctttgagccgctgccagtgaggcccgcatgtcggcgcccccctgctgacatcatctgggaatatatattgcgcaataaaccaataaggcttttctttttatagtaaaaacacagtttatcttctgaaaatcataactaattcatccgagctctgtttaaatccattcaagtctcagtaaatttataaaaatccctagaatccattaaaaatggttttgtttcctgtttcagtagtcttatagcatgttttgcttgtgtgctttgtttgtcgcgtagactggccgtttcgtcgatccgcggtttctcgaagacgttgctgaggtctcatcagtgcgagagcaaggcaagtcatgcattacaattgatcatattgtacccaatttacaaatatcccgcatttctattaaatgttgcatccttttacaatgtcatgtgggatgggtcctattactcagccatttattgtttaccttatgccattgataacttgggtatcaaaatgactagatgttggtttaggaaaatgcttagccatgcttagttcaactagtacacaaatgggtatcacattattacatagactttgtctattagcatagctttggattggtgccaccgcaatggtgttagttaattaaaatacactgaatggcgggctgcgagtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgtgggtgggcgtgatggagttgggtcggccggggtgtccggttgtccagctgccggattcaccgcggcgcacgaggggactgcccactgcccgttaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaaaagcccgcggttatgggcgatcaaccagattcaccgtgattagtctcacccctaggttagcttaatgaactagtgtagttcaggtggctggttgggcctgttgcaacgtggtgtagcgttgaacactgattggttaatattgattaattactacaattgtctttactgttttcaactactgcttttaaatgcctgctttattgcaaatgaacccctagcttcctttggttatatcctgcatcatactcctcttccggtatgacttgctgagtacagtgggtagtactcagtcttgctctcttttcccccacaccagagctgaagatcttcctagttggagctgtcttgttgaggttggtttcgtcgctgccgtcaaggattgcctgtggagtggagtcgccccgctgctgaagtcaagcttccaagtctagctcgttttattttttccgctgcatttgtaatcttttatatttttgtaagacgtggatctgtatgtcaacaattgtcgattgtgtaccctgtctggtcctggacaggggtttaatgcacattcagcttagaaattctggttcatgaatttctaggcgagacatcctagcttcctccacgcccggaatccccgcctcatcccctctcgcaggcgatcgatcctccaccctcccgtacgcggtaggcctcccgcctccgccaatcaacgccgtcgtcctctcccgtctcgccgatgggatattgacccggcaccaacgtctttctcgctttcgtctccccgcgccgacgagagtggcgtcccgaccgtattcccactttctcagttccccacgagaaaatggacatttcgccatgttcaaaacgcggtttcgctagaatgccatcccgaagacgtgattcgataaactgccaatatgaagcgtgcgtctaccgccactttgccattttcgctattttattcattttcgaaaagattttctctcctctactaggtgttgagacaaaatttccccttatcaactcagagaacacggtgagagaggagacagagaaggggcgccgacgccgctgctgccggccggcgccgcctctccgcatcatgcgcggcaacatcgtgtgcgtccgccgcggcggcctttgcatgctctgcccggcggcggagcgggtgaccgacgaggagatgatgaggggcaccaacgccgccgccgccgccggtgccgggaacgggatcgatcatcgacgaggccctctgcctgatgaagctccgcgagaacgtcgtcgactcgatgaaggccgacctctacacccccgtcgtcgccgccacccgcgatggtgtagcagaggcgaggggcgggcgccggcatgttttcggcgacgtcctcgtccatgaggtcgtcgtcatcagggtcgaagtcgaccgcctccacatcagcgtcccggcagagctcctggcgcaccgccagcgtccgcgccgacctccactcggtcttcgccttcctatggttacagatgtgatcctcaagcgcacggatataccattgtagcatttcactcgggagtattctaaggtactgtatttgtttaatcccaagggaagatatgataagagagtactatgctaatagttatatattacttatatacatcaaggtctatgcaggggtaagttaagcttaagggtagagtgacacacaactaaggatttatctaactcctacatctcctaattatagctaagtggcagtagtttagatatgttccattcctgtacttctagtatacaacatcttagtatattataactagtatacactatgtagtataacccctttaacaatgcagcatagctaagcctaagcatagctatgccctcccgatgcatcgcaaagttaccccgggttgccgagtttcttacgataacctgtcataaccctccaaccgaagtaggatacggaggtgtatccaaccccaggaaattgtatgtaggaatataaactgcgggggagacgcccatactgagctgtcaccatcagcggcctacaaatcacccagagaatatacccccaaataatgataagcggtaacctaagctccatgcttaaattactacttattactctatagccttgcaatcggtgtagagcacctgagtccccggaccatagctctcggcctagccagagcagacttatgacccggtaatcagacactataccagaatcaatgcaaatcccagaaggtttaactacacatattatactacttattgataaactaagactggtactcatactctatgattggaataaagtactgaacttgtataaagaagaatataatattgataaatggaagtcttacagagaagaaaggaaaagctatagaacctttaccaaactccccgaagcctccgcggacttggaaactattctaacactactccactagcactaatactactttgtagagagctttgatccttgcttgagtgtgtgagggaatgaatgagaggaggggtatttataggtggagaggtgccttgggagtgtggagatgctccaagcatcctaggagcatctttgctctcctcttgacatgtggcatgatgaagcatccaaagagcatctttctccctccttgtgacaagtgtccatgacggttgcttcaggtagaaacggtcataaccgccattggatgtcgataactactggcctgtggaatttctgggccatctgggctgcttttggttcggccgaaccctggtctggtccatttggcccagaacttggcaggtgtactcctcgtttattccttagcccaatggtgtgaattatgggcttgtttactcatattaattctgtattatcagcctatctatccacaagtctacttctcgacaacgtctgattgatcgttcatctattttctgtcgattctcctccatttatatgtgcttctcctgcatacatgttactagcatagtatatagtggaagtagatattttatttggaatttatgcattgcaagcatagctagtcttcatacattgggtaatattgacggtcgaaactggtcgataacgatcgtcaacagcggtggccgttggccagcagcatccaacggctagtgctaacgccggagggccgggcgaagttaaaattgatattattatactgtaagaatttgctacataatttaaaattagtagactaagccaccgcataaacattaataaccttgtaaaaaaaattacatggttttttagtcacatgatttcatatccgtggagcattcttaagccgccatgtgacacttcaagaaattatggatatttctacgaatatttatactacttaaaaaatacgcaggagggatggtgaaccaatctagacgtactgacaccgcaccccgcgcctccccctctcacgaccccaccagcgcctcctctcacgcccgcacccgtgccctaaaaacggcccgcccctgccgccacgcccacaccgccgcccctatcatgcctgccgctgccgctccgccgcccctctcacgcctgctgccgctgctccgccgcccctctcacgccgccgcccttcgtgccgctcgggaggagttgcggcggggtcgagcccctcatcgccgactacccttctccgctcgcagccgccgtcgtagcgtgcgtcgtcgtcaccagacaccagcgatcaccattccctctgtgtcgcctcgccgtccgtccatactacacctctgccgccgagcagccgccgtcgtagcgtgcgtcgtcgtcaccagcgatcactattccttcagtgccgcctcgccgtccgtctgtactccacctctgccgccgggactcagggccgctggccaccatctcattgtcaactcccccgaacagatctccccagccgcggtcgctggttcttttgctgcaaaactaaaatggtcgggagaacaccgatgcactttattttttatgacctatacttgcctgctcttttctgctcactggggatcaataggaaatgaatttcagaccgatactagcctactgttttaagtctctgcatatgctgaatctgaaagtaccagcctgctcttttctgctcgttggggatcaataggaaatggatttcagaccgatactagcctactgttaaaagtctctgcatatgctgaatctgaaagtaccacttatagtcattatagaaccaaacaggttggagcttgcatgctcagttgtgaacagatgtatttaggtgccagtcttgcccctggctgtgatgcacaatagcagggttaatcttgctaaaaagtaattttcttgaattgtatatctgttcagattaatgagccgagcaaatttctgttgcagatttggcctggtgaaccttatgcagttttctgttgcagtgttgctgcaatctgacactaggtgagttgtatctgctattccttttcctggctatttccaagttgcagtattgcaagatgataactttgttttaccatgttttctttgccacttaacaaacctaaactggtgagtctgttaatagcaaggtattctacacaatttggtccaatatggttctgtagcccttcatatatatgaagatttctaaggatgtaattatgacctaattaatttacttgtagatatagaaatttactgtcatcagatgcatacccattttaagatgtttgaacttatctcaatgtttgcctgccgctgttttttccaataaactgttgcatacaagtatattacaacatacaccagtgaaaatacacagtaaatgacatacaagtaatagtgatgacttatgagcataaataaagcgtgattcatgtgtcacaattcacatccaccagcacagaacatggcaacatgcatgcaacaaaacaacgaagcaacaacattacatcaactccatgatttcaaagcaaccacatactttactcagtaactttctcgttaaattttggaagagataaaatgttacaaaaagcacgaacgcactcagagagttgctcctgggcttttgattatttgcctaacagtttcacctcgagtttacttaattagctaaggtgtttatcatggccttgcatatcaaagataccaaaagatagcaatgtggcgatgctccattccgtgcgtcgccgatcaatcagagctgctgatgatcagctctgcttagttatatggcggatcggcactgaaataagatggcaagggcgccattgccaaattcactgaatgaggagacggcggtgggaacttcctgtggccatgcggtgggggtgcggcagctttgccgtgaggcggtggcgatggatacttgtgcaccggaggaggtggagaatgcggcgagtaacgggacggcggcggcggcggcaggtggtgagcagccgggggcggtggcgaggcttgagcagagggcagcaggtgatgaggcggcggcgaggcatgagccggggacggcggcgaggggtgagaaaggggaggtggcggactgggccgtgttggactttggacttcgaatgactggagagggccatccgaaggaatgttggagcaccaactgcgccgtgttgcagtgagctccaaattctagatggcgtcgcttataatatgggatgaagcctccatgtcaaagaggcaagcggttgaggccctcgatatgagcatgagagatataatgggttgtccgtgttctccgtttggagggaagacgattgtgtttggaggggacttcaggcaggtgctcccggtcattaggaagggcgctaggtctcagataacagatgccactctgcgcaggtcctatctttgggattgtatggttcaattgaagcttgttcgcaatatgagggtgcagagcgacgtgtggtttgcggactacctccttcgagttgggaatggcaccgaggaggtgaaacggatatttgcatgtcgtgcaaagagaatgaaacggacctcgaaaggctcatcgatactgtgttccccaacctaaacgataatcttacgaacccaaactacatcacatgtaggaccataatgtccacccggaatgagttcgtggatcgaattaacatgaaaatgattgggcggtttagaggagaggtggtgacatatcatagctttgatcgaccagaggatgacccttataactattacccgcctgaattcttgaactctctaactctaaatgggctacctccgcatgtgcttaagctgaagattaactgccccatcatgctattgaggaacattgacccagccaacggactttgcaatgggacaaggctggtggttcgtgagttcggaagaaatgctattgacgtagagattgtggtagggcagcatgctggtaagagagttttccttcctcggatacctcaatgtccttcggatgatgagatgttcccctttcgcttcaagaggaagcaatttctggttagattgagctttgcattgaccatcaataaggcgcagggacaaacaattccaaatgcaggcgtctatttaccagagtctgtcttctctcatggtcaactatacgtcacgttgtctagagcaacctctagaacaaacataaaaatactatcgatgccggtagaagacaagaaacaaaagaaaaagtctaagcgtactggcgtgaaggacaatgagaagaaaggaaagaaattgtctaaacagacagcagcatacacaaaaaatattgtgtatagagaggtcctcacagattagaaaaggtatattatgtgactattaaccatccataatatgcttgcttaaattccattctttctgtaatttttatattccaagtctaacatttcgtgtgtttttttcttggacagcagtaaacattactttcggtgggattttggcacggactatatgcaccattacgggtattgtgatactactttttttctggatgatattgatctggagcccttgcctcgcctgtaatccatctcctagggtggtcagcaaggaagagcaaaagagggtgcagtggccaagtgtagcagctttgctgctctcccctgctgtcgaccatccatctataccaggccactattagattcacatggacaaaaaaaaataggcaaattttgctacaggacatcgcgacttcgtggttttagctgtaggacactgcacaaagtcacttttggggaaagacactctcaaaatgtggttatttgccaggggacaccgcagccaataaaatattaatttctggttcaataggagagataaacagtgtaaaaggtcaaaaatgccctcgggcccacttgtcatattcttcccccaccccaaacctccctccttgcctcctctacctccaccggcgatgacgtcctcaccccacccacggccacgagcaacgagctcggcgctgggatgggcggccaacttggcgcagggggaggcggcacgcaccaacagcgcccacggcggcggcctcgccggagctccgccacgaatcaaacttgcagggttgtgatgaagaagcggaagaggcgcggcggtgacacctccgccgccttcgaccggagcgtcttccccatcctgctcgccgtcatcaccgccggacggcgctaacccacgaccccgagcagcctctgccatctcccgtcgccatcccgctgccccaagttgcgtccgcccctggtgctgtccaacgccctcctcggcgccgtccgccgccggcgcatcacgtggcgccctcgtcggcgccgcccgtccccgcgcgccgccgcccacgcccgtcgccatcctgccccccaagctgcgtccgcccccggcactgtccaacgccctcctcagcgccgcccgccgccgccgcatcacgcgactccctcgtcggcgccgcctgtccccgcgcgccgccgcccacgcccatccccacgcgccgatgtcttccgcgtgtacccgcacgctgccgcccatcgcccacgcgccgccgcccacgcccatccccacgcgccgctgcaacgccgcgcccatcgccatgcaccgccgcccacgcccgtccccacacaccgttgcaatgcctcagtagcggcctcgctgttaaaggaggaagagagaggaagagaaagagatgagggcaatttggtcatgccatgtaaaaaagtaggccccttctcgcttagtcagcacaaaaatattaatttaatgaatgaagtgtcccctagcaaataaccacattttgagagtgtctttccccaaaagtgacttcgtgcggtgccctacagctaaaaccacaaagtcgtgatatcttgtagcaaaatttgccaaaaaaataattaatctaaacatataagttggccatagctgtatacagtatacgtaacatgtaacttgtttttgtttgtctgcaaatttaaatggcaaagtttcataattagttggagttgaaaattatattttgtatagctgatttgattaccttaggaacattacaaatggttgtccacaagcacgagcagggaaagtctcctactacagcatatctgacttaatcaattccctggaagaaacaatgcttttgatctgttcttcacacgtcttcctgaccaatttgttaaacaattcaataaaaataccttctttacctatatgcacactctttttctgctaaatattaattgctattgtatactagtagtgcactatacttactttatactccatcatgcagataacccatgagccagtactggtgttttactactctgatctaccagctatttggttccttgatgtgaatgtaaactggaaggagcaatgcaagaagcttccttttcattgccaatggcactggttgaacatgctcttgtcttcctgtagaagtgttgctggcatttgtgatttctgtacttgattttactgataaaaagtgtggatcatgcaatttattgataggggcaatgtttgccggttgaaaaaaatgagatgtgatttgttaattgtgatcgttcgggattacaatttaaacagataatatgctttcagagaggagatcgggtaggttacatcaaaaggaattattctcttgtcatgaaaattggaattaaaatgtacgtagaatcgtgtgttcagctggtagaaaatgctaccagataactgatgcaacagaaacagtagagtttcaagagctattagtctaagaataattgatattgtgcaagaaacgtgattgtccctgatgaatttcaaaaaagaatttttaaagcacctccagagcttcacactgccaagaagctctctctgtatcagatgtggcacatctagcttgattagaaactagaaaggttaactccaagcagcagatctgcaacacccgccaaggaatattttgatggaatattttgcttgcttatttgcactcttggaattaattgataaaggaaacaagctatgggcctaatcggcccatataacatctgactattacggtccaacgccagaaataggaataagttcatctgaggtcccttaactttacaccgaatccgattttcgtccctcgatcggaaaaccagacacaacggatcccttaactattaaaaccagtgcagattaggtccctcggcggttttgagagcggttttggctgacgtggcgcctacgtggctaatttgactcggtcttcgtccgacgtggcattgacgtgacgcttacgtggcaattcaacctgtgggacccacatgtcagtctcacatagaaaataataaaaaaatcatgggacccacgtgggtcccacatgtcaatccaactcacccctcttcttcctcctctctccccatctccctctcttcatctccctatctctgctctctccagccgccacggaagacaacggcgcgcggcggcaggcggccggcagcaggagaggagggagcaacgcgcaaagaccggcgaggcgggcagggagggaggacgcagggaggccggcgatggccgagcgccgtgggcgggggcttgatggcgacggacggagggagaggtgcgcagccggcggtggccagcgggagagggagcggcgaccgccctccgccgcaacccgcctccaccaccgagctcgtcagcgaccgcccaccggagcgaggaggacgacagccggcgacgggtgaagaggacgaaggcagcggtctagagcagaggtcagaggagggcccccagccgccaagatgggcgctcgatccgtcgcgtttcaccaccaccgagctcgtcagcggcagcccaccgaagcgaggagctttcgcttcccttccccccattgacgccaccgttgcagcagctgaggcgccactccccatgccgccgcttctgtggtgcacgccggatgcggacaggaacgccatggccgtggccgcggacgacgtcgacgtcgacctcggcgactcccaggacccccgtgccgccgccgctaccgaggggagcagcgcacggcggacgtcctcctcctctggctgccaccgccatgcctccccgcatgtctgcatctcctcctcctccggcggccatcgctgcacgtcgccccttctccccatcggccaccgcccttctcccggccgccactgccggatctcgattgccggcgctgctccggggggagctgccgctgccccgggtcgatctgttccgcccaccgccgtcgttgatccccttttatcgccccggcttcctcctccagctcgctgctctcgccggtgggcgccggtctcgctgccccctccagctcgccgctctcgccggaagaggagcagagaggggagagagatgaagagagggagatggggagagaggaggaagaagaggaagggtgagtttgactgacatgtggggcccacgatttttttattattttctatgtgagactgacatgtgggtcccacgggttttattatttttcagggtcgaattgccacgtaagcgccgcgtcaatgccatgtcgaacgaagactgagtcaaattagccacgtatgcgccacattagccaaaaccgcccttaaaaccgccgagggacctgatctgcatcggttgtgatagttgagggacccgttgtgtctggttttccgatcgagggacgaaaatcggatttggtgtaaagtcaagggacctcagatgaacttattccccagaaatataatatctgactgttacggtccaacgccagaaatagccaaggaaacaagctatgggcctaatcggcccatataacatctgactgttacggtccaatgccagaaacataacatctgactgttacggtccaacgccagaaacaaccaggcaacgaattttttgttcttttttcgcttttgacggcatggcaagatcacgctaatcgtgattagttacaatcatcatataagttgcgccagcagcaaccgaagctcttgttgccagccctagccaccatttccacattctttgccaccatttccacgttctttccgaactatccacccgttcttacggacgtctcttccgaacggctgattagcacacaatatggagaatgcgtagccgtgcaaccatggaggtcactcttccttcattctattgtttcttgtattgatggattgtgtaaagctatcatgttgtgtatattgtcttccccatgcagaatttgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccatattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccgggttcccaaatgaagttacaagcccataggcccattataggtgatgcaacaccttgttcctgtgattctggccacacgagatagaattcagagaagaggctggatccgttagaaagagggctccgagagctttccatcaagtactcccgggccgaaaacggaggtcgtatgcagattcggtggccgtttgaaatcagcagtgtagtaggtggccgaatcggattccagcacttggagtacttgatctcgatatcttcttgttcatccatgatgtgagcaatggttgcatccgtggtagccatggtcacatcatcctccccttcttcacggaaaaccgtcctcggtttttccatatggtgctctttgcgtagtccatttacaacaacctgtttcttccaatcaaaactaggcaaactcgagacaatttggttagcaataacatttttctctagcttgcatattttatccacatgtacaggaggttctaaatccgagcagatgtaaactctatgcacaaaatatattccaagatcattatattcaccaaagatgtgaaatataacattggttggatatggcaaatcagacttagcaaataatttctccttgaaattatcgagctcacaaaaatcatcaaactgaacataacccaaagtatttaaagaagatctcaattcacgctcctctattttattagcaatgtgaacaacatgcttaaaatcagtgcagtatgaattaacagtaggaatagcatgttcattcacaagttgtggcatggatataagtgaagcattatcgcataactcttctttatcacaaggaacagcaaacaaatcaatttgtgacaaaggaatctcagcagttggttccactaatggttgctctgctatagcatgaaaagtggacaaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagctctggtatcttgttttaaacattgcagtttgttgaacaaaatgtcagcataatacatgggaacataaatatctctgaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttaccttataatggtcatgttgatccctcctcgtgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacaataccacaagatagcactaggaacaactcatgcacaactctgatatatgaagtttagctcaaacataatagtattttctcttttctttctttcttctttcttctttctttttttttccttttcttttctgtttttttttggtgcggctttttttttctctttttttttgcacctttctgccttttttttcacttttttcttgattttttttaacaaaaactgactcaaggaccttaatgtaagattacagggactcaaacataaatataaaatttacagggactcaaatataaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaattgagggagggggtcggactcggccaaaggggcgagtgggactcggcaaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcctgacaacaacagagacatggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgag

SEQ ID NO: 63453 - DNA, 2838 bp, Oryza sativa
  unsure (1)..(2838): unsure at all n locations
aatgcctaactgacctgngataggatccctccttatatagatggagggctacttaatctaatcctaacaaaccttatctaatcctaacaaaccctaattctatctcatgggcctaggactcccggcccaaagcccatgacattactcccctctttttgagcagctcgtcctcgagttgcagcggaccctgctagactcaaacaaaacaccataacctaaactaagactcttaagccttttacatctcggcttttattatgaacaaaaataagaaacaattcatgcgcaggaggacctggtcctacagaaaccctgagcatgcctcccaccgaagcccacttgtccagcccaacagcaaaggaataaatagttgactcggatgcttcatgggccaacgtggaaaccacccagaccagaccagccaacccaattgggagaggacagaaaccctatcctcttgttcttcacgaggccacgccgccagaaacgatgcagccgtgatcgagccgcgagcttcacgaaccaacgtgtggacccggcgcaatctacgccatcgcgacgcacgagtgccacgcccacccgtcgcgctcgcgactcgagccgcatgcacgccgcctggctttgctccaaccgttgccagaatttgcgccaccaactgcggaaaccgcgtcgcatcgcctggaaatcgtgcccgagaaccggacacccaagtcgtgttgtgtcgctgtcttcttctccaccaccattgagggcgccaatggcgacggcgccatcgccagtcccagcggcaaggtcgaggttgcgcagccactcccggacttggcgccgcgcgccctcgcggacgcaaggccaccgcatgccggtataatggttcggcctcctcaaggaaagcagccggctcggttgactgagccgccaaggcccggagttgcgccgccaagttcatcatcttcttcgagatctcggcaagaccttcgctaatgttgggaaccgcagtgatctcggcacccatgggcacagaaccgaagctctgataccaagttgtcacgaacaaggaatacggtcctgaacctaaacggcgcgacgctctccgtcgcactgagaaggcaggccgatgggcactaagataaatattgatctaatgcctaactgacctgggataggatccctccttatatagatggagggctacttaatctaatcctaacaaaccttatctaatcctaacaaaccctaattctatctcatgggcctaggactcccggcccaaagcccatgacattaattagtgtgagtttcatcccgcgatgttctaaattgagcccctttcatcaagtgtaattccaacagtgctgttgttgtggagctcgacatggccaaatgatgcttacaggaagaggcacatgtctgcatcaatgtttcagaattgtcaaatgccacatggtcatacaggtgaacaccttttcccgcattaccatagtcatggcaaggcaactgttagaaattctgattactagacaaatatgagcacttcattgattacgtttctcaagaaatagagaagccagttggttaaagttgtttttgaacattcagttgaccaaagttcaatatgcagaatttccatggaaacagaactgaatatgatggattcgcattgaactccactatataaagtccagccaatttgcttgttcgcttagttcagtgcatctatagatgcagatagagaaaaaagagagaggacgtagttcccaccaggcatagttcagtgcatcgatagctgcggacagaaaaaaaaacacaaaaaaagaagagaggatgtagttctcaccaggcactatgttcacacaagcagcaagcttctcacttataatgctcccagctagcctctttcctgtataaaaaaatgagaaaggcaatcatctaatgctgctaaagaaaaagatcaaacttatcaaaataatatagttatgagtacagctaggaccgctgagtagcataatagaagctattcttgaatggaagctactaaaatagtcaatggggtgaggaaataatctctactttgttcagcacaggtgttgacaacttgtttgctcaagtcgacaagcacgatcgagacacctaaatgccttgcggtgatatggagtcgtcaaacaccttgatctagacaaagctaaaccaagatgggttttgcaagattaaacaggctagcggagccaatttagatgaaacaaggataaacacccgtcttgtgggcgaacagggtttacgggccgaacctacagagggatttcgcactctcacagcgaaggtgggcgatttactgcgcaaatcgacaaagatgaacaaaactaggctagaactaagcaaaaaagtagacatgatattgaaaaagtgattcaattggctaattgtgttcaaagtagattgtgtgttcaattgaaccggccttggtcttgttccttataaaggggttggtcttgcctcctacaatctcctccacatcaaactcagggtagagaccaattagaactttaaaaatacctcaccaagcaaggaaacccaagcaaggaaacccgagacttggtgaaattcaacttggaatcggtctgaccggccacacaccaccggtaagaccgacccataggcagcggtcagatcggctctgtgaaggaaaccaatcatttccaaattttggcgatgttttcctatttcgaatctaggtgccgaatttgggtgttaacaacaggtacaattaaatgacaataaaacacagagtaaatttcacaaaactacatacttcctccatttcacaatgtaagtcattctagc

SEQ ID NO: 63454 - DNA, 1179 bp, Oryza sativa
attcattaacatcactatgaatgtgggaaatgctagaatgacttacattgtgaaacggaggaagtatattttagccaaattatcataaaactatagatttgagatgatgtatcacaaaattacagatttaattttctcacagaactgcagatttaaggtggactatcacaaaactacaaatttagtaacaaagttatcacaaaagtacaggtctagtgtcacatataaacaatgtacctgcttctttattaggaactgtcacatacacaacaatggaaggcacagtggtggaagtagactccattcgagcagaagctgaagagctgagacttctcaccctgtaaagttcccatactggttatttaccagtccagaaaacaaatccaaagtgactacattactttgatgtaactaggctgtaaatataacaccactcccatcctccatcaaggtaaaaagagtgaagcacttcgcatttaagcacaatcggcacaatagttcctatacatcacttctgtgagcaaccaagaactcaaaccgtccccattcatttcgaatcatatgaccaaatctttgaatcccatcgaatcctatgaacaatagttagcaccggtcaaactgcggaatcctcctagattgattggagaggcgcgttaccctgcgaaggcgccgaggctgaggaagaggagagcgccggcgataggggcgcggcgccggagtaggagcggcgagagcccggcagccgcggcggcgcggcgtggggcggcggtggcggcggcggagagagatccgagcggggaggggaggagtggcatcttctgggagcttcggcctacatgcatgggagttgggcccgcttcggcctttggatgtttgggcttttgggctgagttcggttgggaagatgggaacctaccgaatttttttcggttttagattttttttaaaatatttacagaaataatatatcggcaaaaaaaatttacaaaaatagaccctgccgcccacctctggggcggcaagctgacgtggcaaacgggagaggaacgggcggtgacagagggagggttttttgcaggaaaacccttgccgagggcggcaaggggcccgaatgcaaaaaagccagtcggggccggccattttgcaggcggccccttgccgccctctggccgggcggca

SEQ ID NO: 63455 - DNA, 6226 bp, Oryza sativa
atgtgactattgagttaaatagtgtgtattttttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaataaacaaatattccaagtttaccatggaccaggaaacgtccgttacgggccaactggggtagatctgtcatattttattgtatcagaaaggggaattgatagaccggctgagaggagtgtaccttctataaaaggatggttaatgaggggtttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgggcagatgaacatggatgatggcgagggaccaagtgctaaagtaaatgagacttctgtggaggaggtcaacgcacgagaggacgggggcgtagtagctccatgtcacgaccggaaataacccaacgggcgttccttacgtgcgtgtattattccttgtcccaggaggcaaggtacaccaaaagttgatacaatacagagtttaacaagcggaagcgtaaatagttaatttattacatgggcggcgaaggcccagcacacatgaagacaaacgaaaaacagcggaagactagggcgacgaccacaggcgcttgacggcaggcacgagctagacaccaaagccttcatcttccaggaactcctcttctgggtttgggaaaaattgagcaagactgagtacaaccaccgtactcaacaagacacacccacaagtgcagaataaatgcaagggagtacaagggagttataatatagggggttagggtttgcagtaaacagcattaaaaggcacttagttgctcaagctatttggtaaacacgatcctagagctatacaagattattaatcaaggccgtgaacccacacgaacctgccttaacccaaggcctacgatgattcagaccgaactggcaaccaaacccaggtcccagctcgtcccaagccaacccaggccaaccattccatattttagttgttaagcaggttttaagaatttaaaacactaacttgggtacattgctaggcttgcccataaccgagggcgcggctattcgaataggttatactctgatcagaggtgtacatctttactcacaagacatcttcctcacgtgtaaccacgtgccacataccaccacggtatacggacgaaagacgtgacatagttcccaacccatcctagccatagacaagagtaccgacccagccccacctacggccggaacctccgggacaggtaggcaggaccgagcccctagcagcaggacgccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactatcaaaaccgtgcaccgcgagcccagcctaaaaccattttgagggttttgaatagagggggaggtgtgaatccaattccacaataatccaaccattccacaatgtccaagtgatatgaatattcccaaagtctagagttataaaaccacctaatgttgcctaattaaacagcgaagcatctacctaaattcctactagtggtaccataaatagagtacccactagttggggttttgtttattctagggtgaacaaggtaataataacaataacaataataataaggtcataacaaaggtaaataggcatggctaaataaaacagtgataacacgggaatttaaataaagcgataatgcaataatttaaatcaaaataattttataaactgggattcaatatgctcaaggatgatgtgacttgccttagtcgctttcccaaacgtcggcttcaacctccacgtagagcggatcttccgaagctgcagcgtctacacgaccaacggaaaggaaaaaggcttttactctaataaactccatataacaagcaggaacaaagcacaaaaatgggttcttgacttcttgaggaaaaattagagacttgaacggtccaattctgagttcaaatggctaagttatggccatttgaagtttatatgttctttaagtgaatatttgcgaatttcttcatttaaattttaatttaaaaaggatttattgcgtcagccgaggggagggggcgcgcggaccgggtccacgggagtggggcccacgcggcagcctcacggtccacggtggactggcgcacccgggctcacaccggccggcgccgtgggccccacgcgtcagccgcacccgagggcgcgggcggctgacggctgggccccacgcggcggccacacggctcgcccggaggcggccaccacggtgcagccggcgggaggcggcgcccgcgcccctatggtcgccggcggcggccataggaacagcggagcggcggccaagaaaggggaagggaagggggaaaagaggcggcggtccacggctcaccccgggtcgacggcgacgacaaaggaggcggccggagcggaggaaggcggcggcgcgactcgggtggatggggacgacggcgctccggcggtcggcgagctcggcgaggtggtggacggggtcggcgacgatgcggcgaagccggagaaggcgacgccgaggcgggagacggtcctggcgagcggagagggccggccggaggtcgtcggcgacggaggagagagagggcgacggcgcgaactcgattccgacggggagacggtgcggcaagtggcggaaacgggcgagggaggcgcagggagggtttaaataggattgggagggagagagggcggccggcggggaaggaaaccagcgcgggaggtccggccgtcatcaatggcaccggcgagatttgcgggagcaaatccggccgtttgaatgcgagagggagagggaaaaatggggggaaagggggaggggatcacggggaataattccccccacttaattgcacacgggggcggcgggatgcggcggattcggcggcggcagcggcgcttggcgcgggcggggcggcggaagcagcaggaggacagggatgacgggtgggccccacccgtctgagggtggcgggcgggcccgcctgtcagcggcgtgcgcgcggggagaggccgaatgggccgcgggggagaggagagagggaggaagggagatgggccggattcggcccatccgaggggagagagatttttagggtttttctttttataaaaccttttcaactttgtttatttcttcttaattattatttgtgctctgaaaattccactaaaatttatttacacattttaggattttaggaattatacaaaaatcctccaagccttatttgacttttaactttgaacattttaatttttggaggctttcacaaggattttaattattctaggcagaattttgaaggatatattttagggtcgttttgggacgtgacactccagtgggcattcaaccaggtggagtggccgacgagggggagactgtcggtgccattgtggatgaaatggagagggaggattctgacaacgagcgtgtagaggaaggtgattcgtcagatgatgagacggatattaatcctgcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaatcggtcgcaatatgaagttcggtgtgttaaggaaaaagatggttgtccctggagagtgcacgcgtataaggggaaatggaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcaaagagacatacaagtatactattagctatgccaaggcctggagggccaaacagaaaataatagagatgagatttagaacttacgaagcctcgtatgacaatttgccacgcctgtttggtgttatcgaggaaagaaaccctgggagctcttacgaagtgaagaaattcccctcaattgaacatcctggcaagagtgtgctgcaaagggcgttcttagctctacatgcatgcaagatggcattcgtgaattgtcgtcctgttctctgcattgatgggacattcttgacaggaaagtatcggggccagatactaacagcaataggggtagataggaacaatcaggtattgcccttggcatttgcttttgttgagagtgagaataccgacagctggtactggttcctgaaattggttaaaacaaaagttgttggtatgaggccaaatgtgtgcctgatacatgataggcacgctggcattctgcgagtgatagaagagttgcagtttgggagtatggaacgaggataccctggtgtttgggaagatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtgatcagtgtgcagcggctccatcgaccgccgttgctgaccctcctcaagctcttggacctctcccaacggatagtccaacattggttagaagaactggattggagattcggaaattttctaagtggattctgcatgaaccaaaagagaaatgggccaaggcgtatgacacgggtggtgctagatatggaataatgacaacaaatttggcagaagtttacaactgggtgatgcgcggtgtccgtggactgccactagttggcatagtggagttcattttacatgggacatgcgggtattttagggatcggttccaggcagttcttccctctatgccgaacaacagcattttgtttggaactttcatgcaaaaaaagctagaggagttgcgtaaaaaggccatgaaacatcgagctctagtgcaaggtacccaacagcacaggtttgagatactatgtcaagataaggtaggcaggggtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggagttcacagagactaacaatgaagtactcaatattcctgacccatcgaagctccgaggcaaggctggaaggaggaggactcgtcgcatccgcaacgatatggacgagtcggaggctggcagggtgaagcattgcagcaaatgcgatgaacatgggcacacctacaagcattgtcctaaagacaaggagaaaccaggtgcggcggaggcaggactatcaggatcagcagcagatggagctcgccctacgggtgaaggcactacctccactcgaccacgtcctaggcgtcgtcgtgccacgtctggctacgtggtgtagttcttatattctatgttggcatgtggctttgcttgtaattcgtttcgaacttatctatgtgtttatgtttcgtcgtgtaataccctagtccagttagtgtaaattggatctg

SEQ ID NO: 63456 - DNA, 4531 bp, Oryza sativa
acaaagaagataacacaacattctatttattcacaaacttgcatcatataaaagagattaaatagctgtagtattccacctttcattccaatttttatgatttaaaggagatcgagtgattgtagtatgccaccacaacatatattttccgattcggtttattcatgagattaaattggacttgtgtagaattaaaagagtaactaaaataattgcatatgagtgtaggatgtgcacctgcttcacgatgatgggatcatccctgctacgattcacaacataattaagcattgaatcaagatgatctctcactgctatgtacccatatatctgtactgggccactatacatatgtattttagccaacttaattgagaaaatttgcatcatgcgagttgaaaaatgcacagtgcatgtatccctattaggttgacagtccataggttgtgaaagcatcatcggctccaagcaagcttcaccaaagacaactaaattaatacatttggcaaatgtttgttataaaaaatacagatacgctttttaatacatatttatgcaaaattacagaaaaccattgtctgatagaaaaaagttatatatggtttgcaatatgttcaacaaaacttgaactgatttgttctgaccagagttacttcatttcttaatagcccacacctcaagataatttctctggaacatccgtagtacatttatatttcaacacaaaagaacctcaattcttataaagagctagcataacaaaataggaaagagaattcaataacttactctcatgacgatcagcaatttgaaatacttggataaaaccagggcaaaacttgtatatagaaccatcacggtggctactgccttctaatattgttgcaggatgtacatcaacagtgggacagttatcgctgacaccttcagtaaaccaccacatatcttttgtttttttcgagaaaagcctcatgtgtgacctacacataccttttataatggaaaattgcttggccagggtatagttggaggtgcagaaagaatcattagcataagagaagtggcagtgccagtcgaacttactcttattcttctcattttttactccaatgatgcttggcatgaccttgcatccgtaggcaaatctatcaccaaagagcataggcaaaccttagcatctgactcatatatctggcgcaaatttattccaatactatacgttaggctgcactgttcacaagtactaatttaccatcgaatttatcacatagctacagattgttgacgttccatccttagcactgttatctcgatgaaactttgaatcagtagtcttgtgataaagttagcacaaaatctgtaatttaatagttttgttatgtggcttataagcatatggtttgtgattaatttgggttcatatctgtagcattacaacattatagcataatcctgtaattatacgatagttttgtcgaattaaatttgaaaatatactgttcatttttttctcagaaatatccgggatacaattttttttgacacaaatatattgtcattgttgagtgggactactaaaacgtcatgatatcgttgaaccgttgcgagatcgcgggacccaccacagtctcagagccatggcgtgagattgcgcggtcgcgcagagccaagtagccaaccagtgacatggcctcctgattagtgattaatcatcgtgattagcagttaataattactgattatgctaattaaagaaataacagtaattaattaattgctaatgtcgctaattaatctattaatcgcgcgagtgcgctagttagggatgtgaattcgcggtctcgcacactcgccacgcttccattatgcgacattggtatacttctgcaaatcccttctaaacgtgtatttatgtgaaaccaatgaaaaaaagttatagtttcaaaaaaaaactagttatatagtttctgagaaatttattattgaataagatgcgtaacataagtcgttactgctgaaattaaaatcgtactgttttctacattgggatcaaaattccgttcctcagttctgattctagtataattaaaaaaaataatcccaactaatatcagtttcaatttttttccccagttggggagtcgtctgaaattacaaaaacttcaaaaaccctattaagacatctcgaacaagattcaaaaccccccaaatccaaagttggtcccaatcaagatggagaaattcaccgcaaaagcgcatggctctcactgtaaacgggcgtaagcaaagcaagagaaggcaattcaggaaagaaaagaaactgaccgagaaagatgatgcagatgccgcctagagtggagcatctcgccgctcaacggctgcgaggcggagcagaggcagcgggagacgggagagttgggttgcagggtggaggagcaacgagagagtcgagtgacggagcgagagaggaggaggagtcgtatctactccgccgttcatcggggggcggcgcgatggctgtggaatgtggatggctccaccgattgggtcgtttcctcggccggtcgggccttgggtttagtcgtttagtttctcttctgatctgttctcttttttttcgttcgtttgttttaaatttgatctttttatatctaatttttatctgaacatttcttaaaccacgcaaaatcttagtgatatatacgatgatagttatatatcaagttaccagcgaacagtactgccactacaaaacatcaaataatacttatgttatcttttttttaattacacattacatcgcagacactcacaacacacgcacactcacccctatgaaagcacgcacgcaaaccctacccctataagagcaagtacaatagcaggctattagctagctacaaacatattttaatgagataaacgataagagagaagagcagcaggctatagatttgtagccagctgcagcacggactctaagacgcaatatacgtatgacagatgggatcatatattaatagtatagtaagtaactattgtatgaattggctattagattgactatagatgaattggagctaatagtgggctatactattaaacttgctctaagcattttcgaagactgggccggcaaatcctagagattgacgaagtcaccactggcatctcactatcgacgggtacgtcgcctaccactgaaagcacaatgccgataaatcctagaaaattcgctcatcttcgttaaatgataacgatactaagggctagttagaatctccaaccaggtttaagcttttcgatacataaaataaaacaagataaaccattagcacttaaataataagatgagtattaattattataaactttcaaattagttttatttgatttttttcttaaagaaacttatgtataaaaagtttttcaaaaaaaaacaccagtttaaaaacatactaatgaaaatggtaatgttgaagttcgaagtaaaaaaaaaggaacgcatcctatcaaaacatgctaactgaaaacgataaagttagagtttggagttgaagaaagatcacatcctacgatgttgagccaaggctcggacctcggagtagtaccccggctcaccgtatgcagcacaagaccactaatgcattctctccattcaaaatatgagattatatgcccttccacttctctgtaaatataaagagaaaattccctatctagcataaaaaagttgttctttcctctatagcacctaagcttaaaaagttccctatctagacacttctaaaatttcccttccctatgtagcacttctgttagtttttacacttgacggtgctaactagcaagagaaaagacgattttgcccttctttagttttcaggcttgcccttacatgagcgttggtattttagacatgatttctcttgatttaacgtaacactgcaaatataacatgccgatccactcttttgaaaaataataataattatcctcttgtggtttcacttgtcgttagttaacttaagtaattaataaccaacatcatgttcaggcaagtctaaaaactaaagaagggcaaaactgtcttttctcctgctagttaacaccatgaagtgtaaaaactaacgaaagtgctatatagggaagggaaattttagaagtgcctagatagggaactttttaagtttagatgttatcgagggaagagcaactttttttatgctagatagggaattttctcaaatataaatgattttaggattagaaggtaggtatagagtagtacaatatatttttttctggtttatttctcattcatcaacttttgtacttatttacttatatactccctccgtttcgaaatgtttgacgccgttgactttttagcatatgtttgaccgctcgtcttattcaaaaaatttaagtaattattaattcttttcctatcatttgattcattgttaaatatatttttatgtaggcatataattttacatatttcataaaaatttttgaataagacgaa

SEQ ID NO: 63457 - DNA, 8042 bp, Oryza sativa
ggatagaatgggagagattagggtttggattcgaattcaaatttgatattcaaactcgagggtttagggatgtatcaggggaaactcaaggagaagtcatggaaaagattcaaaagaaatacttgggtatttgttctcgggaacatagggtggagtcaaggaaaggattcgaggcgggatttgaaaaattctggattcgtagaagtatttggcgaggattcaaaggaaggatttgaatttcagaatttgatttcggagactcgaattgtaaggggaatttggatgagggggaggattttgatttcgatgagagggaacaacgggattaaattgggatccttggcacaacttagactctcacgcaaagaacgaaaattttcgcaattaggattttgccgagttagtttttaacgactcacgaaaagcggagcgttacagatccacccccccttacaagaatctcgaccccgagattcgaaggtggaccacacacacgaaaccaaaaagggatcttcagacttcttcacaacttcagactctgctagtctttctttatctcgagaatgcatacttgccacaaaacggtctggtactctgactcacttagcattcttcatcttattgtggctctgctcttgcctgtggaacctgttcttctcctgctctttcaacctgctcgagattcacaacttttccatttgtttctacttgcacatggttcagacgaccttgtccaacgggcggtgaggtcaacgaggcagaaccactgtttggtggctttgaactttttggtccagatacgttgggaaggcttgttgtttgttgaacttgttttgacttgactttctgagggcacttcatcttggctttctgagggcaatcccacgaatagtgtcccatctcatggcaggtgaaacattcgactcctgccttatgaccacgtctttttgaaggtgtagggcatggtacggagttgcttccttcatggctattactgttgatcattgtggcttgctgaccaggttctgacatagtcgaaagagacgtagaaccggaaccatttgaatgctgagatgctttctgatagtattgtgttggcgagtttgtttttcgacacaaaccttcttttgcttggatccctagggacattactttgcgtctcttgtattcttgcatctttttcttttcttggatgtcttggcacatgtcacaggatgcttttgctcttttgtcatcagggaaggttggacgtactgcattaacattttgcaaattcgggcttccttggggatagaagggcatccttgaggtgctcatattagcttgtagtagtgcatccatatagggtttttgggggcagtgtctcatgtaatggccaatttcgtggcaaatgaagcatatgagtccgggaacgtgtctgatcttctttgatttgagggtgggggacttgggtaagttttggcaagattgcattgtctgacattgtgggacatcttgcatgtcaacttttgatggcaaggtctttcttttgtgacaacttccttctttaaccatgctattttcttgcgatacggatttattgattgagttctgaaggttggggcaattattagctcgaagtggggttttcatccctataatcatcacatttaagaattctttgttcttctctttatgggtatcagtgccttctactgattgtgttccttgtatttctgcggcctcatccttactcttgtctggattcaccttgggctgtggtagtagcagttgttgttgtatagaagccaaattttgagctatttcttgtagtatctaagtctgattggctagaatctgataaatatccattgagaagtgttgatttctagttgcaacttccttgtttggtccaggaacagtattatcagtcttggcaacttggttggtgacttgttcagctagttgatttggattttctgacaaagctaggtcttccttagaaccaaggtagttgcggacacaagtctgacaggttggttgaggcgccatctgcttcagagggactgagaactgaccaacacagaaaatagataagaaaagaaggaaaacaaaaacactacatcaaaacggttttcgaaatcacagaagacataggtggtgtgttccagccggtaacccaactggtctaacacctgaacacggactaccaaacaaaactcacacacgcactagttcaccacaactcctaccgagcgggtgacggttctaaggttagcctaccaacaagggcttaactaagactcctagaggcttgagcacacctttcttcaactgggcgtgaagacaggtttactctaggataaaagtcaaaacgaacgactagcttctacttttggacacaaaagatttttcgcaaaactagagctaaaggggacaacgacaccttagctttcacaaatatttttgtactcaaataatgtcttcctattaaggggtttcgatcctagggccaacctatgatctgataccatctctgtcacaccccaatctgataccgccgtacaacggcacctgacaggagcgtgtcgtagggaaaacggcgcgaaccacttcctacgaaactgcgatctcagtaccaatcccaggacatagtgctggcacccacggtgacaaatatgaatcatagcaatccttaaaataaatggaggacttatttaccttaacataggttgcagcttagacagcccgagaatacaaccgacgacgcggacgaggaaacaccaacagcagcagcagcagcggaaccaacggtctaacacccaacaccacaggcgacggctgggaaccaggacgaaacccaaatcttcacttcactttatcttcccttcagggtggaggaactatatatatatatttatatagagcaagggtgagtactttcgtactcagcaagtcacgggaacttaggtgtttaatgcaagcttggaagagaggcaaggttgttttgcaaatcttttgtttgaaatcattttgaaatcactaagtgatttatttctttctaagtttgggccgaaaagagacttgcgtctcgatttgactttaagagatgtttttcaacagctcatttggtaatgtaccgacctcccgggtcagatcattacttctcggctcccagagccattccacttgattaatcggctcccagagcctttttcaatttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggatatctcatgccacatagaaggatcaaaacctcacataaacataggccattttaggcattcacaaatcaaactccaaccaccttgatcggtaagtgagcaagcttctcgtccttgccttaccaggaacccagtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgtatcgcgagttttcacaattcattttattttcaaacacatcgacaccacatgtctagttttgaagacttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgtaaacaaaataataatgacttttcaattataggggcaattgatcaaagggtaacttgccttgctcaaggtcttcacgaagcttcacgaatcttcgagaaaacccgcgatcgacgaaaatccgataaccacaactatacgcaaacaatcgaaaacctaaacaaaagaccaaaagaaagatcctatttagactaattagtagtgccattaaatagatctcaatttacggaattattggaagtggaacggagtcaatcggagttgcgaattgggtgatatgaattttgaaagtttaattggagtttctggaataggagagatgatttatggaatttatagaaataatattctcaagaatattattgacagtcattgaatccgggaccaaggaaaatgattcatggaattttggaataaggaattgatttatggaacaagggtggaaaaggaaatcaaggagggatgtatactagacttgtttcggtggcattggtgcggcccaaaggctaacgcggctcggccgaaccaaatgggccggcgcgggcgcgaggaggcggcccatgagggcgcgcggggagagagggaggcccgtcggggtgggcgcggtccaccgcgcgggacccacatggcggtggttgggttcacggtggggagggtgcacgcggaggcgggcgctagggtttcggatgcgcgcggttcgggcgcggcgcgccgggtggacggatggcggcgggcccacgtgcagccgcacggcttgccgtggaccgcgcgcacgggagggaagacggagggaggaggcttactgggcgcgacttgacccagtcaagcgggcccagggctgaggtggctgccacgtggtcggccacgcgggcaggggcgaaaggggaggaggaggaggaggaggaggcgcccgggatcggacggccgacgacgcgcgaggcgttccggcgagcggcggcgaaccggagcgagcggccaccgccggcagctagaggaggtcagggggaatctgtttaacggcacggatttgagaggggaggtacgacggtggctagcggcggcgaccaagctcgccggcacgccgacgtggccgcgcgcgagaagagctaagggtgcgcgggctcgggcttagccgaaccggtatggtgttgcgacgcgcacgcggtgacgcgggacctgatggtcaccggcggcgcacgcacggcggcgttaggcggcggcggaagcggcgacacggcgcggagacaaaggagaaggccgacggccttggggcagccagggggaggtcatggggatccccgggagcgtggcggcgagaggaatcgacgcgagaggagccgacgacggtggattgcggcggcggcaatcaccggagatcaaaaggggaaaacacgacgagacgacgagggttcgattcaaaggggtgggagcatctccggggttcaaggaatccgtttccggcgtcggattggacggagcggcactgagattggctggcgacgagaggcggcctccgggacagagcaagagcgcgtggcgagctatggcgagcggcggcgggcgcggcgcatcgcgcggcaggaggaggattatggtggggagctcaccaatcgaagaggaggcagcgttggcggcgcggtcggtgtcacggcgaggtgttcgcgacgccgaggcggcacggcaccgagagggcgcagccggggaagaagggagggagaggtggtgcccggagctcctcgtcacgcgtctacgcacgcaccggctcctccggtgcttcggcaacggcgagagcgggacgagcagcaacaaggcggcgacggtggttcggcggcaatggcgcggtgggtgtgaggactgaggcgagtgaaaacgagagaggaaggggtttggggtggtttggttttatagcggaggcgaggtcggtttggggaggggagaactgaccttggcggtcaagtgctcggctggcggtagcggcggtttcgtgggcggtgcgaaagcggcgacggcgtggatgcgttgagtggcgaaggcggtggatcgagcggcggaaatcgaaccgctggagcgcgggctggcgcggtcggtcaagcggcgcagaggtggtgacgccggcagtggtcgggaaagggaaaaagaaggggaaaaaggggcttggtcccttgccataatgaggggagggagagtgaggaggaggaggagagggagagtagctgcttctcccactcttggacgggtgcggcgtggagcggcgggggggccatggatgacgtcgacgatgacggcggcggtcagtttggcatggagcgggggcaaggcggcagcgcatggcgttggcggcgaccggccggtcggccacctcgcgaggcgcgcgcgggaatgggcgaaggcggtgggggttttgggcggcgacggcgggaaatcggcgccgaggagagggagatcgagcgagagagagagagagaaacatagagagagagagaggaggaagacgagagagcgagagaaacagagagagcgagcgacggctctctctcggctcgcatgcgtgcaacgcacgagcgaggggggggagatgatgggctgggaggggagatgggccgggggaggagaatcggtccatccaaaaaaaactcagggaggtaaagtagacttttacagagaaaactgatttggatagaattggagatttagggtttggattcgaattcaaatttgatattcaaactcgagggtttagggatgtatcaggggaaactcaaggagaagtcatggaaaagattcaaaaggaatacttgggtatttgttctcgggaacatagggtggagtcaaggaaaggattcgaggcgggatttgaaaaattctggattcgtagaagtatttggcgaggattcaaaggaaggatttgaatttcagaatttgatttcagagactcgaattgtaaggggaatttggatgagggggaggattttgatttcgatgagagggaacaacgggattaaattgggatccttggcacaacttagactctcacacaaagaacgaaaattttcgcaattaggattttgccgagttagtttttaacgactcacgaaaagcggagcgttacataaatcgtgaatttgcatatttgatctgaagttgcgtttcttcggattgtatagcgcccgtctctcctctcgtctccttgttcttttcgctagatgagccgatgtcgcgccgttgtcacctgaagcatcgatgtttccctgctctcatttatctttcttccatgtaagcaaatttgtctaggtgacaccagagagagacggtaaataatagtaaataatagcctttgtacattcccttatgtagttgtgcagtctatttttggtgtgcgagttcggagttcgaagtgttctgaagaatctcttcttgtaatttctagaaatggcattgaggaaattaccagtcttggcttaaaaacaagtctgtctcgtcattcaccgtgcttatttaggacttgttcaactcctgtagaaattctcgaaaattcctcgactttaaatggagccttaccattttttagcagatgcaacaactattatactcctacctgatgactgatgaggactgtgcagcgatcgatatgtgcatgtggccatgtccgaagctaattaaaggacggaaggaccacaagttggtgtataataatggagagggcattgaatcattgtttcaatatccccatcagataatattcaataactcctatggtgacgtcaagcatcaatacatgaaggttacttgttaccaccatcagacaagcatataattgattgctctgatcaagcgatagcaaaacaaaatacaaaccagaacagtctc

SEQ ID NO: 63458 - DNA, 2385 bp, Oryza sativa
aattaaaaaaaaacgaaaaaacgatgttgttgttgccgctcgccacgaccgccggacgcggctgccgccgcccgccggccaccgccggccgcggccttgacacccaccggcccgccggatgagaaggaaagagggggaggaggtggaggagaggggatgaggaagagagttagagaggagagatctgtggagagggggagaaattcgatccgctaagttgtaattgtggaggagaggataagggatagggattatatactacgtgttcaattttaatcacggttagtattaccaaccgggactaaagatctatctagaagatctttagtccttggtgatctttagtcccggttattgacaccaaccgggactaaagattctcggccccctgacatgcatctgataggggatgaactgggactaaagatcatctttagtcccgtactaaggatcaaaatttttataaccgggactaaaaataatctttagtcccggttctttttggaactgggactattgtggattttgccagaccgaccaaagatggttcctccaccagtgttacatactaattacatattaagtggtgtgtaagtgggatgtaactactgtgtaaatttgtaaatatataaataactacccgctgcatacacatacatgcaagtgtgaactcagaaaagcagcgggcagcatatccaattgccataaaactgactgctatggagccaaaaaactggcgacaaaaatatagtaaaaccgtaatttattagtcccacaaactcactctacttgcacaaaatgatacttatcacacatcgtacccaatattctcaagtgcaacaagacaagctttgtacgatagcagcagcagagatctgtgattggcagctgctagctcccaagatcctgttgcagcgacagagagatccacaaactcactctacttgcaccacatgatacttatcacaattcacacatcgtaccaaacattctcaagtgcaccaagacaagctttgtacaatagcagcagcagcagcagagatcagtgattaggctttaaatcactgatcaagatgagtggcgcaacggcggactgggcatggtggctcggcctcgtcgccggcgccgtcccgctgctcgccctcgccgtctggcactgcaccgacgccttccacagcgccgccttcgcgttccgccgccgcgggacacgcgcgaggctccccccgggccacatgggcctgccgttcgtcggcgagaccctcgccctgatctggtacttcaacctcgcccgccgccccgacgccttcatcgaggccaagaggcggcgctactgctacggcgacggcgacgacgacggcggcatctaccggacgcacctgttcggctcgcccgcggtgctcgtctgctcgccggcgtccaacgggttcgtgttccggtcggcgccgcccggcagcttcggcgtcgggtggccggtgccggagctcgtcggcgcctcgtccctggtgaacgtgcacggcggccggcacgccaggctgcgcaggttcgtcctcggcgccatcaacaggccgggctcactccggaccatcgcgcgggtggcgcagccgcgcgtggcggcggcgctgcggtcgtgggcggccaagggcaccatcaccgccgccaccgagatgaagaatgtaaggcgccgtcttaatttgtcaactgagaattcactgggtttgtgtaggtgtagcacctactagtatttaaagaaaagattttacaactacatgcaaattatcatgatttttttaaaaaatatggatatctatcgcactacaaaatttcaatttaaaatatagctcctgtaaagagaaacgaagaataaaaatcccaacaagtagtaaaatgaggcctgttagtagtttagggattaagttctccggtcaaatagttataaaaactacaattaacaatttccaggataaaaaaatcttagagctccactacagtgctctctactagtagtagaaaacaatctaaaccattgatcttattttatcgaatggtttaaatctatttataccgccatcctagtaacggcagtaaaaatgtggagagacattattgaaaaaaataggtgctggaggggtataatatcatttagctttgactaaactcttttttctttctttttttggcttttttgatggaatatgagcgatatcaacccaatgtaggaccacataacaatttacctgaaaaaataaataacaaagttacccctaatcactgtattaataaattattgatttacccttaaatagtactactagtattatactaccattagagagcaccagatcattgctcaaaatcataaatacatctcgttcatctcctatgaac

SEQ ID NO: 63459 - DNA, 8715 bp, Oryza sativa
cctaaatctactttacaatcttatcaaactaggactttaggccgttccacaatatacagggaaacgtaatacccaagtcatgatccgttacatattatatagatataagttatcccctatagctagtcggataaccatgccgtgtgggtatggggtacccataatctcgacaataccaaaagtgttacttcatattatcatgattttcatgcttgtttattacgttgtggcttagatgaatgcgaagaagctacagaattgaggtttttacgtgggcataacaaagaaattcaggacatgcttgcttgtgaaaaatatagatctctttctcatttgttacaacttgcttgcaatgctgaaagtaaaatagaggaggatatgaaaaagaagcacgctatgtctttgcctcctattactaaccatttgcaggaagtgcataatcatgaaaatgaggaaagagacatgaaagagccgctaatcccattgttcacactcgaattcgatgcaccttcatcatctaaagagatcatcgaaggtaaactaaatggtgctgaaattaatcaaggtgagtgtgttgttaatgaactaaatttgtccacttttcatgctatagtagagcaacccttagtggaacaaactgttgagattcctttgtcacaagttgatttgtttgttgttccttgtgataaagaagagttgtgtgataatacttcacttatatcaacgcctatttctaatgttggttctttacgtgatgattttaagcatgttattcacattgctaatgaagtagaggaacgtgaattgacatcttttttaaatactttgggctatgttcactttgatgatttttatgagcttgataatttgaaggagaaattatttgctaactatgatttgccatgtccaaccaatgttatatttcacatctttggcgaatataataatcttggaatatattttttgcatagggtttacatctgctcggatttataacttcctgtacatgtggataaaatatgcaagttagagagaaatgttattgctaaccaaattgtctctagtttgccttgttttgataggaagaaacaggttgttgtaaatggactacgtaaagagcaccatatagaaaaaccgagaacggtttttcgtgaagaaggggaggatgatgtgaccatggctaccacggatggaaccattgctcatatcatagatgaacaagaagatatcgagatcaagtcctacaagtgctggaatccgattcggccacctgctacactgctgacttcaaacggctaccgaatctgcatacgacctccgtttttggcccacgagtacttgatggaaagctctcggagtcctctttccaacggatctggcctcatcaccagactccatctcgtttggccgcaaacacaaaaacaaggtgttgtgttacctgtcatgggcatttgggcttgtaacttcgtttgggacaccggcccaagtggggcccatgtggggtgtgccccaaccaggtggagcatgaccctagagtccacttgttcgtcctcacacctttataaatagttacgtacccctttacagtttcttgggttttgatagattaaagtttagccattgctacttgcttgcagcgcgcgtgtcggctagaccgtccgtctgcttgttcttcggaaccccaacttatcatttgtattaaattcctatttgcaatatcagattgcttttatcttgttattgcttgtttcttttatttgcttgcagaagtagggtttatctacaccggcaagatcaataacccatggagaggtgtatcgatcgctaaggcgcaacacaacgtctcgtacggttgcagtcggatcgtcaacgtttctcccaaatcatagttatcaccaactcaccgaaaagtcaggccaaacaacagccttgagtgtcacgagtggaactcagggttcatcatatattctcttgtaaaataaattatgtcatgttgtttgaccttaaaactctccggttttaaaatttttgatgtcttagacaagttttagatcaaacttttatatctttgagtatcgataactttataaatattcagtttaagggcactagaacaacatatatatttgtcttgcaaaatactataataaagtaaaatgtatttatttattgtatatattataatagaaatacatagtgaaacacatattttataaagggaaaatcctgaattacacccttgagatattgggtcaatatgaattaccccctcaaactggaaaaccatatatctttcaccctcaactattagccagataaattacccccggactcaaaccggactggttgtggtcctatgtggcagaccagtcagcgatctttttttaatcaatgagccccacctatcaatctctcaccctctttcttccccctcacctctctatctctctctactctctctctctctctctcttccccctcaatcacctcaaggacagcagcggcatgcaactcggcgcgtccatggtcgcaggcatgtgacttgcgacttgttgggggcggcgaaagggattcccgcagccaccggcactcaggtcagctcgaggccacggagctcgggaggccagcagttgccgacgcgcagctcgtcgagggctgctcgtagccaccggcgctcgggttggtggagagggctgcaaagcgagccgaggacggcggtaggcagagctcggggcgatggagagggcgcccatagccgccatctctgctgccgccagcgcgcgtctcgcctacgccacaggtgtgcgggactcctccgggctctgacgcgagagagagagagggggtgagagggacatagagatatctgacagatgggcccatcttatttttaataaaagaattgctgactggactgccacgtaggatcaatacgcttgcaaagctgctcgggggatttatttttatccagtattgatagttgagggtgaaaaatatcttattttcgggtctagcgcggtaattcgtacttaccaaatagttcaaggatgtaattcggacttccctttaaaaattgtatcatggtataaaacgttaagaattatggaacaacaggagttacagatttgtacgattaggacctgtttgggaagcttaaaattctaagaactagctagttgatattcagcttttgagaatatggaaaagctgggtttctcagcttctagcttctagttcattttctagattctacaactatacagcttttcaaaatctagaccaaaaactgaactgttttgggagcttctgattctgggagaagttgtagcaggtagagcctcccccaattagacgctttagattgtcccagtagtgtaggattctgattctggaagaagttgtagcaggtagagcctcccccaattggacgctttagattgtcccagtagtctaggattcctagatctagctactggtatgtatggatcaaagcaaaatttgtttgttcatttttgctccgtaatgcgtggaccaatatttcctaagaaaatcacatgagcgactttaatttgtgatcacaaaatccttttaacgtacgtttgcattttagatttgaaccaaaaacttatcttagatgtgtagacgtcattaattgctgattacctgatcattttcgtatgctgaactagatgatactccgccgcgttgctgcggaacattgtaatagttaaataaactggtatagtaattatgagaaactgtaacaacttacatatgaaaagaaaagaaattattgtgccttaggagtactatgtttgtgatgattttcttatgtaaatccaacaaaaatggcaataaataagaggtggtatggttaggaccttccagatgtggtagtccaactgttgtgttagggacaggcagaacatgatggccctataagtttagtttagatagtaattagaaggagaaaccgaagaacctgttggtaggttgtttacgtttcatgagttaaaaatgagaagattaggaagattagcattggagttctgcttctgcaggctaaaaattttatgggagagaatgttgtttcgatgataaatatttggaatcaaacagcaactgaagtagtacatatggttcttttcttaacacttattggaagcatgaacgaaaataagtgtaaaagccggaaaatattgtcacctttgtgaatagtgtgcaattgtgcatccatgtgtaaatatgcaaaaaatgcatcttgaaaattgaacagttgctcagacctagtcaaatagcacacagacagaaaataaaaagctattaatttgtcatgtagcacaagtttgatagatgcacataaatacatattacgatagaaaaaaattgttgtgctgaatcatactatattttgcatcaaatattagtagcaacgtaggagtatacagactaaaacttataatcctgaggctttatgttgcaaaggaactattggtaaatatcccccaccctagaatgatgcatgaaaactgatttagggagagataacattgctcacatcatctgttaccttaatggcttaacgtggttccgtaggctacatcattggacaactcattcaaaagtcgtttgctgaagatcacctgatggctgatgctacctgtctacctcaaatgcagtatatgtgtaggcattttatcaatcagaggcacatattggttggagaaatttacctcggaacagattcactcgtttctgcagcagcgggagcaacggacggagagaaactcctcaattttgatcgatatatccagggactgaagatactccaggaaacaagaacacaaattgcctgtggcatccgtcactcagatcagagtcgacccaatagaaatacttacggcaagaaaagaacctcctgatttaagaaggctatagctgccgcattagatgcaggcattttcttggagtgaagacatggggcgacagtttgaagagagggaaacgaactggatgaaataattgatttggattggattgcatttacgagagacaatgtgggtggctgatggttgaatgccaggggatcgcggggctaggtgcatgggcgtatcgattgggcggggaaggcgaaccggccgacgctaggagggggagacgaagcggagcccatgcggcacggaggcggacaacatgctggcgccggtacgggggagcgcgttgagtgagatggagagaatgcaacggcgatgcacgcgatggggataggcgagcgccatgcgggagatggataggatgtggcggcgatagagatgtggtgggggcggcggagcaagatgcggaagagggtgccgatgcgggtgtgcgactaagcgagagagatgcgcggtggccggtggggtggcgatgtgatgcgggagagggagccgatgtgggtgcacgagagagatgcgatgggggtggcgatgcgcgagcactatgcgggagaaggaaccgacgcggatgcgggcgtgtggacggatcagcagagcgattagattggatcgaacggctaggaaaaaaagatgacgtggaagcacaggaaccagagaattactaatagtggggatgatttgtagaggtgtataggattactgtaccgtatcatttggaatagacagctcaatgtacagattaatcgtcatcactgggatttcactcgtatatgaaaatcagcataagttactccctcagttttttaatagatgacgatgttcacttctgaacacatttgaccattcgtcttattcaaaaattttatgcaaatatataagatataaatcatgcttaaaataaaacaactcacaacaaaataaattataattacgtaaatttttgaataagacaaatagtcaaacgtgtgataaaaatcaatggcatcatctattaaaaaacggagatagtatttatatactatagacacccatttgcattatcgatagcacccacacgttgtataacatatgtaccctggtggaataattagccgtaaaatacaagcacccatagtctaggatttgaactcgagtggtgatctggttccaccacaagaaaacctaaccagtttgtaaaatcaagagttataggtgtatatatttttaaagacactttaaatgttgcctaaaatatttttaatgtagagacactttagagatatttttattcatattttctcaaatttatcttgtaaatgcatgtttttttcaacactttaaaatttgactaatatgtaaaggcatattctcgaggtatttcaattcctgtagaggtactttttggaattttaatcgaccctaagtaactagatatgacataagagtggtatgattagagcaagaggcatcgagttcaaggatcaccaattgtatggaaagagatagtattttttttccttggtttgctatggttgtggctttttttaatgtcttagaaaatacctttaatgtattttttattgactattgcatctagaaaaaaaataaaaaaaacacgagtgatggagggcaatggaatggtaaaaatctaaacattctatataaaagagtaaattgcgctagcaagcaagttcaacaacatgcaaattactctttttggtataatgacttgggtagtccgtatggacctgtccaaaacaatctgtggagattatgggtaccctaacccatacggcatggttatccgactagttttaggggatagcttatatctatggaatatgtaacagatcataacttgggtattacgtttacttttatattatggagcggcctaaagtcttgatttgataatattgtaccgataccgtattggttaaggtttctatcttgtaatcctgctccccatcctatataaggtgggcaggaggccctctagggggcatgagacacaactagatcgtcagatctatactacacccggcggattcaaatccccaaacaggagtagggtattagggcctgaacctgtctaaatcctttgtctccgcatccatccacttctaggtctcgtgcgctacccccttttattattgccgaattcatgtttcgacagatgacgcgccaggtaggggtgcgtcgagtttccgtcggtaaagtgcgatggaatcaatcatcaacatgaccggatcgtacacgcgcgtcatccaccgtcgcagtgggctgcatcaccgccgcaaggaggacggagggcgcgtctcatcagagcgttgagcgcctgccagatcgagatatcgcgccgatcggtcgtgtgctgtttggacttccggatcggcgagcagctacacgtgacctgcagcaaccagccgccggcacatgatctccgtcgacgtcgcttggtctaattcaatccggccgaccacctcgatcaatctacatccatgcagctgtatagtccacgcgtcagatcgatccgcatgtgcatcacatgacgagggccaagcagggagcaagaatatggcatatgcatctaatcttctttctgctaattagattgattattaaatcagattgattgatggtctttttcttctttgctctttcttctggtgtatgcatgttgccggcgaccaaggtgttcaattaggcatggcataattaagccgtcgcaacgcatggcgaagccgtccactctctgagcgaattcgagtcgtgggctggacaggcatgcacgaaagttcacatgacaagatcgctggagatgtacaggatgtgtcgattcaaccgccatgcatggattaattaatccagccatacatgcattcaatcgctgagatttatacatttaatttgctgatattaatcagatttatttgatttgtttccatgtgaatcgcggagcttcaccaatggacgtcctgtggctaccacgggtcacacatgggaacagccggcctatggcttgtcaggagagaacacatgcagaacatgccgagctatggatcgcttgattagtcctagcgacacagtgcaagaccgacaaccaattttctccgtctcggagtcagtttgatcgaggagatcaatctcatttctgctgtctacatgtaataccgcggcactattgctaccgactggtgtcctcgcttatacggttggttggtcacactaccgtttatgagcgtccacgacttcaccgaccggctggacttcgccgccgccgactggtgtttccgcctgcacggctggcctattatgccaccgttgttgggcgtctacgacttcaccgccggcctgcctccgtcgccgccgactggtgtcctttcctatacggttggttggtcacaccaccgttcatgggcgtccacgactgcaccgaccggttggacttcgccaccgccgactggtggttccgcctgcacggctggcctattatgccaccgttgttgggcgtctacgacttcatcaccggcctgcctccgtcgccaccgactggtgtccttgcctatacgcctattatgccgccgttgttgggcgtctacgacttcaccgccggcctgcctccatcactgccgactagtgttttcgcctatacggttgacggactccgccgccgttgatgggcctcgtcatctacaccaccggcttccgactggtgtttccactgttattgatggacaactttgttcccacattggtcacctctgccatcatctaggggaatattacaaagctaagtcat

SEQ ID NO: 63460 - DNA, 12732 bp, Oryza sativa
ccctcccccccccccccccgcgcgcatggtccgcggtgagccatgaggctgcgcgtgggcctgccgcatctgcgtccttcacgaaccacgcgcatgcgccacgcctcccctccccaaaccctagcacgccccgcgtgcacctcgctcacggtgaaccgagtcgctgacaagcgggtcccacccgggaccacgcgggatggacccggcccatcggttctctctctctctcctccccgcccgcgcgcgcgctttggaccgccttcttgggccggccgtcccattaagctcagccgagccgcgcctttttctctcgggacgcgccctagccgcccgagggaagtctatttctcctccctctttctttttctttttcaaaagggtttaattaaatccttttcctttagatcaaaaatccaataatcttagaaattcaatatcttctcaaccgtatgaccgtttgactccgttcaacttccaaaattcctcaaatctcgagatatatctaatggcacgcttagaggtcaataatagggctttattttcgccgtttgttgagttgtcccgtttcgcgtgtagtttcggagcccgaagacccgcagtgcgagaatttcgaggatcaagcccaagatctcgagcaaggcaagtcacctttgatcatcttgcacctataatttaaatctaagtatttcttttctgtaaatattgcatgaataggattaacacgagtatttcagccgtggcttgcgagatagccaccggccccaatcctaattgctgcaattaccctccttcaattattgaacacttaaacctcctttgtcaattgttgtgcttcgatgcacgggcctccaggtacgcgcatcggaacaccttccctcaaatttaaaatatccaatgatgggtaaaacttggggctttacaaaagacttgaaaaacccgacacttgggtcggtgcttgcgaactaaatgaatttccaaaaccgcagaccggggaacgtaccgagagtacggtttcccgctcttgcacttaaggaccgttttccttggaatttcatctgaacataagacaagtgtgaccacatgggtgaaatgggacacccctgtctgagtaattagctaatcggggaaaccatgatgccaagagacatgtggagtcaacagggtggtgtcggggagaacccccgggcttcctggcacagtatggtctgggacctaacctgttgttggtctgggacccctcttgttggcatatggtaaacctgtgttggctttcgaaatgccttgtcatgaaagcctcaaggtctccagacgtggccgttctgcacgggctgggttatccgggttagtaatgtcgtgtgggtaaagtgtaccccctctgcagaggttattaaactgttcgaacagccgtacccacggtcatgggcggatgtgaggtgattcctagcgtagttttgtttgactactgctttgtgaaattgctgttgtggaatgggatcgatgtttggaaaatctgcggctgatgggatcagccaggcccgggtggccgtttgaaagctgttggccgggtgccaaccttgaatcaattcaaagactgatatattgcacatactccgaccagacgagacgcactgtctcatccgtgtcgtttgagaagcactcacttagctaattcgaaaaggagtttaaataaaatcaattgcaaaaacaacagcctttcccttgaagcctgcattaaacacctaattcccatggcttgctgagtactcctgtactcacccttgctctatataaataatcccccccagttgctgaagaagatgaagtggatcctgctgatgaggagttcttccaggagcaagtcggctacgatgagttttagggtttcggcctagttcccaagtcacgcctatgatgattggtccaagtcttggcttccgctttccccttttgtaatgcagttgtgagctcgggatctgtccgcagcccaacatgactgtactcctactctgtaataaagagacctctgttgctatgatattctgtcttcctgtgataccagcattgtttcctgggactggtatcgatgaacaggttaatttggagcgtcacgggctagttccgttcggggctagttcgggacgtgacaaaagatggtatcagagcacaggcttggccctagggcgaaacccgacgtttaggacgaccctaaggatactaagttctacttgcgaaaagctaaggcttccttttttgctttctttattttcaatagtttattgctaaaatggttacttatctttcctctccctttcaaaattgtagatggcagtgaacgccagcttcagttcccacggttttggtgagggtcaccacgtcgctcagcttcgtgacctcgcccgcttccttggcttctcgtgtcctgagtacacggggtactctgtggaccgtgttccctctcgttatgagctttcggtgtacctttaccctcgtggaggtatacacggggctggccttcgcccacaccacttcactgtggccaggcccactctccagatcgcgtaccaggacctctcctagactgcacttcgtcgcttggcccacgactacagccaccgcctcgggggctctgcctttcggcagctcctgcgccttccttctggccgcactgacactaggtacccttgcccgtacagcgagtctcagcctgtgctgactcgcatggttgagctctctgaggctcaggccacccagcacgaccttctccttgaggcttaccgctcccttgctcgccgctacgctgctttggaggcccgcctggccgaggagggtgtcacctcagttgacactgcctcttgggacttaggtcgcctctgccacgccagccacctgtcttcccacagctcccgcggctctgttcgcactcccagtggcccgcgcacccccagttcgcgtgtgccgtactccccagtgcactctccctaccctcacccagttagcccttcctacactcctggtcacaccccagttgcttcctcctgccgtggcccacgctttatccgcactgtgcggaagcgtgttgttggttcttccactgtgttccgctttgaccacccagctcgcccaccgccagcagcccgtgctgctgccggccctcgacaagttccgccgatctcttcgcgtcagccgatcgacgtctcttcgactgaggagccgactacaggaggtagccaggcaggagaggagtagaggaggcagtcttcaggagccgtccgtatgataggcccttttgttccgctgccaactcttttggagtcgtggcgaggtagtgcgtgcgtgtgtttgatgcgggtgttgtttggtagtcaggttctcctaggtggtgtgcgtacagtcaagctcggcgtagctctgtgacttgtccacacccgttgtatcaggtgtctttatgatttgagaaacccagtttatgcctagtgtgtgctatctgagttattatttaccttgcttcttgtcttcctaagtgcttatccgattcttaccttgccctcttccgagagtttagatggctagccgtccccgccgtgctgctcgtgcaccagcccatttcggttttgaggaaggtagagttgagccagaagcaaatcatgagtcagctaatgagcagtctcaccacagcaaccgttcgcaccatactgcttcccgcaatgcagaagttgagcaaccccaccgcagcaaccgctcgcaccgcacagtttcccgtaatgcagaagtggaacagtctcaccgctctccccgcgctgccattcacaattctagggaagaacgcattccttccccaccccatgttgagaacaacatgcagcacttgatggcagttcagactcaaatcttgcaaggtttagccacagccatagccggtattcagcacaacgcgcatggaaatggccatccccacacgggcaacaacagatctaagctgacagactttctaaggtctcgtccgccagagttctcccagaccgtcgagcccgttgaggctgacgattggctgaaagatgttgagagaaaactcaacttagtgcagtgtactcctgttgagaagacgctctacgcctctcaccagctaagaggacctgctgcagattggtgggagaattattgcaacgcacaccccgaacccactaacattccatgggatgaattcgctgcagctttccgtgcagctcatgtgcctgaaagcactattgacatgaagaaggaagaatttaacaggctcaagcaaggcaataccagtgtcaatgagtatatgagtcagttcaacaagttggctcgatacgctcctgaggaagtggacacagacaagaagaagatcaggaagttcttgaaaggagtcacagttggaatgagactctagttgcttgctcatgacttccccactttttagcacatgatcaacaagagacttctacttgaggatgccagaaaagaggctaccgaggagtataagaaacgcaagtctacccatcagggaaattcttcccgaggggaacctcgccctcgctttggacaacccatgcaatatcaccagtcagtcactcaggctaaccgccagccaagctatgcccctcgtcctcagatgaatcgtctggcacctcagccgcagcagcgtgccccaagtggcaataccgcgccaaacagtgttacctctttcaagtcaccgccaggactatcagcagttcagtgtttccggtgcaaccagatgggtcactatgccagacagtgccctcagaatcttaccaactccaactcagggcataccaatggcagcaccgccagaactcctactcctgcagcagctcagtcccgtcctagcacgcaggcaagtggacaaggttcccgtgcttccaacaactttggtcgagaccgagtgaaccacattcaagccgagaccgctcaggacgctccagacgttgttatgggtatgttctctgtcaactccgcacccgcaatagttctgtttgattcaggagcatcccattctttcatatcgcaagcttttgtgaaaagaaatggttggaaaacccaaaatttgcgagtaccaatgatagtacattcccctggaagggatataagggcaactaaaatatgctcggaagttaaccttagaattgaggaagttgacttcctagccaaaccgatagtcctagactcgcaaagcttggacatcattcttgggatggattggttggctaagcacaaaggacagatagattgtgccgaaaggtccatcaccttgcaaggacctggaggaaagcaagttcgctttacccccaacactcttactgcaagtcggtctatcctaaccagtttgcaagccacttctttggaatcggtacccatagtctgtgaatatcccgacgtatttccaaaagaattaacggaaatgccaccaaaccgagagattgagttcgccatagaactggcactaggcaccgcaccaattgcaaaaagtccctaccgaatggcagctaatgaattagcagaagtcaaaaagcagatcgaagaattggagagtaaaggttatgtgcgacctagctcatccccttggggagccccagtgcttctggttaagaaaaaggatggctctgagagaatggtaattgactatagagccctgaatgaagtaactaaaaagaacaagtacccgttgccacggattgacgatctgttcgatcaactttaaggagcaaaagttttctctaaaattgacctaagatcagtttaccaccagttgaaaatcagatatgaagatatcccgaagaccgctttctcaacgcgctatgggctgtatgagttcacagtgatgtccttcggactcaccaatgctccagcattcttcatgaacctgatgaacaaaatcttcatggagtacctggaccagtttgttgtggtattcatcgatgacatcctgatatactccaagaatgaggaagaacatgttgaacacctgaggctgataatggagaagctaagagatcatcaattgttcgctaagttctcaaaatgcgaattctggctggaccgagtagcattccttggtcacgtgatctcctctaacggtgtcgaagtagatcccagcaaggttgaagctgtccttgcttggtatcctcccaagaatgagtcagagatccgcagtttccttggcctagctggttactatcgaagattcatcgaagggttctctaagctagccagacctatgaccgagctgttaaagaaggaaaagaagtttgaatggtcagcagcctgtgaagacagctttcaagaaatgaagaaaagattgaccactgccccagttctcaccttgccagatatccgaaaagatttcgaaatcttctgtgatgcatcaagacaaggcttaggatgtgtcctaatgcaagagcgaaaggttgtggcctacgcatccaggcagcttaggcctcacgaagtcaactatcccacccatgatctcgagttggcagccgtggttcatgctcttaagatctggaggcactatttaatcgggaacagatgtgaagtatacaccgatcacaaaagtcttaagtacatcttcactcagaccgagttaaatatgaggcagagaagatggttggaactaatcaaggattacgatcttggaattcattaccatcccggtaaagctaatgtggtcgctgatacgctaagtcgcaagacctattgcaatgcagctcaaatatggccagaccaagatcgcctgtgcagagaattggagaagttaaggctgaccgtggtgcagtcaggtgtccctgccagcttgacagtgcagcctaccctagaatcgcaaatccgggaagctcagaaagatgatgaagggataaaagagctaataaaaagaatacagaagatgaaggacaccgatttctccatagacgatcaaggcacagtttggtgcggtccacgcatctgtgtaccggccaagaaggagttaagagacctcattttaaaagaagctcatgagtccgcctactccatctatccaggaagtacgaagatgtaccaggatatcaaggcatatttctggtgggttggaatgaagcgagatgtcgcagaatacgtagccctttgtgacatttgccagagagtcaaggcagagcatcagaggccagctggtctgctgcaacccctaccgattcccgagtggaaatgggaagagatcggaatggatttcataaccggtttgccaagaacccctagcgggtacgactccatctgggtaatcgtggatcgactcacgaaatcggcacatttcgtgccagcgaaaaccacctttgatggaaagaaactggcagaactctacatgacccatgtcgtgtgtcgatttggttgtcccaagaagattgtgtcggatcgaggcactcagttcacctcaaggttctggaagcagttgcatgaagctctcggaaccgatctaaattttagtacagcttaccatccgtagaccgatggtcagacagaaagagtaaatcagatcctagaagacatgctttgtgcgtgtgccctggatttcgaaggcacttgggatcgttgtttgctgtatgctgagttctcatacaacaacagttatcaggccagcattcagatgtcgccgaatgaggcaatgttcggaagaaagtgccgcactcccttgtgctggaataaggttggcgaagcactggtgttcggtcctgacatactcaaggcagcagaagaacaagttaagctgatccgacaatgtttaaagacaactcagaaccgtcagaagaattacgctgacaatcggaggcgtgaccttgagtttgaaaaaggagatcttgtgtacttgcgggtatcacctctccgtggaatgaggaggtttgggatgtccggcaagttagcaccccgctacatcggcccctacctcataaccgccagacgtggtgtcacgccccgaactagccccgagcggaactagcccgtgacgctccaaattaacctgttaatcgataccagtcccaggaaatagtgctggtatcacaggaagacagaatatcacagcaacagaggtctctttattatagagtaggggtacagtcatgttgggctgcggacagatcccgagctcacaactgcattacaaaagggaagcggaagccaagacttggaccaaatatcacaggcgcgacttgggaactaggccgaaaccctaaaactcatcgtagccggcttgctcctggaagaactcctcgtcagcgggatccgcttcatcttcttcagcaactgggagggggattatttatatagagcaatggtgagtacgggagtactcagcaagccatgggaaataagtgtttaatgcaggcttcaaggaaaggctgttgtttttgcaattgattttatttaaactcttttctgaaacaactaagtgagtgcttctcaaacgacacggatgagacagtgcatctcgtccggtcggagtatgtgcaaggtatcagtcttttgaattggtcaaggttggcacccggccaacggcttttaaacggccacccgggcctggctgatcccatcagccgcaggttttccaaacatcgaacccaaaccacatcagcaaatttcacaaaacagtagtcaaacaaaactacgctaggaatcacctcacatccgcccatgaccgtgggcacggctgttcgaacagtttaataacctctgcagagggggtacactttacccacacgacattactaacccggatcatccagcccgtgcagaatggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttgaatccacatgtctcttggcatcatggctccccccgtttagctagttactcagccaggggtgtcccattccacccatgtggtcgcacttgtcttatgttcggatgaaattccaaggaaacggtccttaagtgcaagagcgggaaaccgtacacccggtacgttccccggtccgtgattttggaaattcatttagttcgtaagcaccgacccaggtgtcgggttttccaagtcttttgtaaaacccaagttttacccaaggtgtttctcagtttttaagtttgaaggcgaccgtcgatactcgtgcagagtgcacgattactgaggcgcaactaggtggttacaagggaacatgatataacgattaacaaaggaaggatcagatgcaataagctaggtaggcccatcggtctgccttgcagacggggcaatcctatcaatgcataatattttgcaagcaatataattaagttcaaatataggctcaatatgttcaaaggtggcttgccttgctcgagatcttgagcttgatcctcgaaatccacgcactgcgggtcttcgggctccgaaactacacgtgaaacgggacaactcaacaaacggcgaaaataaagccctattattaacctctaagcgtaccattagatagatctcgagatttgaggaattttggaagttgaacggagtcaaacggtcatacggttgagaagatattgaatttctaagattattggatttttgatctaaaggaaaaggatttaattaaacccttttggaaaagaaaaagaaagagggaggggaaatagacttccctcgggcggctagggcgcggcccgagagaaaaaggcgcggctcggccgagcttaatgggccagccggcccgagaaggcggcccaaggcacgcgcgagaggggaggagagagggagccgatgggccgggtccttctcgcgtggtcccaagtgggacccgcttgtcggtggctcggctcaccgtgcggagggagcacgcggcgcgcgctagggtttggggagagagacgcggtgcacgcgcgcggttcgtggaggacgcggatgcggcgggcccacgcgcagcctcatggctcgcggtggactgcgcccgcgagcggggccggagggagcggctggccgggtcagctcgacccggtcttagccgagctggcgccgacgtggcgcctacgtggctgccacgtgggccggcgggaggtcgaagaagacgccggccggaacggacgacggacggtggctgcgaacggcggggcgaaccacggcgatacaggcgaaagagagcacaccagaaggttgcacgggttgaggggagacgagccaatggctcggattcgccggaggatgctcgacggcggcggattgcggcggcggcaaccggcggtgagagaagggggaaacggcgacgacgcgacgggagaccgattcgggcgagctagagcatctacgcggcttcgggagtctgttgctagcgtcggattgggcggagctacgccgagtgaggctggcgacgagcgggtgctacggagcacgggcggcgacggcggcgagcacacagcgagcggcggcaacggtcggggcggcaccagctagctacggggaggctagtcatgctactacccgaatctaaggggaggagatggaacgaggaggaagaacggagggaggcactaccgtgcgggggtgatggggtgcactgacgagaggccgacggcacgggagtgatctctctggcctcgggccggggaagaggaggaagacgagcgcccggagtccccttccgcgtcctagcgcgcacaggctcctccggcacacgcgacggcggtggtcggcgagagggacggcaatggcgtgggtgaaaaatgggggagattgggaggagaaaaaggaagggagggcgcctgggtttataaggcggcaatgtcggtttggaaaccgaccttgggcggtcaagggagcgagccagcgctcggcggtcgcggcccaaacggcgacagggggaggggaggatgacgccggcgggagaaaaaagggaaaaagagggagagaaagggggcttgcccccttgccactttggggaaaaggaggagggagagagggcgatgcggcagagggggagggagctctgcctccgtcccttggaagcacgcgcgaggaggggcggggccaagtcaatgacgacggcgatgacggccgggcggtttggagcggagcgacgacacgggtggcaggcgcggcaggcgctgacggtggcggcgactggccggtcggccaccatcaaacacacgcacgcactacgtcgccatgactccaaaagagttggcggcggaacaaaagggcctaacacacggacggctgctgaagactgcctcctctactcctcgtctgcctggctgcctcctgtagtcggctcctcagtcgaagaaacgtcgatcggctgacgcgaagggaccagcggaacttgtcgagagccggcagcagcacgggccgctggcggtgggggagttgggtagtcgaagcggaacacggtggaagaaccaacaacacgcttccgcgcagtgcggataaagcgtgggccacggcgggaggaagcaacgggagtgtgtccgggggtgtaggaggggctaactgggtgtgggtacggggagtacactggtgagtacggcgctcgcgagctgggggagcgcgggccactaggagtgcgggcagagccgcgagagctgtgggaggacaggcggctggcgtggcagaggcggcctaagtcccaagagacagtgtcaactgaggtgacaccctcctcggccagacgggcctccagagcggcgtagcggcgggcaagggagcgggaagcctcgaggagtaggtcgtgctgactggcctgagcctccgaaagctcaaccatgcgagtcagcactggctaagactcgctgtacggacaagggtacctggcgtctgcgtggccggaaggaaggtgtggaagctgccggaaggcagagcccccgagacggtggctgtagtcgtgggccaagcgacgaagcgcagtccaggagaggtcctggtacgcgatgtcacgtcccaaaacgactctagaatacatcctttaaactatgcctagaacaattaaaatccgtgtgaaagcctccaacaattaaaatgtgcaaagttaaaagtcaaataaggcttagaggatttttgtatatttcctaaaagcctaaaatgtgtaaataaattttagtggaattttcagagcacaaatagtaattattaagaaataaacaaagttgaaaatgttttataaaaagaaaaaccctaaaaatcccccttccctctcttgggccgaatccggcccatctccctccccctctctcctctcccccgcggcccatccggcctccccccgcgcgcgcgccgctgacgggcgggcccgcctgccaccctcgctgacgggtggggcccacccgtcatccccttcctccagccgatcccgccgctccgcccgcgccaagcgccgccgccgccgccgaatccgccgcatcccgtcctccccgcgtgcaatcaatagggggaattattccccgtgattccctctccctttccccccaattttccctccctctctcccttggattcgtttggaaaccctcccctaatcccgccggcgccattgatggagcctgagagcgccgcgtcggtttccttcccctccggccgccctctcccccttccaaccctatataaaccct

SEQ ID NO: 63461 - DNA, 1283 bp, Oryza sativa
agtgttagcttagctcctcttatcctctcctgcaatattaatattaccatttgcaagttaggaggggataaattaaaatttctaactcagttccttcttgctcacatcgcacatagctccatccaaaaacacacctgcagccctgacattatatgttgtaggagactttggtgcacaccgacaagtgtgtccttgtagtacgtttacatggatatttgttaaggcccatttgagtctatgaagataaaagatcaagtatgggtacgtaaaatgaaaatgctattaacacataattaattgagttttttaaaacataaaattttgatttatttatatgatatttcaaagcaacttctatatagagaattttcgtacaaaatgtaccgtttaacagtttgaaaagtgtgctaacggaaataaaagtaaaatctataacttaaatcaaaaaataagggtagggcccgaaacactatgtagcaacagtactcaagtccatcgtagcgctttatcgtaggtacattccatctaggacatcaaaagcaattcaagctgtggatttgtagcctaacctgcgggtatgcttttccctgatggctggccggaagcagagaggagctgatcactcaaacagattttctagactagttttcaatgtggattttagttttaacaatcattttggatggtgaaagaaattgaataaaccgttcccatatcccatttttctctccaattgttctaatatttcttcttcctattatacgtcctcctcatacattttgtcgatgaggctgatcgatccctatccatctctccttttaagtgcatgcatctattgataactttttttttgttcatgccgtcaaacacgatcgaaaacacctaattcttttcagtaataaggagtcgcctaccacctcaatctaaacaaatccaaaccaagatgggttttgaagatcaaagctggctaatggagctgatttagacagaagagagataaacacccatctcgtgagcagaatggaaggtttacaagacaaacctaaaaagggattcgcacttgaaacgaaggcagatgatttacggagcaaatcgataaagatagacgaaactaggctagaaccaggtaaaaagtaaatacgatattgaaaaagatattcaattggctaattgtgttaagtagattgtcatagataatgtgctcaactgaaccagccatagcctttataaagggttggccttacctcctataatgcattctccatgtcttactcgagatagca

SEQ ID NO: 63462 - DNA, 3280 bp, Oryza sativa
agatcgtggagaaatgaacactgtcgcatgaaaatcaccgtggtcaacgatgtactcctacctgcatctacttctgcacggtcattacacacggaggaggagtagaaaaacgaggagccgtaaatgccaaggctcggtaagtccaagcgtgcgtcggcgcacgcggcacgtgggctccacaccaggggcaattcggccactccacccaggtaagaaaataaaaagaccagactgtgtgctagtagcagtagtactgctatttttgtgtaatatgtggctatgtgctagtattgaaacgataagaaacaatggggctttatactttatctagcaaatcaaagatcgacgtgatcactattatttcttttgttacaattcaggctagttctaaaattgagtaggttttagtatatacttcctccgtttcacaatgtaaatcattctagtattttccacattcatattgatattaatgaatctagacatatagaatgacttacattgtgaaacggagggagggagtaacttttttgttgttgtaaatctacacaagatttatctaaattcaatagataattaactctattacattaacgtaaacattgcttgctacctgatgtagatacatcatacatggtgctttggacaaccaaattaataacaggaggtacttaattaatgacaaaaagtaaagacattgaaataattatatcttcaactcaccgtaatggacaaaacatttaaaatagcccgtttaaattaagactagaattattttgatatagatgtatttagcgtaccattttacatgcttcttagccatttattagaatttaagttagttgaaaattatagagaatcaagggacctatttagtagagatccggcttcaattctcaccttaggccaaacaatttcagctccatctggaaaaagagggtgaagcgggctctcataaaataaactaagacatgaagtcgggtttagactgtttcataactccattccagatctaattcttgaagttaaacttataatttagagctctatcaaacatatcctacatgtattcattcatagcatgacgtattagcgtttattatagtgcaatatagtcctctctccgtcccacaatagttatcattctagattatttaggatggattaaggtttaattaaaaaatttataataccccgtattaaataatatctaatgagaagtgaaaaggttattgagggtaaaatatgaaaatttttgaatataaaatgatttatgggacaaccagtactctatattaacaagtactatttgagaacaaaacttaaatagtattataggacggtatataagtattataggacggagatagcgtttttttctattcgaaatatttcaaaacggggagctatgctccgttccgactgcaaaaccgcagtcggcggaagacaacagaacaaaaccggcgttgagaaggggggaggggcaatcccgtcattccacgcgagcccgagttgcacggcaccaccaccgccttcttccttcactcgacccgaccgccgtctcgtccgtctcccccgcttcctccgcctccaaaacccccccatcccaacccgacctcctcctcgccctcccctcgcgcttcgcttcgctccgatccgaccgccgccgccgccgccgccacagcgagaagagagagagggagatggcgggcggggagaaggtggactacgtgttcaaggtggtgctgatcggggactccgccgtcggcaagtcccagatcctcgcccgcttcgcccgcaacgagttctccatcgactccaaggccaccatcggcgtcgagttccagacccgcaccctcctcatcgaccacaagtccgtcaaggcccagatctgggacaccgccggccaggagaggcaagcctctccccccccccccccccgccaaatctcgcaacaattccgctctccagatttcgatcctgctgtttcgcgtcatttcgttactgttcgttcatcatatcatttttctcccaattttttccggcgttcagatcgctggattagtgagctcctccgtgatacgcgcgccaattgattcaatgctagctggtgggcttacgtcacacttccatttagatcgtaggtagcagtagtagcgtacagcaacgcagcgagtggttggtagaggtggtacgacactacactagtcctagatctctgctccccgttggctgcaacggtcggggttagcttgcagtgcacactgctacctacctggtgattgggcagtgtgatgtgcgactcacctactctggagtctggatctgccctgaattatgctggtggggggtgtggtttactacatgcaaccacatttagttgcgtatgctgtcgaatttaggtgctcttgtatggtggtgggtggctgggtgggcaattgggcggatactaggagtactaaatatggagagtgcgtgtgcatttcggaagtatgtcgattatggttcatgtggttggttgtaatttgttggcacgtgaatctgacatagcgcccgatgaatgggggttattttgaattcgaagatgtccattgctgaactctgcacacttggtgtcctgtcctgctgtatataccaaaggtccatgggatgtttatatatgctttgacatgacccttaaatgtgattgtagttagtacttttactccctccgttttaggttataagactttctagcattgcccacattcatatatatgttaatgaatctaggcacacatatatgtctagattcattaacatatatatgaatgtggccaatgctagaaattcttataatatgaaacggaggaagtacgtactttgatgaaaagaatttgttgtgcccgtgtgctctgtgttgtactcttttgataagcttaaccaatgcatggactgaggccagtgtcatgctccaacttaagctgtgtatttccttcaccaacaataactctcgtgttttagttatggctgattcattcctttcatgaagccacatcatctcaactgtttcggatctttggatgatcgatctaaggcgcaaaagcgcctagctgcacagcaaatcaacattgcacctcttgttagcattttatcatgttattttttcaagcaatttgaagggtttccatcacgtttcataagtattctagtccctagcaagtgtgcagcaatgtattcttttttgttctgatgacaccactatatccatcttagcagtcaggtacaatcttgtggacga

SEQ ID NO: 63463 - DNA, 1234 bp, Oryza sativa
agtcgaggggccgaagcagaactgccatgctgcaaactgaagcagaatcgtttgcagcgaggtggagcgcatcgaggaggacacgctgccgactctatcggactagatctgcataacgaagaagagtagatcaggcgatagggctagatctggggataccagcaatggaaatcttgtgaatttatctctagcttgttccaatctctgcatttgaatgactaattagagcgattttctagctattctatgccagtgtgactcgatttgtgtgtgtcgcaatgttggctgtttctgaaaagaagtctcggtctttgcctctgatgatgacatctggttggccatgaggcgtggtgtggttgagagtgtggaccgcaatggcaagccacgttcacatctcagacgcctccgtgtccattgcagtggtgggtggtgttgtggagcaaggggctcgacctcacacaatcgcaaaggatgcagagagtgcaaaggtaatacatgcggtgggtgcagagcaacatatgtagacctcggtggcatggcaggcagcggagcggtctcctctttccacctagactttgatgatcagcgcttcctattccacgacgagaaaggcagcaagaaaatgatatcaacgaccggaaaggggtgggacgagaagatggtgctcttgattggcacatgagccttggcggcggtgacctttggactagggtggtggcgtgtcaagtggacaacacgacgtggagtaagctagcaaccgaaggttgacagaaatcgttacagcaatggcgcggttcaaattttaaaaaatgttagtgatacatggcagtactccctccgtcccacaaaatcacgaatcctggagggggaggtttgtcccaaaaaaaccgatctgtgcacagaaaaagagattgtgggccatagtagatgggaaacgagccagccacctctctctctcctatcgttttgaccacagaaaccttatctcctcggcttttctcgtctcgttctctcctccctaaatcgcatcgctctctcttcccccaaatcacgcccagatgcgacctcctgcctccacgccttcctccccgcaaatccctcccctctccacgccgctcccctcacgccctccctgccttcctccccgcacatccctcctgctcaacgcggcggcggtggtcggcgggggaggcgacgagcggacgccggtgttcaagcgtacatgcggcctcgg

SEQ ID NO: 63464 - DNA, 1465 bp, Oryza sativa
agaattcagagaagaggctggatccgttagaaagagggctccgagagctttccatcaagtactcccgggccgaaaacggaggtcgtatgcagattcggtggccgtttgaaatcagcagtgtagtaggtggccgaatcggattccagcacttggagtacttgatctcgatatcttcttgttcatccatgatgtgagcaatggttgcatccgtggtagccatggtcacatcagaattgttcggttccacgaggtacaaatggatcacatacactgaaaatggtggattgtccgtgcgagggtcatcaagaaagcgtacctggagattagctgtcttctatttatgttgctttttataatttaataaacgccatgagattgttttatgcgccaaaaaggttatactacgcttctgtaattataacatatatcttgcttttaaattaatcttagaacaactatgacttgtagtttcttttggattgccagattttgttttcccgtgatcaacaaaattcccgtagcaacgcacgagcactctactagtaataagcagaaagtaagaccaagagcgggacattctacaatactatactagtttcagtccaaaaagaaaaaaatagcaaaacgacataagcatatttactaaccagcacggcctggctgtgtatctattttggatgtagaggccggtttaatctattttctaaaaaaaaccagcacggctgattggcaaaatgtcgctattggatctgtacagatcatacaagtgcaggtggatttcgatatcacgcagctgcaacctgccaaaattcaccatgcagtttgagatggaaagaagtgtaatgacagagaacgtaagttaccaaaattgtaatgatcaatataacattgattggataatagacaaaggacatccattatgtctgaaagccaaagtggctgctctgccatccagagctctttatcttcatgtgttgtcgtgtaattcgcatttacattgtcagctatacgatgatggaagaactctgaaaggttccagatgaggcaatggtgctggatagctacatcattaacaacaaacaataaaaaacgagttttagttagttcgaaaggttagagacgaaatggggaaaaaagatgtaggagttgggagagcaccttgttttaccttgggtggtaagtttgctagtggagccgtatatgtaaatctgggtttgatgcttctaattccttgacttgaaccattaaatcgatgctgcagtctcgtattcttagacgttccaatgagaccgggaagccgtccttgggcagcgacatgatttccggacatccagcgatatttagtttatagagagaataaaggcaatgcaacccttcggggagggactgcagacgaaggcacttccggaatttcaggcattggagggaggtgaggagctgaagtgcctcttcctgttcttctgtg

SEQ ID NO: 63465 - DNA, 2550 bp, Oryza sativa
cagggatcaatatataagttaaaaactatttttctctgagctagttttttagctagttacttgtctcaactagacaggaacttgcctgcgaaattaaaacattgacaggtactaaccaagtccacttatcaattactactaaatctttgaacgcttggttgctcaaacagacatatggtcattcaagctggtcagattcatgaatagcttttccaaggcattttcactgaatgtcaccactggatatgtaaatgcactggctctttttttttttaccggaaccactgcaggggaggcccccgcagttaatatattatattaaaaagatcataagtacagaccaaaaactaaaattgcaatgcatggctcatttgccaacatgatcttcacggggaatggttggtcgcaatgcttgttccataatcttttgtttgaggaatgaactaaaactttggtgccacttttgttcagtgcacagtactttctttgagctatacacattccccttggtgtgtaactgcaaccagttcactctagtttagatgtctagctgatattaccataatatagttgttttttttttaattctggttgacataagagcaaggataatagtgagctataagcaagctatatgcttatgtggaagagagagataaacaaaagtggggagtgttggctcttatgcaagagctaactacacacaagctccaagaaatatgcattaaattcatagtgagaaagagagaggatgaaaaaaataaagataaccttatagctaacctattatacatgttagctttaacattgactaatactccctccgtcccaaaaaaagtgaatctaggactgaatgtgacatattctagtacaacgaatctagacatacaggatgtgtgacatccagtattacgttggttttttatgagatggagggagtagtaagtagtgagctctactattaaacttgctctaagccttgttgtttttactcagtaacatacatattgaaatattgaatttcacattcatatgccctagaagtgaaccaaggtttggagaacttgagtggagccagcctaaagtgcttttttttttctcttgaaatttgtctggaggtttattagttatctcctaaggaagaactatttagttccaaagtttgatggttgttctcattcttatctaaaatatcttctatatcaaccaaactagagaattatctggttccctctctgtactgaccactttttgtgattttaaggtccatgacatcatcccaacttcattgctactgggtttttgagttgcccatatgtatttatgtacaattacctgcaaaatatctgtatggtggttcaatattttaatagagaatgagttatgatttgcaacagttttttttttcttctgaaatgttcccctaagccttcctacttttgatattctctataatcttgtcattgtattatttctgactactcaaatgtgtatccatggtaaccatagccttaaaattcttttatgctgcttcgtttgctttgttttccctgtcatttgaactgcattctgttctgcatttgagcacatgacacacaataggtgtgcgtgctgtattatccatgaaatcttagtcctgcactttagagaacttctctatttttactgtcatcatgtgaagaaacagtactccaagatcacagtgagacaaaatatatacgtattttctgtatatatgttgtagcactcaaaatgtgtgatgaattttgtggcagtattggcattcatctgttttgtctttctcatgtagcttacaaacttgtttctttcatgaacacaacttactaacctgtcatgcctatttacttcaactactgcaggtatagagctgtcacgagtgcatactacagaggagcattgggagctctcctagtctacgatatcaccaagcgccagagctttgatcacatccctcgctggctggaggagctccgtggccatgcggacaagaacatagtcatcatgctggttggcaacaagagcgatcttgaagacgagcgggccgtgagcaccgaggatgccaaggagtttgctgagaaggagaacctcttcttcctggagacctccgctctgcaggccaccaacgtcgagaacgccttccagaccgtcctgtcagagatattcaaaattcacagcaagaagaacatggcagcggacccaaaagcaaacggcgctgccccatcgctagcagggaagaaggtcgtcgtcccgggcccagcgcaggagatccccaagagcaagtgctgcagttccatgtgatcttactctactcagattcagctgtatttgtgtgcctctttttgagaattttcacgcgatctttctggatgtacatccctgctcaaatagctctaggctgcgagtattgttggactattggttgtttcggtgatcaggtggacgggatagcttagaatttgtgacattttgtcacttctctcagctggagtagggtgcgagcagaggagctctatttttcataggagtggg

SEQ ID NO: 63466 - DNA, 1056 bp, Oryza sativa
atattttttatgctgtcaaactcgactgcaaagatttggtttttcatgtcgccattgttctcgctgttgaggagtcccaggaattgtactggcaacgcggatgaaaaattcttgcttggtgctatgaagaatgtaaagccttggctagggtaggtagattggacaccaaatacaaaagatgtggaaaaggattgcaccaggccactggagaagttgcagaagggcagcggagttggatagaaagcatgcccattgagcctggtagagccattggttatgtcgaggaggccgttggcagtcaccatggctgcaccatcaagggtaatgttattgtgggcgaagccagagtagatgaatacgtattcaccatatgcacagctcactagatcaaggctaaagaacagtatctgtagaagtaataaagtgagcttcatgccagccttgactataaacccaggcctttgcccacaatatttgtagaagtaaaaaagagtgatcgaaaagtgaggaggtgatcttgggcagttgcctccttttaagcttacaccggagtttataacatccagagataaggcaatgtctagcaactccatggcttttacttttctcttgttttgtttttccccgctgccgtatctattcaagtatgtatccaattgtggacaaggttaatttgtaagttgactactttactttggtgaatactatcagtattcctgttaaaaaaatactatcagtattatcaccgatagaagtgatcttaattattgatttataagtttaactaacaatagagaaaaaaatattctactacccatagttgagatggtagtataaatagatatgatccatgtaattagaaaagatgagcggctattaatttctactagtagtagacaccgttgttaaacatttctctataagtttgttaccgatcgataccaatatatgtaattatgtttaatttttatttgtgtaataataaatacaagaaaaaatatccaaaatttccatggactaagtaatataatatatttataaatttcccgaagtgat

SEQ ID NO: 63467 - DNA, 3303 bp, Oryza sativa
ccgccgccgccgccgtcgtcgtcctcaacctcctcctcctcctcctcgtacgccgccgcgccgccgccgtccatgtacgacctcatgttgtcctctgcaacacaacacacatgatgttctacgtgttaattaccattgcaaaacaaaaaaaaagtctctaaattcacgcataattcagcaactagctacaaaatgcgtacaaaaactaaatgaattgtacatgtttttggtgcatgtatgatcatgcatgtaaagttggcttggaagaaatagaattatggtgtaccttgttgatcagaggtgtcatggatgatggccatggaggagcctctgcagctgggcctcttcatgagcccaattcttgagagaatcaacaatgaagagagaagatatacaaaatggatctgagaggaagaaactagggaacagtgagaagaagaagaagaagaacactagctagctgcaagaggaagaagaagaaagcttggatctacaagagcagctagctggcaatggagagagagagagaaggaaggaagagagaaacaaactggtgcaagaggccaaggagggtgtataaataaaagcatttggttgggttggggcatgtgggtggtaccaagatggcatgtggcagagatatttggtgcctggtttgttagcatttttttgacaggtaatgcccaacttgtttaatgtgctgtcatcctaattcctcttagctagctagttaattcagggttaattaattaattaattgtggtttgcggtgctgtagttttagttttgggaatgcacacagcatgtactactctgacaaaaaaaaacccaatcctagctatgaatctggacaggatgtgtcttttttggatggagaggttatgtttctgccttcaagaaatttaaaagagagaatccatggatgttttattttctctaattagtctacaatttatacatttttgtgtatatatatgtatgcacacaactctgaagtagctatatgtaatactaacatcatggaccatgcaatacatgcctaaaatgtctattttttgccattttaactccctcgcctgaattagcgaatcatgctgttgatatcttggcaaaggcttcgcagtaacctagcttaataaccccatccaatatgtataggaatggcatgtgttactgatttaataagaactttaattactcccaaccaaaaagtttgctccattcaaccgatgaaaaaaaacaaacgatcgagtatatcgttgtgcaatttacgaatgttttaaattcttttgttttggagtttttcttgtcttctaaacttattcggatttcttcaacatagtgagtctaatcatgctggtaaattagttagatgtaactctttcgtttttatagcaataaacgatacaataaatatttggtagtcttataattcacaggcatatatatatgcatgcctatggaatccacaaagtatcctgatgggttaataatctaaccacggttaagcatgactccagtttagctaacatgcaaatggaactgtaacgaatataatatttctcctaactttgttttgagttttttaaatgtaggaatgaagactatcaagtgtagacaattaccaatattttttgtccttctacattgcccttacatgcaagtaatgtcacaaatactaccaagtcaattataacagctaggactcattacacagaagtcatgacttaattaatcaaatgtgaacacacagaattagtgtagcaccacctttaaacaagtctttcttttattaaccacagttaatttgacagatatttcgagtttctatacacaaacctaggttatttttttaacaccatagatgaaatcatatttagttttctttcacttaattttatgatttgtttagatgtgctcggtgcttgcttgggttgattgtcatttgtcacatgcatatagttttataaattaaagtgtgcgtgatccatgtacattggtccggcgtatgcatttctttcatcaaattaataaagcgcagctgcgcgcagggcatgcttttttttttctttgcctttttttaccatcttctaagaaaagctagtacgtatatacttcaacttaaccgattaaattgagagtccccttgtgttatcacacaattgcacggtaatttgcaggtacttgtagaaaacgtaagtttcttacctacactgtccacatctatgctcgttggtacataggagtataatccctccgtactcgtaaaggaagttgttttgaacagcgacacgatctccaaaacacaactttgacttcttgtttctataaaaatatttattaaaaagtgatatatgtatacttttatgaaagtatttttcaagacaaatctattcatataatttttatattttcaaactcaacaacttaagagttattcatgatttatattcgtaaggtttgacttaaacattgtcttaaacgattttcctttacgagtacggaggaagtatacatatggtcggatcagatcctgatctcctccttgaatttctctctaataatacttattcccccttaagctcattaattcgaaccatttaaacggctacctgagggcaattaacatgaaaactatatattattcgaccaatctattcataaacattaactagttccactatgcttagataattaattgcaaacagtattatgattgcaaaatgcaagatatatatatacatatatatatatattaattatatcctcatttttgcttgtacactctttggtactccatcagattccatattttcggtcgacgttgaatcgttttttggtcagatctatggaaatttctgttgaaatattaataagcatcttagacgagtttacctctataattaatgttgccgtggtttccaacgtgagagaaatacctagtttaaattaaggcatttaatatgaacataacgataaatagacattctaattaattactttttggttgatgaaattatatccaaaacgatgcacaacaagcagtgatgtcactgacacgtgggtctcattttactatagcctactatatttgttcgaaatataacaattttgagctttgtattctaaatatgtagtcaaaatttactatatatacagttccattaatttcaaaattgagtagcaattttgtgttagctataaatacggtgtccgtacgtagtcgatggacggtcgagatgcgaagggatcggtcggctcacgtggtgtcgaaacgtggcgtcgactgtgcggccactgagc

SEQ ID NO: 63468 - DNA, 612 bp, Oryza sativa
ctcgcggcttggagagaggaaagccgatccgattcgaactcgaatccatcgatttccaaaccgatttagccgaagtttccaaaggagaaaaggtagaggagatcccgaagatcatttcccctctatcaattcagccggaaacggaaaggagcggccggattggaaagcggctgtcgcgaccgggaaaattgccttttcccgaacgctagtgtattaatccccgtcccaggaaaagccggggtacaccacacaaacatgatataaaagacacatctttattatatcgacaatatttacattattacaaaggcacttaaggcctgacaatcaaaaataaacagcagcggactagcgggcctacggctccatcttcacaggcgctcaactggggtataagccaggactccccctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaaga

SEQ ID NO: 63469 - DNA, 12221 bp, Oryza sativa
gtgattcctagcgtagttttgtttgactactgttttgtgaaatttgctgatgtggtttgggttcgatgtttggaaaacctgcggctgatgggatcagccaggcccgggtggccgtttaaaagccgttggccgggtgccaaccttgaccaattcaaaagactgataccttgcacatactccgaccggacgagatgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccgtactcaccattgctctatataaataatccccctcccagttgctgaagaagatgaagcggatcccgctgacgaggagttcttccaggagcaagtcggctacgatgagttttagggtttcggcctagttcccaagtcgcgcctatgatgtttggtccaagtcttggctttcgcttcccttttgtaatgcagttgtgagctcgggatctgtccgcagcccaacatgattgtacccctactctataataaagagacctctgttgctgtgatattctgtcttcctgtgataccagcactgtttcctgggactgatatcgatgaacaggttaatttggagcatcacgggctagttccgctcggggctagttcggggcgtgacaagagatggtatcagagcacaggcttggccctagggcgaaactctacgtttaggacgacccaaaggatactaagttcaaaactacttgcgaaaagctaaggcccttttttcttttggattctttattttcaatagtttgttgctaaaatggttactgatcttttctccctgtttcaaaattgtagatggcagtgaacgccagcttcagttcccatggttttggtgagggtcaccacgtcgctcagcttcgtgacctcgcccgcttccttggcttctcgtgtcccgagtacacggggtactccgtggaccgcgttcccactcgctgtgagctctctgtgtacctttaccctcgtggaggtatacacggagctggtcttcgcccacaccacttcactgtggccaggcccattctccagatcgcgtgtcacgaccggaaataacccaacgggcgttccttacgtgcgtgtattattccttgtcctaggaggcaaggtacaccaaaagttgatacatttcagagtttatcaagcggaagcgtaaatagttactttattacatgggcggcgaaggcccagcacacacaaagacaaacgggaaacagcggaagactagggcgacgaccacaggcgcatgacggcaggcacgagctagatgccttcatcttccaggaagtcctcttctgggtttgggaaaaattgagcaagactgagtacaaccaccgtactcaacaagacacacccatatgtgcagaataaatgcaagggagtacaagggggttataatataaagggttagggtttgcagtaaacagcactaaaagacacttagttgctcaaagctattttgtaaacacggtcctagagctatacaatattattaaacaaggccgtgaacccacacgaacctgccttaacccaaggcctacgatgattcagaccgaactggcaaccagaccctgggtcccaactcgtcccaagccaacccaggccaaccattccacattttagttattaagcaggttttaagaattaaaaacactaacttgggtacattgctcgacttgcccataaccgagggcgcggctattcgaatagattatactctgatcagaggtgtacatctttacccacaagacacatcttcctcacgtgtaaccacgtgccacataccaccacggtatacggacggaagacatgacatagttttcaacccatcctagccataaacaagagtaccgacccaaccccatctacggccggaacccccgggacaggtaggcaggactgagcccctagcagctggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggaagtacggtagtgctactgtcaaaaccatgcaccccgaacccagcctaaaaccattttgaggggtttgaatagagggggaggtgtgaatccaattccacaataatccaaccattccatagtgtccaggtgataagagtatttccaaagtctagagttgtaaaaccacctaatgttgcctaattaaccagtgaagcatctacctaaaatcatactagtggtaccatgagtagagtgtccactagttggtgttttgtttattctagggtgaacaaggtaataataacaataacaataataaggtcataacaaaggtacataggcatggctagataaaacagtgataacgcgggaatttaaataaagcgataatgcaataatttaaatcaaaataatttaataaaccaggattcaatatgttcaaggatgatgtgacttgccttggtcactttcccaaatgtcggcttcaacctccacgaagagcggatcttccgaagctgcaacgtctacacgaccaacggaaaataaaagggcttttactctaataaactccatataacagcaggaacaaagcacaaaaatgggttcttgacttcttaaggaaaaattagagacttgaacagtccaattccgagttcaaatggccaagttatggccatttgaagtttatatgctctttaaatgaatatttgcgaatttcttcaattaaattttaatttaaaaaaaaggtttattgcgtcagccgaggggagggggcgcacggaccgggtccatgggagtggggcccacgtggcagcctcacggtccacggtggaccgggcgtaccagggctcgcaccagccagcgccgtttgccccacgcgtcagccgcacccgagggcgcgggcggctgacggccgagccccacgcggcgtccacttggcgcgcccgaaggcagccactcggcgcggccggcgggaggcggcgcccgcggccctatggtcgccggcggcggccataggcacggcggagcggctgccgagagaggggaagggaagggggaaaagacgcggtggtccacggctcaccctaggtcgacggcgacgacgaaaaaggcggccggagcgaaggaaggcggcggcgcggctcgggtcgacggggtcgacggagttccggcggtccgcgggctcggcgagggggtggacggagtcgacggtggtgcggcgaagccggaggaggcgacgccggggcgggagacggtcccggcgagcggagaaggccggccggaaacgggcgagggaggcgcggggagggtttatatagggttggaagggggagagggcggccggaggggaaggaaaccggcgcggcgctctcgggctccatcaatggcgccggcgggattaggggagggtttccaaacgaaaccaagggagagagggagggaaaattggggggaaagatagagggaatcacggggaataattcccccctattgattgcacgcggggaggacgggatgcggcggattcggcggcggcggcggcgcttggcgcgggcggagcggcgggagcggcgggaggaagggaatgacgggtaggccccacccgttagcgagggtggtgggcgggcccacccgtcagcggcgcgcgcgcgggggaaggccggatgggccgcgggggagaggagagagggggagggagatgggccggattcggcccaagagagggaagggggatttttagggtttttctttttataaaaccttttcaactttgtttatttcttaataattactatttgtgctctgaaaattccactaaaatttatttacacattttaggcttttaggaaatatacaaaaatcctctaagccttatttgacttttaactttgcacattttaatttttgcaggctttcacacggattttaattattctaggcataatttagaggatgtattttagagtcgttatgggacgtgacaaacctaccccccttaaacggaatctcgaccccgagattcggaagaactggcgaagagatcgggatgggctgccttcagctcgtcttcacgctcccaagtagcttcttcctcggcgtggttgctccattggaccttgcaaaaacggattacccgtttcctggtcctgcgctccatggcgtccaggattttcactggcctctccacgtaggtcaagtattcgcgaacttcaatctgctctgagtcggcctgctcggacagcactcgaaggcatttcttgagttgcgacacatggaacacatcatgcacgttgcccaaggaggcaggcagctccagctggttagcgacttctccgtgtcgagcaatgatacggaaaggacccacaaaccgaggtgcgagcttccctttcgtctgaaaccggtgtacgcctcgcaacggcgtgacccggagatacacaaagtcatccactgcgaattccaggtcacggcgtcggttgtctgcataactcttctgccgagactgggccacctttaaattctccctaatggtcctgaccttcgcttcagcttctctcaagatatcggtcccgaacacttggctttccccaacttggtcccacaatagtggtgtccggcatttgcggccatacaacgcttcgtacagtgccatctgtatgctggcttggtagctgttattgtaggagaactcggcgtaggggagactcttatcccatgtcttcctaaaatcttggacacatgcgcggagcatatcttctaggatctgatttagacgctcggtctgtccatctgtctgcgggtgatacgcggtgctgaaatttaagcgggtacccaactcttcttggagcttcttccagaaatgagaggtgaactggcttccccgatcagatacaattttcttaggaacgccatggagactcacgatcctagcgaagtagagttcagctagtttgttccctccataggtggtcttcacaggaataaaccgagctaccttggttagtcgatccacgactacccatatagaatcataaccgccttgggtttttggaagtccggtgatgaaatccatcccaatttcatcccatttccattctggtacttgtagaggttggagaagtccggccggccgttttctgccttgacacgctggcacacatcacaaagggccacgaactctgcaatttcccacttcatactaacccaccagtatgtccctttcaagtctaagtacatcttcgtactgccagggtggatggaataaggactttcgtgagcttcctgaactatcagctgtttaagttccttgtcgtccggaacgcatacacgacttccgttccatagggttccatgttcatcttctgtgaaaccagcggctttaccttgtttcatattcttgaggatcccatgcatatctggatcattcttctgagcctcgcggatttgatcgagcaaggtaggcttggcttccagtgtagccaagaatccacgaccaactatgcttaggttcagggcttccatctgttgatgaagttccggtggaatgccacggacgccaagagtgttgcaacggctttttcgacttagagcgtcggcgaccacgttggccttaccagggtgataaaggattcccacatcataatccttgatgagttctaaccatcttctctgccgaagattcagatccgactgggtgaagatgtatttcaaactcttatgatcggtatatatttcgcagcgattcccaatgagataatgccgccagatttttagagcatgaaccacagcggccaactccaaatcatgggtagggtagttgccttcatgatgtcgtagctggcgtgaggcataggctaccacatgaccttcctgcatgagcacgcaccccaatccttggcgcgaagcatcacagcacaccatgaagtccttgcgagtatccggtaagattaaaactggcgaggaaaccagcttttccttgagagtttggaacgccttctcgcattgcgggctccacacaaattttttttctttcttcaacaactgtgtcatgggtcgagcgattttggagaagttctcgatgaacctccggtagtatcctgccaaacccaaaaagctgcgaacctgagtgactgtcttgggttgcttccaatcagtgacggcggtcactgtttcggggtccacagcaactcctttagcagatatcacgtgccctaagaatttgacttcggacaaccagaactcacacttgctaagcttggcatacaattgatgttcccgcaactttcccaacaccagacggagatgctgctgatggtcttcctctgattgtgagtacaccaaaatgtcatcaatgaaaaccacaacaaacttatccaagtattccatgaacactttgttcattaagttcatgaagaaggcaggagcattggtcagaccgaacgacattaccgtgaattcatacagtccgtatcgcgtggtgaatgcggtcttcgggatatcctcttcacgaatacgcaattggtgatatccggaacgaagatcgattttagaaaagacagtggcacctttaagctgatcgaacagatcatcaatccggggaagagggtacttgtttttgatagtaacttcattgagagctctgtagtcaacacacatcctctttgtcttgtccttcttttccacaaaaatcacgggagcaccccagggggaagtgctcggccgtatataccccttttctttcaactcttccaactgtttcttgacttcggccagttcatttgctgccatacggtagagtcgcttgtacagaggagtggttcctggagcaagatctatccggaactcaatctctcgcttgggcggcataccgggtagttcttccggaaacacatctccgaactcactgacgatggggatttctgacagtcctatctgatgaagttctgaactgccgatagaagttgggggtgcaaagaaaacaaccggttgttccggccctcggtacagagtgacagtgcgtcttgcgcaatccactactccttggaattcagccaaccaattcatcccaaggatcacatccaagttcttagtgtctagaagaatcagatccgagggaaaaggaattccctggatttctattgggacggcagggctataatactttgctgtcataacccctctaggggtggtgatgagcagagggttcctaagcctttcgacccccaactgatttctccccacgaatggcacagatataaacgagtgggaagctccagagtcgaacaaaatggtagcagggatggaatgaatgaggaatgtaccaacgatgacgtctggagttgtcagcacatcctcggcagtcacgtggttcacacgaccccgaatgacatccttaccaccattgttggggcggggaggcgcttggccttgctggcgcctcggctttgggcatttatccgcaaagtgcccgggctcgaagcagttgaagcacagacgctgctgaccttgaacttctctgcggccttgaccaggctgcacaacgggcgcaggaggacggggcacacgggtcccttgctgactctgctgttgctgcggctgtgaggaggatccccctggatatggattggtgtagcggaccctttggttagccccctgttgattgcggagattcgccaagcgacgcttctgcgactccagttccttgtgcttggcttccaagcggatgctcttgtccaccagacgttggaaatccggatagtccccggagaccagacgcacggacagctcagggtccattcttgccaagaacttctcttgcttctcctcatcttcacgaacatcctccggggcgtaccgggccaggttgttaaacccatgcaaatactccatcacagagcggttgccttgcttcaactctcggaattcccttttcttaagggccatgactccggcgggcacatgggtcctccggaaagcggcggtgaagcgggcccaagtaataggctgcccctctggctgcgtagcctggaagtggtcccaccatagagatgcgggcccttgcagttggtgagcggcaaagatgactttctcctcatcgttgcactgcacggtgtctaactttttccccacggcatgcaaccaatccaaagcatccacggggttattggagctagagaaggtaggcggacggatgcggaggagctcggcgagtttagagtgttgtgggggtggtggtggaggtggagcattatgctgtggcggattttggatgtgatggaggaaagcagccatcatgttggcctgctgggcgaggatttgggtgaggatggagttggtgtctggtggtggtggtggaggcgggggaggaggtggaggtgggccgccttggatgttggggttgctaccttcgggttggttgccatcaccggtagcagcacttctcctggttgtcaccatctgaaatatcccatacagaaccagccaagagagagaacagactattaaagctaatcacccacgactaccaaaattcttgaatttaatactgctattaaattggttcattaaggttcaagttgcttaagccaataaaataaagacaggctccgacacagttataccacacaccggtataaccatgccccacacgactctagcagaaaaacaaacgagaagaacacacgcgcaagcctactaactgctcgtctacttttgcgacgggccagggcggaaggtgagcagcagcgcaccctccgtgctaccaacgccagaggctccctcctcctgaggaaccacgggcgcgggctcggcacgaggggtctcgacgaaacaggtccatgccaaggactgacgaacaagcttgggcctggaggtactcttgcgggcggtgatcttctggctgcggcagacgcgacggcgcttggggcgacagacctctccctgggcgatcttgagctgacacagctgcgcctccaccgcgtctaggtccttcttcagctgcagattctcctgacgcagctccaggatcttcatgttgttcttgaccaacccacggcgcaccatctggtggaagtcgatacgggccgcgtcgtacgcctccaccatgcgcgccaggtgcatgatggtagcgtcatcctccgagctagcatcttggaaggtggcgtagtcgcgggctcctccgcgacgagggtggtagcggtagggcgagtgctgcaactcgtccgggtagcgctggtgaagagtgccgatggcgaggagtgcggcgttctggcaagcggcggagaaggaatctccacccgcggtgactgccaacgaagtcctctcgggtgagccagtgaggatcactgcagtgacctcctaggcagcgtggggctctgcatcgtcaccttcctgctccaggagctgcttgccctggtagtccactccatgcggataccccaagacaacgcacatgccccgcagctccaaaacgaaaccagtcaggtccagaccacgacggttgatgctgccggccatctacaaacaaaaacaaaagagaaaagcaacattttaaaggtcagattttgacgataaatgaagcagcaggacagagagagactagaggattttcacaaataagaaaggatttttattttgaaaatattgctaaggcttgggatctaaggctcgtcctagggtcaagctggctctgataccaacttgtcacgaccggaaataacccaacgggcattccttacgtgcgtgtattattccttgtcccaggaggcaaggtacaccaaaagatgatacatttcagagtttatcaagcggaagcataaatagttactttattacatgggcggcgaaggcccagcacacaaaaagacaaacgggaaacagcggaagactagggcgacgaccacagacgcttgacggcaggcacgaactagacgccaaagccttcatcttccaggaactcctcttctgggtttgggaaaaattgagcaagactgagtacaaccaccgtactcaacaagacacacccataagtgcagaataaatgcaagggagtacaagggggttataatacaaagggttagggtttgcagtaaacagcactaaaagacacttagttgctcaaagctattttgtaaacacggtcctagagctatacaatattattaaacaaggccgtgaacccacacgaacctgccttaacccaaggcctacgatgattcagaccgaactggcaaccagaccctgggtcccaactcgtcccaagccaacccaggccaaccattccacattttagttattaagcaggttttaagaattaaaaacactaacttgggtacattgctcggcttgcccataaccgagggcgcggctattcgaatagattatactctgatcagaggtgtacatctttacccacaagacacatcttcctcatgtgtaaccacgtgccacataccaccacggtatacggacggaagacatgacatagtttccaacccatcctagccataaacaagagtaccgacccaaccccacctatggccggaaccccgggacaggtaggcaggactgagcccctagcagcaggacaccggccctgtgccatgacatctcgactaccgggccgcagctcgtgtagccttcatttgccctagagatgtccatcgactcccgacttcgtccatctccatccgtgtacttttgtttataacctgactgagccaaaaactaagccttacccactagacgtgtggaagtacggtagtgctttgcaacagaggcccgaagaccggtccttatatggccgaggtgctactgtcaaaaccatgcaccccgagcccagcctaaaaccattttgagggttttgaatagagggggaggtgtgaatccaattccacaataatccaactattccatagtgtccaggtgataagagtatttccaaagtctagagttgtaaaaccacctaatgttgcctaattaacaagcgaagcatctacctaaaatcatactagtggtaccatgagtagagtgtccactagttggtgttttgtttattctagggtgaacaaggtaataataacaataacaataataaggtcataacaaaggtacataggcatggctagataaaacagtgataacgcgggaatttaaataaagcgataatgaaataatttaaatcaaaataattttataaactaggattcaatatgttcaaggacgatgtgacttgccttgctcactttcccaaacgtcggcttcaacctccacgaagagcggatcttccaaagctgcaacgtctacacgaccaacggaaaataaaagggcttttactataataaactccatataacagcatgaacaaagcataaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaaaaggtttattgcgtcagccgaggggagggggcgcgcggaccgggtccacgggagtggggcccacgcggaagcctcacggtccacggtggaccgggcgcacccgggttcgcaccggccagcgccgtgggccccacgcgtcagccgcacccgagggcgcgggcggctgacggtcgggccccacgcggcggccactcggcacgcccgaaggcggcgactcggcgcggccggcgggaggcggcgcccgcgcccctatggtcgccggcggcggccataggcacggcggagcggctgccgagagaggggaagggaagggggaaaagaggcggtggtccacggctcaccctaggtcgacgacgacgacgaaaaaggcggccggagcggaggaaggcggcggcccggctcgggtcgacggggtcgacggagttccggcggtccgcgggctcggcgagggggtggacggagtcgacggtggtgcggcgaacccggaggaggcgac

SEQ ID NO: 63470 - DNA, 1540 bp, Oryza sativa
tttagtacgtgtttgaccattcgtcttattcaaaaaaatttaagtaattatttattcttttcgtatcatttgattcattgttaaatatactttcatgtatacatatagttttacatattttacaaatttttttttgaataagacgaacggtcaaacatgtgctaaaaagtcaacggtgtcaaacattttgaaatggagggagtatattactaagataagcaaaaaagaaactagcatattagttcgggagacctataaattaccacataagttagacaaaaacataaagattaatttatattgtttgatcagggtgggccagttcatgtaaattgatcaatatagttgtacacaaatataattgtatttatgaaaacataagtcaagaattatatatctatccaattcttaaaaaaactcttaaaattggtgaacacaaagcacgttaagagtagttgtacaatacgacaaatccaattcttttaaaatatagccccgcaaaaaaaaaggtctgcatttctaaaataaaaaagatctaaaaaaatagctccatacaaaattgcgcatgaaaatttggaagtatatatatgtacaatggatggatttttgcggcatgtccatgtaactatctggatttgaaattgccaaaatactatcaaattaattcttcacctagataaggacaaatcatcttttttttttcagctgatgatcgatccaattagtaagttgtaccatgcctattatcatcagccactgaaagtgattgttcatatgcatatgagagaagagagaattgaagagagagagagagagagagacatatatatatatatatatatatatatatatatatatatatatatatatatatatatatatatgcctgctaccctcccagatttaagacatgaatgatcatcaatatccattaatcagattattggctgaagctgcgacgcccatagatctcagactataattaatcaagagctatagctaagctagctataattaggtatatatagtacggtgatctcagcgagttatataattaattgggttcttagccaagaaattaagagacagacagggccaactgatgtgatcggtcgtacctgcatgcatggaggcgaattagggtgacgacaaaatgcagcagatatttcactgtttgtgatttatttgatctgggtctatcgacagcagcatatgcaggcaaacatataaacaagcagcagttcgttcgatcaatcgatcgactggcaggagtagcagctactaccctctccatgttttgatagatcagctagctagttattagctagttgctgctgtgtctacactatagagcttaatttgcttaattggggatttctttttgttataacaagaagctagccaggagttactccttaacacacactcagacatagcgctatactcctattataacaagaagcagctctatgttatttacacacactcagacataggctaaagattaattcataaatcgtgtggaatttatttaaataag

SEQ ID NO: 63471 - DNA, 6131 bp, Oryza sativa
accacatgggaatactgggatgctgacaatccttctcttacagttcttcatccgattatgctcactttcgagttgtatggctttgtccacaagtttctcaaaatcttcatattcctctaggagtagttgcactgtgatctcatcttttaacccctggagatacttctcttgtttgtcttcatcattttccacatcttctggtgcatagtgagccaaacgatggaactcgtgcaggtactctgtgacggtcaaatcttcttgcttcaggtagcggaactctcgttttctcagtgtgatcattcctgcgggaacatgggatctcttgaatacagatgaaaactcgtcccaggtgatggtgtgtccttctggccgtgatgcttcgtagctatcccaccattctgaagccagtccaaccaactgatgagttgcgaagacaacccgctcctggtctgtgcactgaatcaaccccagcttcttctcgactgtgcgcaaccaatcactggcttccataggttcgacggcaatggcaaaggttggagtctcagttttgagaaattctgataacttgcactgttgctggactgtaggtacttgaacgttggttgcccctgctgggttgttccaattctgtaatagttgaaaggctgttgccaacatgttggttcggttaaccacaatttggattagctctggtgaggtttcgttgatgcttttctcattcccattggcttgggttcttcatcttgtacttgatttcttggctgctgtgctggaacatccaaaggtaaaatgccgatactggcctctgtcttgtcaactggtggctggggctgaaattgagcattgacaccttgtggtaatgcactcgctggagttggagctgttgcaacgcgggctataggactgcttcgggatgcatggatgacaattcgctgaggagcaagcttctgattgcagggagttgcgtggactgacgtgctggcagctatgtctctcggttttgggtacttgtcggcgaaatgacccattccttgacaattgaagcaacatatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagcaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcagttcgcattggtgtttttcttttctgctgaggaccctcctgtcacgtcctgataaattcatcccgaattaaaaatcattcgctaaaaggaataatagaattaattaaaattcgaaaagaaattggcaaacactaaaatacgtgcaagaaaaattcaaatgtggcccggagaatttttgttaaattctccttggtctaaaaggagccctcaaattttacttgaatttttatagcaccggaaataattattaagcaacaaaaacaattaacaaagtttattaaaaagaaaaacctaaaaataaccctccttcctcctttgggccaagtctggcccaaagtcctccctctctcccctcggcccgcggccgaagtctcccattcctccctctctttctctccctctccttctctccctcctcttgggcccccttcccctcggcccagcaccctcctccctctctctcccgggctgtctctccccccccctcccggcctgcccggcccaagccgcacccccccctccaggccgagccgccctcccgcccgtgccgcgcgcgtgcgcgcgctgacgacgccgcctgaccgcgtggggcccacgcgccaggtcgtcatcgtcttcctcccccagccggccttctctctctctctctccccggaaaccaagcgccgttcctcccttaaatccacgcgaatcaatgcccttctttccaaattgattaggggaaattaaaccccattgaatcctcttcaattccccccaatttccctcttgaatggcgcccccaatcgtcgggaacggccgcgcttttcccggccaccaaccatggccgccggccgccattcccgtcgccgttccgccctcccccgtggccggctccctcttttctcatataaaatgggatcctcatcccccgttctctcgttttagccccctcccgagcctccccgtggtccctagccatctccccgccgccctcctctctctcccacgccgccggccgcctccagccgcctgtgccgcctcgcccgcgcaccggccggccgtgccgtcgcctcctccagcgtcgcagccgcctcctcttccccggcgccacctccgatttgtggggaaatcgccggaacggtgcccccgccggcaaccagtggcattggtgccactgtactccctccagccggctcctgtacgtcgccggtgcgccgatcgacgccgccgtctcctccttcgacaccgcggcatcgcctccttccccggcatcacctcctcctcgcccgaagctcgccggagtggcctcgtcgtcggcgtccagtacctcccggtctccggtcggctcctgtacgtcgccggtacgccgatcgacgtcgccatctcctccgtcgacgtcgcagcgttgtcctcacctccagctgctcctcggtttcgccggaacaccgccgtgtcgccaccaacccctccacccgcctcgccggagtcctccggccgcccgttcctcctcgcttgtttaccggtcagccgcggcaccaccacctccggcatcgcagcggcaaggtcgccctcggcctcgcctccccttcgaccgaacccctccgcggtccatcgtcgttgtctccgttcgttctcgtcgtcgacgtcccgtcggtcgcccggctcgtcgtctcgcggtgccgcctccgtcatcgtcatcgcagcggcgtgttccacgtcgtcccgtctccgtgcagccactgctggctgtccctcatcgccccctcgccggccccggtcgtcgtcgtcctcgtcctctcgtcgttcccgatcgtcgtggcgttcgtccctccgtcgagccgttctcgtccgtcgtccgcgttcgtcaagcgagccgctgcagccccgtcctcgtcttcgtcctcggctccgcgtcgtcaagccttgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcgcgtggtggtaaggatccgtcctctcgcttccccgtcctcgtcctttcggtgtcgcccgtgctcgttgtgcggttgtcggccccggtacccgtgtaccggtgtcggtagtcgttcacgcgtgcgggtggtgaccgtgtagtgtccgtgttagtgtgcccgctcggtagccgcgtgatttccacgtgtgcaggccgtgtggtgtttagtggagtccgtttgtcggccactcgcctcggttgacacacggggtctgcttccgtcgacccgaggaccgtctctgtgtacccggtctaccgcggtcctttaggttgacatgtggggtccgcatgtcaacggcgcagccttcctgtcttttccaggctagcgcttacacctgttttatagttgcaaagcttaattataataatccgcaaatctccatataacagcattaaacttcggatgatcatatcttggtcatgcgagctccgaatcgacccgttcaagtctcttaatgtttgatataacctaaagaaccctgtgctttctttttatgtattgttattgcttctttataggcttgtagctttgcttgtgtgcttcgcgtagctttcgtcgttccggaggttcccgaagcgtggttcgtggttgtcgccgaaggttcggaaggccgttctctctgagcaaggcaagtcacatcatccttgagcatattgaatcccagtttataaaattattttgatttaaattaatgcatgatcgctttatttaaattcccgcgttatcactgttttatttagccatgcctatttacctttgttaagacattattattgctactgttattattaccttgttcaccctaggataaacaaaaccccaactagtgggtactctattcatggttccactagtatgaatttaggtagatgcttcgctgattaataggacaacattaggtggttttataattttagactttgggaatattcatatcatttggacactatggaattgttggtttatggtggaattggacatacacctctcttcctctttcaaaacccctaaaacatgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccggaggttccggctgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcataggccttgggttaaggcaggttcgtgagggttcacggccttgtttaataatactgtgtagctctaggatcgtctttataaaatggctttgggcaactaagtgacttttaaatgctgtttactgcaaaacttaacccctatattattatccccttgtactcccttgcattaatcatgcatctgccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattattacactatcgttcgggaaaaggcaattttcttggtcgcgacaactcccttgcatagtgcccttgctcatcacacataaaacaaatgatacttgcttcttttgagtcaacatgtggcacgtcaccatgggtccttcgggatgctggcggcatgctgactcgtggtgtgagtgcttggactgcctccaactgcacttgaggttgtatctgactcaggttcagaattggcgtctgatgctgctgtagtatctctataagcaatcggttctggttaatcaggtgttggaccagtgtcacacaactggtgtctggtgcttcattcactcgggagct

SEQ ID NO: 63472 - DNA, 4172 bp, Oryza sativa
ggttgatagcaccttgggcgctacacacacacagttgatctagattttaattatacaaatttctatatataataaaattacttcctgtgaatacactgaccaattacatcaaccccttcgtatgtaacacattatacttgtttgaagtgcccaagcaagcattcgtaagtaataatattttttcaaatctttcaaattaaaattagatatgtcgaacaccgtgagcatcatcgtccacctgagaggccagagaatgtgccgatgcttgtcctaaactccggatatgacatggctgatgggttaaatcctttgctttgcatcaaaggtagcttgctgaaacctagacgtgttggtgctaactctggctgtggcaagtccttgtcgaggtattgcattacctgccgcatatttggccttgaagcatgaaatggatgcaaacacacaagagctaattttaggactaggcatgcctcttcaatgttataatcaccttggagtctcatgtccactgcctcagtgagagatccatcatgccaatgcttaagaacccaatcaaccagcataagttggttgccttgagagttttgtttcactggcctttgtccacaagtggtctcaagaaggaatgcgccaaaagcaaacacatctgtgagaggggatgccttacctgtctgtaccatctcaggtgctaggtagcccatggtcctaaccacatgtgtagtctgtaggtcagtaccatgatcatatagtcgtgcaagcccaaagtcgcctaattttccattcatttcagcatcaaggaggatgtggttgcctttatgtctcgatgtataacaactttctcccatctctcgtgcaaatagaacaatccacatgcaacatctttaattatctgaaatctttgagcccaattaagtatagccctattgtctacatcatgtagatacttatcaagactaccttttggcatgtagttatagaccaaaagtagttcactcttccgtcgacagtagccaagtagtggcacaaggttgcgatgtcgaagacgaccaatgctaacaatctctgttataaactccttcattccttgtctcgactcatgggagatcttcttcacggcaatctccaatttggatgtcgcaaggactcctttatagactttcccaaatccacctactccaatcatgtttttattcttaaatccttgagtggcatggaacaggtccttgtatgaaaaccgctgaggcccaaaatcaatctcccaatcttctcgtagctcagcatacagtagcttcctccgcacaatcaaaatgaccatggtgccgacaatgatgatgaacatggcactggctattgggaggacgatttccaagacattggaacgaggcttggttccaacacgaggtagctttggtagtttggtgatatcaatgtccggagctggaacacccatgccaaagctccagccaagcacgatatgtcgtgtgctaattacgccagttgcagctgaaaaacctatgtacacagggtctgtgagcacagtcgagagatcataggtggcatagagcagtggcctcttcggctttggtgtatcaatgggagccatggtcacggtgatctgcgtggcctcttcgctgtattccatccaaacttgcatagcccgaccattgtacagagtcaagtttgtgaaaatcccgttcttgtcatcatagaagccagcaaaggaggaattcacggagcggacgtcattgatatcaatgccaacatggctgttactgatatccccaaactcattgttctgaaaggtgtcgagctcgactgcgaggatgcggttacttgaattccctctgttgctgatgttaaagagacccaggtacccatctggccacgcagtcgagagattgttgcttggggctatcaagaacgccatgccatcgtagcttctatcggagtagaaggactggatggcgaacatgaagttcaccgagaatgactgaacggtgctgttgggtgaactgcggaaatgcataggtgttgggaagaatgcatggccattgagatcattcttgtcactagtcagctcaaggagtccttccggtgtgattttggtggtgccatcgatagtgaggtttttgccggtgaaaccatggtagatgaattggttttgaccggcacaaagggctataaggttgaagccaagcgacacaaggagcagaaagaagggaggatgctccatgtcacaggtatagaacttcagccttcaaggaagttggaagagcatatgtagcgtatattttgtagttcgaacaccggttaatcgtgcttacacggtagctaggtaagcatcttataaatattttgcacggtggatctcctgagaccacaaccacgctggactatataccctaaaccccaagtcaggtgtctagctaccccggttttccacaagcttccctttctgaaagtaacagttaggggattttttttttctacttcgcattacaatttagagatattctagtgtaaatttacctaaaaattgtggtatcttgctcgatacgtcctcaagtattgtaaaatcactcaataattattttcaagaacatgatattaatcttactttggaatgataccgtgctaaaaatctcgtaaagtacaacaggtgattgacaactgtaagtaaaaaggacgaacagttatgtacacacagcgttgtctgaaattttccaaattatttcgtccttaaatttattttttaaaattttatggtgaattaaaaaaattaaaattccataaaaatgttcttttatggaattttattttttgcataatgaaatactagtataactggtgtgtatatactacatcaactcgctattagatagttccccaacaaactcaagtgaactggagaaagtaaaacaacattttttgccatcatgtaattatccaaatagtaacaaactatatcggttacaacttaggaattaagaattattaaattattaggatgacaaacaaaatcgtgtcaaatcaatgttgagctttcatgtcattaattaatgacatttgatttttaaacaccacaactaaatagtcaaaaattgcaagaagtacccatcaaataaatttgattctatccatctgtagaattactttgtccgttttggtagtttggtctcctcttcagctgtttctcacttgtatattgctagattcgcatcctgctgagtcaacatgacttgggttgcggtagaaaaaaatgccagatggaatattaggacgcggctttaaatcaaccacatcatgtcttcgtcgctagtaaaattttctaatgcactagtcccgttcaatgtagaaaagtactagtctgaaaatgccatgtctggacagttggattacctgttgcctgatggcaatgcagtctagaattgtttcctcgcactccaacaagtcacaatgactagatgttacagcgttatattggtggcggttttgttttaccttttctagatcatatatagccttccaaactaaactataatgttataactttttatttgctataacaatatgaaacatttgatgttcatttcaaaaacagcgtcaatattattaaacacaaatattatctttgctatctttgtagtggttcatgcttacctttttaatacaaataatcacatttatagattatttgaactatttaattatcaaacatggattcaaaatttataagagtaaattgcactagcggtccttaaatatacaagcaggttttatctacgtccacgaacttgcaaagtgtgcattgaggtctctaaacttgatttattgtatcatcctgatccaaagcgttgtttaaccgtggtcttgcctacgtggcatgacatgtaaacgacaacatggcacattattattattattattattattattattattattattattattatttatttatttatttatttattttttctcccttcttcctctttcatttctctcttcttcggcctgttcgacgcgggggagctcgaggtggctttagtggaggaagaagataaaagaataggaggaaaaagaaaaggggaaaggaaaaaacaccatattatcgtccacgtggtgtgccacgtacgcaagaccacggtcaatagacgctttggatcggg

SEQ ID NO: 63473 - DNA, 6074 bp, Oryza sativa
tccgttcgctcataaaagtaatatatttaacttttatgataagatttggttaaactatcaaatgcttagtttaaaataacaatatcataaacttatatagtactttataaatttattttcatacaaaatagactgttaaagtttcaaaattttactaaatccgattctaaacatcaaatatttttgaccgagaaaatataaatattattatgcgccatgctttagtgacggtgccagagttagaaaagagttcaatattgctgtaaaagaaaaaaaaagttcctcccggggagggggagctggaatacttcgtgaaaatttaagtccaaattctgctaagttcgataaattgaacccttttcgaccaaaagtatatctacagtgcaccctccttgtggacgacgatgtagttcaattcaatagcctcaacgagtgcctggagccatgtatatatagccaaaacccatagcatcaactgctcttatatatatgggaatatatcctgtgcacactcctttcatataaactagcaaatgtcacagaaaattctaaaaaaaattacacacatacttccaatagtattacacgtacgtgtgaaatcttatcttcaaattcattatattttagccataaaaaagacaaaattctgacagatttttaccctttaatctgtcatatttttcaacttttttctacggttaaaatataatgaatttaaaaacaagactttcagatatgtatagtacaattaggagtagatgtttaattgtttctagaatttttcatgatatttgctagttagtgtgtacggagtgtgcatgtgaaatttatgcgcataggatatgtacttatatatacattaattttctataaaagggaacaccctaacagtatacattaaatactctcccgtaactaattaattaccagttgcaagcctttctatgcatataatataatcgaaaaaaaaacaaaaacccacttgcaagagtctgccccattcacacagctatagccaattaatccatcaggaaacgcacgtacgagtacgtcacaaatgtcagcaattaattaattaactgtccatacgtgtgctctacgacgtttgcaaactatatactcctgggtttgtcagcaaatttgttcgatctctctcgatcgtctcaagaattaatgtcagcatctgatggacgatgatgatatgatgaacggtgaaagagatcgagatcgagagagagagagagatagagagatagagagatagctctatatatgtccatgcctgcctgctgtaatgggcactcaaatctaaatgacgatatatatgacgcatggcaccaaacagagatgcaaacatgatgacacagctgataggtatgcttgtactacatatatatctatctctcacaagaaacacaccaagtggctgagagagagatttgcaattgcaattgcatgcactgtctcactttttgcaagttgcagacttgcaaactgtgcagacaaagttttttggatatggagaggcagatggatgagcttgctgtaggtaagattgaactgaatgtggatagctagacaccaacagcgcagcactgcacaggtgcttattttgatattttgacctcagctcggcattgaggtgcttaatattgttcaaaaacttgtatatacagtgttctttttggtgtgtatatttatatctaactgcaagctataaagatatgcatttaacatttagcattttagtatgattaggaattagctgggtgggtgtgctttttttttctataaatttgatcaaatctaaagaattttgactaagaaaaaaattcaaacgaattataatatgaaatggatggagcatataagaatggatataatgtataattaatacaaatacaaaatgactaaatgagccatgcgtgtctcggatggcgatagccacttgaaattaataaatgtacgcgtgccaatgacaaataaaacaaatgataaatatattatttgatcttcatcttatatatccatcatattatattcgtacagttacatactggcaacgatttttttgttagctggattcacaacacagtcgcaaaaataaaatcaaaagatgaaaatggccaagataagaccatgggctgccaaaggaagtttatagttgggcccatacagcggccaagttgggcctacgaaaacatgggccttttggttgatggacgacatgaataaacttgggaaaagtacaccgaaggttcctcaacttgtcatcgagatacaaaattgtctcccaaccacaaaaccagataccggaggtctctcaactaacagttttgtctgacgtgacgggtgagtcagcgtggaccccacgtgggccccgcctgtcagtacgccagctcatctctctccccctcttctctccttcctcatctctctccgcttcccccctctctgcaaggcagctagcgggtggggaggaggtccagtgaggacgacacaggagaaggaggcggcagcggctgcgactgcgacttgagaagggagaggcggctggcggcaaagcggggtcggtgcgggcggcggatggcggggaagcagctggctagctgggcgcgagcggtgggcataagcggcggtgggaggagctgcgcgggcggttcctcgcactctctgccaccagagccgctagctctcatgtgtggacgctgacgttgcccgccgccgtcatcaccacggcagctggacaccgacaccaatgtggaagcggtcccctccggcgattgcacctacttcagcttcgattccaactagcgaaagagccgcgagtcgtgcctccgcgatggcgctagctcgtagggaggtcgaggcaagccgccaccaccgccagactccccaagctcctgggagttcaccaacaacggcgaccgcccctcttgcacattccttggcgagaaaatggggatggccggtcgagctcggtgacgacgccgcccgcggccgcgcgcaccagcctgctggccctcctccccacagcgtcgcccgtcgccgtcgtgagaaaacagatagagagagagaaagggataagaggagaaacgctcacacactcccactggccacacagttgagggcgctggcgcgagatctgcggccatggacgacgacggcggcagtgtcctcgctctccccgtcggcgccatcttcctctcccacaacgtgcctgcccactgcccgtctgctctgtcggctggccgctccccgcgctgtcgcccggtcctccggcaggcctgtgcagcaggtgcatctgccgccgctccgcccgccgccggccgcgcgccgccgcctgcccgcagctcctccccccgccgccgcctcgtgggccttttgggtggcggccagcgggggagtccgcacgccgctcctcccccagtggcccctcccccgctgcccgcccgcagctcctccccccaccgccgccgcgttgcctgtcgtcgctgtcaccacagttgcgtcgcccgcgtctccatcgaattggagagaagcgagagagagatgaggaaggagagaagaaggggagagagatgagctagcgtactgacaggtggggtccacgtggggcccacgctgactcatcccgccacgtcagacaaaaccgggctcaaaaccgccagaggatctcaagcgaacggttttgttagttgagggacctccggtatctggttttgcggttggaggacgattttgtaactcgatgacaagttgagggaccttcggtgtacttttcccaataaacttctacagaatataagtccacttactatccctcatctttacatagagtttaaatgacatccctaaaccgcaataatagaaatctgcaccctccatcttcataaaaccattcaagttaggttctatggcagtttggatgaacggtttcgctgaagtgacatcctattcagtaaaaaaaattaaaaaatatatgggacccatctgtaagtgtcatacattttcttcctcactcatttcacttccgcaatcgctcagacgtggcttgcgctcgatgccgttctcgtcggtcccctcgaggaaccaaagagccgaacaaggaatatgatttagacacagtttaactgttgatctgaccacatcgtgcatatattcagacgatcatggcgacgcaatatttcgacacctctgaacattgcagtacagtaccttgagattcagaagagcaacctcgatacccatcgcagtttgaaccactacacatggagcaaaaacgaacaaaatgttcttgtatgtgattacaacaacaaaccgcatcgctgatcaatgtctcattgcactacagaattgggtgattaaatttgtgattgctgaaaatcatctgcatggttataaatttaaaaagaagaagaagaagaagaaaatttggcctgatcctgtgtttcagaagccagttttcagacgagaaggtgaggaggatggatggccaccgccgctaccccggcatggccttctccatcgtccgccgcatggccaccgacggcaccacgccccacctccggccctcttttcctactgcgacgctagagacgccaacggggccaccgaggtcgaggctcaatgccaccaccagtggctgcggctgcagcacccacccaggccccagcgcttagttttgaggcaggagattatgtctatcttcgtggcactccactcaggggagttcatcattttcagaccaaaggcaaattggcaccacgctttgtaagaccacacagaatcttggaacgaagaagagaagttgcttaccaggagcttccacccaacatgactagcatccatgatgtttttcacatgtcataactgaagaagtgtttaaaagtacctgagggggcgagtcccgataatatcgaaatccaagaggacttgacgtatgtggagaagccaactcgccccaaaaccagtgagagaagaactagaaacaaggtaatcagattctgccgagtttattggagtcatcacttggaggacgaagcaacttgggaaacagaagatgagttaaaagccgcccatccgcaactcttcgacagctcttccgaatctcagggtcgagattctgtttaggggtaggtttgtcacacccgaaagtttcccatttttccttggtccctaattcattaataaattacctagagaaaacatttatgttaatctggattgtgaattagctgaatcagcatggtagaattttcttcgaaattccttatgtttaaatgcattaacaagatttttagaggaatttttagagcagaggtggtaacatttataaaccaaagaaatcatcaggagtcaattaaacaaaattccttcctctccctcctttacccgtgagccgtttccggttcacacctttcctatacccatcttcgaactcgcgccgccgctgcatcggccaccgcgtcccccattttcttatcatacccggcctcacactgttcacgctggtcgtatccctatccaattctacctaccgttgtttttatcctctccaaaagacagcgccgccaccctaactagccgccacccttcctctgccgcgcacactgccctagccgccatcgggcccactaaaccaccaccgcctataaaagccaccccacacatcccctatttatgtttccttttttctcgccgtgtgccgccctagccgtcacccccttcctctcccgtgcgtgcctgccctagccgccgccctccctctgccgcgcccttgccacctctaccgctgccatgcatgccactgccgtcgccggtgagccctcccctcaccctcatctctcgccagcatgttttgctatcaagatcatcccctccatctaactaatctatcatgtgttttgccctattcgtcgtcgtcgtcgtccgcggatcaccgccgcagccgctcctccaccggttgctgtcattccccgatgaggcccccttccgctccttccctactcagtgtgcgcctgccgccaccgacgtcttgccgcgccgctgccgcctttgctgtgagcttgccg

SEQ ID NO: 63474 - DNA, 769 bp, Oryza sativa
agtgaagaggcaactcaagcctcggagtcctgaaaagaagatacctattgacccgtgctatgaagaacttctttaagggaatgtccacaacaaacaaggaggcctcacagatatcggactatgaccgaacacttcagaaagcctatcacaagaagtccaaaccaatccctcagcttggagaacaacaaacaaggaggcctcacagatatcggactatgaccgaacacttcagaaagcctatcacaagaagtccaaaccaatccctcagcttggagaacaaccaaaccaagaggttgagccgttagtgaccagcaaagattttggcataacggaattcatttcaaacaccggtctaactgtggatcagctaattcgaggcgcaccaatcccgaaggcggaagtggcatacaagtttgaactcggtaaaccgcttgtcacgcctgagcagctgcagtccctaccaacgcagatgtacaaattccatgaagggtacatggaaatgagcgccaagggtagagagatgttcggagcgaggatcagaaaccccgacttcttgcaaggagaagatgttctctggatccatttcaaggatctctttgatctgtaccatctagacgccctcgacgtctctcttctgagcgcatgtattttgtgagtatctctgagttcgatttggttcggtcaataaataacttctggcatatatataaagcataataatttcctctcatcgctggagaatggagattaaaaggcccaacggggaggg

SEQ ID NO: 63475 - DNA, 537 bp, Oryza sativa
ggtattacttcttgaataagaaggcctgaacctgtataaatccttggtctccaaacccattcacttctccagcttgatagccacccccttttattattgccgaaatctagtttcgacactttgatgtgacgggatgatgttgatgcccaacaaatagccatggcgcgctatcttcttttttccaatttctttatgtatgttgggtttctctagtttgagttagctgctctgatgtcaaaatggagggatatggcaccattctgataaccgagacagagctagaggaagttaaactctggaatgcttccatttctctactggaaatgggggaggttgtgacattgtgtcctccctttcttaaagaagaaaaacaaaaacaaaaaaacaatcagccgctagtggggttgcttgcattgaagcccagctgcaagccacaatggatgagctgcacacgcaggaagaacaaacgacgcggaggacaaaaacgaggggctggtcggatattcattttcaacatactattttttcataaagttg

SEQ ID NO: 63476 - DNA, 3114 bp, Oryza sativa
tacaattgatgtgccaaattactgtaaatactaattttttatcggtacagtgatagattgaattattaaaaaatggtcaagctagctgtaagtggtatgggtccgttttatttcaatttctacttatggtatttacatgttcacatcataacaaataatacagccctatttcccttttcaatttctattgaaattatgttattgtatactctatttgtattacagttttttctaatctgtatatataattctttggttctctgggacaagtctgtaaaggtctgatcacacatacaacaaaggagaaactagaggaaataaattatggccagtcgtccaaacaaatttattttagacaaattgatcggtccggccatgctcaaaacttttgtaactttgagcttttctttttgaaaaaaaaataaagacagaagtcttcattgataaagaagagatacacgtcgaccttttaattcacataaaaaacaccatcatcaacaaccaagattccttcttgtgaggtaagaatgtaagatacggtaggcacacgtttagagccgctaatatttacatcagcattaattccttcacttttactctgtccacaaattctttacgtttatctcaaatccctgtacctgtagttgaattaagttttcttgatttggacttttgtggattccagcccgacaatgttgctgtgcgtcacagtcagtcgtgctctgcatcatggatcattcaactagaactatcacgaaggtgacagttcagttctgggaggaaaagtccattgtactccagtaaacatttaacactagaaattttgaaactatgctactgtcctctgaattgtgtctatttgtacaatactttctttccataaatttatttagattttcgattgacaaagtatctagctaggtttgaaagcacctgtgattaataccagttcaaaccttagatatgaaaaagacatgcaaatagccctgcaaattctatgaatatttcataaaatagtgtaattaacgttatctataataccacaaaattataacttaaattcctctagaaagaaataaggcagtaaggtaagctactttaaaaactgtcataggccctaatagaaattcatgggccttaattggaattcatgggcctaaaaggaacaggtttcctatgtggatcaacccattagaaataagtttacttagcatccctcaatttgtcgccgagtttgaaatttttccttaaaccgaaataccatgtatagtctacccctcaactcataataccgtgtcaactttggtcctcgacagtatagagatcggttttggctgatgtggtgagtaggtcccacgtaggccccacatatcaacgaccacttcttcttcctcctcttctcttcctagcacgcgacgcgccgctggggtgtgctctgcgaccgcaccttcacctccgacagatgcgtgctcgacatggtagccgcggcaattgggcgaggcgtcgccacaacatatgctgaaaaaaatttgctaatatacttatttttttaataatttatgtttatatacatgtatcggaaggattagcaaaaatatacccgtcccgcgggatggaaacgtgggaccacgatgatcccatagctccaaaacgtgagaccgacggtcccgcagttttggacggtcccgcggaatggaagagcacggtaccgcgacggtaggcagccatcaatttttaacgttgtgcagcactgtgacaccgtgtagcacttttttggaacgacggtaccgcaggttgaatgtgcggaactggtccataatcagcgtcaaaacagcgatgaacagtagcaaatagtcacagaatagggtcaaacagtgccgatgcagtatataaatcactggctgcctcgctcccgcgttctcaaccacgcgaccgtcgcggtcccgcatattggagctgcgggaccgtcgatgtcccgcgttttgaagttgcgggactatcgtggttccgtgtttccatcccacggaacaggtatacttttacaaatccgtctcatgcaggtatataaatgtaaatttttgaaaatataagtatatttgcaactttcttccaacatatgttattcaacgacgtcaccggcatgggcactagctggcgccgtgctctactcagtcgccggcctagtttcccaagcggacaccaatcgtactacaggaagtggcgcacgctcgacgccgatatacatgtctatgttctaaatacatcacaacacatagactgacatataataatcaatgttatgataatattttaaataatttcacatcatatttaaggcatcaaatatcacttgacgactatacaaagctaatttaaatctacatatataaaataaatgaaacaatgtgtttttctaagtagatctgatttaattttaatttgtttgagaatagattcttacctctctttttttgaattttcagaactatttcattagtatccgagaagtgggcaacataaatattacatagatgtgaaaaaaattatgaaaaatatttcaagctaatgatcttgctataatacaaccccttaatcgatcatgagatttctggccatatatgtatgttttttctttgccaaatagctttgacaataaataaacaatcaagtaacatatggaataaactactcattatatattttcttatagttgaggaattcaaacatggcagcaataatttgatggatgtatgtcatacaccctattgacgtgactacaagtatacttcaataaattagttactgtacatagatgcattctccaaattaataaggtgcctcatgattatgaacaataggttatggaaaaaaacagacacaaaattatagatatttgtcaaaatataatcaataatacggtgctctggagattattgtggtagtatttaaaagaagcactttatcttggttaaaaaatcaaatatagtataaatagatacgaacaaactccattattccattatcgtgacaaagtttttctcgcaaactcaaggctggtttcaaacgcaaagaagacattaataaaaacatgtttaaaatagagtcaagatctat

SEQ ID NO: 63477 - DNA, 15301 bp, Oryza sativa
gaaaaagagagggaatcacggggaatatttccccccactttattgtgcgcgtggacgccggaaggcggcgggattcccggcggcggcggcgctagggcacgggcgagcggcggggagcggcgggaggacagggatgacaggtgggccccacccgtcagcgagggtggcgggcgggcccacccgtcagcggcgcgcgcgcggggaggaggccggatgggccgcggggaagaggagagagagataaagggatgggccgagccggcccaagaggggaaaagggggggaaagactttttagggtttttctttttataaaatcattttaactttgtttatttcttaataattattatttgtgctctgagaattccactaaaatttgagggctccttttagaccaaggagaatttaacaaaaattctccgggtcacatttgaatttttcttgtacgtattttaatgtttgccaatttcttttcaaattttaattaattctattattccttttagagaatgatttttatttcgggatgaatttatcaggacgtgacaaatccaccccccttacaagaatctcgtccccgagattcgaggaggctagcatgaagataggttgggcagtcttctcttcttgtctgacttcttccgctccgtcttctataaccaacttgcctaacaaaacttctccactctggaacgcttggctcgatctcctgttgcagatggaatcttctcttcacccgacttgtccctggttgaacttctaactgacccagactaggctgcggtggttgaggatggggcttcggttctagaacttcttatcattcatatctttggcgtcaacctcatacaagttacccgcttcatgtcatgcgtcgagatcagctcgtcattactaagataccatgcttgtcatcatgagaataccatgcttgtcatttacttctaactcgccaccaactgcctcatattagctttcctggtctccgggtgatagctacttctgctatttgatgcaagggtcgataactttgcctttgaattatgcttcccaagagaaccaacttatcccacttgatatgctttgacgtcttcccaaatggctttactgctggatttgttattgtctaatcattatcctgtcaaatctgaggcttcgttgttagatgtgattttaatctgacctctgtagattatcttcgaacatatcacttgattcataactgggaatagtctcacgaacaagcaactcggattcactttctttacattcagtttacttcccattatcatcttcaggttgtcctcagttagtattcaacgtattcctttacacctttaaccttgatgtgttctttcccattggatcatctcccaagaaatggcattgcctggtaaccggtgcttgcacttttcactccgtgtagcatctgataccgagttgaagatttcactctttgccttcctagaaacacttttacctaggtcatcttgcttacttaatgacaaggtgactgttgcgtggcaattacaatcaagggtcttccttgagcgatgcagagcatgtttctgtttatcaatcacctttcggcctacttctttcatgctagagaacatctttgccaatctcttttatcaatcatctttcggcttacctctaacaggtggtattctttaatgtggattgcggacgcttctggggacgatgagatcctttggcttgctgcctttcagtgaaaccttgatgtggttcgtcaaaaagctgcactgactaccttcagggaaatacattgcttgctatctgtatctatgccactagggtttaattgccgatgatcatctttagtgcttcctcgagatggggagcatccaaattgttcttctgccatatcacctttgacccttttctgatacctgatagattaattaccaaccatcgactactatgttctcaaatattgatgtctcctggatcttcttaactgcttgcaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgaggttagaacatagttcgtctgaaatgagaccctaggtctcctttatcagtaagcaattatacacataatcacatatccacatcttccaaaagaaccctcatagaacttgtctgtattacacatttctccctcattacatgaatactaagcactgcctaaaaggaaaggtgcttagcatcggcacattgtttctgctatgggttctgattaacacgaggcctcacgggtacggcgtttgctccagtgaccacaatacgattgggatgtctgcttcgtgtaaattggcggtaatgtggagatcgactttgccttggttgcaggcagtccctcgagtaatgccctggtcctttgcaattgtagcaaatcaacgtcttctttgctgagctatccgtctggggacgatcattctgacttggagttggaattggtggttggaaatccttgctaacattggcatcagtggtaccatagttgctatcaccattggagtctttctcagagtcacaattgctagggttgtcattttgggtgccatcattgatactatcgtcgacaccttggtgaatgatgttgacattgcacgcttgatttgagtggtcactaatggggcaagaagcatggttgttggtggtatcatcatcattagtattgctaatgttgttgtctgcattgtgtccatcttcttggggcggaaactcttgatgcgcaacagaagatccggtgatctgaagtggctccgtgcgctgtctttggttaccacatgggaatactgggatgctgacaatccttctcttacagttcttcatccgattatgctcactttcgagttgtatggctttgtccacaagtttctcaaaatcttcatattcctctaggagtagttgcactgtgatctcatcttttaacccctggagatacttctcttgtttgtcttcatcattttccacatcttctggtgcatagtgagccaaacgatggaactcgtgcaggtactctgtgacggtcaaatcttcttgcttcaggtagcggaactctcgttttctcagtgtgatcattcctgcgggaacatgggatctcttgaatacagatgaaaactcgtcccaggtgatggtgtgtcacgaccggaaataacccaacgggcattccttacgtgcgtgcattaatccttgtcccaggaggcaaggtacagcaaaagttgatacaaatcagagtttaacaagcggaagcgtaaatagttaatttattacatgggcagcgaaggcccagcacacacaaagacaaacgagaaacagcggaagactagggcgacgaccacaggcacttgacggcaggcacgagctagacaccaaagccttcatcttcaaggagctcctcttctgggcttgggaaaaattgagcaagactgagtacaaccaccgtactcaacaagacacacccacaagtgcagaataaatgcaagggagtacaagggaattataacatagaggggttagggttgaagtaaacagcatttaaagacatttagttgctcaagctattttgtaaacacgatcctagagctatacaatgttattaatcaaggccgtgaacccacacgaacctgccttaacccaaggcctacgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacagacgaaagacgtgacatagtttccaacccatcctagccatagacaagagtaccgacccaatccccctacggccgggacacccgggacaggcaggcaggactgagcaccctagcagcagggcaccaaccctctgccatgacatctcgactaccgggccgcagctcgtgtagccttcatttgccctggagaatgtccatcgacccccgacttcatccatcttgatgcttctctccgttggaactggcgggttggttggccatcttcttcgtcagcagcaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgatttctccacaacgagagcatgccttaagttctattttattctggttaaaaccttggggagacttctcatcttcatcatctgaggagacttgatctgaatcttcactaccagacactctacctccattagctaaaagatgctctgtcaactgttgtgcacctcgggaggaatttcttctctgacattttgtcattcctggtggaggccattctgtgctggtaatgatcatcttacggacttcatcttcggttcgcattggtgcttttcttttctgctgaggacagttccttgcatagtgcccttgctcatcacacataaaacagatgatacttgcttcttttgggtcaacatgtggcatggcatgaggggccttctgggatgttggcggtgcgctgacttgtggtgtgagtgcttggactgcctccaactgcacttgaggttgtatctgactcgggttcaaaattggcatccgatgctgctgtagtatctctataagcaatttgttctggttaatcaggtgttggaccactgccacacaactggtgtctggtgcttcattcactcgagagcttgaggtaccaatgtcctgacttctgaccttattgcctttctcattgtcagccatctgttgcaaaggtttggatagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacaactctaccctagagggtggcttaggttctgtgacgggttctcaagatcttcactcctgcttcacagctggcttcagtgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttagaaaatatgtccttaggttttatccacttggcttatcctacagtcgagatggctctgataccagcttgtcgcgaccgagaaaattaccttttcccgaacgctagtgtattaatccccgtcccaggaaaagccggggtacaccgaacaaacatgatacaaaaggcacatctttattatatcgataatatttacattattacaaaggcacttaaggcctgacaatcaaaaataaacagcagcggactagcgggcctacggctacatcttcacaggcgctcaactggggtataagccaggactccacctaagacttcttctccaaagcttctcttactgaagagggaaaagattgagcaagaatgagtacatccacagtactcagcgagccacaccggcagatgcatgattaatgcaaagggggtacaaggggtaataatataggggttaagctttgtagaaaacagcatttaaaagtcacttagttgcccaaagccattttataagacgatcctagagctacacaatattattaatcaaggccgtgaaccctcacgaacctgccttaacccaagacctacgatgattcagaccgaactagcaacccgaccctgagtcccagctcgtcccaagccaacccaggccaaccattccacattttagttgttgagcaaattttaagaattaaaacactaacttgggtacattgctttgcttgcccataacagagggcgcggctattcgaatagattatactctgatcagaggtgtacatctttacccacaagacacatcttcctcacatgtgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttactatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgatcgaccatcgtgaactatcattaagccatcatgaaataatagtaaatcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctttcgcgaaaacggactctccggaaacgacggaatctaagcaaaaagaagcaaaatcaccaaaacagcacataaacaagcatgaacagtacatgtggatatttttaatgtgtagatcttaattttagaaaaatttagagacttgaaccaactaaatcggagctaagatgaattagttatgaatttttaaagattaaatcggattaaaacacttaaatcgattaaaattgaattatgacgcaataatgaattatttttgaaaaggaaaaagggattattgcgtcagcgggctagggtttggtggaccgggcgcacgggcggcggttcacacgaacggacggccgagattgatccgatccaaatcggacggccgagatcgatcgggtccacggcggttcacggcggacggccttgatgacgccagcaatgacgtcaccgacggcggcggcggctcggcgaggcagacggctcgggcggcgcacgctcaccggcgaacggcggcaccacggcaccaacggagggcaccagcacgtagaggacaacacggcgaacacaccggtgaccaaaacggcggcggagaaggaacggacgacgacggcgacgagaaggaagcggcggctaccttcgggttgtcgacggcgacgaagctccggcgggttccgacggctgcgaaggggcggacggggacggcggcgacttggcgatgacgacggcggtcttcccgagcgacggcgacggctggaacgacggcggcgcacggctgaagcggcggcggcgaaggcaaagctagggcacacggcgctagggctactccggcgacgagaggcgaaggcgagggtggcggcgagtagaggagacaccgggggtccttttaaaggggctcggaggcgacggcggaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccgaagatcatttcccctctatcaattcagccggaaacggaaaggagcggccggattggaaagcggctgtcgcgaccgggaaaattgccttttcccgaacgctagtgtattaatccccgtcccaggaaaagccggggtacaccacacaaacatgatataaaagacacatctttattatatcgacaatatttacattattacaaaggcacttaaggcctgacaatcaaaaataaacagcagcggactagcgggcctacggctccatcttcacaggcgctcaactggggtataagccaggactccccctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagcctgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataatcaaacaattccatagtgtccaaatgatatgagaattcccaaagtctaaagtcataaaaccacctaatgttgcctaattaatcagcgaagcatctacctaaattcatactagtggaaccaggaatagagtacccactagttggggtttttattttcctagggtgaacaaggtaataataacaataacaataataatgtattaacaaaggtaaataggcatggctaaataaaacagtgataacgcgggaatttaaataaagcaataatgcagtaatttaaatcaaaataatttgataaactgggattcaatatgttcaagtatgatgtgacttgccttgctcgctttcccaaacgccggcttcaactttcacgaagagcggatcttccgaagctgcagcgtctacacgaccaacggaaaagaaaagacttttactctaataaactccatacaacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaatcgggtttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggcgcgggcggctgacggccgggcccacttggcagccgcgagggcgcgcccgaaggcagcctcgccggcacggccgacgggaggcggacacgcccgcgccccgatggtcaccgccggcgaccaccggcgcggcggagcggcgcccgagagagcggagaggagagggaagcgaaagggcggtcttcggctcaccccgggtcgacggcgacgacgggaacggcggccgaagcggaggaaggcgtcggcgcggttcgggacggcgagggcgacggtgctccggcggtcggcgagcgaagcggaggggtggccgaggtcgacggggacgcggcgaagccgatggaggtgacgccgagtggggaggaggtccggagcgacgacggcggcgaaccggagctcggcggcgacggcggagagaaggtgcgacggtgcgggctcgattccgacggggaggagagacggcgagtggcggaaacggagggggagagcacggggaacgcttatatagcgtcgggaggggtagagcgcggccggagagggaggaaacgggcgcggagatctcggccgccattgatggcgccggcgaggtttgcgggagcgattccggacgaatccgagggagagagagagggaaaaacggggggggaaagagagagggaatcgcggggaatgattcccccctcattatggcgcgcggggacggcgggatgcggcggaatccgcggcggcggcggcgctagggcacgggcgagcggcgggagcggcgggaggaaggcgatgacaggtgggccccacccgtcagcgagggcggcgggcgggcccgcctgtcagcggcgcgcgcgctggggaggaggccgatgggccgcgggggagaggagagagagggagggagagttgggccgagccggcccaaaagaggaaggggggggaaaagaagacttttagggatttttctttttataaaaccttttcaactttgtttatttcttaataattattattcgtgctctgaaaattccactaaaatttgagggctccttttagaccaaggagaatttaacaaaaattctctgggccacatttgaatttttcttgtacgtattttagggtttgccaatttcttttcgaatttttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgctccgctttctataacaaacttgcctaacaaagcttctccactctggactgcttggctcgatctcctgttgcaggtggaatcttcttttcacctgactcgaaccagggttgaacctttagctgacttcgactgggttgcggcacttgaagatggggcttcagttccagaacttcgcatagttcatatctttggagtcaacctcatacaagttacccgcttcatgtcatgtgtcgagatcagctcgtcattactaagataccatgcttgtcatttgcttctaactcgccaccaactgcctcatattagcttccctggtctccgggtgatagctacttctgctatttgatgcaagggtcgataactttacctttgaattatgcttcccaagagagccaacttatcctacttgatatactttgacgtcttcccaaatggctttactgctggatttgttattgtctaatcattatcctgccaaatctgaggcttcgctgttacatgtgattttaaactgacctctgtagactatcttcgaacatatcacttggttcataactgggaatagctcccacgaacaagcaactcagattcactttctttatgttcagtttactttccgctattctcttcatgttgtcatcagttagcactcaacgtattcctttacacctttaaccttgatgagttctttcccgttggatcatctcccaggacgtggcgttgcctggtaaccggtgcttgcatttttcactccgtgtagcatctgataccgagtggaagatttcactctttgccttcatagaaacacttttacctaggtcatcttgcttacttaatgacaaggtgactgttgcggggcaattacaatcaggggtcttccgtgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggatgatgaggtcctttggcttgctgcctttccgtggaaccttgatgtggttcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgattccggataaactaattaccaaccaacgactattatgttctcaaatattgatgtctcctggatctccttaactgttggcaggtatatccgatcttatcaatgtagaggcatggcgggtacccttaggggtttcctccaacaatccttatcttgatctgtaaaaggcgtatccaaactcctatcctcaactactgtctcgttggctttttaacccaacacagtttaattgtttttcttttccatccacaggttggttattaactcgaggttagaatatagttcctctgacacgagaccctaggtctcctttgtcagtaaacaattatacacatgatcatatatccgcatctttcaaacgaatcctcctggaacttgtctgtattacacatttctccctcattacatgaatacgaggcactgccttaaacaaaaagggacggtgcttaacatcggtacattgtattctcaacgtgaatcatccacaagcatagcaagctcactgtttatagacatgaatatatttatgtattacatggttgctgcaaactttcgattacaccatgataagtagcgaactgaaaaccacaaacatggctgctcattttgattctggagagatatagctggcattgttctagtgactgcatccttgattggttctgtgatgatgtgacaggactacataatgctatcattcacaggagaagcttccttctgattgctggttgaagcggatgacggtcttctgcttggtatcgccctccggaggttgattgctcttggctcggcctggagtaggtcggggagagacacaacttcttccatctacgacaattctttgctgaggctgtcgatgcagagaatggttgctatgatttattgccgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcagtgcagttgtaacaaacaataactttcttacactcgggttcttcatcttgtacttgatttctcagctgctgtattggaacttccaaaggtacaacgcagatactggcctctgtcttgtcagctggtggctggggctgaaattgagcattgacaccttgtggtagtgcactcattggaattggagctgttgcaacgcgggctataggactgcttcgggatgcatggatgacaattcgttgaggagcaagcttctgattgcgggggtttgcgtggactgacgtgctggcagctacgtttctcggttttgggcacttgtcggcgaaatgacccattccttgacaattgaagcaacagatatcttcccggactcggcattttcttttctcattttgtttcctctgtcctggcactggagttaggctgaaactgtaatcttggcgaggatttgtgtttccttgatgcttctctccgttggaactgacgggttggttggccatcttcttcgtcagcagaaaactgaatcgacaatcttttggtacatgatcagttccttcacaaaagaaacaagtgatcctgctcgttggacacctatcgggtggatggtcttcctcacaatgaacgcatgtagaggcacacgagctggcaacatgaccgatttcttcacaacgagagcatgccttaa

SEQ ID NO: 63478 - DNA, 11818 bp, Oryza sativa
cgcaactccgggaatccattccttgcgccggattaggaggaaacgcaccgagggaggccggcgacgagaggcgcttaccgagctcgggcggcgacggcggcgagcacacagtgggcggcggcaaggcttggggcggcaccagctagctacggggaggctacacaagcttctaccgaaagctaaggggaagagggggaacgaggagggagaacggggagatgcactaccgtgcgggacggggcgcagtgacgatgggccgacggcacgggagtgatctctccggcctcgggccggggaagcggaggaagacgatgcgcccgaagcccccttcacgcgtccttcgcacgcaccggctctcccggtgcttggcgatgaacggcggaggcgagatagaggggcagcaatggcgcggtggtggcgagcgaaacgggaggaggaattgatgggagggcgccttggttaaataggaggcgatgtcggtttgggaaccgacctaggacggttaagggagcgagctagtgctcggcggtcgtggccaaaacggcgacagggggggtgacgccaatggaagagaaagggaaaaaagaggagagaaaggggggcttgccccttgccactttgggaaaaggaggagggagagagggcgatgcggcagagggaggaggagctctgcctccatcccttggaagctagcgtgcggagtggcggggccgggtcgtgacgacggcgatgacggcgggggcggtttggaacggagcggcgacacgggcggcaggcgcgggctcaggcgcggtagagggctgacggcggcggcgactggccggtcggccaccacggcgcccgcgcgcgcgcgggaagcaacgggcggcgcggcgatttgggcggcgtcggcgggaacggcggcgagaacggagagggagggagaggcgctcggcgcggctcacgcgcacgcgcgtgcggcgcacgggcaaagcgagggaggggagagagagaaagagagaaagatgggccaagagggaatcggcccaccgaacctaagggaggcaaaatagacttttcgagaaggattgagattagggatttgaatttgacgatggattggggatttgagatctggaattggcacggaaacggacaacaagcaaagaaacaatcttcgcaaatagggtttttagaatttaaattttcccgctaggcgccacgacggaacgggcactacagctccaccggcgaggtgcgctccacttcctccgcctcttccctcgtgtgttcgacctccgcgacccgctaccactctccctctcggttaccgcacccgctgccgagctcctcgccgtcgccacctccctcgccgcggcggccgccggctccgatgagcggtggggttatgacaatggggagggctgcacctcgggtgccatctgatttgcgggaggagagtgaggtaggaggaggggatccggattagtacaggatactggtgtattttagccattatttttttatagaaataaaaaagagtcaacactatcatatatttagatgtaattttaatacattttagccattattttttttatggaaataaaatagagtcaacgctatcagatatttattggtaaattttttgatagaaatataagaacaaaagggcatacatgtgcttcttaagttgtgaaagatctcccatactcacacacactgacccaccccttcattcaacatttattttcatcgaagaaaataacaccttaaacagaactagaactagaagagaactggtgtatcttcagttggtggcagcagcagcggcgccagccatcctcgccatggcgagctcgatcagcttgtccacctccggcatggcggccttggcgacgtccagctcgacgaagcgctcggcccacgccgccagcagcggggtggtggccgggtcgaacctcttgacgcccttcatcgcgtcgccggcgcgaacccacgccaggaagctgccgagcacgatgtcgacgtagccgacggtgtcgccaccgaagaagggcttccccttggagcactcgctcagcccgacctccatcttctccagcgcctccaccaccttcttctccccttccgccttctcctcctccgtctttcccgacgacgcctgctgcgacgccttcgcgatctgccaaaaataataatccaccgcgcataaacaacacggaaatcggaatcgacgcggatgatcagatggatggatcgatgcgaggtggtggtggtcgagttggtaccgtgtcgtcgcagaatgcggcccagaagcgagcgacggcgcgttcgtgggggtcggcggggagcagggtggcgccggcatcggggaacgcctcgtcgaggtactgcaggatgatctgcgactcgcagactggcttgccattgtggatgaggacgggcaccttcttgttcaccgggttggagctgaggaggagctcgctcttgttcttgagatcctcctcgacgtactcgtagtcgaggcccttgagactgagcgcgagcttcactcgcagaacgtacgggctcgcccacatgcccagcagcttcagctcgtctcctcctccggccatggctttctcgtgtctgaactctgaactccgatggtctctgctctgtatcagcttgtgagttgcgagctctgttctgtttggtggttggtgttgaggtggaaggagatgacgcgtatttatagaattaggcccaaattatattagcctgagctctgaaatctgcagtttccacgaagaggccggacgactgtttttttgttatattctggtataaaattctggtttgaataaacaatcgaaagtttatatgcttgggcaagaatcaaagaaaagtatgagcatggtcaagctggtcattcatttttctttcttcatcaatgactagtatattgggtgatgctctcaaaaactcagccacgattgcacttatcttgacttcagtacaaagaagcgtaggctgagtggctgacaaatctgttccaatccttttgatatcatcatttgtattattcacgtaaacacataatactcgtcgctactccattatttgtcatctgatacgtcaatctgcaaggctgatagataagattgggtcaagactgccaggctggaaaggacatttttttacctctgcgggacgtcaacactagttacctctattttaagtgctacgccgacacatcatcttacggtctttcaagcacccaaataggtacttaaaagaattgaccgtttcagaagatcgtttatgtggaaaggcaaatatcccgatcactaaaatcctagcgacagtttgatcaactggcaaacagtttgtaaacccaagaaattgggtggggctggcctcccaaacctggatagattctcaagagctcttcaactccgctggctctaattcaagtggaaggaggagaacaaaccttgggtaggcattaatctactctgtgacgatttgaacaaaagactttttcaagcagcaacaacaatatcagtgggcaacggtgctaaaactagtttctggcatgataattggatccaaaatcgatgtttaaaagatattgtgcccaactgtttcagtctggtaaatagaaagcaaagaaccatgcaagttgagatgagagacaacaaatggcttacctcttttagacaattcacctatgtggaggaattgcatgacttggtgcagcttggaggtttgctccaactggtctcgctttcttaagatccggatgacatttcctgggattggactgaacctggttcctacacaaccaagagcgtatctctttcaattttaaggttccttcgctaggaatgattttgtatctctatggagggccctggttgaaccaaaaatgaaattctttggattgttaattctttataaaaaaaaacccttattgcccagaatttgctccggagacactaatcatgcaattggatatgttgtctctgtaccgcttttgaagatacatcatctgttcagtgaatgtgtctttgtcagacaagtttggagcctagtttgccaattccaaaatctgacccctgcaggttccaaagagcaagcgcatgcgattagaggctcgttgttaactacctggttgaatatttggttagaaagaaatagaagaatcttcccaaactcttcttgttcagaaaccgaagtagcttactttatcaaacaggacataccttctctattgttaaattccggcagatgtcctgccgtccttccccttaaaaaaaaacgtcaatctgaacttgtacctgtttcaatctgcacttgtacctgttttcttgtgcatatacattattagggagattagactgactgcttcctctctgaattctgattgccatgtgtgcgtatgctgtgacgctcaaacgatgatcagtaaaaatcaaagaagtcagctcttgttatcaccaatctggttgactggttccagaacactaagtctccattcggtggcaccagttggaggaatattttcttttttcatttttgggagttcgaggaataattttaacacacgtaaaatgagaaaactcattactacataattaattaaatattaactattataaaattaaaaaaaattatttaatttttataagtacttctacataaaaactttttactaaaaacgtaaaaacgtaagtaccgtttaacggtttgaaaaacgtacgaacgaaaagtgaggaagttgaagtttggagctgagaaaaaaagtgggcctaagttctgtaaactaacactaagtcttgttaatttatttcccattctcttgtattatccatatacattttgtgtcacgcttgcatttcttggtcgggtgcatccatacatgatgcgacgtattttcaactacaacataggcggccatgtttagttgccacataaaaattttacaccatatcacatcgaacgtttaaacagctgcatgaaatattaaatataggctaaaaaataactaattacacagattgcgactaatttgcgagacaaatcttttaagtctaattgctccatgatttgataatttggtgctatagtaaacatttattaatgacggattaattagacttaataaatttgtctcgcggtttattgacgtattctgtaattagttttttattaatgctcaaacaccctatgcgacaccctatataatacccgatgtgacacgccaaaactttacaccccggatcttaacacccccatagtcaaatttctataactacaatattagcaagaatacaattcaaattagtaatattactttacaaactaggtgggtctgcgtcactttggaaatatgcaatattaatacatttaaaattataacatcccggcctagggcttaatagaattaatagaatactcatatcaacaggttgcaacttcttttccggaagccgatctccaaagaactccagggttaagcgtgcttggcctagagcagggttaagcgtgcttggcctagagcaatttgggatgggtgaccgaccgggaatcagggggtgagggtgtaacatctcggcctagggcttaatagggtgagggtgtccggaagccgatctccaaagaactccagggttaagcgtgcttggcctagagcaatttgggatgggtgaccgaccgggaatcagggggtgagggtgtaacatcccggcctagggcttaataggattaacagaatactcatattaacaagttacaacttcttttctactcatattaacaagttacaacttcttttccggaagccgatctccaaagaactccagggcggggttgatcgacgggggcgtcgatctctcttaagggggtgagggtgtaacatcccggcctagggcttaataggattaatagaatactcatattaacaagttacaacttcttttccggaagccgatctccaaaaaaactctagggttaagcgtgcttggcctggagggttaagcttcttttccggaagccgatctccaaaaaaactccagggttaagcgtgcttggcctggagggttaagcttcttttccggaagccgatctccaaaaaaactccagggttaagcgtgcttggcctggagggttaagcgtgcttggcctagagcaatttgggatgggtgatcgaccgggaaattcttcccgagcaatttgggatgggtgaccgaccgggaaattcttcccggctgcatgtgttggtctgtgagggcagtctatgacctataagctatcagatgtaagcgggcccggcctaaaaaataacaaatgtgaatgtgaataatggatgcattagatagagtttacactaatttgttatttatattatattattattagacaataatcactatgaatacgtagccgcccttttgcgcgccaaccaatcgatgtaatagtgttcaaccaccctcttggatcagtgcacaccttcatctggcctcaggcctctgcggcggcttcttgtgcctgcttcttcttgaactctatcatcatgccggcgtccggcatgaccgccttgtaggcctcgagctcgccgacgcgctccagccacgccgccaggagcggtgtcttggcggcgtcgaactgcttcaacccgaacagctcctccatcgcatgcacccacgggacgaagccaccgagcgcgacgtcgacgtacccgacggcgtcgccgccaaagaagggcttccccttggagcactccctcagggctccctccagcgtctccgccaccgcgaacgtctgcttcctcccctccaccttctcctcctccgtctttcccttgaacaccatcttccacgcactgaacagctgcatcattcgatcagcaccaaaatcgtcagaaaagcttgcgtgagagaactgatgtacggtgatcatacgaattaccttgtcgtcgacgtaggaggcccagaagcgagcgacggcgcggtcgagggggtcggaggggaggagggcggcgccggcgccggggaacgcctcgtcgaggtactgcacgatgaccatggactcggagatgggcttgccgttgtggatgaccacgggggtcctcttgtgcaccgggttggagctgacgaggagatcgctcttgttgtggaggtcctcctcgacgtactcgaagctcaggcccttgaagctgagcgcgagcttcactcgcagtgggaatgggctcacgtagacgccgagcatcttcaggtcatctcctcctccggccatggctatccaacgctctgaggcctaagcagtagtacgtcccaaggattggagcttttggcttttgttttgttgggctccttgtcttttggaggtacgaagctatgataggtggtgtatatatatatagagagagagagatttgcctctgcctgcagggttaactgatgtagaaactattcagccagtgaccaatttgttttgaatatacttcattgatttttcttggaagtggatttttgtccctcaagaggatatccactcgttttatgcatagcattcagaaagttataaaaaaatttgaaaattttatcaatatagataaatatatgatatatcttttcgcaaacatgcgagctaaaattcgaattatataattcgaaacaaaaataacaaatttgactgtgaattacacgttctattcgtagtcaaatttattatttttgtttctacttgtataagttgaattttaatatgcatgtttgtaaagtgacatatcacatattgatctatcctactaaattttttcaattttttatgacattttaagtaacatgtaaaaatgaggggatatccccttaaagcatgaattgagttttccatttttcttgcccaccactactatgcaatactattctccatcaccctgtaagttttgagatgctgacaatccatccagattgcaactttctactgcccttgctttgcataaacgcagtcgttagactatctccaacagcctaggcatagcgacaaccaaacccaaaatgcgtgctccaggctactgtagcggaaaaaaacagggtccaacagagtacccatactaaggacctactttgggtgccaaccgaggcggaactcaaatatgagcgccctctctcctcaaccaaaacacctagcgtaactgtttcgcgggaggcggagagaagaggaaagcgcacctggccccggtgataggaaaagctccgccgccggcgagatctgctctgagctaggattcgcaagtatggatctctctccaaccccaccctccttcatccctggtcccatctctcctctctctcgacgtggatttggccgcggccgctcgcaccctggccaagggcgcatcgcgccgcatgctgtgcctagccccagcgacgccgctcaaatttttgttgaccgcaccctccctggcatgtttgtgccatgtttaattgaatctctgttgtaataggatgatggataaaaatattggtggctcaagtgctcgcgctggcgaatctgaagaaatctttcggacagatcagtgggcttttggtttttctgccgctttgcattcttttgaaagggaatgtgacatcgaacaagcaaacatgcagccggccttgtccgaacaagcaaatgttcgaacggaattagccacaaattaaaagggaatgtgacatcgaacaagcaaatgctagaaatcatattacctgtgttctgattgactctgctgcgccaacgttcggccttgtccgaacggtcgctcgccggcggctacctcgctgccactgagactcccttctcacatgcagccggggcggcaaaacaatcccgccatcgagccaacaccgcagtcccgcgccccgcgcccggtatatctcgcacgacaccctccgtttcccgcgtaaaaatttcatcgcgggcccacgaaggaaactgtccgtgttgcagggtttccttttgcgttcgctgttggagaaggcaagaaataggtgcgtgacccttttgccacaggtgacacataccgtccaatgggtctcctgttaagggtattattgttagagatagtcttatatggtgctggtctgtctcttgttcctcgttacttgcctggtctgtgctacacacgtggcacaactactgtaatatctgatcagtgacgcttgcttgttcggctgttccgttgttcgtcatcgatgacggctgcgtttgatatggctgttgtgcttggctagttagcaaggaaaataagacgagcaattaacgtgtatttaattaagtattaatcattataaatttgaaatataaagtcattgcttaaagaaaaaatatataaaaagtttctttaaaaaattatatcgtttagcagtttagaaagcatgttcgtagctcaagtaataagcagaaattttgatccagtattatcatctattaccttatgcctcgtgctactgcaaggtttgaatgatgagcttttttgccgtccagcatgctgttgtgataccgaatctatcatggttacggataaaacatacctcttatcctatgactgacgaaacatacgagtatggtataccatcatccatacgatatacttccgtatgtgataaggaaatctacaagatattatggaaaatatcctcacggacttgtgattaatagagtcctactcggagatgattgggtttatcctatatatatcgtgtagggttcattgtctccgagttctacttagagactaaggcaactcacggtataaaaggcacaccccctgaggggttcagatcatcgaatcatagtgccaacacacttaccataatttacgaagccggaggacgcgaagccagactcgtcgggagatctcgtcaaaccatctcgacaagggtctcgccggtaacgccggattcgtctgttctctttatactctgtggttttccatataaatcttatataaactagactaaggctattacctcacgaggggcctgaaccaatataatctttatctttgtctttcgtgatgtcgtatcgtatagatcctcgtaccaacgtacctcaataccctatttatcctgtctacgggtatccctcgtcgacagaatcctatccattagtttgattgatccaatggctagcgtaggtcggtaccacgaggtaccattttagtccttggggtggtagtgctcataaaatagaagtggaagggtaagattgtcctttcacattgcaaaattttttttctcggtttgaatttgtatggacggatgagtggagaaggcaaagaccaaccaatgccgtggcattcatatatctttgcatcgccgcatcttcatccctcatctacttccatgcgagctacgtttccacctctctgcctacttatgtgactctgccgtcgctgcccgccactaacacagtcgatttagtcgcccatgccgccgtgcggaggtggagagacggcggcatgggggatggagagtacacagggatattagccggcgtcgccctgcacggaggaatggcacttcggcaaggaaacgatgcatacttgcatttcgggaaggaagaatgtggcggtggcggtgacgtcgcaagcttgttccgggtgctggctttatttcgttctcgattgtacccctcgtgattaaacggttggatttgttttggtacctggcaataccagtacctaggggtatcaatgctagaccagagcaaacctcttgaatgataatgtcttgggtgacggcctttcgaaaaagaaatgaaaatgggagtaggaaaaaatacatttgtatgaagaagtttatttgaacaaatattattgaaacaaatcaacgtatgaattaatatagacgtagcacatcatacatcatcttggtagaatagccacttcccacttggcaactgcgacggtacatggcgaagatacacggtgcggcaatacgaactgatgaacatagttgcagaaacaagacgaggtacagccataggaactgcgaaaatgtggaagcacacgacaatctatatggttgtgtttcaaacttcaaactcccctccaggattcagcaaacttcaactggcctcacccgcggcggctgcggccgcccccgctgcctgtgcctgcctcatcttggcgagctcgaccagcctgccaatgtccggcatgacctccttgacggcgtcgagctcgtcgaagcgctccaaccacgccgccaggagcggcgtcttggcggcgtcgaactggttcaggccgaacacctcttcgatcgcgtgcacccacgcgacgaagcctccgagcacgacgtcgacgtagccgacggtgtcgccgccgaagaagggcttccccttggagcactcgctcagtgctccctccagtttctccaccaccgcaaacgtctgcttcaccgcctccgccttctcctcctccgtcttgcttctgaacaccagaatccacgcactgaacagctgcaacgcacagaacacacgcagatcgatcaatcagcttaattcacaaacataagagagaaatcaagtaatcaataaaagtgcatggtgatctgacgaaccttttcgtcaatgtaggcagcccagaagcgagcgacggcgcgatcgtggggatcggcggggaggagggtgacgccggcgtcggggaacacctcgtcgatgtactgcacgatgacctgcgactcgcagatgggcttgcctcttgtggatgagcacggggaccttcttgtgtaccgggttggagctgaggaggacatcgctcttgttcttgaagtcctcctcgacgtagtcgtagctcaggcccttgaag

SEQ ID NO: 63479 - DNA, 5638 bp, Oryza sativa
tagtaaaaacacagtaaagcttccaaaattcctttctaaatcattcaagctccattttaattcattcaagtctcaataaattcataaaaatgtctagaatccattaaaatagttttgtttcttgtttagtatatttatagcatgttttgagtgcgtgctttgtttgtcgtatagaattccgcagttccgaagctcccgtttattatgaagtggtcactaaagttcctccagctcaggagcaaggcaagtcatacatacgcattgatcatattgtacctattttgtaaattcctcgcttttttcttaaaatcgcattgttttataatgtcacgagggatggatacgtaatgtaactcagcctttgttattctatatcattgatagcttgggatataaaatgattagatgattggtttaggtgatgcttagccatgcttagatcaattagtacactatgggttccacacgaattcttagtccttaatttaatgatggaataccaccatgatattaattaaactaaaacatgacaaatggttggttgtgggtccatggttttgatagtagcaccccatggcaattaaggacctgttcttgggaaacactggaggaattacccgtacttaccacaagtcaacgtgggcaatgattggatttggagtgtagcttctttctaaccgagtaccaacgatagggtgggcgtgatgaagtaggatgggtcctgcgacgacctctgctacttccaaatccacctaggcacgagtgggggttgtccactgctggtttatgggtgggggcaaaacctgatgtgggtgcgatttgttaggaagggttatatgaagggtcctgtcagaacctctttccaaggtagcatggtggtattgaggcgcatggtaccatgtcgtgggctgtcttgtgggtaaagttgtatacctctgatcagagtaaagctattcgaatagtcgtgcccgtggctatgggcggtcaaccagattcactgtgattagtctcaccttaataatttgatatattgaactggtttagtgttgggcatgtttcaatgtgatttagcgttgagcagtgatgtttaatattgattaatttatatctactattttactatattcaaattgtgatatgaaaatgttgcttatgcaaataacccatagctctcctttggtattattctgcatcgtgccttctattggttgttgttatggcttgttaaatacagtgggtagtactcggtcttattttatttttcccccaacacttagaagcaaagtattattcggatgaagattattgggaagagtaggcttgttgcggtcttgcggacgtcaaggatgcctgtggatttggagacgctatgttttcccaagagatggatgattagctaattcgattatttatttccgctgcatatgtaagacttatttatatttttgtaagacatggatctgtgtattaatattgtcgtttgtgtatcttggctagtctggacagagatttcaatacacattctgcttaaaattcggatcagcgaatttttggacgtgacaggctactagctgggagtctgggacccctgagctctagctcctgcccgcccgtcgcccatcatggcatggtcgtaggacacaaccggcggccttttcttggcttccggtatgtatctatgctgatctagctcatttgtgattagtgaatccataaatattccactgccaatttgtgattttattggcaatgaagtctatccaatgggtgagagtcggttgaatctctctccaaacgcgatgacgagctactcccgacttggtggtgtttgttctgaagatgaagataaagataaagattaagtttttcacgtaaaacgatgtggtaatagcatgtaattaattgagttttaattattacaaacttgaaaaatgaattaatcttatattttagaacaactttcatatagaaaattttcgcaccaaacacaccgtttagcagtttaaaaagcgtgccacgagtttccaaaaatttatccaacctttattagagaaaagaacaggacggtgctagatgcttcttgtattgaagcatgtcataaagattgacaaaacagccgctataacataacagactttgagttgagtcgtgacttctactacctccgtctcaaaataagtgcagccgtggatatccgtatccaacctttgaccatccgtcttatttaaaaaatttatgaaaaaattaaaaaaaattagtaacacataaagtactattcatgttttatcatctaatagcaataaaaatactaatcataaaaaaatttctaataagatgaatggtcaaacgttgaacatgaatagtacaaaactgcatttattttgggacggagggagtacttgttttgcatttgtatcaaattttaactaattttatacttgtacacatgttttatctgtgttcgaaaattttattatgtgatataaacctgtgaagtaggactatccaacgaaaacttactagctacgccattacttgtcgcacatttttttttaaatgtgctaggcatgatgtttaccactctctaagctggactgggattactggtattcaatgaagaccagatcagtatgtcgtgccacccatcattctgcttcgtttgcttgcttgcttacacaaacccacagcttggtgtttacagctgtactaacggctttttcaatagagtacgatcagtttattcaccgaaagataaagtatatatatatatataaaaaaaaagaagccgaccagcttaacggctagtcccgtaacaggcggaggagagagagactttccgaccagcccgttacccatccatccccaccgtccatcccggatcgggctcatcctgatcctgccacgtgtccacgtgccctgaactagccgttacgtcctttcgtccccgcctggtccccgccgtgagacgcacacacgttcgctgccaggtgggtcccacctagccgggcccgcgtgtcagcgtcgtggtggcgtgtccccaggtggtgtgccccacgttggtggaagggaatctgatctaacggctagttttctccgccgccgcctataaataccacgtctcctacccgcctcgccaaccaccacacatccagcgtccatctctcccactagcgcgaatctcaagcacttctgcctcgtcttgtccggcgaagagaccaccacgaccaccgcatcaatggcccgcctcgccgtcgccgccgccgccgccgcgctcgtcgccatcctctccgccgtggcggtgacagcgcagagcccgagcgctgccccgaagatggccccgctgccgccgccgctgaagatggggcccctgccgcctcccccggcggccaaggcccccaccgcctcggcgccgtcgccggtgacggcggcctcgccgccggccccgccgatgtccccggcctcgtcgccatccgacgcggcggctgcggcgccgggccccgccgacgccggcgccgcgacggccccgtccagcggcgtgtccgcgcccgcactcgcgcccgccgcggccgggaagagcgccgccggcgccgtctccgcctccttccgcctcgtcgctgtcgccggtgcgttggccgccgccgccgtcgtgttctagatttagaatttttagatagccgcggcttcgccgccgctgctgttgatacttgtactctaccgccactctgttctcgtttttttccccattctttatttgtttgattaattcgagaccgagagggagattgattgaaaatgagatattattcgggttttttttcaagcggaaatgattatcattacatgcttcatagaagataagtgaagtaatttcgtagaacattatctgaaaaagtttgataaattcttctcccatttgttgctctgcttaacaggggaatattaacaattgaattaaccgattcgacgaatattggctaaagacctaagaggttttgcacaaacaatctgaacatttgtacagagctgaagttgagttctctgaaaatttagtgcttcttaatggtgcctcttgtgccatgcttgtgattatctataatcggctcgatcatcgtcttcacgtcctcttcgatttcgtcaacctgtagaaacagtcaattcgattgataatttctggtgggactcgcatattaaaaaaaaaaatccggtttttccggaaaccatgcccccaccatttgtctcattttaccgacaagttcaaattcaaaaattgaaatcatagctatctgcctacccgccagaaaaattcaaattgaaatttgaatccatagcctacgctgtttttggtaccagaagacgctatcttcattgtagtagtctttatatgattcaaaattattctaaaatacttatcttattgtagtagtctttatagtagtccaaaaatactttcggcagatgagatagttccaaatattgaagcaatattctcttttggaaccatcgtatcttatctaatctctgaaccaaacacataaggggatgtttagatggggctaaaactttttagctcatgtcacaacccctaaaaatagaatgatcccatcccaggacatctcttcaaccaaacacatgcctaaagtattagttatctcatgcatcatctttcatttaaatttcttcctatgatatactctcgaatatcactccactatccacatcatttaataagtgccaatatagccttttttttccataaaaagtcttaatgtatgttaaattatctatatcattgtagtagtatgtattttgggacggagacattagtagaatagagtagaagcaacataaaggtcagggtttcagtgttgcttaaagccatggagtaccatcgttttcagtaatccagtgttgggcaaaatagcagatttcttactcctctgttatggaagctgcaaaactgtgatcagataaggattaattaatggttagtactaaccttgtggatgatgtcgtgggcgagatgagcctcctcggcgacctccctggacgcgcgctccaccagcgccgccgcccgccgcagcgccccgtgctccggcagctgctccgcctccgccacctccgccgacgccttctccaccgccgcggccacctcctccaccacctccgccgccgtctccgccgcgtccttcaccatctccacctcgcctgcaattaacggccatccaacgaatctcagatcgtgttcctgtccgatatgaattaatcgcaagaaccaattcgtgtgtgttttatgtgtgtctgtgttgtttttttactttggattcggagaagcgtcgcccacttggactgcaagaacggcgccatggcggcgaggacgacgaccaatcttgccctggcaacagaattaggacaagacggaataaaatttcgtggtaaaattggaaagcgcaactgattgggtggtttaaatctaggtgtccacgaatattatgcacatacaaataagttttcataatgagtttagttttcataacgaatattatgcccagaaatattatgcacatatattcgtgaagatgcgagtgcggtgttccgtgtgcagtggcgttgtgctcctctgccgtttaatcgaagaaaa

SEQ ID NO: 63480 - DNA, 6023 bp, Oryza sativa
  unsure (1)..(6023): unsure at all n locations
gacaaagtttttctcgcaaactcaaggctggtttcaaacgcaaagaagacattaataaaaacatgtttaaaatagagtcaagatctattttaaaaatatcatctacatgtaaacatttataataaaaattcaagcaacactatctagttcttttaaaagaccagagtggtggtgatgagtaccaccgtcatctaacatgtaggcccatgaaatcggtggaccccgcattccccacatgagcgttctgtttgctctctttagttttctagccgtttgaaatttgagcaagatgagaagcttcacgtttttatgaagtgcaccacttcatccaagtaaagataagatattttttcctgaccaagataactgataattatatttttatcttaaataaatcgttgcaatgcacgaatattttacttgtaaccagataaattggatcagggtttcggaaaggcaaagtaccacagcaaatcaatcataaggaggaaacaacgtcgtccatcataaacctggaaagagatccatgtgaacacgatcaagtgaccaacgacgggtgcagtataaccaaaataatcaacaattagggaagcaagcggaacgggtttgcaagcttcgaggcttgctaatcataggattacaaaccataaccacaaccacaaaacagaagtgcataacagagagtatctaaaaataatatgtgcataaaagagagcagcagtaatagacgcagccggctgcgagttcttttcacccccatttctcttcagaagaatggttctgacgagagtgaaatggttacaaagagaaatactacttgttcttgtagccagcaacctctgaatctggtcatttttaatgtaacaggcatcacctttgatgatacccctttttgcctaataaaatttggtcagcagcttacttcttgcctggcaaaaaatagcattaagcgatagtaactagtaagtaaaaggttgtattttattcccagaaattaattatgaaaaagtcatcaaccacccttttcaccttgcaagaatgagcagttccattagcttctttcagtcacggtcttcgaatcagaaagtgccatctccttcttttctgaacgttgaagacctgcccagtacctcaaaactattattagtctgaataagatgtctggtgcatattgccctttttattttggaaatgggaacagttccaggcattccagactgaccaacagactgccaagaaacgcaaggcatatggactaattttagtatcacccagaacatgttttagttatataagtcccagatgcctaggttaataatctgtattcatatgcagaaataaccaatggtaactcaatttagtttatcttaggaaactattcacatgaagcattactgacttcttgtggaagaatcgcgcaagtgtagacacataataaatctatctattttatactaaaagtccattaaacttcctatgaatactctgaagccgccacgtggcactcctacaaacactcctaagtcgccacatggtattatctaatctcaccgttgatttttacttaaatcgatggatccattagtttacaccattagattagatctattataaaaaaataataacctcatgtttataacatacaggcgctactaatgtccgtacgtatgaatttgtatgatacaaattctactgctgatctttccatacgtacaaacgtacacgatctttcctaatcttgctggaataaaaaaatatacacatggacataaaaaaagacagaaaaatcatactaccttcgtcccaaaataagtgcaaccgtggatatccgtacccaacgtttgaccgtccgtcttatttgaaaattttgtgaaaaatttaaaaatatttaattacacataaagtactattcatgttttatcatctattactgattaataaaaatactaatcataaaaacttttcaaataaaacgaacggtcaaacgttgaacgtgaatagtgcaaaactgcacttattttgggacggaaaaagtacatccataaaaatcagcggtctttaaaatatgattttagatcaaatatattacttcacaaatataaatatatttagttaaataaagatctataatatatatccaatcaatgttctttaaaccatattctaaatctatctaatatatagtaaaagtacattaaactttctacaaatgcttttacactgctatgtgactctcaaataaattagaaaaatcctagaaatctattatatactaaaagtctattaaacttcctgaacgctcctacgttatcacgtgacgctctaatttagagaaatcctagaaatttagagtaaaaaaaaatccaaccttcaattttcaacttaaattagtggcccattattttaaacattggattagagctctttaaattcccatgttgctaatctctatcccggaaaaaacataacgtgcttacgtcatacgatcgtctccctacccaaaaaaaacaaaacttaaatacctacaccatatacgatcgaaaaaaaagataaagccgaaaaagaaaaaagaaagcatgcacagtagaatcggaaagaaatactaatcaggaaaaaacatcggtgctggcacagatttgttgtcaacagcctttaatctacgattttaagatcttcctccccaatctgatattgtagtcctggtatagatagaaattcctttatggtctaattccgagcggtagtaaatactaatctgattttgagttttcgcttacaacgtttgaccactcgtcttattcaaaaaattttaaaattattatttattttatttgtgacttactttattatctacagtactttaagcacaacttttcgttttttatatttgcaaaaaaaattgaataagacgagtggtcaaacgttacaagcaaaaactcaaaatcccttatattgtgggacggagggagtaggacttagcaatatttgattgatcacaatttggtatattccatttattataaaggttgctaaggaactcattatagggatgcttccaatagaactggtttgtttttgcacatcgaaaccaaaaattaatcgcgcagagaagaataggtgagcaattcatacacagcatccctttcttttatcgaaggttctagcaattgatatcgggatttttaccgaaggttctagcaattgatatcgggatttttatttaaatctaagatccattcttatcacattagtagtatattgaaatctaccgtttattttacggtaaatatatttctttttttattgtaggataatctaaattcccttacagtatatatatagtgacgtatgattccttttagcattttttttaataacaaataagaagcccgtgcatctgtgcgaaattcctttctgatttatattccagaaatgtcctccagtttatattatgtcgttatagtgtttgaaacacaaactataatacatgctgacgcgaatgcgcaggctaccttcctcttcctagttaatacttagatctataaaatggagcgcaaatgagaaatcttactggtgaatttccatcgtttcacacggagagcatgataacgaatctgatgaatgtgtttaacatagacatgatcctctgcatgtgtcctctccatgaattcttttggcatatcccagaggcgtaaaatttgtagtgatgtcagatatttaaatcctactggcacagatatcatattctgcagcccacataataccaaaatgctcaagtttggcattgtgccagcttcaatatcaattgaacgtaactggtccatgtcagctaaacccaatttccctaagatttggaaaccagccagcctgaaaggtcatcaacaaaccatcataggctttctgaaggtaaagttctgctaggttcgacaaatgtgagattgcaggaagaggatcaacctgcaacctggaccaccctatgcttaggtatcttaatttactgaaattctgcaaatttgatgtagcacctgctccatgtaacttccctcgtaggtgcagccattccaaatctggaacatggcccaaatgttgtagatcaagtatttcatcctcaccatgtgagactatacccaacctaacaagatttggcatactttttatggagacacatagtttctccatatgatcctgcttcacgtcgcagatgccaagacatcgtagctgtgttaatctactaagnnnnnnnnnnnnnnnnnnnnnnnnnnnnnnnnnncctagcacttgtaaatccgtcagaagataaaattcagaacaaattcgagtggcctggaaccgaggaaagtgtctgtgtaagttgctaggatcacagtcaacatcgacagataggaaccgcaacttggttagaaactttatttcttctggcagctgttctacaaatgtctccctaagatccaaaagtttgtagcttcctcagcttcccaattgactgctggatctcttgaacttctgtatgacgtaaatcaagataatgcaaattgaacagataagttacagcatcaggaagcttcacaatttttgcataacgtaaggacaagacccttagcaatctgaaattcgaagttgccttttgtatccatgagaattgcacttcctcatcgaacaaaataaaggacctgatctttcttgaaccttggccagattccattgatttcccgcccttcactaaggaaactcgacgtgcttcatcactcagttttgtaacacacgtgttgtctgctaggagagaaaacttttcagttttgcattttgtcactgttatgtctctcacaagatcatgcatgcgaaatgactttggtctctcatactcttttgtccaagcaacttgaagaagtgaacgttgaacaagttctttgaggtagtcttcagccacttcttccaatgtaatatctcccctttcttcaataaaaccttcagctatccatagccgaattatctgttttcttctgatctcatggtcttcagggaacatgctacaataaaggaagcaattttttagatttgctggtagataatcgaagctgagattgagaatacttgttacatagttgagcttttggttcttggttagttgccagttaagttgaccatagaacaacttccactctgcctcatctatttgcttataggatagaagacttccaatggcaacaatagcaagaggcaatccttcacacttgctgacaattttttctgcccagtgcatcacaacttgaggacaaccattctggtctagcctgtgaaacgcttttcggcagaagagatcccatgcatccccccatggtaggtacttaggcttaaaagaacacccgttatttgcaattgatgctacatcttcatttctagttgtaatgacaattctacttccttttttatttttcacaaaagcacgatccaatagaatccaagcatcttgactccacatgtcatccaagaaaattaaatactttttgtcctgcaggtaatttcttagcctctctaccaagcttaccctatacataatgtcagtctgatcaggaatgttctcattcatatccagaaattgtttgagtattcttctaaacaaatcttcaaccttgtagttttgggagattgtaatccacgaaaagcaatcaaagttctttctaatctcattctttttatagatggcccgggcaagagttgtttttcctagcccacccattccacaaatggatatgactgtacgggtttcttcgccatgtatcaataatttcataactttttcggattcttctttattgccagccatatcatcttcagtatcaaaatacgctgaatcagatgtaagctcctttaggctctcatgacttgaagtgctaccatcttcactgtcatttgctgaaatgccataacgagccttcatgtttgtgaggttttgaaggcgagatttgatttgtgaaagttgtgttgcaataatgtgccaatcactggtagttttggagcaatgg

SEQ ID NO: 63481 - DNA, 761 bp, Oryza sativa
ctctttccgctccggtcgccgttcccgtcgtcgccatcgatccggggtgagccatggaccgcccatttcgtttcccccttcccacccctctttcggccgccgctccgccgtgcctatggccgccgccggcgaccataggggcgcgggcgcgccgcctcccgtcggccgtgccggcgaggccgccttcgggcgcgccccgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaacccgattttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctcttcgtggaagttgaagccggcgtttgggaaagcgagcaaggcaagtcacatcatacttgaacatattgaatcccagtttatcaaattattttgatttaaattactgcattattgctttatttaaattcc

SEQ ID NO: 63482 - DNA, 3083 bp, Oryza sativa
aaaaaaattcgtggcaaaatgcgtgcaagatcgatcaatattacagcgcgcgacgggctggctagctgtgtaccaggtgaagagaggggctgttccttctttgccatgccggcgcggtgatcctcccgtgtccgccgcgccgccgccgccgccgccggtggtggcctctctgcacatgacaccacgacggcaaactcagcggccggcaacctgacgacagagagaccacacggcgacagagacagcaggtggagcagagtaacgtacatgcgatccaccctggacaagaacggcctccgttgatccagcgccggtgctcgcgccgccggtgtccccgcggtggcgccgccgccgaggcggacggttcgccggagcccctggcagtagagcgacgccacggacctgacaagggccgacatttttcacaacgatcgaccgcgatatatcggagtaaatgtctatttgatcaccggcctatatatacacgtccacatatatatatagttcaggtgacgcgaggatgagaggctggcttgcaaggcatctgaagtggagtaaattctgaactgatctgataaggatatctgaatatatgtgataggatgctgtgctgagctgggtgaatggacctgtgggcagtgtgcactgcattacacgtcaatgcaaagccactacacacaacattgcttgcaagcagcgtggtgctatgtgcgacaaaaagatacacatttttgtagagatggaaaatcaaccaaaaaaaaaaacaaattgagctaggcttgcaagcaacaggcaggggctaattcatccacttgagttttcttttcttcttttttttttgttctgttctgtgttggcacacaacgatactccctcgttctataacaaaccatgcaacacatcctattacaacaaatttgaatagaatgtaccacatccagttttatatttgttgttttttttgaaacagagggagtagatgtgaagatgagtaatacacccaaatccacatgagaagcctctttttctggagtgcgctttccatttgtaatgatcaaaccattttttctattggtatcagctataacgaagtgacacatggcaccattttcccgaagacgctattagttccatgcttttccaccgtttctttttctcccctacaatatactccgtatgtgcttacttaggattacgcatccgtaaaatgtactctgctcacaggtcatgaactcacaatatatcgaacgcttgaaatatggtcttaaacgtaccacaaaagctcataagcgtacagattaacacacttttgtccaatcatggaatctaatctcaccacgatggactgattacagggacaaagaatctcgaaaacgaaaaagagctggtccatgatgattgggtacggcccagcccataatggtctattcgatattatcaacctatgaagcccataagttatatttagtgggagaatttaggcatggttatttccagcaacttaattggattgttgtcacgaattagtcgttccctacctctctaaaactatattttctacaaagaaacttccttatacatttagatccactcattctaagttattcattcattaagtttatttatcaatatatttaatttgtatatataatcgtatggataatcttctacaataatctggttcaacatgggaccttttccattggtaccaaaacttttgcaccggaaaaaaaaaatcaaactccggtcgctacagctctgtgaaatctcttcgagttgccacttccattgtgaccggctgtaaattgtttttaatcttaacaattgtgctagaggagaggctagatgcagctcaatagaggtagggtgagttcaacgttttctcgcgaacgcacagaaaaattgcacgccaatatattagaaaaaaagaatttttttacacaacgcaatcagccagaccggtctaaactttttttttccttggattgcgttttgtaacaaaaactctttttctccctttccctggtttaattagaccggtcatctttttacttcacccgcagaccggtccaaaccaaaccaggggaagagagaaaaagcaaaacaaaagctgcagcaaggaaaaggagaaaaaaaaactacaacgatggctaagcgcaactctgatcagctggtgagttcaaagtgaaaagatgaaatacagagtgtccaaactaaaacttgaataataaaagatggtccaaattgcaatttactcaatttatttccccgtatcattttaagtgtagttgtgggtttcaatgtccaacgtttcaccgtcttatttaatttgtttataattagtattttttattgttattagatgataaaatgtgaatagtacttcatgcgtgacttatttttttataatttttttaaataaaacagatgttgaaacgttagacatatgaacccacaactgcacttagagcaaatataatagagggctgtaagaagatcaaatactgatgtggataagagaggagatgagagagatgagaaacgggctataagcttgcagccagcttaagcacaggaaccaagaaaatctgtgagacagatagatgggccatatatttatagtgagtaagtagctggttgtattattagcttctcttgaaatgagatactagctataattacagaggaatacaccgtttaatttctctagcatttccatcaaatctgctcggtgcaatgccattcacgagatggaattaggtgtagcactgtagctagcagtgccttttgggacacgtgggggccatggctgcactgctcacctctggggatttgcttccacgtcagagacacacaacatgctagcttcatgtgccagcaaagcttacgtgtacggccctgattcctcccatcacatattccaagtgctccttttttacttttcttttctttttctttttacaaaagccacatatattgcacgtgttttgtctgcactctcgattggctactttgcacaagaatgcgcaccacattcagaattgtaacatgctttgtgatctggactttctgtaggttttaaa

SEQ ID NO: 63483 - DNA, 4163 bp, Oryza sativa
attaaattcattccatcttcaaaccaaacaacgtgtaaagtgcattgtatatcatgacgtctctcattttttagtttcctttcagtaccaagtaattgatccaaacatatagttaattaaacctctccctgcttcttaatatatgccaaaaccaccatatctcaaatattatattttctagctagctaatactagttcgcaataaacatttgatgcctgcactgccaagtgccattacatacaagagaatccccagctggagcacatctgggaaagtaggcagctgcaggcagtacaattcacaagctagttttggcatcagcaaaagcctgctcctcctgcatcctctccagaatctcatgcactgcagttgcaatctcctccacagacccaagcttacatccatcctccacctacagttatacatccaaatcacaaatcattattcttcgcatcataaatcataaatatctattttgttcacataaaatatatattaatacattttccttaagaacaaaaaaaacaaatttgccacctctaaattacttttaacatttgtcaaataaacaaggtagatgctaggatttgaagtcgggtgggttggttggatcatgaaacagatcaatataaaatataagaaaaagaaaaatcgaacaccattggtggttgagactgaccttgaggctgaaggagtacatggccatggcggcgacggtggtgacgttgagatgcaaggtggtgagccctagctggtggagcccggcgacgagcttgagcagctgcctcggccgccgccgcgcctgcaccttgacgctggcgtggccctccaccatgctcgcctcgatgtcggcgatcgccgcgccggcgccgccaccggcggccgtagtcgtcgtctctgcaggcttgacgacgatcctgctgtgtgcatcgccgccgccgccatggccggaggtggcggtggagtactgtgggaaggcgaagaagccggcgaagggggagggagactcgccggcgccgccgtcgatgtggtccttgatggtccttctcgcctccagtgtttggagcagctgctctagttccctcacgtagttgattgctcccccaactatggatgcttggtcaccctagaaaagaaaaagaaaacaaaatctatcaattcgttttccatgaaggtgtaaaagtaaaacgatgttgaacagatgtaaattttgaaatgtgggtttgatctgatttatcttctgatggtgcattgattttgaaattcgataaatttagaattgatatgaaaacaaataaaaagattaccctttgggcgtaggaaggtggcatgagggagcggagcacggcgaggtactcgttcatctggcggcggcggtttcgctcgacggcaatgtgggtcatccgctggctctcgatctcctcccggttcttcgccgccttcgcccgccgcctctttctcttccccgccgccgccgccgccttcacaggcggccgcgccgccaccttagaagaagaagaagcatgctgatcctgatccacctcccactcatccacgccctggatcacatcaagagacgcctctgccgcgaacaggccgggatcgtcccagctcccgccgccaccggcggctgcgaagacatcccacggcgccgccggggcgccgcccatcagcccgccgccgtacccgccgaaatggccgccgtgggagtaaaccaccgcctccagcgccatcaccttccaatgccagcaatggcgtgcggtggctggccggtaagtgtgaacgaacaccagcccgcaccggccggcggcgggggaggaagacgacgacgagcgaggtgaagaatatgggaggagaagacaatggtggtgggtggccaatggagatggaggaagctaagctaagctagggaggggttttatagagtggaaattggagcaagcaaagagccaaggttagggtagctatagccaagaaattgaaatgaaggacgacatgaaggtcccacaaaggagaaagattgggggtggctggattttgtgcttgggggaatgagacccaatgattaagtatttgcaagtagctaattagggggttgtagtgttcaattaatctttggttttctatgcaattgggcagggcaagaggggtgcatgtagagagatttgatagagaggtttgtgggaggaaaacattccttcttgccttgaatgtttatgtggctttttctccttaattgtttattgatgattgtggactagtgtctagtggttgtatttttgtggtttaggaggatgtgtaagcttgctagcttgttgaacttgatttgctatgcttgtgttaggaacctaggatcaaataatggtgagtttttctccagataaggataaccaacgatagaactagcatgtagaaattttgtagagcctgactagataacactagcatcccacatactttggtgtggcagctcgagcaactatatattgacgcagctgattccaccaccgggttatagtaaaaaagttggtaactaaaccacattttgccatcactttttggtgtagtacacgcatgtgggtacggtggaaccaaccaaccaaccgatcttatatgatgttttcagtatattttctgcgtacatatgagaagtgtgtgtgtgtgtgtgtgtgtgtgtgtgtgtgtgtgtgtgtgtgtgtgtgtgtgtgtgtgtgtgtgtgtgtgtgtatatatatatatatatatatatatatatgtgtgtgtgtgtgtgtgtgtgtgtgtgtgtgtgtgtgtgtgtaacactatgatactagactaccgtctaatatattcttttctagtgttttacgctaacaaaaatggtccactttttaacatgatcatatcccttataggttgtgcacatctcgatcacgaaatgccaaaaatctgaacagtgacaatagatcatgtctactgcacaaacctaagtgatgaccaaaagaagttttcttgagtgacgaaacccatcatatgtggctggcatccaacgtactacgacattgtagcgtgacatacccaacgcccatttgccgcgcaccggttattaagctgatcagacacctgcctagtgtcaatattattaattgtttcttggtccgtgactagaatagtagtaaaaattgctggcaaaccaattccatcttattgtgatagaaattaagagaaataaataagcttaatttagttaatatataacaaaagttatttgtaaaattccaaccattctatttatttggaaaatatccaaaagattaaacgagaatagaaaatttccacctcgcctaagtagagatattttacaaataaagaggaaactaataaatttagttagaaaataagataaaataaaatatttttgataccaaaatatttggttttttgataacctgctacacttttgctaccattttttcggggcaataatgcattgtggatacacacaccaacctaaccaaccaacctcaaatggtttgatcttgtagtgagcatttttcatatgcacaaaaagtaaattttggcgcaatactactacaatacaactagataccaggtaattatatatactacaatattttgatttttgaaccactacagaaacacacaaaggatacgacactataggtcctgaaacagttaaaaccggcacctatagtgcttttcccaccacaaacgcatacccacagagcaccatcggttagaatcgacacctttgggaagaaataggggccggttctagagaaaaactagcaccaatactatatgtgctagtttttttaaaaaactgacacctataatatattataggtgttagttaataaaaaaccgatacctataatatattataggttttggtttttttaaagaaaccaacacacgtaataaccaagctgagctgagccgagccggccactcacgagtggatatggagagggaagggccgagtgggcgtccttatccactccactcacctcccagccacgagggcgctgcagtcggcatcgatctgctcggaggcggtgcgagccaccaaggccatggcgtgcaaggtgctgctgcgggtggcacccgcggaagagaatcggtagctgggacgatcggtggagcagtgccggtgcctggg

SEQ ID NO: 63484 - DNA, 708 bp, Oryza sativa
aactgttacgaaagattgatatacaaacatcattatttaatggttaaaccacgtgcctccacaaggataataagttactgacctacagaaggtttctctacactaaatttttcgtggctgttctgcttttatttttctatttgtgttgtttggctttcgttcttttcttgatgaagagtcgtcagagaagcaggttatttatagtaattcgatccatgctgttgcctgtaaatctttcagtttcatcatatttttgaatcattcatatgttttgctgtattttatttatcatatacaggtgaaagaaatgtttggctttaaatcggatgagccaaagaacttcattgaacattgctgctcatggttactttctttccttattctgaggggtgagactgccgatcttaattggctatccaaggtgaatggatatttgttttaatattggcagtcatgtagttcaatatttgttgtgtttattgttattctaaaattctggaagcttgccagttttttatttaactgtcaccgtgttaaggactaggatctccatgtggaactcctaaatatggtcctaacttgttggtttaataaacttttatacccctgatttttttaacttaactgtagaaagtggtcatactgtgtaacatgtcaaacaccaatttcccttaaaattatcaactgtgaagtattttcccttttcaa

SEQ ID NO: 63485 - DNA, 47289 bp, Oryza sativa
cttatgcaagaaagtgaaacagaccgcctacacacatacaacaggtcgtcggataaaatacatgtcagagtaaacgacaagcataagacagtatttgtaaatattctgcaacacactcctactagaattacgcaatgaccttattgaaaatatacacgtattctaaagttctgtcacgcatggagcgtattaaaagaaaaacatgctttgttattccaaatttctaagcctttttgggtgaagaacatgaggacggcgatatgcatggaaatcacgacagctttctttattttcctgtcttgacaacgaattctcaatcatttggccagactacttataggttcatactaattactccctccgtcaaaaaaaactcaacctacgagaggatttgatctctcctagtataatgaatctggactacctttatctagaggggtcacatctcctgctaggttgagttattttgagatggagggagtaagtactaacattacatttttttcttgcaacataaaatgaaataagtaattaataacaaaaatacagaatctaattttagctattcattgttcaatacgtacgtacttgccaccaagttaagtagcgccatcaagttaattttctcttgttgcaaatattagtacacaaatcaaataaacatggctgcatcactaaacgaagaaatagcacgaactggtacaagatttgttagctacgagtcacccgatcgaacaccgtgtgcgcacactgcatacgtcgggcacggcaacagacgagaaaactgaagaacgcagaaaaggaattcagaacagagaaagcaaagttttactgagtttcagaacttcgcgagagagagagaatttgtggggcaattttctggtttctttcattcaaactgaattgtaaaacttacaaatggaaacttagctactgctacttatactccaataacagaaaaaaaggaatccaagcttacaatcgcgtcaacccacgattcggaactcctggatccaatgccgtgcaaaactcacgccaacttcgcacttctgatgcagtcaccatctctgcagctcaccgcatctcccatgcatgcataacaaactttgatttatttgttccagccgttgcaaccgccatcgcctagatcaccttggggccatagctgaaataacagtcaacaaactcccccttaattctgctatggcccaaaatcacgaacacctagcaggtgccgagctgtctctaatcttgctgctggcaaacctttcgttaacgcatccgcccgctgctccttagtccggacgaactcaatttgaatcttcccactttcaacacactcccgaatgaaatggtagcgggtatctatgtacttacttctcccataaaacacagggttcttcatgagtgcaatcgctaattggttacagtatacaacttcaccggcctaggttctgcgccaataatctcaatcaacaatcccctgagccacagagcgtgacaagctgccgcagtggctgccatgaacttagcctcacaggacgagagagccaccgttttatgcttttgtgaactccaggaaatcaaactattgttgagataaaatgccatcccgctagtactctgacaatcatcagtgttaccagcctgatcactatctgtgaatctggtgatctccactgcaccgttgccatcagcaaacgtgaacccacagttgatagtacccttgagatacttgaggatttgctttactaccttgaaatgcatcacagtcggtcgctccatgagtctgctcactacacccacagcataggacagatccggccgtgtatgcaacaagtaacgcagacaacctatcactcgcctgaattgtgtggcatcaactggactccctttagcatctttatgcagctgtgaacggtgctcaataggaattgaggtggaattgcaatgtaacatcccaaactgggtcagaatcttccttgcataagcagcctgcttgatggcgatcccatttgcaccttgcattgtatcacttcaatccccaaataataagtgagaagtccaagatcactcatatcaaactcccccaccatctgttgtttaaatgttgtgatctcgcttgagttttctcctgtcacgatcaaatcatcaacataaaccccgacaattagtccggcattccctgtacctctggtgtagacagcttgcttttgtgcacaccggctgaacccaagctccttcatactccagtcaagacaagtgttccagccccgaagtgcctgtctcaggccgtagagagccttgctcagtttgtaaacaagatgctccttcccctgcttcacaaatccttccgactgatcaacaaatacctcttcctctagatcgccattaaggaatgccgacttgacatcgagatgatgcacctcccatctccgattggcagcaactgcgagaatggcttgcaccgtgtccagccacgcaaccggcgcgaacacttcatcaaagtccacaccttgcctctgaacatagcccttcgccaccaaacgcgccttgtgtttgatcacctcgccggtagtgtttttcttcagcttgaacacccgcttgtggcggtgagtacggtgctgtcaggtggcactcgatgccggcctcggtgcagacgctcgtgaactcgctggacaagaactcgccgccgcggtctgttcggagtgtcttgatggttcggcctgccatgttctctggcaacggtttgaatttctcgaatgccgtgagcgcttggtccttagacttgatcacaaacacccacatccaacgagaaaaatcatcaacgatcaacataaagtatcgattaccggccagtgttgatggggtgatcggcccacataagtccatgtggagcagctcgagcggtgtctctgctcgataattggcaatcgctgggaacggctgccggatcggcttagccacaaaacatgcttggcacaattgatttggatggtggactgcgggcacccctgtcgccatctccttgtccaccaaatgcttcaacgcctagaagttcacgtgcccgagccgggcatgccagagccacaccaggtcgtcgagagtcgagactggccagcaaacacacaggggacgccaacttcagctcgatgcgatacaacctgttcacggttcttctcaccctgatcaccaatcgacagtgattttgtcgaacacctcgaggtcatccccatccatcatgactcggtggctagtttcggtgagttgccccagactcaccatgttgcagcagaggctggcaatgtagtagacatcgtcgagtagccactggtcgccatttttgaatgagaaaaggattgaacccttctctattatctgcaccgatgaggcatcgccgaacctgacttgccccgtcacggttttgtccagctcccggaattttcgacgatctccattcatgtgattactagcaccattgtataggtaccagacatcaccggcggcggcgccattgcctgccagcatcaggcgcggccatacatggtcctcgtgcacgaccagcccacagtgcacgccttgacgcggcgtgttctgcaccgcctctgtcatggcgagcaacaaagctgggccggcatccttcgtctacgcaagatgagtttcggtattcttcttcttagggtgtgggcactacgtggagtagtggccaaattcgtcacaattgaagcactttatgtggctcttgtcatggccaccgccaccagagccgccgctaccaccatcagagccaccactgttggaaaagagtccaaacaacgtattcaatgtgtattctttattcaatctgcctccaacttgggcaatgcttacatatttatatacaggatacaagagggaattacatctttgccctacctaaatcagatgtaacttggctggctgatgggccagcccttgggcaatcggtaaaatcccaggtgacaaaagcagtgacgcttcccgagggtgatggctattatccgggtaaaggcgtgcccccggataatagcggatgctgcctgcccttgttaggatgtcagaggtggttggcagacgcatagtgcgtatttatggtgccccactacgctcgtgatccatttctccatgcttgagtattttgggcccctggtcgctccggagcccttgatctgcttcggagccattggtcagctctggagccagtgacctgctccggagtcgttgatctgctccggagcttatgacaggctccggggtgactggtcagctccggagatggtgatgtgctccagagctctcggttggctccgaagcctttggtcagctttgacttccggggtatcgactgcctttggtcattctcccttggtggactgctcctagctgagtttccctactgacggaggccagctccatcatccggagccattcccccaacaaccacctcctgagttgttgttttgtgccccgccgcgtctgccagctctgcgacccctgccacgtccgcacccgtcctggccgcggttcgccccctcgccatagggcttattcttctgtggcgcgaagtttctctgccatttttcttgaagcacgcttccactcgacctgagtgtgcaacacctagccgtaggcgatcactccgccaacagcagctttcttcttgcacacgcgctcgtcatacgcctttagatagcccacagcctcttcgaacggtatttcgtcgatgtcgtagaattgctcgatgacggcaacaagactgatgaatttctccgggacgatgtcgaacaactttttcaccatatcgacgttgttgcacccagagcagaattccggacccccatcgtggtgatcctgccggcgtactggttcagcgtctcctcggcttccaccaccatactagtgatctcccttgagagtttgaaggcgcgcattgcgcacccagtccgccccgacgaaccttgtcttcaggcagtcccacacctccttcgccgtccacttctttgccacctgcatcaagagatcctccggcagcgactgaagaagatgcgtcttggccttcttgtccttcttcgggtcgactgccgccccagccgccggctcgatcgtctcctatacgccttgatcctccatcattgcttgaacccgtatcatccaactagtgtagtttgttgatgtgagttatcggtaaaggaaagcacttcatcgggtccgccgttgccggaaccaacgccatagtgccaaatccgccctcaacctgagaagctctcataccacttgttagttacgagtcaaccgatcgaacatcttgtgcacacactgcacatgtctggcatagcaacagacgagaaaactgaagaacacagaaaaggtattcagaacagagaaagcagagttttgctgagtttcagaacttcgcgcgagagaaagaatttgtggggaaattttctggtttctttcattcaaactgaattgtaaaacttacaaatggaaacttagctactgctacttatactccaataacaaaaaaaggaatccaatgccacgatccggaactcatggttccaacgccatgcaaaactcacgcccacttcgcacttctgacacagtcaccatgtctgcagctcgccgcatctcccgtgcatgcataacaaactttgatttattcgttccagccgttgcaaccggcatcgccgggatcaccttggggccatagctgaaataacagtcaacaaaattgcagcctggtgatgatagtcaagccaaatccataaatgagggattcaattgagccatagctcagactacaatgatcccaatgccttttatgcccaaagaacattcgcactagtaaacagaatatcatccatgactgcatattgtgggagtgggaccatatatggcttgacatagggttgatggattttctattttctcccaacaagattcggttgagttgtatttgaattcatatgcatatataaagccagatgcctagctaacattgtacgttagttaatttccaactaataattgattgtataccattaaagcatgtggccaataaaaaggcacaaaataagagcttggcacagcttgtctggatgcatgagctctgtcccaattttattatttttacaaataaatcgactgaatttctagttattttgaagaaaggttgcatagtgaaagaaagaaatgggactaaaccaaggccatgaagtttattgcactgtacgtattattgctttagctactaggggtttctctagacatgaagctcctaccgtcactccagaacgatacttcgggccacttaggacatcaaattccttaaactggtatttaagcttattccagtgagcaaccaacagatgtatgtgctgggtgcaagctgaacagcaatgtcatggggggacaaggacaacagtacacagatgtcatcaatcctatcccggcagccgacttgctgtggcgacacagaagtgtcgcaagcaaatacttgaattcaaattatcaggttcctttgtgcaaaacatcaaaaaagttcagttttaacaagattctaatccaaaggagtgaaattttaaacgggaaatggatgtttgaagctgggagtactggaaacgaaccggtttgcagggaaaaccgaccgaaataaatgagaaaccaatgatagttaagagtttattattcttccatgcaaatggggaaatgcatggagggaaaacggcaggggcgaagccaggatttatggttagaggtgtgtgggcagggcgaacaagttataagtcagagtaagcaataccgacgataaaacaaaacatcaagtgttctgccataaaaaagcttgaatttagctctttagttgtatcattggatatttgacagtttgagatttgagacatcatgctcaacagcgagatgcaatgggaggacggagagacatgtgaagccgaagcaatgaatacgagttgatttgcattgtctctttcttattgattaattttctatattatgtttattgataatggactaattaacatgctaatacactaattagtacaacagggaggggtcagatatggggggtgttggccccctccagcaccccctgtagctgcacctctgaaaacggtcgaatgttgtgaaattaaacttatggagtggtgaggaaaagccttaaaaaattacgcctattattatattcatgtatggaggataatcttatcctatgttactacaaagttacagtactctagtaaatcctaaaactgaacatgcaaatatactaccggcctgttcactttgatgtcattttcaaccttaccaagttttaataaagttgccaaaaaaagtggctacatttagtttgctgctaaattttagtaactatataagaaatcctgccaaaattttagcaagttaccaaaatttggtagtttttttttcatcaaagtgaacaggccctacattatcgggcctgttcactttgatgccattttcaaccttaccaaattttgataaagttaccaaaaaaatggctatattgccaaattttggtaaggtttttttttggcatcaaagtaaacaggcccatcatctataatgaattttctcttatataattgtacagttgatgtgccatgatttttggcagctctcgtatgatgttttataattaattgaaagatttctttaaaggagtatctactaacttggaagacaaacattccatgggataaataacttttcaaaatctttttgctaagttcagtaaaatttagaaagtttgccctacatactgtcctaccgagacccaacaataaaggctgagtttggcactccatgttcccaactcacctctttcttttttcgcatgcacgctttttaaactactaaacggtctattagttcttcacacacaatgtcccttggatcagagatgttgaactatccaggcagtgtatgggccccacaggcacccacggtctattaggtattcacacactatgtcactcaggtcaaagatattgaactatccagattctgataccaattataagatcgtaaaggacatttcccaccccaaaaggtagctaatgaggtgagaggctccctcacttatatattagatcccttaaccttctacaaccaacatgagagtattctacaaccatcatagcgggtgttgtaatgactcattagaaaactctggcattcaggtcttttcatattttctagctcaccagtcaccagcacgatcatcgagcagaggtggttcttcagtagccctagtactgaactactgattggcacgttgccaacttgtttttccttttgaaaggaacgttgtctccttgtcgccgtgagcctgatatgaaatcttccgaaggcagtgctaccgacaatccatatatacttcaattgagaaatgtcaattgtcagttgccatgccacgaagcgcatagtagagaaatgtagttggtgtggttgagcacaaaacttgacttactgatcatccaatatgtactaaatcaatatatatatgcgttagttcctgagatttcaactattacaaatcagaaagggttcaatataaactcttggcaccaagctgttaagcagccgaggaaccactttgtttgtggcataatttggcttatagttatttcatctgtgcaagccaaattattttaggatagatggtgcaattgtcagatgatttgcttgaaaatgaactcactttacatgtgcacgaattgctgtgcagagtttcaaggttgattaattatatcatgcaacatgctaggaggtgattatggaaatcaatgctttgtctcgagctgcatgcttggggagtcgccaaaatatattgacgccttttcgtgaccaacacaagatcacctaacgatttgcggtataatcaacagagtcgccaaaatcgatagatcaaaatcggctagcggaaccgatttcgagattaattcactttcgcggaatcacacgactaatttacaagcaaattagcaaagaggataaatatcgtacttacgtgacgacgaacgactagtttccgagcaaactagtaaatgataacctcctcgctttcgtggagaagcacggccgtttttcaacgcaaaacggcaaagatcaaccaaatcctagggttgctagaactcagccataaaaatgaaatagaaaagaactaaaaagaaaagaagatgaatagtagattgataaaattgttcgggctcctgtcaattggttgtcaccggcgcttatatataccggcaatcacaccaatttttggcatcctaactgatcccatgtagaaaacagaaagtcctatcgaaaaggaaacaaactaaataaaatccatctccgatacggcgccgctgcatgcgcgaaccatatccagctcttgcttgcaaccagtaaactactccattgtctagttacatcccgccctggttcagagagaatcttcaccaagcagcagctcgagacaaagcattgatttccataatcaccacctagcatgttgcatgatataattaatcaaccttgaaactctgcacagcaattcgtacacatgtaaagtgagttcattttcaagcaaatcatctgacaattgcaccatctatcctaaaataatttggtttgcacagatgaaataactataagccaaattatgccacaaacacacttctctctcttgttgtgaacattggtgtgtggcactgtgagatcatcgacagtcagactgtcagaggcatcagcagcatcaccaaggtgtgtttagttcacggtaaaattagaagtttggttgaaattgaaatgatgtgacgaaaaagttagaagtttgtctgtatgaaagttttgatatgatggaaaatttgaaagtttgaagattggaactaaactcggcccaaactacataatttctctactgtcacagggagatcgtcgacagtcagactgtcagacggtcattgagtacaaatttgtttatgaaactgatactgcaaactagcttgtacgtactattgcactaggtacagcatcgtgtgcaatccctgaaaacagcactcagctcgctggttaggtttgtctgcaatctagaccacactatcacgggacatgatgaacctcgtggaaaccgagcgatgctgtcgagatagagaccggacagtagttacagactgcaagaatcctgatgccttccatgcctcaagcacaatccgggaggaactgtcaaatgcatgcctgaactcattgtgttgacatgttgtttcataaaggaccggtcgatagtgtatttcatttttcaccaccaattcccttgtagtttatatagctagctagatggccaactaacatgatacatatttagttatttttgttattttacagtccttaattagaaattatcagaaggtggcatattttttaatatttacactaaattctttcttgcctatcactatctttgaaggatcgtaaaatttctcagttcatgccaactaatttttattgcgtaaagtccagttactttcctgttacagctaagttaccatattccacttcttgcactactggagaatgcctcttctctcctggttcacacccccctgtagtcccgggttacaaaccgggagaaggaatccaggactaaagatagcgatctttagtcccggtttaaatacctgggagtagagatgttatcaaccgggactaaaaatcatctacaaattaagagggaaaaaggaaaaaaaaagaaaaacatcggccggccggccctaatcgtgcgcctggccactggccgcaccctctgcgccgctgcctgtcgtcgagcgctgccgcccgccatgcccctccgcgccagccgccgcgcggccctccgtgctaccgccagccgcgcctccccacatccaccgctcgctccactgctgctcgagaggataggatagagagaggaatgggagagatagagagaggaaagggagatgataagaaaagagaggaggaggataacggaaaaggtggttgctagaggataagtccgagggaatatatattatgcgccgatttttagtcccggttggtggttccaatcgggaataaaaagagtagggggacggacaatttttcaaccggggctaaaaatgatttttagtaacagttggtgttcccaaccgagactaaagatcatagaatggctgtggggttttcaaccggggctaaagatgatttttagtcctggttctttctgaaaccgtaattattgtggttttcagccgatccagcaaagatcagttctccagtagtgttagtaataatggaaacaaaatgttaccgtaacattatattgtagtgagttacaagcacattgtcagcattttatttttgatgttatagttagcatatcatgtataaatgtttcgtgatattgggagcatttgtttaactcaagtatatactctaaagaaagtgtcataagaaagctttatgtgtgctgtctgttatgtgttcaaaatgcaaggcacttagtgctgccaacgatagtaaacctgaatattataagaatggttctgttagcatatctaattaaatgtgcaatgaacctttcgaattcatattttcaattgttttgaaaacatcaggtagcattctctttcagaaacaaaatattcagactgtattttgtgaatattattgatttaatgagcatgaacagttttttgatggtgtcaaaattaaattcagaaaaagggtgaaattgacatttttctagataatggaatgaaacatcccggcctttgctcatgagagatacagccaattattacaagaagtagcacactaaaaaggcacagtccaaaattaaacaagcacaccaaccaaaaataaaagaaatcctaacatgacaagaaaaacattattccagtctattggtgaatctccgtatccatggttggtaaaagttgcataaccgttgactcaaggttacgatatgcagcagacatgaattcttcatcttcctcacacttttggagttgggcccaccgtcgaagccaatatgttgccctgaaaattacatatgatgttatcataaactgtttctggtacatatgatgtcctccaagtccaattatgattaacagatgggttaagatgcagttagactaaaaataaaatctattaacataattgaacagaacatttttttccaacctcttgttgcaaaagactacagtgctaaagtgagatagcagagttgtactttttgcgcgtaggtttgtaaaatttaaaaatttatcaaattgcagaaaattaaagaaaatgttgaaatttgaatagctattgtttgctgaatctgaacaaaattttccaatctaaataaaaaactcaattttataacgcgcacacatccaacctagacctaccgttggacatgaaatttgagcctaaaattgcaaattaaccctgtactccgggcctccctgcaatggtacatagagcttggaccaagcagctttaaatataggcaaaatttatcacaggacactcaaaaaatatgtaattagctgtgaaacaccgtaaatacgtgaatttgttcaaggatactacaaaagggtgataatttgctgtaggaccacaggacacgttaaaatatattatcacacaattgaggagagataagccatacaaaatagcaattttgcctccccctctgcgtcacggctctgctctcttcaccgaagcttgccatctcctcccccaagcttgtttgtctcttcgtcagcaaggtaaaccgtaaacccctctgtaccccaacaacggaaacagagaaggacagcaaaaaaaaaaaaaaaaaaactaaaagaacacacgggaggaagctcaaagacccaattgtttatctgtgtcgacgaccacgaccgaacaagacgagcaagacatagccagaggagatgaggtaagtggtgggagcgagcagggcctgtttagtttgagaaaagaaaatttttggatgtcacatcggatgtttgaccggatatcgaaagggttttttggacacgaataaaaaaactaatttcataactcgtctggaaaccgcgagacgaatcttttgagactaattaagccgtcattagcacatgtgggttaccgtagcacttatggctaattatggactaattatgcttaaaagattcgtctcgcgattttctccctaactgtacaattagttttttcatttatctatatttaatacttaatgcatgtgtctaaagatttgatgtgatgtttttgggaaaaaattttgaggaagtaaatggggccaaaaactgagaagcgcatgcagatgaaaagagataagggaggagagacgcgacgtgaacggttagcgaaggaaagggggcaaggcaaagaaagacggcgagatatggccccaagcctgactccttccatgcctagaggcaacattgtcacaacttccataccgcccggcagccgtagctaaaggtcacagatgcatgctaagtttggggttgctaattaaataatctgtggttctgaataaatagggagaaattaaagtatctagctagctacttatagtgaacatgatggggtatatctgcactcgtatgaatgtacaattaatcatcgttcgacctgggaaaattttgcacaaaatggcaatatttttcgctgctttgatccagcatttcagaattgcaagatttaatataagggtttttttttactgtgattatctgtagacgaacacgtgagaagagaatgtgttgcatccttacatatgacaatttcgttttccacacaagcctttccttttgtgtttcgatgaagaaattaaggcaaagtaatctacattcataaggcaatatatgtataggtgtatgaggctgtatgttcagattaatgtcattacaaaccataccaatttttcggtaaagttagcaaaattgtgcacacatttaattttttgcaaaacattaaatatacatttagctttttgcaaaactttaaatacatagaaatcctgctaaaattttgataatattgctaacttatcaaaattttgacattgccaaaatttactaaggtttattttggctacaatctgaacagctcctatatttacaatctaattggcaccttgtctagtattatattcctagctatatatctcaatctgatttgaagagctgcatacaaacgccttgcctatatttgtaaaattatgcaaactctgcatagtttgtgatgacgacaataggtttggaaagtttaatttaacggatggttgtgtgctgcggctaaagtacatgctctccgatgcatgcagcgctactgtaatttttttacttgaattgagaaatgtaacgtacgtagctagcacattaattttcattccttcaaataatgtcaagaaaaaaaataagaaaggtttgtagccgtccagaaaactgatttactaatacatagagttgactattataaatctcgagtactccctacatttcataattttcatattataagtcgttttgacgttttccttattttaagtttaactaagtttataaaaagatacatcaacatttctaacctaaacaaaatatattatcaaaccatattaaatttctaattcggtgttgtagatatgcattaaatttttctataaacttgactaaacttaaaaaaaaattcactagaaaacagtcaaaaacaacttataatatactacctccatatgacgccgttgattttttatctaacatttgaccattcgtcttattaaaaaaattatgtaattattatttattttattgtgacttgattcgtcattaaatattctttaagcatgacataaatatttttatatttgtacaaaaaattttgaataaaacgaatggtcaaacgttgatcgaaaaatcaacggcgtcatacattaaaatacgggggagtaaaatgtaatagagggagaagatgtctcgtaatgagaatcaaaatggccctcaacacgtaaaaaacaagaaccgcatgttcgctgggcggcgtcactaaactagtgaattaacactggacattgccagatggcaccgggtagtggatgtcggccccagcctgtagataacatcgtgactactcgatggaaaatgttgatatgcgtgtgattttctagggctgccacacctaacagaaaacaagcgatgccaccgagctacatctgtcacggacagcagtgatcccgatctgccttccatggctgaagcacatggctaattctttgcgtggctagctagctgcattgtgtaattgtgtccaagtatggctcaacattgcgttgatggtttttcggttctcttttcaaaaagatatcgaacaaggctagatggcagaggagagtggtatatatatatatagcaggatcgctagctaattagcatgacacgcagttaatttcttatcggatgattaatgtttgtgtgctccctccgtttcatattataaaacgttctagcattgtccacatatatgtgtctagattcattaatatatatatatatatatatatatatatgaatgtggacaatgctagaacgaaatagagggagtataagttacagctactactctccgttcaaaaacaaacaacttatagagttttgcatttgtaaaagaaaaaaaatcaacttttgccacatccaaactactactgcatggtaaacaataaacacaaatattatagtagtacttccgaaaaaaaaatcaacaattaattacaatagtattgtacaagggcattttggtctgttgttattatattaccactaaatttgtattgagcttttttgagaaaaagagagtacaaaatatataattcttagttactatctctatcccatcttgtaactacttctgcacttttaagagacattaagtaataaggtgaaattaaacaagagacggttgtgatggttgaaatgagaatgtatatatgtaaataaaataaataagacatggttataattggttgagaaaagagaatcagtggagaaatagtatattatgggataaattttaaatactagaagtagctataatagaacagaggtaataccacacttttcttcttagtactagttgtaatgaagaaaacattattacactactatattatatatatactgagctgtatgaaccaatcaaccgttcttttcttaattagttcgatattcattgttatggaagcaatgccagaaatttgctctcctagtaatagctagcatatcatgtataaatatttcgtgataccagtagaatttgattgaaccaactattggccggaaagatatcttaagtaagctgtacgcgtgtgctgcatgtcttagtaattaaaatttgcagaatgcaagatcggcatagtaagttctgccaacgatcacacaactgaatatatcatatataaggctggttgtgatataagttatctaatgaaatatttaatgaagatttcaaatgcagcgctactgtcaacaagaatatttttactcgattttgagaatcaccaggtagcagttttgttctagaaacatgatattcagatattgtacattttttttgtatgcataatgagattttctgatcattcattgttatactaattcagcaaactgcattcttcccatgcttagtatctaataagttgtccctgaagtatgagcaacaactcttttcgattttgtagactgcatctgaataactaactacatgcttaacaaaattaagcataatttggatttgtacgatctcaagttataacaaaatcatcatcaactacttgcaccaagtagcagccaaatgaacttaccaaaagaaagtgagccgggcgaaattgtcatgtttatgaagttatgtttcgtggtacatgatgtttcccaaatacaattcaggtcaatcaaggattctgttttctccaggcgttgctaaagaaaaacaaattgccgcgtgccttgcacgatcactccaatggtagtagaaacgaaacaaattatgtttctgctggttgcaatgtagctcgaggagccaatttgaaatgctggaattgcaagtccagtggtagaagctaaacatatagatcccaatgtttcccatgtccatgaaagcagtgcctatattatgttgaatggtgatgctatttttctcttgcaatctttttccctacaagaatcggactactagaccgtgtttgcattttgtagtttgtacaaatatatttataaacaagttcttgctatatatatatagccatacatcaattgacacccttaaagtaaaattgttttctttctagtctcaactaacatggatatattgttgctatatataatatatggtatctctgcacggaggcaaataatttgctgcagcaaaagcctcataacttctctctgcttgtaattttaaagcatacatctacccaaaggagaaaatagtggatactcaattttaaaggttaacacaacaaaagggtaaatctttcggtactattgttcacagtacagatgattaccttgtcctagaaaatgaaatgcatcatcaattccgtacaatatatacaacaggttggtagataaattacaagtcgcgtaagctgtatgcaacacatccgcttattgcaaatatacacatatccacaaagttctatcacgcaaaacattaaaacaaagttatttttgttcatatagcagctctagacttcttcctcgtgaagaacatggtgatgcgggggaagaacgacagcttctttcttttcttcttattcgagagcaacgctgaatcattaggggtactcctcgcagacatatccagcagtggatgaaccgaggcgtaactatcatccttgcttgtgctcttggtgtcgctgctgcgttcaacgatgatcacaggggtgcttgatggattaagttgcgatttcaaagcttcgccagccttacgacgctgctcattctcttctctccattttctcaattcttgctccatggcaagcttgccttcagtggctctatcagctctctctgtggcagcaaccaatgcctgctttcgttgttccaaaaccttgtgtgtttcactcagtgttgataaggtacgagactcggactccttggctatcttggcctgtgcaattgcagaagccgtcctttcatggacaagttcttctgccttgctggatttcgcaatgagagattggtattcatccaggtcaactgtgactatctgagagccttgttcctcgatatccactggaagctcactgtcaaacggtctgagggcatcaattgccagcctcatggactctttcgtggcctccatctcctttagaactgcctggatcctgaattccatagtatcaagacaagattttgcatggtccatatcctccttggcctttcttagcttctcctgtgcctctcttgcgatggacttagactcatcagcttctttggctgtatcttccataatcttctgcaaaccaagcattccatttcgggattctttctccttggcctgaactgcttccagttcccggagtgctagctgaatctccacccttagagatgcagcagcgatggatgacgtcgcttccatctgcttcatggtagcaagtgccgttttctctttgatcaactctgtttttagcgatgccgcagcaacattcagagcacaaacttcatctctcaccttatctacgctcatcagacactcctccaactctcgtgtagatagaataacttcattgtgtaaagatctttgagtaatatttccttgtgcttctttatcaattggcttagcttccacatatccagctagctcatttttcagcttgagcaacaagccggttgatgtgtcaagtgttgatttcaattcttcaatagaagaaattttcttggcgagctgattgagctcctcttctgcttgcctcagatcactcttccatttaagggaatcctcatcacatgccaaggacgtgtctttactatgtttttcagcatcatggcatgtggaatgagccaattccaactccaccttcagtctgttaagttctacggtgagctcctcaaccttccttacagcaccttcagacattgaaacggctaactgagctttcccgatagaaatatcccgttcaatcaacaaggtctcgtaattctcctgcacttttccggactcatccttcactaacattaagttggccagcactgcgttgtactgttctttgattatattcaatttctccctgccaatgacaccaccatcactggtatctccttcccgcatctcatgtactattaactgaaataactccaaacccaaccttgcaattatctcctcctcttgtgccttttccaggtcatgttccaatccttcaattagcctctttgttttctcatactcattggacagaggcacctttgctgcctctacagcctccgcttgtcgtttactttctgaaatttccttcttcagcctatcaagttcaagtacgatttcattctcctgcatgtactaagattgttaatcttacatggagatcacatatgaaaagaagtaaattaagtggtaaagcaaggttttacaaaattaaagaaaaaaatacaaatgacagcataatttatagagctgtagctgagatgtttcatatgcaaataagggaagggaacaactctgagttacctgctctggctctgttatacgagttttccagttgacgctgccaccaaatcttgaggccgccaccttaactgattcaatgtgggttgttgtatcgacaaaggtgttatctgttctgaagttcttcccgctgtttgatctgttcaaaggtgcaggggccttctgccgcatgtctcttaagctcatttggcgctcattaaaatgatgcatcagatgtggcttcttttctttcacctttgctggtgtcgcagctgaagtctcatatgaagccttcacagaataggaacaaaaggcatcatccccagtgttatgcaggggtgtatcttgtagttggaccactgctttcagcctgtcggaggtctgtgaagttgagtgggtgttcttctctgaaggtggaattgtggtagaatcactgctgggttctgttgattcatcatcattctgagaggtcactgaaaaagcatgaggatcactggcagatacaagtccactgttgtctacttcagatggagttgcgcagacgctaataggagccttttgttctgttgatatttcttgcatattgcttttgttgccaactaagatttctggaagttcttcctgcattgctgcctcaaagttggctgtttctctgttctgaagattactgttctcacaatcagtacctgcagttagctcaggctctgcagaattttgcatgaatttcggtgccgacaaagatgcaattagaggggagtcgggctcttcaagattcttctctgccattcttcaaactcagttaaatattatctatggaagagaacattgaagaggaaagtagactgataagttgatcacagagcattataaaccaatattggagaaagagctgctttctcaaatggaataaaatcaaataatacatgatcgtacaaacacatgctaataacaaacttgtataaccatgaagggagatttttttttggttatttcatcaaaggatttatcttctgtgattttactatttgaagaacatttatggatggcatcaaataattcatggtaattacagcaaactaaacataaactatcagtgcataaacaacttgataattcaaaaaccaatggccatactgtttatttggccagagatacttccgggctcttattattactattttccgtgaacaattagaattcatttagagaaagttacaaatatattagtacactatggacttttaccagacaattttttttactgaattttaccagacaaaattaaaaacaccaatctttttaagaacataaaaacaccaatctgaaacatataaagaataaaagatcaggagagtgaggagagttttcaattttgacttttgagtaaattctgttgtaaaacaaagaaccatattcatgctgaaacagcagaaaacatcagaatgatcagtcgaggactcatgaaacgaaatatcaatatcagtctaaaactgaaatatgaccaatacaacagaatagtacagatatcatggcaatggataagaatgtaatcccaaatgtaaagacaaaaagcataagctgaagcttacccgagacacttgcacttctgattttggaggaagaagtggatttggcagtttttgcaggtattggatggacaagactggaggggttcaatgaattgaagcaggagagagccaggtgggagaggagaaaggaccaattgaataatcatagcagtagacttggacctgttctcccaattataaaattacttctttattttgagactataggcacaaaagctggatgcttaaggaaattgtgtgccaccatgagttacgaacaggctgggctgaataacattttagaaaaaaaaacactcaaataaatcaacatgatagttcaaaataatatatacatgtctctttctacctatatatataaaagaatggtgcttcatgtttctctggcgacaatttgttatggtctggcatttcattagtttaatttgcacagaacatcttttaaaatactacctgaatcagtttatcctttttcttcaagtctacaagaaggcaaatacaaaaacaattattacagatacatctatattctatactatcctgtacattttgaaatggagcagaagaatccaatggtgtgtcttgatttccatggtaacaatttacagtgtaagaaagtaaataggtaagttaccatatgtaaagttattgttgagcgctggatatatacgtgcttctatcctgcttcagttttataattaccagaaaatagaaaaacaatgtacagttggcctgtagagcatcatttaacaacaaatttatatcttgcctccaagttaaacaaaattccacaattgcagggatctttgtttcagctcaatggaagacctgactgacagctgaattctccacaggacttgttgcattttttttaattgataatcaaatttgacaggatttcattagctgtctgttgacctaggctgtcatttatcttcatccaaatcagaccgaaaaaatgtttaattttgtactgccagaaacagcaatcatcacagcaatgaaacaactgtagacatctcaccatttacataatcagaatctgaataaatttgaagcggttgcaccaagatggaaatggttccttcagttttaatgtttgcctgctagttcaaaagatttcgctgcagaaacatgaatgcattttgttttttgctttgacaacctaattcatctgttgatcctctgtagcaaagcatcgaccagacctgaaattgtactgcctaatgtatgagtatcggaccactaacaataacttctttcatcagggtcagtatgttcccccaattaagctaactcccacatcttttatcaatccttttgcttccatatctgaccgcagtcgctcgtaatcactccatttgcccgctgaagcatagatgttagagagcatgacataagatcttggatttccatggtcagattcagtgagtattttcccaacagattcaccaagtttagaatttccatgaaacctacaggctccaagcaatgactcaagcaaacttttggatggtctgaatggcatcgttgtaacaatatcatatgcttcatccaagtgtccagttcggcccaatagatctaccatgcatgcataatgctccattcttggtgtgatgccatgatctgcaagcattgatctgaataatgttcttccttgctcgagaaatccacttcgactgcaggctgataaaacactaacaaaagttatgtcatcaggcttgattcctgaagataccatcatcaagaaaaggtcaagggcagacccaccatccccatgcatactgtaggcattaatcattgtactccaagagacagaatctttttccatcgagatatcaaagatcttccttgcaaaagatatgcttccgcaccttgaatgcatatctataagagcattgagaacaataatggttccatcaaagcccttctgcagtgcaattgctgtgacacattctgccaaatctgcctttccaagctgtgaacatgctgagataagtgccaacatggttactgcatcagttttaacatttaggaactgtatttgcctgaagtaatcaaatgcaactccagcctgcttacattgcacacaagcagataggatggcattccacactatgttgtttctttcacctaccaaacaaaaaaggttgtggcaatattctaaattgttgaacctactatacatacaaatggctgatgtaaagagagatgtttctagcttggagaaatttcgaattgcatagctgtgaacagtcttcccttgcaactggctatgacagataggcaataaattcagcagcgtaataatatttggcttctgatcattcttgatcatatgatagaataaaggtaggatctcctcaaataagttgtttttgcggtatcctgtcatcagagcattgtaagagattgtgttcactgaagacaagctatcaaagagtttctcaccagcctgaataataccacagttggtgtacatagtaatgagggcatttgcaacagaaacatccaagttgcatccacttctaattgctaaagaatgaacagattctccaactgtaatatcctcaatggcagaaaggctgctgataagcgcaatcagcgttactagatcaaactgcatgtctgccaggcgcatttggcagaaaaatcttaaacaagccactgaatctccattttcagcaaaaccagatattatagtgttccaagatattaatgtccgcacttccattgtatgaaataacttacaacaaattgagagctgcccgcagtcggcatacatagcaaggagtgcattcatcacactctcattcaattcaagtctgcttctgacagcatatgcatgtatagacttcccgacatgtaaatcttctgtgtgtctgcatttcgagatcacactaatgacagttaatgcatctggatcaactccttcaatttgcatccttcgtactgaacccataaccatgttccatttgttattcacaaggtacccagaaattaaggagttccacaagagttgactcttctcggtaacactagagaaaagaaacacagctgaatccaagtccccaagcttcgaatacatggaaaccagagcactgacaacagaaacctgttctgcaagaccaaacttgataaccataccatgcacagactcaccatggtttataccaaagaaattactgcaacatggaaggatagataccactgtaaccagattaggcactagccctttgcaacgcatcaatctgaataccccaaatgctttctcccaagctccatgctgcatgcacactgagatcatggaattgcaagataccaaattatccaccaaactctgatgaaagagtgacaaggatgatgaaagatgaccgaacgcggcatacattgagatgaaagcaggtgtaagggactcgtcaccaaggacaccagatttcagtgcgaatgcgtgcaacggatcaccggcatcccttactcctaaaccactgaccatactgacaatgccaacaagagagctagcattgggcctgaaaccatcctgctgcatctgcttcaaagcctcagcagcttccagtaaacagccattcagagaatagccagaaatcatcgcgttccaggagatcaggtctctactcttcatgccatcaaagactctcctcgacagatcaacctgaccagacttagcatacatgtcaagcagcgcagtctgcactccgacatttccaccatgccctgtccgcacaacccggcagtgcacctccttccccagccggaggcaagaaacggcggcgcaagccctgatgaccggcgggaacgtgaagttgtcggacccaaaggcgcacacctcccggtagaggccaagaagctcccggtggaacccatggtccgagaagcaccggacggcaatgttcaggtcatacacctcggcgcggccgcggtagaacccggcgaacaccgccgccgccgaagcgggcttaccgaagaagaggtacctctcgacggcgcccgcgacgacggaggcgtcctcccggagcgcgcccgtgacggcgagccgcgcgtggagcttgctgaggcatttcgccgaacgggtggcgcgcaagagcctggagacagcgtcgactcgtggtggaatcgcgcttgatggagtcgaggaggcgtccggggattctgcgtgggttcgcttggatttggatggggaacttgagtttttgatgaatcttgagaatctgtggtggcgcgtggtcatgctacgaaaccatggaggaggagcaacttctcctcggttttgttggctttggtagcgactagcaactgccgagtgccgatctggctctagcgtaagggggaatttaattatttatctcttttagtttgacaattatctaaattaggacaatggtagactaatgcgcgggcatgtatatcataggctatatttgagaaacttaccaggaatatcaaccatacatgccaaacttcagaaatatgttttcttcataaatttatttgccgactttgcctaaataacttttgttaggtatctgttacctttatactagtatgtaatatttaatgcatccgtattcgtaattattattttcttcttcaccatttaaaatagaggtgaaaacatgtgtaacaaattaagaattaagttcaaattaaaagtaatgtgtttttttagttgaatgttttggggctcttttaataaatcttgaaaaactattattgttaataatgtaccatcaagctagccctccttttaattggttcatattaaggcaatttgttatatatttttacatatggataataaagatagaatagatacctgatttttcttgcgggagcatgtatgtacaacataaggaggggaggagttttgtttcctttgagatagatccaatagttggggtctttaattataaattttgtagtaaataatctagtgatgtacgtaaaatattagctatatgatttagcttatcacaaaatatattttctatacagaggaggggagcttgcataaggggggaagatgtagcgtacgtacgtgcacaatatgtaaacgatatggacagcccctatgggccttagggacttttacttttttgttagcaaatctaatggtacaaagtgggtccactgagtttaaagtaaaattaatggtcagatatgtttctttttctaagaattattagaaattcctctaatttattaaagcgccacgtggccacttaggatcgtttgtaggagtcacacgtgatagtttgattgtgtttgtagaaagtttaatgagcttttaataatatataatagataatagatagatgtccgatccattgtctctattttcttaagaaacctcgcgaaacttttactactgacaaatatatattatttgtaccatcgtcattgctttaattggttcatatgcatataatttgttatatgcttgcatgtgaattagtaaatatggaaaaaaatatatttaccctacacattgtttctctatgatacgtgagacccgtacagtagttaaaagaaaaagtatagtcaatctaaataatattaatactcatacatagtaaattatatcagaaaatctaaatggatttttaagttggttatgcatgcataggaacaatgaacatgctcgaggcctattaatattcatatataggagtattcacatttttaatggtctacgcatataaaatagacaaatttatctttatatctaaaagatatagaagccatagtaatattcatttgtttcttttacctttaagtccattaaatgataatgtatactatattttagaattcttatatacaaatcagccgatttaatttatctcgtcagttgagcatatttcaaaagacataattaattagatattgttgcatccaactaaaggtacaatattttttttataatttatgttattgatagttaaatctgttcttttcacttacatattatatatctaatttttctatgcatgcttgcaaagtaatgtatgatgatgcagtatatgttgtatgacaatttggatgacatttaaagtgtaggagtatggacctagataaattaaatttatgcataaatttattttcatagtttcatttataatttttattttaacaccatcgatctaatatagctatgcagttttatggaataacttaagatcacataatacatgtttattttatttttaatgtttcattgtgaccactagataaattattcttttatatgaaaattattcacggtgtatgtttcttaaatggtttaagatgataaaatatatgtacatttttttatatatcttattgttgtttgattggtatgtaaaagatacattggcctttctacattcaccttcctgggtagattattcgattctagctatattcatgtcatattaatcaatatatatcaatcaacaattacataatttatatgtgtagtaccctgataattttttgctaggatcgcaattaaaagaaagggtatatatccaagtgatgccctgataattcttttcttgggtttgctatatccaggtgacgtattataatttttgtacagaaacatatgataacatctaaataaataatagtttaaacaaattaaaaattggatattggatatatactcgagagttatgaatatctatctaattattattatttttatatatttggttgatagctaaaaaatagaagagtcatttatacaattatggtaatttattatgtccattgtagcttaggagtatttgtagaggtgtactgcaggtaaaagttctactcatattgacgtgaacaaacttcaaatatctgtttttttacttacggtagtttttaatcttacattgtacttatatataatttacgatgcacatttttccttctaattaaaccttcgcggcaagcagggggtagaaacggagggagtaccgacggtttctcggaggaaggcggcggtttgtgcgcacaggaggcgggggaccggggataatgcagggtgcgcgggctcacgttcataggcgcgcggggcgaggttggctggtgattggtgaagtgcgatcagaagcgaggatcgatggagtgtagcgtcgcctgaacagaacacccacgatcgcgagcgctgcagggtagaacagtcactcacatcatcatctacaattctgctttctttattagtgtttcgattagtatatgtgattacattgcatcacttgttcacctgagcttctattgtatcgcgggcagacgagcagtgcattgtcacatctaatttcctttccttctttcttttccgtgtgtaggtgtgatgtgcacacatgatgacacacatattatttgatttgtactatggttactaaaaacatgttctaattaaatatcattgtccagcatcgtttttatgttttctcgatgataatgacatttcgatatcgagctgataaaatagaagatagcaccaataattccatacataagaaatatcgctaagtacagttcaatagttcagcacgatgattagtgtaagtaatacttatttggatggggcactagctgggatttgattttcagattaaaccggtctgttttgttgtggagtttttgagattaatccaaataccggactggaatcacctgccaattctaatcacattgtctgctcattcctctcacgtacctgacactatgtttttcttctgggttaacctgatctgtcatctgtttttgtccccttcttgcacatgcagagaactgcagcaataagagtaagagctgatgatgcaggcaagctagctagctagaaaagacaagggagcttgcggaaaaataagaaaaaaaaaatgtcagatgagagaacaagcaacatatttgagcagagttttcattcagcatggcctgcaacttcagccatttggtgtagcagtgcgacacataatgagatgatagacgtgcagcacacataaggaaactaaattgacaagccaaatgtcacaattacgtttacatagatggacccatctgtccatataccagattatccggacgaaagccacacaccacacacagtgatacaaatccaaatcgatacacttgaatgcacacaaagcaatcagcatgcataatgcaggtgcgtgcggcgcacacacgcacatggtttattcgaagaagcaaacacacacacacacacactcaggcgacgatgagtaatatatcatcaaaggatataatggagacattaatttcctcgatcagctactgctgatcctccttcttcgagaaatagctggcacagccacgccgaagccatgattcatcgccatgttcctcttttagtgcttgatcctgacgctgcggcttcttaggtgtaagaacaggtttatttttatgtgctctgatgtctttcttcacctgcttagggacattgtcacagtccagatcaagctccttcaatttctcaacattgccaatgccagggagaggctccaactcagcgaaggacggccgtgaccagatgatcttctcaaggttaggagcagatcccttgttgaagatgattttttctagagaggcgctccggtgcactatacttgcaatattctactccaaatagaattaatctcggccgtttatcttaaaggatagattagtaatctgttaatataaattaagggtaattttggaatgggatgatttatctgtcttatcaggtacggcggaatcggtggctcgacgcaaagcatctcgcccccccccctcccccccacgcatcaccacgatttctgcttctcctcccggcaggcggcggcgctgcccccgaccccccgacgcaggcaccgcatcaccgcatctctcccgagcccccgacggatcactgcatcaccgcggtttccgctagtcctcccggcaggcggcggcgctggtcgcgccacccccgagcccccggcgcggtatttgttttcccatatattttctgtaattagtttttgccaaactgattgaaaggttctttagcggttgacaaggtattccgaggccttcttgcaggtatatgaacctcaactctattgttttgtaacaaaaacaaatcattcaattgcgactgtagtttatgatagagtatctgcagagttttccactgatactgaacaatggcactgcataaattgtttctttatgttatttcgaaagtttgcaagttatttcctcgttaatttcagtattttgaaatttgaatggctgggttatcagatcagtatctgatccgatgtgttcaatttgcattgttgtatttaagccgaaagagaccccctcgctgctggagcaaacaactgccggcaggaaggtgtggcaatatctggcttgctagatggaactggagattatgaaggtgacagggtgcttgttggagatgtgccgtgggggtgtgttttccgttctaccttgcattttcagagagtagtaaacaaagttactacatttattggatactgattacgcaaacagcaatgcttaaaaatgatatgcagtctattgccttaatttttttttcagttttattgattatcaaatgattatcaaactgagaaaaaataattctaccatcaaactagaccatgcctcctatttgataggagcaattttacggttcttaaggagataccatgaggtatcattttttttattgtaaatttggtacctcttggtatcactaaattttttttatctcatagtaccttctcaaaaggattgtagaattgcttatctgatagtctgaaactccaaatcatgtaggatgtttgtttcttcagttaagagactgagagtactgaagacatctgacctatcttcatctgttagtacctctttccaccttccttctattacatcaaactcacggtaatctccgcattattctgaaatttcttcatgccatataatccatgcagcttataacttctggacggaaaagaacagcagctgagtgttgaccttcttttttcgatctgctttaacactttcagtgacctgctgttcagaagaatatgatcctctgagcttgtatcatcgtctctttctctcaatgtcttgctgtgctgagcttgtaaccagccattagagaagacagtccgagattagggcaaaaggatagctccatccaagagacgaaggccattcagtgagacattgcacacaaataaccaataaggttattgtggctcacaaactttgtatcttttgtattaatggcattgtttttttattggattaatggcagcaatagctattatatatagtgtgcaaacaggaggatttttaaccttccccaatacttttttttttcggatcagctctgaaaatacatataggccacttgagcactgtattctcttatcaagccatgctataatttacagaagtttgtgagaagaactcaggagattttgcattttatgatcttgcaggactagttgtcatggacacccttttttaccttatccatcaataatattctcagtcgtgcaaatgccttcttttactttcctaaccttctgtatacatgcatagcagggtcaggttcttagtgagagatggtgaaacagaagggagctccagtagcatgttttggttcttgaagccttgcacatttctagtggagtaacagcaaaataaccagaagctttgaagaactgcactttatgtagtcaggatacattatttcattctattcgattccaatttggccaattcatatgatcgacatttttgtcaggaaataaacagcaagcaatgtatagttacttaccaaagtgatacatgtttgagagattctttccatatgttgggttcaagatatagaaaaatattgttcttatgtggcttaattattttgtatgagatactgccattttctttgaaaaaaccatggttttccggtcgatcgctcctaaaatatagcggaacggtttattttgtacaaataaaaaattaaatccgtgactaggtcaattttaaaaaaaccattgtttttttgtcgatcgcttctagaatatagcggaacggtttattttggacaaataaaaaattaagtccgcgactaggtcgattttaaaaaaccatagttttccggtcgatcgctcctacataatagcggaacggtttattttggacaaataaaaaactaagtcctcgaccgagacgattctaaaaaaccattgtttctggtcaattactcctagaatatagaggaacggtttattttggataaataaaaaattaagtccatgactgggttggtttttaaaaaacaattgtttccggtcgatcgctcttagaatatagcggaatggtttattttggacaaataaaaaattaagtctgtgaccgtctgaaccgggtcgatcttaaaaatccatggatttccggtcgatcgctcctagaatatggcggaatggtttattttggataaataaataattaagtccgcgacctggtcgattttaaaaaaccattgttttacagtcgatcgctcatagaatatagcggaacggtttattttgtacaaataaaaaattaagtccgcgaccatccggaccaggtcgattttaaaaaaccaaggttttccgatcgatcgctcctagaatatagcggaacaatttattttggacaaataaaatattaagtcagcgaccgggtcgattttaaaaaaccatggttttccggttgattactcctagaatatatcataacggtttcttttggacaaataaaaatttaagtacgcgaccgggttgattttagaaaaccatagttttctggtaaatcgctcatagaatatagcggaacactttattttggaaaaataaaaaattaagtccgaaaagggtagattttaaaaaaccatggttttgcggtcgatatctcctagaatatagctgaacggtttcttttggacaaataaaaaattaagtacgcgacccggtcgattttaaaaaccatggttttccggtcgatcgctcatagaatatagcggaacggtttattttagacaaataaaaaattaagtccgcgaccgggtcaatttttaaaaaccatggttttccggttgatcgctcatagaatatagcggaatggtttattttgaacaaataaaaaattaagtccgtgaccggaacaattttaaaaaaccatggttttctggtcgattgctcataaattatagcggaacggtttatttctcacaaataaaaaaataagtccgcgaccgtccggactgggtcgattttaaaaaaccattgttttccgatcgatcgctcctagaatatggcaaaacggtttattttgtacaaatacaaatcaagtccacgaccgtccggacgggtcgatttttaaaaagacacgcatggttgtccgacgtcggttgtaaattcttgtcggaatctatccccattttttatcccgtacttggagataatatatcccatattattctgctctattattctgttttgatcccctgttacttggagacaaggtttcttttttttttattactaccgatctcggcagattttttaatctattttctatttttcccgtatcgatccccaattttgccgctgttaatccgttctgatcccctgttatctctgttatcacgtacttggacggttagagagtgaacagttagataattacaaattacaataatacccctacgtgaattattatctttggacaaatatacccctctacatttctactcccataaaatttggtgggagtagaattagatctcaaacctacgattaaatacgatcaatggctcggattaatttctactacaagtagaaagcatcggagcgagactcttttttctatcttggagcaccggacagtaagaaggttgagctttggaaactcatctttcttgaaggtaagctcgctttcttcataagaattttcctagagcaccaggcagcaaatgttttgtttcttggctaggcgtccagcttcatctctgttcagtgaggtaacacagagaatcaccttttcaattttattagcattcttaagtagcgaaaggaggattgacttgtcacccttcacctcgatctccttcaattttgctcggctgccagacacagtaagctgggactcctttctagtcaacaacaagatgatcctctcaagctcaggaaccgctccattttcaatgatgatgtcgacaattttggagtcctcgaaaagaaaatacttgagttgctggaattctcccttcttgaatgtaatctttacctcagtatttatctgtggagctggtccttctgcagaaggtggaacttgtccatcagtacttgtgtgaggagctgctccatcttcagaaggtgaaacatgtacgtcattgtttttctgaggagcagccccatctttagaatgtgaaactggctcgttgctttcctgatgagctcctccatctccagacaacggaacacctccatggaaagaaaataatgatttgttgcctttcaactcgagctccttcaacattggaaggcgaccgaccccacgaagggacctaacattggtagaggacaagacgatcttctcaagctcaacagccgctccctcttcaaagatgatgtccgtcatgcacttcaggttatctccgtcgacaagtaagcatttgagatgttcaaacatttccttcttgaacgttaggctagggtcattgtatgcatcattgtcggagcctgacactgcgtaacttgggatggtcggcaagcatgtccagatttttctgtctcaacttggtgccactcaaagctaccttggtaagctcattgctaccttttgccaataatgagagaatccgtagatttgtggatccgttgatgcttacactctccagaagcttcggtggatgtatcaagcggttgtaaagttcatctgatagtatttttgaatcttttgaggtggtctcacttctggtgtcagttatagtgatcgaaatagattgaaggcactcattcaagtcaccaaccgcttgaaacaaattctggaggtgtctgtctttatctttgataaccacaccaagcttccttagctgccatagctttcttatgtctttcaattcatagccataccatgaagccgtgacattagacaacacctccatattttccattttctcaatcttggaaggaatccggacacaggaaaatgtcctattgtttgtgcccttgtcattaaagcttggacttggatcagtgtaaccagcgagcaagcgccttagctttaggagcaggacaagctttgtttccttctcaggaaccttagtttgccggatatccaatatctctaggtcatggaggttgttgatttcactgggtagatgggtgatatttgtcctcctcaggctcaaatacttgagaagtgctatgttgttgcagatggccttaaggtagctgcttttgtcaaaacattgacaaccttgcagatctagcaacttgagtagtgatagttgagatgaataattatgaagcttcttcacaaacatgtctatgctgtcagaggcacggagtcggagaccgctgaagacagagaagtggtgtgcccagtatgtgataagcgtgcatccaaaatgtgttgtttcttagcaatcttggtgataaacccatggataagatcaccaaccatgcagctcttgaactctcctttagcactaatatcacctggagaaacaagacaccggtcgatgagagcatcaaaacatcgctcggcatggcgaactgcggtaggccagtcttcctttgttattagtccttctgtaagccatcgtgctattaaggttgatcgcctaatgttggtgccttgagggaagattgctaagtatagcaagcaggtcttgtgttctctatgcagatctctgtaggagaacttgaatatcttcttggctttagtatccaacgagttttctgaaatctgtagtgtgtcacgtagcctgcctagttctttattgctcctgttgggattagcatacaaagcacgagcgaacatcttcatgcaaaattcatgtggatggcacttgtccaagatgtcgcggagaatctgggaattgttgttgtcatcttcattattcaccagttgttgtgtgagcttgagcacaatatcatggtagagtccaacaagagaatatgttataggctcacttggtgggtagcaaaactcactggccttctgggtgttctttgtggtcactatcacggcactgcccttggcgcacttcaacagttccaaagcattcatgatatcctcccacttaagttcatgtcttctgttttcatcctccacgataatgaataatgtgtctccatcttttaagtataaatttattctatctatcattcctttaattatcatctgctccttaattttgaggccaatttgtgtaatcttgttcttggcatcttggatggcactgacgacttgatcatggcctagtttttgttctctagggccatgggatttaatagcctgtatctcctcaaggatgtcttgtttgaccaggtggatgattcctttgatctgttccatgatttctttggtttgatcgtcgcccaatgtagcaggtgcagcacgtctgttagtactactactagtagcactagcagcagtagtagcttcctcgggattgctggtcaggaacacctcccacagaatagcttggtattgggtatcaagcagcttaattgttggggtcttcatatctccttccatgtgctgcttaaactctttggcagtgttgttgataagagtttgctcctccaatgctaacacatccttggcttgcttccatttttcctcacttagcaacgcaagatagagtacacataagggtttgtcagtttgaagaaccagggagcactcggtatctactgcttcttcagtcgtctttccaccgcctgttttttcttgggtctcggtgctcccacctctttgttcaactgtcttgcttccccctcccttttcctcactctttgtgaccccccctttttctccagctgtgtttcttcctcctcctgcgtttccttcaattgtcttgcttccaccatctgttccttcattcatgctgtcctcttcatatgtttgtcttgttttttcgctacctactgtttttacattgatcttactctccatatcttcaatcttgctaatgagatcttgaatccttctcggaacatgctcttcaaacttgttactgactattcttatcatctgttctctttgcctccaagctttgaaccgaacaatcccattatccacatagtttggatctttgttatccttctggattgtgcatacacgcaagatgtagcagaggacctcgttgggtcctagataatctgatgggtagtgtactgatgggaggttgatccgaaccgtgtgcttgaattgtacacccgctttggtcaaaccttcacttacaatgtcactagcggtgttgtccgatgccacaacagcgatggatcgtattgattccctcgactttctcacctccactcagctggctatcttgtccaggaagtagttatccagagtaggaggctccagatcttgttgctggtagtaagaagaagaagattccgccgccgctgccgccttttgctcaccagctctgtcctcatcatcgtcttgtgtggccggaagtgcggcaacagcttgagacgaggaggaagacgatgggcaccaccttccacgggatctccacgccatacctcatccgccgcttgtcgacgtcgctcgcccgctccttgagctcacacagtcgagcggccgctttgtgctgggcgaccttctccagcacgaaccagtaagcccaccagaagtagccacggaggccacccctggcgcggtggatcgccgggtcaccacgctggaggtagtggtcgatgcagttgctgtagtcgtgggcgaggtaccggacctgcttcatccacgtctgcacctgctcgtcgtgcgacccgtcgggaggcgccgtcctcgccaggtgctccagaaagctgttcatgctctccatctcctccttgatgaattccacgtcatgaccgacgcactgtagcagctaggcctcgttccggaggatgcccagcagcgagctcacggcgccagccgcgagctcagccattgcaacagcacagggcttgctgctgtgctgccgacgacgcgacctcgccgaacggtgtccacctagctaagcctcttagctttagttttagattagcaccttagcaagttgtactgggaccgagaatgaacgagctaggtgtctctccaatagtgcattggattattggtgtgtggttgattggataggtctcttctcttcaacaggcaaagcagctctagttcttcaagaaatacatgggaagagataatgcccggttttacgaactttctattcttctcttttcttctaggcaaggcaagcatatggttctattcattggaggattcttgaagtcattcataaggtcaggtgtcaggacgtactacatccaatgactttatcctttgctttgctttgcttgtctgttcttgcatcttttcaagcattggacaaaccacaaaatgaaggaaggtagtatgagatattagtccgactacagtgctctttaccggtagtattctacaactagtagaaacaatcttaaccgtctgtttataaggacgtattagtacttgggtaattcttccttaggggtaattttggttattgcttttttcctgtgtttcagtcttgtattcacgcatccttctagcgtcctctcgcattgccgttgccagctgatttcagtggcaacaccctgtcccgcgaccgccttgatcagtgggtgtttatccacacaagtcgctttcttttgttccctgccccatccgtggctcccttcattgccgtcatcactgtcgatgttcgattttcccatcggcaacctgattgttgtaccactcgccgccatcactttagttttacacaacctcctcatgtgcgaggtcgtgggagagtgctacgctcgggcacaggagcacagccgcgctggtgccggctccctagctctcttgcctgggcctggagtggaggtagaccacgagcacgccgccttcggatctcacccttcgtcatccagccgatccgctgtcgctgagaacgccacaccaaccacgtgactgatggcacgagcgcgccgcgttccactccttgattattgtgcatctgaggcgcaaatctaaaattttatccctccaagttttgtttttttctttactattatttcattagatgagggtattttttaccaggtctctacatccaactagatatatacaacatttttaaattgaaaggttagccactcaaataatccaatcatctatatattatatgtgatattcatattgtatagtatataaatgataattaattaaggtgttattatacggaaatatcacgcattgggaactcaggacccaatctgtgacaagtatatcctttcatgtttctattttcattaattaaggtggtagtataaataaatcttacccctggataaaaagtcataaatgatttagattaactagcattggtggcccgtgtagattgcgtggctagtatcgttaattttttttcttattaatagcttaaatattttcacatttgattattaaaatattttaaaatggcaacataattctaaagtatgtactaacttgaccaaaccaactaatgcaagatattcatattttatagtatatagatgatagttattaattatttttcagtttcaaattttagttatttctaaattatattggctcagtgaactggtgggtgttccgaggttgaagcgggtctgcattctctctgcaattctagagacttcgtgttttggtggagtcggagttgctgcatcggattcaaccgatgagctgggcaatgataacacccaacatcgggttcaacgcctgtgggtgccgtttccccttggaggtgttgctttcttgtctctctccttgggtgaaatcccagcccagttatgggcaggcattggcatcggccttgtcgttacttcccttcctggaggcctcgccttgatgttcttgctccttccttggtcgccatcgggttttcatagttgttttgccacaggtttttgttttttcttctgtgtagggtttcgccggcttccccttagtaaaccgtacagttgtatggtttttgggtctggttttatttataaatagggcaaactctcttcttcttaatatattggtagatctcctaccgttgttcagttaaaaaaaaattatgtatgcaatactctagactcctcttttaatattccttttttaaaaaaaaattgtattcccattatttatgaactttattcctatacgaactatagacttcgcttccaatatttctttttcttaatttcaagttttagttattcgtaaattgtatttctgcaaatctgtgaccacctggactcatgtacgtggtcatagtataacccaagtcccaacatgtctcgaattaattcacgttgttgatgtacggtaggatggttgtccgcatacgcatagctacattggcatactttttacatatgtaggttatgatttatctttatttcattagtagcagcagcagtagtagtagtttgagtgtttgaccgatgcatgcaatgtggtggtcagtcagcatatatattgatgtgggcgatggtatcacgatccttcgataagaggataagtcgattggatggagagacgttggtgatctgactacaactatccatggatgttgcgccttagcaatcgttacaccaactccagaggcggtcgttcgacggatgcatgatcagcctaaccacgaggatatttgttcctgcaagcaatcgagaactagcaagaacaagataaacaagcaactcattttgcgaatcaagatgatgtattgaatcaatagaagtatcacaagtggggttccataacaagcaaaccggcgatctaaccaatcacgggattatttggcaaagtagcgatgctagactttgatctaagctaaacccaattgtttttgcggcggctaaaggtataagaagagggggagaacgaccacatgggtgttggggtcatactctaaccctagagcgcgcccctaatgggcccaacttgatacacaatccattggacccaaatgaggtgacgcaacaccgtggatagaaaagtactcggtagtaaaacgataattgcgggcgctccaaaacatatatggacatgatgctggatccatttaaaagtagacttgataagcttttcatgaaatacttgtacgtccaaatcggagtttgcatgaagtcatggcggccatcaaaatttggtgcagtcttgtagtccaccccgcacgaatcctctccccattggattctctccagcattcctgagtaaaacaagagtgcacgcgtctccaggatataaacaagcggaatatgaactcaagaattcactcacctgatagttgagttaacgtgcacgagcgcaggaaataggatcatgaaattgtacttgtggagacgtggatgtatcgatggtgttgatgtcctcatcatatatatcgctggctgtcagttgaacaatcgaagcagcaacggcatgtcgaaaatgctcatactcggatgcccgatccacgcccaaaatattagacgcattttcccaaccacccgtgactccctctctccctctctctttctcgcaccttcccctctcccttcctccgcctcctcggcttcccacctgtccagcgcccacctccctttctcctcctacacctccgccaccaccaccaccaccgtcctcgccttctccgaggagtgggagaggaggtgcgggcactggcccgcgggttctcgccgtacgtggaggcgacggcgagattctcgcctcgtccgtccatcccgtcgttctggtgttctctaccgctgcggtgtgcgtgttgagggagatttgaggaggtggcgtgttggtttggcacgaatcggccgagtggagcgcctgccacgatgctgctattggtggctgcttcattgagtgtttcctgcttagcctgaaaccgttccagttcaagcctgaaccctgctcgcgcggcagctgcacaggtcgatcggcggccacgcgcacagcgtctcgaggaacattgacgccatttctctgggctgctgccatctactcctgcactgccgccatcggaggagagggaagaaggcagatctgactggtattttcgtgattttttttatgtttcagccaatgtaactcgatgtttctttgtgttgcatcaaattgttgtagtgggatttcttatggtctttaaattttttttttgatccttgtggatttgttgatgtttcaatatttgaaatttgatgtttcctgtttcagaacaaagtgttttagttcatgattcaaccgtgtttcatcatttaaatagtctgaaacatgtgttaagctagtggtgaaacaatttacttacaagtactgaaacaacgcccgatttgtaggtgcttctgcaccctgtacatggacatcaaaacccttcattttatgtattcgtatcggactcataatgcccccttctgtgcggatgtgtatgaatgaagaaacaaaaataacaaattttatctacactgtatggttactattcactatctgattttgttatttttctttctctagttatagatcaaatttagttctgtatgtttgtgtatagatcataacaaccaatgttacttaattttttcaataactatttgagtcgcatgtaaatgatgggtgccatggtacctaggtgtagaaaatccttatgcatatgggcacgcacgataagattgcgcacgcacgtgcaatggtagtgattttaaattcagaagaacggcacctaagcttacgttaatttactagctatatccaatggctgggaggacttggaggcagaactcaatcttcttcacagccgcgtctagaatctgcgcagctggctgcaacggaggacgacagccgccggcgccggaggacgtcgacgaggcttgcggcgacgacggggatggcatcctgctcaggtgataccactggctgtaccagacgacccagcgggcgtcccggagagcgtccctgaggtcatccctcagcagcggccacgacgtctccgcgtcccgcatcagccgcgacgccgcgtgcgggcgctccatgaggtcggccacctgctgcgcgagctgcgccacgcggagcacctcctccacgttgtgcgtcgcgtgccacgccccctgcacggtcacccgcgcgtcttccacaatccccctcacgacatggccccagtcgccaccactgtcagtgcttgcaccttgctgccatggcgccaccatggttggaggaggagcatgagcatctcggtaatctcggtggatgttgttgctggcgacgtggttgtagtggtggtattgctgtaggatcgaggagatccgatggtcgagggcgtggagctcgccgggcttcttgtccggcgatctcgatatgtcgtcgagggcacctcttaggcctgacagcaccccggccatcgccgggtccggcggtgtcgacggcgtcttcttatcctccaatagcttgagtatttttttggtattttcggcctgttccctcagcaggcgaaccttctccctctcgcgcttacctgtccccgccatccccttgatttgagctccaagcgcgacaacggccacccacagagccatcgtctccaccgctggcatcttgatcaatcttgcgggttcttggtgcacccgaactcgtatgcagcgtatagtccagtgttgatgtgggtcttcctgtaaatcagtggattaattaggtcatttgcaacaacaaattaattaacacatgcccggtgccccccactccatgtacgcacagtagccccctcacatgttctttcaacagcgaaatggattctactcccccaagagagaagatctccccacgtacacctttgttttctctctatttcaagataatttattgtgaaaaaaatcaatgtattgcatagcatgatatatatcactataccaaaaacataatcgacaaatataaatcaacagaaaaaagttcggctgtactgtttatatattagatttgtattattttcttatgtcctaatgtgtaagttgcgtttaaattttgattttgtggaaacgtatatttatattgttcaaagatattttaataaccatttaggtgacattttcttataaatatttgaatggtgtttaaataaatgaagaatattaccatatagtacgtcaggagactcgtccaactgtggggatgtggggcagctgccctagcagcgatagttcagccaggggagcaaatggaggtgaggagtggggcccacgaggttggttggtaggacacacgtgggcttctgtatattttatttgagatagtagtatggatatttatatatatgtatttttatccttcgagaatatccgcttgttgcttacataccattaaatagttattaaaaatttgacaactaaattcatatgaaatatatcactccacaaaaatacaaaaaccaaattcgacttctataagttacaacaaaaagaataaattaaactgaaaattgttatcctgaattcgtagttatatttgttacaacttgtaaaagttagaattttaacttgcatgtttattgagtaatatatttcatattaatctagctcgctaatttctttaggtttttattattatttaggtcacagatacgaaacgaggggatgccccatcgaaggatataaacactttcccatagtagtaggatatggaatttattttatccctcaaggtgatatatatcttctcgctgcttgcaactgcatgccatcgatctaaatagctagttatcaacaaattttaaaaaaattgacagctagataagaggctgaacgatggggccacttaaggtgtgcgaaatctgcactatatatatttgactcagggtggttattcatctggttcatcaaattcaaaagattttgataccatggcagtgtatataccggaccaaaggaaaaatttagggaggagtcggaagaggttaaagtggaaaatgcgagaataaaagctttttctggtagtgggacttacgaaaataaaagccctacagcgccgaaaatattttttctagtagtgggaccttttcctctagagtgcagattgagaaatgaaaacaagcctgcgatttgagatcattatatttttttccgatcctcaggatgtatatataaagaagtatatgtatcttataattaatatttgtcagaatatatataagctctaccctataagtgtatatacctcctaagacaatacctacaactctaaaaaccattacaaagggtcaagaacatatttaaaaagataaattttcagttctattccaacctgtaaaattaattttgatatttccctccatgaaaaagtatatatcaagtacgggacctcttcatgctccattcatgcatcttgcttgatttctccctatagctataagctagtttgtgtttaccggctctccaagaataatgacttaacgtttattactccattaccatccggctgatcaccactaccaaattatagtttgcacaggcggacaaattcttaatgatatataaaaagaataattcgcgagataaattagtgcatactagctagtaacagtaaataattaagacatttaccgatggatccaatgttcgctgaactcgtagctaagctagctgctccttcccaagctagggtatcagtatcttcagtagtgagtagctagtgagagctctattgccttttgccttcttgcaagcatatacaggcactgaaggcgcttagctatttataatcaggcaaatttagtctcctaacgcgctagctcctacgcttaattaagtggccagctcgtaatataatcacagtgacgacgcgtctgcaagagacgacccaaaactgagtaaagaccaatgattaggacaaaggaacgagtctccaactcttctctcccctcttctccaatgaatccaaaataaccagacgtggtcacagtactggtcccggggctcggggccggtctggtttggttgaccggctgggtcttagcttcgagtcaacctaaaaaaacaagagtaaagttcatcaccgatctctaaacttgtaccgctgtgttatcccggttcctaaactcgcaaatcgaccgttctgattctcaaacttattcaactgtgtcatcccgatccctaaacttgcagatcactcatttaggtcctccaacttattctgttatgccaccccggcccctaaacagaacggtctaaaaactttatatattaaaaaataattcataactttttcatgtaaactctaataagacaaactttatatcaaaattgtagccctcggcgtgacctacaactttattatgtttttaatgcctatgaaaaaatgcatatagtgtgctattggtaaaacaggagcaaaggcaaaacaaaaaaaaaagatacgatgaatcatgatatggtattgcgagctaattatgtttttaatgcctatgaaaaaaaacaatatttacatatgatgttttcttgcaggtgttcctaccaattatggcaaatcacactggtacgttatcgttattaatgcaagatattagaaaatttaaatcctggactccatgcaatgggggcaaattggtacaatgcaaaggaggatactccctccgttttaaaat

SEQ ID NO: 63486 - DNA, 8850 bp, Oryza sativa
aattcctgcagcccgtgtcattgttgcatgtcctatatcatctttagttttggaaaaatgacaactcgaatgacaatattattagcctcaatatttacgagcatctgaatgtgttgtggatcactatatcatgactccaccacgtacacagcttcaagtagttctagattagaacttacaggaccgtctataatagagtcctacatactatataaaccagtaatatgtgatcgagttacgtacgctggaagtagataattaatcacgaaagagaaaaatgaactcatatgccagtgagctgaccacactattgcgacttgtaagcttgacgatagagaggggttggagccttggaggtggtggattcagcagccggcacggtcaaggtcatcagagatgttagatccaaatgccaagtactccagaagagttagggaggttggctggaggcatcggggactacctcaactaaaaaaaccattttttgcagacgttggttttttttcttaggcgggtatcgccctagaagataaatggccgcctacgaaaatgacatctgtgggggtgagattattgcccgcctgcgaaaatagattttcgcaggcggaccttaagaagtccgcctccgaagatacctttatttttgcaggtggacctcttaagagctccgtctgtgaaaatatatttttgcagtcggagcttttaagaggtctgcctacaaaaaaggtggacgatattaaaaatgccgctgcccaccaccaaaatcactaagtcccacaccaaacacctctccctctccgcctctctctctctctccctcgctcctgtcttcccctctctcccacctctcctctcccgggagatatggcggcggcggctactggtggcggtggtggctgacggcgcgaaggtggcggctaccagcgggaggcggagggtacatgggtgggcgacgtctcccctcaatcctcccagatccggtggaggcgacggcggaaggcggcggcggtgcagaggtggcggctaccagcgggaggcagagggtgcatgggcggaggtgtctcccctccctcctcccagacccagtggaggcagcacagtgggtggcggcggccctctctaccgaatctggcacggcatcccctccggatctggctggcgacgagcgacctcccctccagatctggttggcggcggtggtcctcccttcggcgatgactgtgatgcatttgttttgattgtgaacgatgttgcttctatgttaatttgtgatgtttctgtgaatttggattaactgggataggaaatgggaactagattgggaacgagaagctgtagcccaccgaaacgacggtggctgcccattttttttttaacgtaggaaactcttttcgcaggtggaccagttacccgcctgcgaaaatcaactatttttacaggcggttgagttgcaagcggaccagttgcccgcctgcgaaaacttgtttagcccgtctggaaaaacatttttttgtgtactacctattccttggctttctcaacaacgaggaggggcttgtgcagcgcttccttcccttctcctacatcggcattgaggcaaatgcccacaggaaataatatgatcgtggagataatagtacaaattttaataaatgaatttattactccctccgtctcattttaagtgcagttgtgggttttccgtgtccaacgtttgaccgttcgtcttatttgaaaaatttatgaaaaatatatttttttaaaaaataagtcactcataagtactatattcatgttttatattgtaataaaaataaaaatactaatcataaaaaatcaaataagacgaacgatcaaatgttggacacagaatcccacaactgcactgaaaatggaatggaggagtaattgctacatcctccgttaaaaaaaaaagaagactttattaattaatatatggctatatgcaggcagtttgacacagaggtagtagtagaatccagtgttgtcttatattatacataatcaggaggatgactacacttccaactctaccacaccctccatgtgacagtgggcaggcaactatagcttagcaagcttaggtcatgcatgtgaatatcttgtacactttgtacagtgattttaccctggcccagctactattatgtccatgtatgtacgttcttgttgcatccggcgccgctgcagcagcaatgcaatgcatcatctctctatatgtaaagactacactggagctcatgtgatgtttcactgcaggcaggttgtgtgcctttcacaggcccctagtatatatgggtgccctaactatagcttgcttgatgtgatgatgtttcttctgccaatttaacagttttatctgtttcagcaaaaatgtttttagctttccaaatttttggaaactttctagaggttgagccatcgtttgactggtcaacttaagtaattaataacctctataggttgaacctattggttgatactacaatacaagttttgaagaacacgtacggccggtgcattattttgcaatctaaattaacaagttgcggaacaaaaactaaaaactagtagaaattatacttcaatgatcacctatatgtactgaaaacttggcgtgcgtgcataaacattactatgcaatgataaattcatacatatacatgatgcttcacgtttgccggcttcagctatgagccaagaggcccctgttgcaatttggaatgaaatgaatagcataaaattaataaagatatatatcacaatatcgcggagaagttcatttggtttattggggatcaaatatataacaagatcttgcttgatgttacaggcatgatttacattgttgtttgtagcttcagcaaaaaaatagccgtgtcgtcagcatcaaacaaagaagctaggggccggaaagcgaaagatgcatgcacacacccattttttttcacctgaactgatctactttccgaaccttaatttgtcatctagatcgatttgcatttcattatacaagccattttttcaaggggtcaattgaatccatgccattacaaataaaccgatttacataaatactactatatttcatctatctgtatcaatgccattatattcaaattcacacaaaatttcaaccgtgccactactaccatcctgtttttcatcacatccttttctctcatcctccttcctcttttttttctctcctctccgtcccatcgagggtcgaagccggccgccggcgagtgctcatggcggtgtactctcctcctcttcaaccagtgttgtaccatacagctgcacagctggagacaaacccctcccgcagcagcaatggcggccgaccaagttcggtgatcagccaccgcagccctccctagggtggagccccaacctcaaccttccctacccgctcccgcccacgcagccgaccgtggtgtcgctgccggccccgcgctcgggaggacccgcgcttccactactaccgcaccatcaccacgttagatctaaggtggccttccgcttcccgaatgaccagggcttcgagggcggcacgaacggtggtgtattcgtagaacaggctcaccaccctagtgctagcgcggtactcggggcgctcgagaggcacacgacactgttgctctactccaatcggctcgttggctcgctcccgccatcgctgggcgggctggctgctctccggatgctccacatcagcgacacctcggtaatgtcgagccctagccttgtcgtgcttagcaggctcgcaaacctcaccgtgttcgagctcgcgtcctgcaacctcaacaacacgatcctgaggagcctcgggaggctcaccaaggaaaggggagggcgtggggattggaaggacgaccgccgccaccgccgtgaccaatggcttcgccaacaatgtcctagagacgcaccctcctcgccaactgctgcatttgaaatgaggtggagagagatggggaagaaaataagaggggatgatggaggaagaagatggaactgacatgtgggtcccatatctaagggtattttggtctatatgatgacgaaaaacgtgacggtgataacgtggttctaattttgcgcgatttcggatggtatggatacaaatagacgaattgtaatgttatttatctgaatcactatatttttggaatgctatggattaaccctttgttatacataataacttggtaggtaccctccaccttaaaataaatatatatatttaacataaatatagacgtagagcgcttatatcaatacttgcgtataaaagttaatttattttgggagggagagtagcatatatttgtgcatatatacgtatgcccattaaatacgaagagatgtgcattttgtttttcatgcatagattgcataaatagtcggtcatttgttgcatttgaaaaaacaccacaagataaggctggagacaggaattacacgtctgacaacacgcgattctctaaccacagtgccaatcgatatgcgtctgcatctgtaagttgaagaataataacaaatttaatgtcccctggtgctagctaggagtatttgtttatatcatttacaaacaaacaaataactaattaacgccaattaattaattttctagaaaacaaaattatcaggagtacacttcacttggacaggtcactgaaaccagtgactggttatgtgcccttaactaggggcggcagaacaccggattggcttgcggctgatagttttttgatggccatggtattggatctggacaaaataaatcccaaaatgattctctcttccctgtctctgtctctgtctctctctttttttttcctctctttttttgctgctctcacacgcctggaatctaatgtggattgattaaatccttcttttccgatggcatcactttctgatgcacacagcacaaagagatactcccttccgtcccataatataagggattttaagtttttacttgcaacgtttgactactcgtcttatttaattttttttgaaattattatttattttatttgtgacttactttattatctatggtactttaagcacaacttttcgttttttatatttgcaaaaaaaattcgaataagacgagtggtcaaacattgcaatcaaaaactcaaaatcccttatattgtgggatagagggagtagtatatagtactgatcatttcttgctcatataacatggggttgtttttattcagtataaaaaattaagttggctagaagatacaagttttccctcttttttttttggtttttctttgggagtatatgttcaggggatcaagaagtgctgtgtacgaccaattatataaaaagaaatgcagaggcagaagacgagtacaaattaatgtcaaattacatagtatatatcaactgtatacatggtacactacttgacatgagaaaataatcatattaatagaaatgttctaatgtacggacctttccatattaaataaatattgtaaggatcataacgagattaatttggtccacctcaattagattcaaaataaattttatattttttaaatggtcattttcaaagaataaggagaagaggtttttcataggccgatttcttaaaaaccactcttaaaatgattcgcggttccaataaaaaaaattgattcgcggttccaataaaaaaaattgattcgcggttccaataaaaaaaattgattcgcggttctcataagaaaagaaggtctgtaaaagttggtttttgtggacaattctcttatggaaagtgccctggaaataaagaaatattatttcaaggaaaaaaaatcgcaactctttgctatgagatcaaatgatgacaaattaaattatatatatgaaattgtagctcaagttgaaattgtttcctatttacatggtttaaggggttcgttgagattttggatgtgctagctctatttcaacatatagatggacataatccaaatccaaaaggttgtttctttttgtgaaactacagcatttgtaagtacttgctcaactaagactgctactatcatgatgttctctacttataaaagctctatttgattttttttgtttgcctcagatcgattactaactgacatacgatgttatatttgttctcatcaaagatttaaggcgctttcaaccttgcaagctgccctttatatgtatcaagctcactatattgttctaattctttcctgaacaatttaatttggacgtactacatgaaaacagtaccataagaacaatcacacagaattaaagcggtataaactaaagtatgtagtacatgttataggtattatattctccttgttttttgtaggataagaaaccttccaaaaaggaaaatttaaggtatgttgttggtatagtactatatatatatatatatactattcttatgttttctaagaacattttgtttcttcaaggacaattaattatgtggaccaattgttttgatcagcctatgatataataataaatacatttgctttccataatacataaggtggtcaatatatatgttgcgaacagctagctagtcatcaaaaaaagttgtagggactagggccggtgacattgtaacaaaatttggtactaacagaaaaggaaatcttgctgttttgtgtagatgtattattagcttcaatttggtcatttaatgtattttgttttgtttgtttcatgatgtcttcaattaatatacatgacatactttcactatgaaatctcgctgatttctcgtgatatttcgctatctcggtgcctctagagatattattaccctggtaaaaaaatttgagttcagtcaatttctttttatttattgattaaattattcaaaccacttctaattcaaataaaatatgataaaaaacaatttctctcagcgagattttcatcaagattttgacatttcacgagatttcgctgtgtcaggccctcccaagattttagtctttaatttcgttttattccagtagttagtacatacaatgacaagaacagaatgtgctctttaagtatttaaggaaaaagtatatgtttattctgctaaagaaaatctctaactaaggaacttctctcaaaaattttcatcccactttcctgtcgcttcgctccctaatggtatctgttttttttttcttttttctatttgtgcaagtctatgcatgccaagtctttttttatgttgtagttttgtggagcaatagaggaaaatatagggtacaaaacaaaatactttagaagttatgcaagaccactttcatgcattttcatatcttgaggatttaaacatgccttcactgtaccaatctatgatagttcaggaaagtgaggcaaataaaaaatcttttaactgtttaaattttcagcgaaataattcaggtaaataaagcttagcactttcctataaaaaataaagctgtttaaatgtgtgtatccagccttcaatgttatacatccttcattaatttacatggggtataaccctaaaaagaattacatgggtatatgaaataatattaattagtaccaattaattcttaactagtgctatgtgtgaaaacaagattgttaattaatctatgcgaatcttggggtgatggtgtgtggggtgtaatagaaagatttcattatatctctcatgcatatgcatgcatggtttattgcggcgtgagattacaaagtttggaggcatgctgttcatatctctgccgtctgtgtattggtcagcaacctatcagcactaccctatctgcttaattaaacaatttatacaaacaaagctgctagcttaagaaagaaacattttacaaagattaattgatgttgtcctaaagtaattcaaggtggtttcattatggggaaaagtctgaattaccccctgatacaattatggttgtcagaattacccttgaacacaactaccatatatttagcatcccacctttttaaccggatgaattagcccataacttaatctagagagatttttttctgacgtgatgtacatgtggcaatccagtcagtaaaaaaaatattaaaaaattctataggctccacatgtcaatgcatcctccatgttcctctcctccccgacttgaccccagtagacaacgacggcgaggtgacatggacatggactctgatgaggcgtggccttagccactgccacacctcttcctaggctcgacctgggcaggcggcgacccgtggagcagatagttgcaatggaggagcccatcgtgcccccaatagcaagagaaattatggggaaggggccaaggtaacgatggtgccagtggccaaagcgaaggaggtgacaacgatgacactgatcggaggtgatggagtggcatggcaagcagctcgaaaggaggggacgatggcagggagactctcggaggaagaggtgatgggacagatgtggcgcggcatggtggcctgcccactcgtccatgaaggtggcggttggaggtggaggaagaagccgagctcgagctcccctcatggaggctggtggaggttgcggccagtgaccgagctcgagctcactcatgaagggaagtagaggtagatctcgagctctcttcgggcaggtggtgaagactcgagacatgtgaccgatggacccggagctcgatcgggatggtgcaaccagcggtcatgtggaactcgcggctggtagtggtggatctggtcacaatggagggagatgggcatattcctcaccggcaccacagtcctctaacttcacgatccccatcatcgtggcaaggcctc

SEQ ID NO: 63487 - DNA, 3509 bp, Oryza sativa
ttgattagcatgtgatgtgcatgtgtatagtgagtatgcataaaacatgctatgtattcataaatttaatctctactttatcctttatcattgaaatgatcaatatcatatatttctaacccttgtatcgttgctcaactttcatatctttctctacaatcactatgtcccattctataaatttttactgaacatatgtctgtctaaatagcattctcacatatgtgtgtgtgtgtgtgtttacgtagtatgctaattaacacatgaatcgacaagattaatcaggcactcctccactcttttcctaacaaaaagatatctttcatcttttcctctctctagtcactggaaacacccattgcaagtcttgcacaagtcaccttatccattttcccctccaatctcccaccacaagtcttgtaagtgcagttcgatcatgtttctgccaattgccttcgatacatagtgcttccctcaccatcaccatgttggcactagcaagacccaccagtcatcccctcccaactacctccctctcctcttcatcttacatacatgatgttatcatctcccatcttcatcaactcggcactagtatcctcacactcccctctttgaaaggttgatcagtggagatcttttactgctatatcctaactcccgcttgcgaaccacatagaatctctcacacttgccattaaccccactcaccaccctcttcttcgtcctcgcggctccagcaataatatcacttgcacctgatcacctacccgtctctgccacccaagctttccctctaaacctgatcttatagtgccccctaccaagggaaataatccggcctagggctatactaataactttgtttatttaaatttgtcgacgggggataaccgcagactgtatattgagggttggggtacgttggtacgaggatctacacgatacgacatcaagcacatagaagacaaagattatactggttcagaccccttgtaaggtaatagccttaatccagttcatatgggattatgagaaaaaaccacagaatacaataaagaacaacagaacttcgagattactgatgagatccttgtcgagagcgtcttgacgagatttatcggtgagtaggcttcaagttcgtccagatcgcttaagttatggcgggtatcttgtgctaagattcgatgttcggtacccctcaaggggtctctatttatactgcagatcaccttagtctccgagtaggactcggagacaatggaccccgtacaataagataatatcgtcatcttctccaaatacaactctgacaccttctattcgtagagattgtttcctcaagaacttaacaatttcctttaactcaaaaggatacttcccgtatacttgaggatatatcgtatccacatatctcatgactcctaggataaagggtatgttttatccgtaaccctgacaaaattttcatgttttttttgtaggatctaaaatggattaaactttaaagagactacaattgggctcaacccttaagtacccttgtcttgtctcctcgctgcccctacctccatcccatcataaagccctaaaacttaatctagaggagctcgccggagttaataagtttgagtcgctatcattggagtgccataggagaagacgctgccgtcggtgagttcttccgtccgtggctttcataacgtctaagaagccgacggctaatttcaatctacttacagtagcataaacaattgctggacatagatggagtaagtatttgtccaaaactccaaatacatagctaaaaggttactactatatagagagtaataattcattagtcacacaattaaactcactcacaccaaatgaatgatacttatcacatggaacccaaatattctcaagtgcaacaagacaagctttgtacagtagcagcagcagggatcagtgattagcagctgctagctgccaaagctcccgtgagattaggcttaatttatactccctccgtctcataatataaggattttgagtttttgtttgcactgtttaaccactcggcttatttaaagaattttggaattattatttattttttttacttactttattatccaaagtactttaagcagaatttttcgtttttatatttgcacaaatattttgaatgagacgaatggtcaaatagtgtaaccaaaaactcaaaacttgtataatacggagtgagtatatcacccacccactgtactattccgccgtacgtgcaacctcaattcactccaagatgatgagtggcatgcagacgccagtagtggccgtgggcgccacggactgggcgtggcggctcggcgccctcgtcgctggcgccgtcccgctgctcgcgctcgccgtctggcactgcaccgacgccttccaccgtgccgccttcgcgttccgccgccgcgggacacgacgcgcgagacggctcccgccgggccacatgggcctgccgttcgtcggcgagaccctcgccctgctctggtacttcaacctcgcccgccgccccgacgccttcatccaggccaagaggcggcgctactgctacggcgacggcgacgacgacgccggcatctaccggacgcacctgttcggctcgcccgcggtgctcgtctgctcgccggcgtccaacgggttcgtgttccggtcggcgccgcccggcagcttcggcgtcggttggccggacccggagctcgtcggcgtctcgtcgatcgtgaacgtgcacggcggccggcacgccaggctgcgcaggttcgtcctcggcgccatcaacagcccaaactccctccggtccttcgcggaggtcgtccagccgcgcgtggcggcggcgctgcggtcgtgggcggccaagggcaccatcaccgccgccaccgagatcaagaaagtaaactaaccatactcctacttgcttctcatggatgcaacgaattatatgttgcttttcaccgatcgatcgatggatccatcgagatcaggtgacgttcgagaacatatgcaggatgttcgtgagcatggagccgtcgccggcgactgccaagatcgacgagtggttcgccggattggttgccgggttcagggcgctacagttggacatcccaggaaccgcgttccaccacgctcgaaaggtgacaccctgtaaattaatttttctctgcttggatcggatttaacaacagtgaagctagagatggtagaacgtactactgtacacatgaatttgtgcatgcagtgccgtaggaagctgaactcggtgttcagggaggaggtcaagaggaggaagttgaaggcgaagttagaggagcacgatgatgttatgagcgggctgatgcggatggaggatgagcagggtcggcggctgggcgacgacgaggtggtggataacatagtctcccttgtcttgggaggctacaagtccacctccagcgccatcatgtgggcaacctactacctcgcaaaattgtccgctg

SEQ ID NO: 63488 - DNA, 660 bp, Oryza sativa
aattcgagctcggtacccaaaactacctccttccttttttttgtcctccatgaaaccattgatgccatccttttccctaaatctaactgaccagagtgggggacaactgccactaccccgcttttactcttcatggggattgccgatgcagttgcactactttgccctccactctgctccatgaggagagggagatcaacggcatcgacaagacccaaaacttgatattcacttgcaacaccagaaacttgagcatcatcaagaccatgagctcgatctctatcatcgcctatgctctcatggctcccaagcttgacctcctcctcctccaatttcacttgatccagtggcgtttgtggtcgaggtgctaagaggcatgatggagaaatgggattgggaggaagaatgtcgcggttcaagagaaaaggagcacacagacgccttgtcaatcaaggtccgaatggtggtggtagggaaccagaggtggagaagagatagatggagagagggtggtccaaagtgcaaaaggggataaatataccatggtaaagaaaatggggacaaatatacatggctttcaatgaaaatattagatatgggtagtcttagtgaaagtttggtaaaaatcttactcccaaaccacaatttactccatttctt

SEQ ID NO: 63489 - DNA, 1864 bp, Oryza sativa
tctcaagtttccattgcttaattgcgttttttaaccttatcaagttttctcagacatagaccatttttaatattctcaactcttctttaaaggtaagacatcttagaattttcttccatgtttaattttcccgtattaaacaagtactatcccctatcacaaataaataaaatttcatttccaatccagtataaaggaagttgaggcgttttcttaattcttgggcataaatccaaaacaacttggaaccaaatggagtatatgtgtgtcaatagactattttctaaaggaaaaaagattttataccttaatgagataaccccctcattattttctgaaaaaaaaacaagcaaaataatgatgaaaatatttttaaaaaatttggagacattattaaagactattttggtgacaatggcaaatatatgtatatatccactatcctagaaaattccaactgtaaattcggcccatacattggggaggaggggggactccaaactatgaatagtacctgagctaattatcactttatttgtctcttttctcgttttggagaccatgttcaacttaaagtctttttggagtggtagatgtcaataaataatatattatcatttttttagaatttccataactgtgagtatatttgaggaagtaagtaaagagatatggggcacatcctttggaggtatacatatccatcttcttagcttattacgtctcctttggaaccaagaaaaaatagaagatttttataggattgaaatcatgtgctgctttagaatatttgagattcctacaaaatttatttggaatggcttaattcattggaattttggagcctttccaacctgaggttgaacctcataagaaatttttcttttgtctatctctctcctcaaatcctaagcttttcctatgaaaaatccaaacaataagcttcaacaattcatatgtttagaattcccaaggacatataccacttccattccttcgttttttctgtcacgtgttttttattcatgtttttttttgagactagggctgagccccccttccattaccggaacggataaaaagatcttttcttacaaactgaaagcaaacaggagaagaaagagagaaaacccccacccctatagcaagactaagcttcccatacaagtgcccaaaaagagtcacaatttggatgagggtggatcgtttatagggagatttccagacagaaactaggagaaacgacacaccaattgccacctaaaggaagcaggacagcagtcaaactcagcaaaagccaacagactcaacaacactccagtcttcttgtgcacggcttccatccaaatcttgagttgtatacatcatctgctacctgctttaccagcctggctcccagctccagtcttcttcgatttgcctccagtttctgcagaagagcccaagattcaattagattacagactaaataaaccacctcagtgggagttttgggcaggacattatcaaaacaaactctattccttgttttccaaatagcccacactactgctgatatgcccaccattagcagatttttcatatttttgtcatagccagatagccaggtaccaatcacctgggttctattcagagtgggtttaaaattgaaagcacaaatgataatgttccaaatcatctttgcaagagggcaatcaaaaaacaaatgttgaagggtctcctccctacagcaaaactgacacaacttatccccttttttccagccttttttatacaagttatctttagttaagattttatttttcagaaaaagccaaaaaaagatttctaatcttaagggggactttgatgttccagatttttt

SEQ ID NO: 63490 - DNA, 2084 bp, Oryza sativa
gtaaaaatatatgtgtacatgaaagtatatttaacaatgaatcaaatgatatgaaaagaataactaattacttaaattttttgaaaataagacgaatggtcaaacacgtactaaaaagtcaacggtgtcaaacattttaaaacggagggagtataaattaaaatccattgtaagttcatttttactttcattcctataataactgaatctgccctaacatgatagttttcagattaatggtgtggccaagtatattgtgtacaaggtgaaagaaaatggtacttccacatcttggactaacacaaatgttgctaattggccacggttcccaaagaatgtacctcaacaaagagacaggtgcaacatcatcaaccatatttcacacaataacttaattgttaactgattatatgctttgaagttcatagaaacttggaatggaaaatagttatccaacgaatacttcactatggtatattctgaaactactgacctatattaacactttcattttactgcatataacattaatttccttttgcttataggaatccaacgaagttttcagatttaaacatagttatttcagtccatgaagacataagacgtctagagtccgaacattctgaacttcatgcatcatttagtacatctgaagttaccaacgatatttaataaagaaataaatgcaacaacatatctgcatctaaatgtattgaaaactttcttttgagacatgtcattgaagctattcaattccgattgccccaactgtgtgaataatgtttcgctaatttcaatccatcctcagccatatattggggcataaaaatactaaccacccaatgaaggggagaactgtgcatgcatcgtacctattattcctcctaaaataatcgaattgtgtacttaattctatctgtagcaggagcaaaacattgaaaaaaaaacccacaaattgcaaggtaaaaaaccgaaaccttatgcatcagcaccgccctcgctctccatgctgcagcaacgccataaccttatgcggcaggtggcgttgaccaccaaacatcgactggccatggatttgtgtcaccgacctcccaacgaatcgccgacgtaaccatcgccaagctcccgacgttgaccaccaaacattgacttgccatagatttgggtcaccgagttcccgatgaggtaccgctgcaaccatcgccgagctcccggcgttgaccttcacccatcgaatggaatttgcgctgcaactaggatctaggcctaaccatgcgatggagatttacggttcgtttcgtattgccccttctctcactgcaatgccgcgtgcggtgagaaggaaaagaacgcaaaagagatgagagcgaaagagatgccgcgtgcgtaatgtggaagagaatgcgaaagtacaaaacaaccctcccacctaccgtaccgtctcaatcaggatctacggtcccacgtggtacagactattttcaactgttggatgttgccaaatcgacggtcccgatttagtactgcacaccctgaagtacagtaaaaaatctcttgatataaagtttgtctttatctatattaaaaatcatcggttcttttttttttttgaaaaaactacaggtattgggtacttaatggactggacggtccagtcgtttcggtataactgttttgttgtttattatcaacatgtgtctgtcagtaccggttcattaacatgaactagttttgagtatgactactgattcatgttaagaactggcagctgatacatatttcactctctgttctcaacaagaaccgatatggaacctaagtaatcttactgctggttcgtaatatgaattggcggtgatcggtgatgaattattgtgattcaaagtagtatcactgctctgatgaggcggtttctattatgctaattgtgtgtcctgcatggtgtttggttgtattctccttttcatatattaataggatttctatactcatacacacaaaaaaattgtaaaattgattaatatgctcctgagaaagcccggaaaaaggcttttatttgataagtatatatgtgactaaac

SEQ ID NO: 63491 - DNA, 852 bp, Oryza sativa
ataaaaaaaatcaatttctagatgaacctaaacaagcatgtatccaagttcatcccccaaaagttatctatttttaggatagagggagtgcaataagtaggaacttaggcccttcacagtgctccaccctggagcgttccttcgtcccaccacgtagacttcgtgatgtcatggaggagagaatgtgtgggcccgagttcctccgcatgattgctcggttccttggtgagcaacgagttcctcataaaaaagcctgcaaaaaggtctgaagcatgcacaaaaccatcggaaagaggcgaggaagagcatgaggaggagaacgggaagagtctgggtcacgcgtctggctcgccacttccccaccgccgaggccgccgcgctcgcctacgacgacgccacaagccaccaccgccgccgcgctcgcctacgacagtgtcgcgagcgcagcggcgcacgacgacgctgcaagccgccgtcgtcgcgtcccacccggtgatcgtcgggctcgccagggaggtcgccggcgagtgccgtgggctgccactcacgctcatcaccatcagcatggaggaggagaacgccggcatgctgtaggaccgagatgtcgactagaggagggtgaataggcgatttaaaaactaaatgacacctaatcaaaactaacctaagttgctaggctcggtgagggttaagtctaactaagcaactaagttatgttttgcaaacctagggtgatagtggctcaattaattctctaggaaagtaaattacactcctatgtcaatgttttgcaatcctagggtgatatgatctcaagaaagtctctaggaatgtaaattgcacaaatgtaaa

SEQ ID NO: 63492 - DNA, 1666 bp, Oryza sativa
ttcttctgatgatccaaatgcagaacaaccgttgactcgaatactgctcttatcgataatgctatcatctttggactgaccgtggcgtcgtccatgccgctgaatggatttcgcactagcatcttgttgatttcaaatgaaccctcatcctcaatgatttcgttcacctcgttctccaaaggtgcgtagagtggtatgtagaaggaatcgagcttttctttgtcaatgataccctacaaaagcgaattgattattcataaatatcctatcatgaggtaatatatatgtcaaaaacgaaaattcctttgtggttaaatagcaatatattgctactatagtaacccagcgcaaacaaatataagacaaagggcatgggaatctcagacgacttgatgtaacaaagtgaatgcaataaattaagcttccgttatcctaaaaaaaaaagagggcacggagaactaaacatgtgctcaccctggatgccatgtcattcaaagctactgctaccacctgccatgcctgattggatcttgagatagggttttccgagcaccggccatacaaggagataaccatccggcctcccgtcaccaattcttgagccctcaagctcaagaactgcgtgaaatccttcctgaactggcgagcataagcatccctaacagctgcacgcctcgacaccctaagatgttcaaccatgtcatacataggtattttaccctccttaagatcatctggagcctgttttttttttaattacaaaatgcacatcttaaggtccattatactcatcggtagaatgactttcatagaacaatttaatcaagaattatagttacctttgatagccagtgcaagctgttcgacgagcaaacaaaatgcagagagccacaggggaatagcctctcgtagaatgacccaggtatcattccgattccggtgatcacaaccggatcgtctagatcgccatggctgtgcttcagagtcgccaagcttttcgcgacggagttaaaatcgttgctgggcaaatcgttcaagaagacgcacacctctggcggtggctgttgctgctgtgcacagtgatggtggatagcatcgagagcagccgagacaagcgttagcgcgttcgggcctgaggagcagcccaagtctgcaatcgccatgctctttgggagaatggtgctcgtcggttcgcataagcctgtgatggcctcatttatcagcatcttcattctatcttgctctgttttctgcataaaatcaattgtttagataggtttgttgtgaagtttattactccctccgtcctaaaatataaacaattttatcatagtgacaagtcaaatatttataattttggctattgaaaaatataaaaaagatcaatcatgtaaaattgatgttactagtagatttataattaaacaaactatcacaatatgcaactctttttatttaaaacatcttatttttatagatatcgttggtcaaagtagaatctcgaataccgtgtcaaaatctaaaagtgcttatattttaggacgaatggaatatttaattatttgggaaaagtctgaattttatccttagagcaggtacaatagtaggctataagccagctataaccacatatcgagaaaaaaagataagagagagaagaaagcgg

SEQ ID NO: 63493 - DNA, 2300 bp, Oryza sativa
ttcctgcagcccttctcgtcccttatttcatttcatcttctattttaacatatactttaaagtacaaatgtatagttctatactctacgctactcctagtataaaaccataataatccaaccatatttaaattcacaattcaaattcgattcttttaaaaaaaataaaatggaaatacaaatcctagtagcatgtattcatagctcgggtgaaacgagcttctgctactgtagcgcttccatgcattttctcacatgtgttgatttttcccgtcttctcatccacccatagaccagctacttctctcacgaagcaacaaccaagcaaaacaacaaaaaagctgcatagcacatcgcatgtatcactttccccattcttctaagtcccacaatcgcagctgctagtgctaccctgctactactttctcaattttgcagcctgcaacaacacttgaatcatccagtgcctcgacgccatcgcatgactcggccactgggccatgtttttcatcgagttcaggcagagggtgcaggctagaggagactccaggtacagcagacgcgtcggccgggaaggagcgtcgggtagaggaatgcacttgagggatgacacggtaggcagggaggagccgcaccgggcgggaatgagcactgggcaggggaggtgccggcggaccaagaccacgtcgggcagctcccgagcttttccaaccgtggatgggggctgtgcagtagagcccctgagactgggggcttggaaagattatttgggtgcctacctaatttaggatccttgatagggtgtcacatcctgatttttgtttcaggatttataaattatttaataaattattaatagaatttatattaaatgttctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagagcttttcttgtttaaaatccttaaattataaattgttgtttaaaaggaattattagaaatgattttaaaagcttaaaagagaagatctaattttaatttgctaaatctcaacataaaattgggccagataaaattttgttaaatactttgcttaattctataattcctagatttttctgggatttatttgagctaaggaagtatttttaataaatggaattgcatttaagaaataattttaattgaaaaaggtttttaaaagtctgttttggctttgggccgaaagtcggcccaaaacctctctctttcttctctctctccccggcccagtcggctcaagtcggcccgcagcccagtccgccgagccgccgctctcctctctctctctcgctgtcgctgacaggtggggcccgcctgtcggacccgtcgtcttcctcgcgtcggccgccgcccgaaaccctagccgagccgcgccgccgtctccttccaaattcggccgcgtctttccatctccggccgaatcgtttgaggggaaatgatcttctcgatctcctcttccttttctcttttggaatcatcgtctttttcggtttggaaatccgtggattcgagttcgattcggatcgacttttctccctccaatccgacctttccttctcgccgccggtcgccgtgggccaccgtcgccgctcgctagcccctttaaaaggacccccgagctctcctctacccgccgccaccttcgccttcgtctctcgtcgtcggaagcgctctagcgccgtgtaacctagcgccgccgtcgtcgccgtcgctccagccgtgcgccgccgccgttccagtcgccgtcgtcactcgggaaggccatcgtcgggatcgccaagttgccgccgtcctcgtccgccccttcgccattcgccggcgagcgtgcgccgtccgagccgtctgagccgccgccgccggaggtgacgtcaccgccgacgtcatcgtcgccctctcccgtgagccggtcgtggaccgttcgatctcggccgtcctttttggacagggttgatctcggccgtccgttcccgtgaaccgccgccgtgcacccgatccaccgcaaaccctagccgctgacgcaataatcattcttttccttttcaaaaataattcattattgcgtcataattcaattaaaatccatataagtgttttaatccgatttaatctttaaaaattcaca

SEQ ID NO: 63494 - DNA, 27333 bp, Oryza sativa
  unsure (1)..(27333): unsure at all n locations
cccttagacctgaaagcctgatatctttcacccttaactattaatatcggacgaattaccccccgtaactcaatccggggtggttttggtactacgtggcagtccgatcagtatttttttttgctaaaaaagggtgggaccatatgtcatattctctccctcaccccttacccctctctctttttgggaagtttattatttaattttgtacaatattaccaggttcatatactacttctgtcatgagatctattccaaactataattatattgtcttccaatttttgcagaaataaataataaagctagattaaaatttagtactatttccgtcataaaataagtgtagttatgggtttctgtgtccaatgtttgaccgcccgtcttatttaaaaaaaaatgattagtattttttgttgttattagatgataaaatatgaatagtactttatgtatgactatttttttaaaaaatattttataaaattttcaaataagacagttggtcaaatgttgcacagagaccgaccactaaagcactctccatggatacatatgatctatgaaaaagtccaaatacactctaaaatttggatgaagttatatttatcagacatatgagtcccaaaacatcctctaaaatttatgaactttataatacaagtgtgtcccaatataagtgcagttgtgggtttctacgtccaacgtttgaccgctcgtcttatttgaaaaaaaataaaaaaaaaggagtgttttgggactcttatgtgcctgataaattgtgtcaagatacacctctctctttcctctattttaatgtgggtgggtcctattatgattataaggggtgttttatattttgcgataattttctttagttgatatgattaatgtgtgccccacactttgtacccccatattaatgtgtgctcttacatataacgtacttatattgtcatgcttattattatgttgttattcctttgtaaatgagaacgagcaagtggataaaaataatgatttaaaaggatattttaaaacacacacacatatatgtacaatctatatgacacgtgatgatcagacttgttaacgtatatgtagctagattagataaaaaaacactttacaaaacaacctaggagattatatggatgaactattttaatattcaaggtgctagatgaacttccaatcaaaatttagagtgtatttggactgtttcatatgatttacatgaatccaagcttcaaactattgaaaatttgattagatgtgcttctacaaagagatgtttttgtgaccagaggaactgttgtacaatgggagtttacgacttgattcgtaatgttaagtaccaaagttaaggtatgttttttttagaaaaacatataatatcattgtggtatgaagttagttgaatataaacattataataaaattgtagagcccaactagcattttatagttcaccacttctttttatttaggatcgtaaatattatgatatattttagtggtaccaattttaaattttcttcgtaccttccaatagagatgagctttatgtgaatgttacagatctgaacgatgtttttgtttgaagttatctaacactactctagaaacaacgagtacccctatataagtttgtaggcagacataagtgatcgcggctaaaaaaaagtcgacctgcattttcgtatatgacttcttaacaggtcgaagtttcatattagaagagtcaaagtaaaagcatgtgtgttatgaagtaatcagtggggtaagctggctacacgtggacgaaaaagtcttcgggcctaattaatcatactggcatttcaactatgaaaataaatgtgcgatttgtgtctttcatatatatacactaatacataccctgcaggatcaagatacagatttttcttatttttctggagcgaaaaaaaaaatcaaacttcgggatagcaatagctgccagttttcgtgacttgaacggatggtccctgacagcgtcggctatacagccgcaataatacaattacagtatccctgcttgttatattaattagcgcaggttaaaaaccggccgttatagcaaagttttgaactggcacgttcggaacatatattctcggttgggctactccactagcacgatttccgaacagcacaaacggttgtgtttaatttttaaaaaataggaaaaactttttttaaaattcaaataaaatactttttttaacttttgttaagtttataaaagtgaaatataatactcaactaattatgtggtaatgatttttcacacgcagaaaagggtcaccaaccccacccatttcgaattgagacttagaggtagtatgaatttaaaaaaacgcatagaacttttgtgagatattacatgattacatcatgatagttcactagtgtaaatccatacaacatttgttgtgctttctcttcgaacatatatatatatacatatatatatatatatatgtatatatatatatgtgtatatatatatatatatatgtgtatatatatatatatatgtgtatatatatatatatgtatatatatatatgtatatatatatgtatatatatatatatgtatatatatatatgtatatatgtgtatatatatatgtagcaaacatgcacatcaatagttgagttaaatttaggtggacatattattttctataatttttattcatatatctatggctacaataagttatacaacagatagacattcatacacatatacactaaggcatgttcagattatagccaaaataaaccttaccaaattttggcaataccaaaattttagcaagttgataatattgctaaaattttgacaggatttcttctgtatttgtcaaaggttggcaacaaactaaacgtagacatatttttgataactataccaataaatgatatggttgaaaatggcatcaatctgaataacacctaatttggtacaagcagcatagattcctaattatattaaaataagaaaatgacaaactattcttgctactgttgttattataactattggtttccaaggacaatacaataaaataaacaaaccaaataagatcaatatttaagaaaaaaataacaggagaaatatgtgagaaaaagaacagaaatttagaatcacacgtagaaaaacgccagcagtttataaaaccactgtagctatcggttatacaatagcggagctaacgaggatatatcattagcaccaaaccagcacatataggggatcaggggtgcacctatttttcacacttcaattcctgcaacttatatgatttttcacacaatatacgcacatatatacagttgacaagaatcaaaactaggacctctctctcagaacaaagcctctttaatatcttactacctagcaaacacttgttttcttaattagtggcaaatactattatttagaaaatccggttgtatttcttggtgcacaggaaatttacaactgataaaaatacagaaacatccaagaagaccccaagtgtactcaccacatttggccagacttttgaagcaatttctgtcatatttcagttcttttagcataagaatcaactgtcgtcaacttaactatgtattaaataccggatttttcaaaactaaaaaagataagaacaggaaagcaggggcttcgattacttttcaattatccaattaataatcaaaacacgatcatttcatgcagatcagaaagaacttatacaattcaactaacatctcctcatcacagaaatatgtacaactgtacgtactgtgactcagaaatcagccaaagcctatcgccaacgaacatatatatatatatatatatatatatatatataacacacacacacatacctgaactgtggagttgcgagcatagctagtttcgccatgccctgcattcatatggagaatttctttggtggtcatggcgcagttgcactaatatctgaatgtgtttgctacgatatatgatgtctgagttacctatttatagccttacaagtcgcccattgtgtggtctttattgtcagctgacctttgatgtcagaaatataaaacaatgattttcttttactaccgacagatatatttgttgcttaaaattaatttgtacaataaactgtccaatcattcattaatatttctgacaaccatgcccatgtgcggctaagtttgtacaataatccgcttactaataatttgtacaaaataagcgtggacttgtgagcatattatgtaatcgctccgttttacaatataaattattccagtattttctacatttatattaatattaatgaatctggataggaaatgttagaatgacttgcattgtgaaatggatcctgttgtccgataaacttatttgtttttagccgtgtacatctacatgtgaataaatgtagaataaaagaggcgggattttgattctactaaaattctagctgagatggatatggatgctatcatatatatactcatattttatctagagagtctcttcatgcatggactggttggagtagcatgcatgctatttaactgaattgactctagctaagatggatcactgagagtgctcaactcagtaaatctatcgtatacaatttaactatgataggttagtgagtatatatgctgacatatgtcagttaatgttacttttgtggtgcagaaaaaatgccgaatatttgccctactgccgcgcgccccttaattgggtacgttctcaagtcgttgcccaccgtgtccgtacatgacagtagcacataaaactgtgctacagagaaataaatcagtaattaacacatgtttcgtcttcttatttaagtaaggtgaataaattaacgagtgcagacacaatcacatgcacatgttgtgttacaaaagcaactcataacacataatatatatatatatatatatatatatatatatatatatatatatatatatatatatatatatatatatatatatatatatatgagagttgaacaaatatgttacaggcaaattgcttaaccatgtgacaatcagactatatgtggtcttccgcattagtctttgatgtgaatttcgtgttcaattagctaaataccagtgtttttgctacggataaatgtaaattatatgcatgcacttgtctatataaataaacttgattttagagatgattagataatcacaaattaaaatgtagaatcactagctatcttctaataatatggaagtatacataaggagatgtcggtaagaaaaatataaaaatagagttcgtaggtggtagagtcagtttccaccaccactgccttattttagagggtaaattaggacccacatgagtcaatgacatatgggttaggatggcatatttcaaattttgcaaaattataatggcatggttccaattttccctattttgggtagaagagtatatatagatatagatattgatagattaatattatggctattttcgcaaagtgaaaatcatggggatagtgcgaaattatcaaaacatattattgatattgactaatgttttcctgtatattggagaatcgttgctgaaagtaaacaaaaatatatatttaaaaaaatagaaaagctgaaacagagaaaatatatgtggagcaccttttctatatttttatgtcaagatttatttcagatgatagaagttgcatgaaaaggttatgacctagagttatagcagattctttatataagcaattcagattggttcccattacacattcaaatcatccaacttttgcagtcattatattgatatatatcatcgaagttaggatgctcttgtaaccactcacattttacaacaagaaaaggtaacttcatgttggtttattaatattttgtttattatttagatatattggaacgtattaattataggtaaaacagctcttcgatccattgccacctagcaaccaacatatttattattttttaacctttttaatttttattttaaaaatctcatccagaactaattttcagattgcaatctttccgccatgccagtcagattggcatgacaaaacaatgttcacacatcgatttgattggcacaaaattatttgtcacgtcggcctagttagcatgatagcattggctgtgtttagattggcctaaagtttagaatttggttgaaattggagacgatgtgactgaaaagttatgtgtgtatgaaatgtttgatgtgatggaaagttgtaagtttggaaaaaaaactttagaactaaacacacctattgttttgttcactacgagtggtatgatagtgttgttttgtcacgtcatatgcgatggcagggctaaaattttcgaattttcgattaagtgtgggaggttaatttttaaaattaaaaaatagaaatgtttaaaaaatattaaagattccacactcttatatactacatcaattctctgtaaaaaaaaatgaattgattttttatgagatggagggagtagcgagtcagtagtcacaatatggacggtctatgtacaggccgagctggcgtgataagatcactcgtaattaattctacaaacccaactgtgcctacacacaacttaattctgaactacctcccgttccagaaagaaccgatttgtagaggggatcgtttgtagcagaaagaatcgatttctgcacgcaaaccttcactgagttgcaggtgagaaaatccacttgttcacgcaaaagcttctctcctctctcttttctctcgcctagtgtagtactctctatctcgttcaaaagatgctctctgccctgtcagaagagagtacttgtgcaaaaaagaaggtatttttattggagagatagaatgaatcgtgtacttgtatgagggtattatggtagtatttggtaatagctgctaaaaatgcatcgggcatcttgtcacttttggatagagggagtaatcatcacgacaattgtactagtccaaccaaaacggttgactcactcacagtaacgcagccatggtctaactgccgccgtccacaaatataaatactttttttcttttccaaataacggatgaagaaaaataaaatcattatatttttatagataatgataagaaaaataagataattatatctcttactaaagggaggattgagaagggagaaggttgttgggggtaagattgagtgaaaaaaatattatcaatacatattataaactaaaaattaattaaacatttttacgtaccactcctaagccatgtggcattgtaataaattttaaaaatataaaaatagtaaaaaactaaaacatctatctactgattttaattaaatggtgggttaaataaaaaaatcacctctccaaccaatatattagaactataataatcaagataaaatttactatagaacacctaaaaaagtgtaattagttgtgagacattgtaaaaaagtgaatttactcgagcacactttaaaagtatgttaatttgctataggatactggacgtattagaatataatatccaatcaattagtaagagagaatccgtataaaatgaccgttttgtccatacctttgtcttccttctagtcttcgcccgacactgcacgctgctattccaagatgagaacctcgtgtgcatgtatcacaacatggggcagggtgccttcagccgcccaacgtggttgacgatggacgcacggaagctcatcgatatgcccgtcgctggggtgagcctcggcgcgcgtgggtggcatgcggttcgtggcgtgcaagccggagagcggcgtggtcacgcgaatggaggcgctcgcgacggtcaacacaccatgcctatgtgcgtgacgacgagcggcgcgcggggtgtgcctcgattgcgcggagccgtgcgggtgcacggggcagctcgccgacgcatttgatttggtttggtgtttattcttcttttgagaagcatcggaagaacactataaaaagagagaagaagataatggcaaaattgtcatttgatgtggtttctctcttattaattgggtgaatattatactttaatgcgtccggtgtcttacagctaattacctcacttttagagtgttcttaggcaaattaacgtttctatgatgtcccacaataaattatatttttttctgtcatgtagtaaattttgctaataattagtgccgactaatcgctctcatctgaccttattacatacgtacctacctaaaaaaggcattaccgacctccctccttgttaggatctatttattttaaaccttttctagttttatctaaaaaaaataaactcccacaaaactatttccaaatatcaacctttcagccacactcagtacaatattgccacaacagtcttactagattatcatggtgtccgggctccaagctataaaacacacaaattctctcaaatttttaaaaattttcaaattatgagtatatatctaggtatatgaatttgattcatacaaatacctaacaacaaaacaactcaaactcaactttatttcacaattcattattacatatctaacgaattatatgtttggatgttatatacctagaatcaaaatctaacaaaaaaaaaagttcaaactcagttcaaacttgtttgaacttgttagtaaagaagttaatgttcatatctaaacatttaaaaaaatttcatactcattcaaattgggtatatactcaatttgaatcttggagcccatactccatgtagcactagttaatttacttttatatatatatatatatatatatatatatatatatatgtgtgtgtgtgtgtgtgtgtgtgtgtgtgaatgaatctagatgtatatgtgtgcttagattcatatatatatatataaatgtgagcaatgcaacaaactcttataacctgaaacggagggagtatatatatttggtcacgttctgactggcgtgacattgtggtttcgccatgccatcctgattggttagcgtggcagtattgttttatcacgtcggaagagatatcatggtcaaaaggttcggattttattattgaaaagattaaaaacaaataaaaacttctctcgacctgtgcttgtatataaatgtgcttacttaaaaaaacaaagccccataaaatatatcatgccaagtgctatcttatataataaaagtattcactaaatgtcaagaaaagaaaattaacaacatagattatataaaaatgcaaagttaattcattcatttttcaaggtaattccgctccaactctattgccatcttcctttagtgagaaaaataatcttaaatattaaaatctatcactattgaattttcacttaaaccgatatacccactatttatttacgtacatgcaacaacactaccaaccaccccaccccaccccaccccaccccccaaaaaaaagaaaagcctacttcctctcctctgtgttttatatggaagttgactagatgaaaataatagtatatatgtaaataaataatattatgaaaccatatatataatttctaatttgtttgaatagcaatatttgtcactgctaaaaagacaatttaagacgcatattaactttaactttatttagaaaatgtggcacacgggcatgatatattagaaaattacaatctagattactcttatcatatactcccgccgtgtgagaatgtaagaacctactcgatagaacatattctattactacgaatctagacagttcctatatctagattcgcaatgtactatgatgctttccatacaggttcttatatttatattctcagatggaaggagtattaatctacaaacacgcatagctaaattagattcataatacacgaaaaaaatatcaaatcaacgtaacatttaaattatatatccaatatatgcccactaattcatcaaatgaatcaagtaatagatacggatttttctttaccaattatttttggcgagacaatcaaaaaatctggtgacactttaacaataattctcaatgaggtgcaagctaccactaatggagaaaccatctttggtcggtcgacccaaatccacactagttccggttttccattaaaaaccgggacaaaaaacgatttttagtcccggtttataagaacaacaggactagatgatctttattcccggttggtgttgggactaaagatgaagatcatctttagtcccggttggttccatgtcagaccgtgtcaggcgcctaggatctttagtcccggtttgtaacaccaaccgggactaaagatctaactttagtcccgattggtgttactaaccggaaataaaaatcaacacgtagtatataatccctattacttatcctcttttctcttccacacaacaaactctctctctatctctttttttcctctctaactccctatctctttctcctgccttatctctttccttttcggattgagcgagagcgagagcgggccggccgggcggcagctggcacggcggcgcggagggccgcgcggcggcctacgcgagcggtgcggcggcgcgaagggccgcgcggcggagggccgtgcggcggtggccggccggcgcggagaggaggcggcagcgaccggccggcgcctctgtgggttttcttttttagaatttgtgatttattgcatgatcctgtgatgtatttgatttgtgtgtgatgtgaacttgtgatgtatttgcgatgaattttgtagaacttgtgatgtaatttgatttgtgtgtaattgcttttaggatttgtgatgtatttgatttgtgtgtataagtaactttaagatttgtgatgtggatttgggatgttactttgatttgggatttgggatttaattcggggacatacatacgacttgattcgggagaaaataaaaaagaaaaaaaagaagaaaaaagaaaaaaagaagaaaggggaccatctggactgttgttatcccctctttagtcccggttggtaacaccaacctggatagttggtgttaccaatcgggactaaatatcgatctttagtcccggttatatcacccaggactaaagataacgatcttttcccggattcgtagtcccggttggataaccgggactaaagggggttacgaaccggaaggaaagaaggtttctccaccagtgtaatgtaggtggcctttgggtgtgtctatatggatcctgagagcaaggataatggtagagctcagttactactattaccctatcttaaagccaacacatatatacatacgtacatacgtacgtacatacatacacacacataattaaatatatatataatagataagctataaggttagcttcaatttttttacataaaaaaagggtgggtttcaatttttcttctcctcacactttttctcacttatacatttgattaatgtatttgtcttgagctagctcttacatgagagagctaacactcttaattttttcttacctctcagctccacataaccttacagtaaactttatagctcattactatctttgcttgagtgagtgtggaaatgctgatctcgaggagcatggtgatggtgaagccggcaggcatgcgcttaatttgctggtcggtaggggcacatcaacgtccatatatgctggagcccgggcttcatggcatcggaaaaagtgaggcaagccaatgctgagaccttgtttggtgtatctatgaggagcttgagcaggtatacgagggcagggagtgtgtcttgcacaaaccaaggcttcatgacattgtagaaaagaaaaggcctgggcaattgctgtcggattttactgggtgcaggatcatacttaatctcaatatggtgttatcctattaggtgaaaatagtggtatttccataatatttttttatagatttacacagaagtgagagaacgaagctttccatgtatggagtggatatgattttttttatcgtatacttaattggtacctagttcacttttggtgatatagatgcaatttcaccacaacaataataagtaccacttccatcccatgatataaggtgccctgattctttaaaaaagtaaatattgtatatattttttactaactgttaaactgatgatgtatacattgatgacttattattagattcgttttcgaaactaattttagaacatgttacattcatatttgttgctaatatattataaaagaaatgcatggtcaaaaaagtaaagcgttggaaaaactttatattttaagacgagtggagtagtggtggtcagtggtggtttatgattgtatctcatagaattaaatttgtaaatatatattttttttcaatattttgcgtttatatacatatatgcaaaacatttgcacagatatatctccttcgtacgatgtgaacgcgggacggaggtggtgccgcgcttccattatgcgggaccggtggtcgcgcagcacggccgtgcggcaccgctcgctcccctagccggggagagcggcagcgtggtagaggcagctgcccacggtcgaggcgaccgcctccgcggcgggcgggactggatcggtcgcgtgggaccgtgccggtcgagcaacacgtcccgtcccgtcccgcgtgtgcgtgtgtcgcggttgacgtgccatgcaagcatcacctatcgagcacgcatgtaggcagttgatccagtcaaatcccacaatacataggcactagattaggggtgtgttcggcacctccattttccaacccaatctctctcattttccactcagcacacttttcaaacggctaaacggtgtgttttttaaaaaaagtttctgtgaaagttgcttaaaaaattcaaattaatctatttttttaaaaaattagctcatgcttaattaatcacgcgctaatggactgctccgtttccgcgcattcctagttgggaacctataccagcgaacacaccctaggcccccctnnntcccaccctaaaatttttcaccatgttacatcaaacgtttgaacaccttcataaagtattaaatataagctaaaaaaacaactaattgcacagattgtgactaatttgcgagacaaatcttttaaatctaattactccatgatttaataatgtggtactatagtaaatatttgctaatgacggattaattaggcttaataaatcccctaagctagtgcctatgtattgtggggtttgactggatcaactgcctgcatgcgaccatgcgtgcttgacaggtgatgcttgcatggcgcgcgtcgaccgcgacacgcgcacgcgggggacgggacgggacgggacagtgctgcgcgccatggtgccgcgcgaccggatcggtccagcgcatcggcgccgtgcgaccgcctcagcaccgcgtgcagccgtcctccaccacgctgccgctctcccgggctgcgggagcgagcagtgccgcgacagccggtcccgcagaatggaagcgcgacaacgcctcggtcccgcgttcccattatacggaggaggtatatttgtgcaaatgttttacatacatgtatataaacgcaaaatattgaaaaacaatgtatattttcaaatttaattcgtatctcatatgcattcttgttatttgatagataaatatatgtcgggagtagacactactacaaaacattaaatagataccaacactatatagatgtcggtcactataggtgttggatgtgataaaaccagcacctatagtgcctttcctacccatgcgcccgccagcccgccaaaatgcttaggaactagcatctttatctcttaataggtgccttcttttttttcaaaaaaggcagccttttgcccctgtcagagatagatgccggttttaatttaaatccgacatcttttagttggcgtgggacccacccaataaccagcatctctatgctaaaaggaatagctgccggtttttttaaaaacaacacctacaatatattatatattatagctaccggtttttttaaaaaactgacacctcgtaaaaccgagctgagccgcatgctctatctcgcacggttttttttaagccgttcttatcctcccataccaccgacgcgctctctctctcgcgcaccgatgctctctcttccttctctttcttctcctcttctcgtcctcctcatctcttgcatgcgtcggcggtggcccagcagtggaggcggcagcggcgcctcccctctgccagatccgctgtaatgccccgattttcgttcgggattaaaaatcaattaataatgcatttctagaaattaaattaaaagttaaatcaatttaatcaagtgaaattatagaggaagttaaaatttcctttaaaaaaatcattggccgggaatattttgcaatattctttgtgccctaaaatactctccggatttttccgcaaattttcggagctcaagaaataattttgaagtcacagagatcatttaaccaattaaataaaaaggaaacaaatttaattctccttccttccccttcctccctttcgggctcggcccaaattcctccccctccttcctctcccgcggcccgcgcgcctcctccctctcttgggccggctcccttctcccttggcccgctcgcaaaagtctgttttgcgtccctccttctctcccttcgccgacaggtgggaccggcggtcccacccgtcagctcctcctcctatctcttgccggccaaccccaaccgccattgctgcccatgtcgccgcaaaatccggcgccctcccacacccgagctcgcatccaacgacgtgggcacaaaaaccggcgccggccaagccgccaccaccccacatcggcccccacttccccggcggttgccgccccgactccgcctctcctgggctcggtccggcctcccctcccctataaaaacattccccgcacctccctctcccttttcccctctctcctgagccctcccgtgcacgaaaaccaccccgccaccgtcgcacctcccgccgccgctcgccgacgaccctccagccggtcgccacagccgctcccaccaccgccgttccgcgcgaccgccaccagcggcttcgccgcgtcgtgccgcaccccggcatccgctccatttcccctccccgcctccgaagcaccgtcgccacgcgcactacctccttccaccgccgccgccgactccagccaccgcttggcgccgctcctagccaccccaagtcgcgctgtcgccgccgctcgcttcgcagcgccgaggagcacctcggccgccgcttttcatggccgggattccaccggaacacggttcccctcgcgccggtgcgcatccgccgcctgttctcacctccgaccagcgattcatgccgctgggagccctctctccccctcctaacctctcccccatcctccccaggtccttctagccgccgtccgccggttcccgttcgcggaacgccgtcgggccgccgttccgccttcgtcccagggagcgccgacgccgagctcccccgcctttccccgcccctcgtcgccgccctcggtgagcactcctcctcccttccctctttctccccttggccggccgcctcccgtgctttcgcacgccgtgccgccgccaccggtggccgcccagcccgtgtgccgccgtcgctttggtcccggccgccgccgccgccagccttgtgtgcgcgctggctaggccgcgccgcccggccatccccaaccgtccgatcggccatggccgatctgggccgtccaacccgtggaccggcggtggaccgtccttgtggtcccggtccatgttggaccgccacctcgtctcgctgacgtgtggggcccgcctgtcggcgccggcgccccttgctgacgtcagcgaatgccttttcctttgagataataattgataattgcgcaataaatcattcataattatagaaatccatttaaatggctcaatacttctaaaattcatatctaattcattcgaactccgaattgggccattcaaattgcaaaattcatctaaaattgagttatacatgtttgtttactttttatgtactgtttctttggttttgttagggtttttcctcattttgcgtgccagcgtgtagaatccgtcgtttcggaagatcgcggtcgcgaggaaaagagtttagaaaatccaagtgaagaagcaaggcaagtcacacattccccttgagcatgttgttcccaatttacaaatgttttaccgtttgcaaataaatatgcatgttttggtaattacatgggatcagggtttacctatctgctcgcttgtgccatgtttacttgatatctgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgcttgagacatctggccatatttcatggtcgtaattatctaactaaaatgcgactgaatggtgggctgtgggtgcatggttttgctggtcgcacccatggcaattaaggaccggttcacgggaaaccctggaagacttacagtgcttaccacaaacgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccatttgaggggtggggatgaaaccttagcgtggtgtagatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcttacccctaataaatcgactcaatgtactgtagttcaggtgggttggttgggcctgttcaacgtggtgtagcgttgatcagtggagatttaatattaccttaattactcaactgttttactgttttgctcaataaaatgatttacaaccgcatttatgcaaatagccacaaaccgtccttgtatccccttacacgtctgcatcgttggtgtggcttgctgagtacggtggttgtacttagccttgctattattcctccttttcagaagtgtagtgcttctgagctgaagacgaagttggaagaccaaggctcagaccccagttgagttttgcctgtggagtggagctgaagccccgctaggatcgcctttttcgctgctgctgcttttgtttcggtgtgaggactaagtgcctcttctgtaagtattttacgctttatttacgtttggaactgtatattacttgtcgttttgtgtaccgtggctggtcctggacatggatttaatacacaaaatagtctgaaaatttgggctaaatttctgggcgtgacatccgctaggcaggggaggtggcagaggtggcggcgcgaggtacggcggtgccctccgctagatctggccggaggcagaggtgggcagtggcgggaggtgtggcggcgtctcccctctgccagatccgatcgggaggggaggtgccggcttggcgcatggtgcagcggcagcaggaggcaggtcgtggtgggagggaaggccgcggtggtggcttcggacggaggaggcggcgacaaaagaatcgggtaacatgttcttcttttttctcatgtgttcttgttcttgttcatgcaaaagaatcgagttgaaggaattgagattttgttcttgttcttgttcttgttcttgtttaggtgaattgggtgtgttcttgttcatgtgaattggtcggggtgaaagggagctgctcggctcgatgcattagctcggatgcattgagcctgctttttttttattcgtgaaaccttaaagatgctggttctaaaacataaaaaaccgacatctttacccatatagatgcttgttctaaaatcggcaccgatgaccaaagttatccgtatcgcctccatggtgctgtttggacaaataggcacctaagggggttcccaaacggcaccgattagctatcctagtgagagtgagtatttcatatatagatccaagggcatgacctattttatagcacaactcttttttttcaacgattatagtgaggtaattagtaatgaaaatttatgaactactttacagtctatatcattatactccctccgtttaatattataagtcgtttgttttttctcctcgtcaaacttcttttaagtttgaacaaatttttggaaaaatatagttgtattttcaacgcaaaacaaattattatcaaaatatattcaatgttagattaatgaaactaattcgatattttagatgttatttttttatatacttgttgaaacttaataaagtttgattatgacttataatatgaaatggagggtgtacaaaataaaaagatgaccgttcattcgtgtgaggtttcttcctactagttaattaaatgatggaagcaggttgggtgatataaatgtgcagttctctataattgaaacaaattgcaaatgcctcatatattaatggagcgaggaaattaatatatctttgtcgtcggaatgaaaagaatattggaaaattggtttgacatttaatggtctcatacaactagtgaagagaaccagtacaaacaaccaatctggaccagctgctgtgccatcgtatgcactgtctaaatgacttttcacacagcaaaagccatcaatatgtgtaccctcttccaaccggcgacgattagttggttcctattgttttctatgcacagtagacatattcatgttcgtcgcttgtgttgtgtgttccttcacggctgctccctttcatagacactattgctatgtagagatggggagaaatgaccatcacaatgaacacggtcaccgttaatcggtgatacgtcgctgtcaaggacgacggtcggaaggcacatggaatacctagctgttgttaactaatccctcgatctaaaaatatttgtcgccgttgacttttttttaaatgtttgaccgtttattttatttaaaaaatttaagtaattattaattcttttcctatcatttgattcattgttaaatatacttttatgtatatttaaaaatatatatgttttaaatatatattaaaaatatatatttttaatatatatttttaaaaatttttaaaaacggtcaaacatgcttaaaaatatcaacggcgtcaaacatctagagaaaaaggattacttattatatatgtggcgagaaactaaattgcaattcacactactacacaaatatatatgttttctgcatgaacacccctagtgacgctgatcctggctgtgcccgacgggtgttggtgtcgccgctgctggctccaccggcggcttggcctccagtgcagcgacctgagcctatggatgcaagcgcggcgggcaagtggatttttttagcaatagtgttttttatctcacttctaatttattttttcttctaaattatataatatcatgtgagaaataaactagtaagcgggtttttgtgcgggctgagccacgatacccccgacctcctcatggagcttctttatcccagcatccaagaatccaactttacatccccttgagcgaacccaggatgttgttgatgttgctggtgagatcaagcacccgttgattcgagctcaccgtctcttcctccaccgccaccattcttttttgagattcggcgccgatttaattattgcatgccattttctacaggatccgaactctctaatactaaattgtcacgaactcgcaacaatcacacggcgtcacaccaacgtgagcttgagatcacaagggattttggggatttggggaagaataacgttgtcacgagacacgcgcacacacagatcatgaaggaggtagttagttatgagttctcttcatttatgcctccctcactgataggtgggtccttcaatacaggcctgcacgccacatacgcaaatgcaaccgccagtccagcacgggactcttaccacatccacgtacacggcccacaacaggcccacacaaacacacaatgcagcccagcggcctagaacgctaatatcgctccatatctctacgactcatgatccgagctctttgttgttatcaactactcggccgccagtgcatggctgtcccccactcgagagagggatagatttggttggctctacgagggagtagtctgccgaggtttgcagaggtttttttttttttaagtaaagtatacgggcggtccttaaatttgtaggggtatatcatctaggtccataaactctcaaaatgtatatccaagtctcagaacttgtcatagtgtgtcatctaggtcccaaattgtcataaccccttcgggatcctacgtggcgttgatgtggcataccacatggacatgacgtggcatcattttgactgacaaatgggacccatttaaagtttttccattttctttttttcttctctttttttcctttcttctcctttatctgtaacccaagcagaagaatagaaaaaaagaatgagaagaaaaaaagaaacaaagaaaaaaaaaggacacgtcacatccatatggcatgccgtatcagcgccacctaggatcctagagggaatgtgtcgatttgggacctagatgatacactttgacaagttttaggacctggatatgcattttaagagtttagggacctatatgacacaaccctacaagtttaaggaccgccaatgcacctaactgttttttttttacctgatggtccacttattttgcttcgcggtagtggactggccattctgatgcttcagtggttcattttggtgccttcaattggaaaagaataaatgcttctaagttaggggtgtttagatctatgtgtgtaaagttttggcgtgtcacatcagatattatataggacgtctgttgaaattataagcacataatgatttaatttattcaataaataaatcatgacattgcagatgtaaactagactgaacgcatcattatatctacacatgtaaactaagcagtaaaacatgaatagatcaaatatgcgcaacacacgcgagcgaagaggaaggcgagccgtcgcggacgaacagggagcagtcgcgtgaagcgcttcccaaaaaccttattgccgctttctcccggtgcagtacgtagaaggcagaggttccggagacctgctttcccgatcgccggtgcacgccggcgagcgggatgaagtagtctacgagcgacggcgcagtatagtgtaggaggcaaaccctagattgatttcgtgcgtgttgcgtgaaggcggcggctcggtttatatagagataggtcgcctgatcagggcgcccgcgtaaaccgaaccggataagtcgcgcgtaaccaatctggactccacgccgttttcacgcaccggatttttcgaaatgtttccaaaacaaaacaaatccgaatttcccgtagcaaaaaaaaaactgcaaaaggaagctgcatctgcgcaagggtgaggagccaattttgcggaccattcgacgcgtacgtcgtgcacgcgcgctgcctgccctgcactgccaggccaggcgagcgagcgcgcgtgtttcccctcttctctccaccacgcatgtttcaaatggctaggagggcatcctcccttttaagaggtccccctctcctagaataagcaaggtggtactaaactccacatgcatgccatcccatgaggtgggcttttgtgattttccaaagaattaatcttcgaatgcaccttagcccatctattaattccaacaatcccccacaaaatcttaaaatcccactgagatttgccttttccaatgtactgtttatataccagcggttcgatggagtccgattaaggttgaacatccacctagaacgctaagctacacttactcacaacttgaacaatggactacgccttgaattgcaagtcttgcgcaagcaagtttcactcagagtcttatctggtactagaccctccgtagactacccctcgggtggagcgtataagtcatactcctaggtcttagtaagcttcttaaaagattcacccaaaatctccatagactgtgaccaacagtcaagcttacaaaggtgagttctttcaagaatactctgcaggacaacatcttcgctaattaaagccaacagaactcattaaggcatagccaacctgccttgcagctcacaagagtacatgcatcttcacttagagagggtatagattggtactctcctctagtttactaatagtgtgttcttcccaagttctaattcacgggatctccgatcacatagactgggttaccaccatagtataactcacatgggtctcaaacccatctccttcgatgcattgtctatcacatttcgtgatagtcccttcgtgaagggatctgccaggtttctagctgtttggatgtaatccaacgttataactccggagtttctcaatttcctgacagacttcaatcgtcttttcacatgtctagacgatttcatattatccttagaactattcactttgacaattaccgtttgattgtcacaattcataaggatagccggcaccggtttttctacaataggcagatccattaatagatcacgtagccattctgcctcaacagtagcagtatccagtgctgtcagttctgcttccatggttgacctcgtcaaaatggtctgtttgcaagacctccatgaaacagcaccaccacccagtgtgaagacatatccactagtggctttgatctcatccacgtcagagatctagttagaatcactataaccctccagtaccgcaggatacccagtatagtgaagccccgattccatagtacctttcagataacacattactcgctcaagcgcacgccagtgatcatcttccggattagtggtaaaccgactcaacttgctcacagcaaaggagatatcaggcctagttgcactagccaggtacatcagcgagccaatgatttgggagtattctagttgattcctagcaattttcttgttcttgcgaatcaacaagctaggatcataaggtgttggagaaggcttactatcaatgtagcaaaaacgattcaagatcttctccacataatgggactgcaagagcgtaatcccattctcacctctaattagcttaatgttttagataacatcagctactcccaaatccttcatatcaaaattttaagacaagaatgatttaacctcatttgtcacctaaggtttgtcccaaatatcagtatgtcaacaacatacaagcacagaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcatcatccagctctccattaagaaaagctgtcttaacgtccatttgatgaacgagaagaccatgtgaggctgctaggaaaagtagcacacgaattgtggtcaatctagcaacaggtgagtaagtttcaaagaaatcttcgccttctttctgaatatagcctttagcaacaagccgagccttgtacttttcaatagtaccgtcaggcctaagcttcttcttgaacacccacttgcaccccacaggtttacacccatatggtcgctcagtcacctcccaagtcccgttagcgataatggaatccatttcactacagacaacctccttctagttgtctgcatcaggagatgcatatgcttctgaaattgacttaggagtgtcatccacgaggtacacagtgaaatcatcaccaaaggacttagccgtcctttgtctcttactccttcgaggagcttcactgacatcctcctcagtgacatgttcatgtgtatgttcagtttgttctggtggtgtgattgaattgggaattacttcagagggttggctcgaactactatgtgtatccttcattgggaaaaagctctcaaagaaggtagcatcacgagactccataattgtaccaacatgcatgtcaggtacctcagatttaattattaaaaatctataggcaatgctatgatgagcatatcccagaaagacagtccacagtcttaggtcccagtttgcgcttcttcgttattggtacattgactttcgccaagcactcccatgtgcgcaaataagaaagtgatggttttctcccaatccatatctcatatggtgttctgtccttatttctattaggaactctgtttaacacatgattcgaggtcaacaatgcctccccccaccatgccttaggtagtcccgtggtgtccaacatggcattcaccaagtcagtcagtgtgcggttcttcctttcagcaatcccattagactcgagagaataggaaggcgtcctctcatgtatgatgccatgtttctcacagaataagtcaaactcgtttgagaaaaactctccaccacgatcagacctaagcctttttatctttctatcaagttgattttcaacttctgcattataaattttaaaatagtctagagcctcgtctttcgttttcaacaagtacacatagcaaaatctagtagcatcatcaatcagcgtcatgaaatatcattttccacccttcgtcaacaccccattcatttcacaaagatctgaatgtaggagttctagtggtgccaagtttctctcctcggcagccttgtgaggcttgcgagattgcttcgattgcatacaactatggcacttagaacctttgacaatggaaaacttaggaattaaatacatgctggaaaaccgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagacatgactactttattagactcaaaaaccaacttaaatctgtctctattcagacgggagccactaacaagattcctgtcgatagaagggacatgctgcacgttctttcccgaagtaaacttcagatctaccgtgccaacaccatggacagaagcatgtgacccattccccattaggacagtggaaccccgtgcgacctgataagaagaaaacaatgagatgtcagcacaaacatgtacattggccccagtatcaacccaccaattagtagactgattaactgaaaaaacagttggtaaattaccatacccgcttccatctccagtgttgccaatggtcgcattagcagacttagaagtctgccctacaggtgcctttatccccttacgctgtggacacttcctagccagatgaccaggttgcccacacaccaggttgagctttgtatttccccttgctcttgttctgggccttgtgcacaacattggcactggaccgcccaccatcgcccttagacgcggcgtctttttcccgagctttctcctcaacatcaagagacgctatcaacccctccacggagtattcctgtttcttgtgtttgagtgcagtaccgaaacttttccatgatggaggtactttcgcaataatgcaaccggccacaaatttgtcgggtaagacacatttaaggagttcgagttcattagccatggtttgtatctcatgagcctgttcgactacagaacggttgtcagccatcttgtagtcatgaaactgctccatgatatacagatcattgctagcaacggtagcaccgaatttagtattcagtgcatcccacaactccttagcgtcggtcatatgcatatacacctcgaccagacgatcgccaacaacgctaagaatgcatcccacaaagagagtagtggcttcctcgaattgcttctgctgatcaacagtaagaattccttcaggtttgccagtactcacccagaagcatttcatagccgtcaaccacagagtgaccctgatctgccatctcttaaagtgcacaccggtgaatttatccggcctcagtgcatcggcaaaaccagccatagtaaaatcacagcgccaacaataaggtttttggattgttgaaattataagcacataattatttaatttattccataaataaatcatgacattgcagatgtaaactagattgaacgcatcattagatccacacatgtaaactaagcagtaaaacatgaacagatcaaatatgcgcaacatgtcgaacatgtattgaggtggcggaaagaccggttgctcggcaggaactactcgcggttgctagcgtcgacgaaggcgcgaagcacgcgagcgaagaggaaggcgagccgtcgcggacgaacagggagcagtcgcgcgaagcgcttccctaaaaccttattgccgccttctcccggtgcaggacgtagaaggcagaggttccggagacctgctctcccgatcgccggtgcacgccggcgagcgggatgaagtagtctacgagcgaagacgcagtacagagtaggaggcaaatcctagattgatttcgcgtgtgttgcgtgaaggcgggggctcggtttatatagagataggtcgcctgatcagggcgcccgcgtaaaccgaactggataagtcgtgcgtaacctatccggactccacgccgttttcacgcaccggatttttcgaaatatttccaaaacaaaacaaatccgaacttcccgcagcaaaacaaaactgcaaaagaaggctgcatctacgcaagggtgaggagccaattttgcggaccattcgatgcgtacgtcgtgcacgtgcgccgcctgccctgccctgccaggccaggcgagcgagcgcgcatgtgtttcccctcttctctccaccacacatgcttcaagtggctaggtgggcatcctccctattaaggaggtccccctcttctagaataagcaaggtggtactaaaactccacatgcatgccatccca

SEQ ID NO: 63495 - DNA, 790 bp, Oryza sativa
taaattaataagtgcttgtccatcctttcatacattaaaattaaatgataggctaagtctctttaagagcagagatctaggtctttttaaaacagagtttttttagtaaggccttgtttagttttcaaaaatgtcacatcaaatctttagatacatgtatggatcattaaatatagataaaataaaaaactaattgcacagtttgtatgaaaatcgcaagatgaatcttttgagcttaattagtcaatgattagcgataagtgctacagtcacccatatatgctaatgatggattaattaggcttaataaattcgtttcgtggtttccaggcgagttatgaaattagttttgtcattcgtgtccgaaaacccttccaacatctggacaaacgtccgatgtgacacctaaaaaaatttcttttcatcaactaaacaaggccttgtattattcgtgatctcacgatgaagtcaggcacacgcgtgatcactacagtagtacacacaaatcgatcgatatcaatcacacactcatgaatcattttgtgtttgactcggaacgagcgatctatcactctctcaaactgtgctcttcctcactcttgacgatacaagtctaccggtttgctaattagcaacaaagtcaagaaaagacaccagaactcgtcaattacattgaacgttcctacctacgcgtaccaacacacaaatatgcctattgcctaaggtctaaatcttgaagataaatacatatgtgtacaacgtatgtatacttcatgggtaccgagctcga

SEQ ID NO: 63496 - DNA, 3082 bp, Oryza sativa
cgccgctatcctctctctctctgtcgctgacaggtgggacccacctgtcaggttcatcttcctcgcgccgccgccgccgcccgaaaccctagcgctgcgccgccgccgccgctttccaaattcggtcgctcctttccttctccggccgaatcgattgaggggaaacaatctccgcgatccactctatcttttctcttatggaatcgtcgtctttttcgctttggaagttcgtggattcgaggtcgaatcggatcggtctctttcctccgaaccccgatctttccttctcgccgccggtcgccgtgggcctccgtcgccgctcgctagcacctttaaaacgacccccgagctctcctctacccgccgccaccctcgcctttgtctctcgccgtcggaagagccctagcgccatggatctagcgccaccgtcgtcgccgtcgctccagccgtgcgccgccgccgttccggtcatcgccgtcgctcgggaagaccgccatcgtggtcgccaagtcgccgccgtcctcgtccgccccttcgccgccgccgaagactgccggagcaccgtcgccgtcgtcgacccgatctccgccgccgcttcttcctcgtcgccggcgccgtccgttgcccttccgccgttgttttggtcaccagtgagttcgccgcgtcgccctctacccgttggtgtcctccgtttgcgtcgtcgcgccgtcgttcgccggcgagcatgcgttgccgagccgccgccggtgctgacgtcatcgctgacgtagccgctgacgtcatcgttgccgtttcccgtgagccggtcgtggaccgttcgatctcggccatccgttttggataagatcgatctcggccgttcgtttccgtgaaccgccgccgtgcacccggtccaccgcaaaccctagccgctgacgcaataatcctccttttccttttcaaaaataattcattattgcgtcataattcaattaaaatccatataagtgttttaatccgatttaatctttgaaaattcataactaattcattgtaactcagtttaatgtggttcaagttgcaaaaattatataaaataaagatctacatattaaaattgtccataaattgaattaaatttatttaatcctttttaaatgggctttaaatagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacaccgatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgagctatatatattggttcagctagatattagatatgattgcttagccatgcttagaaacagtagcacactattgggataacttatgactaactattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtggacaacggctttaccttttgtatagcatgattcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgtggtggtactgaggcacatggtgacatgttgtggggctgtgtcttgtgggtacagtggtacacctctggccagagtaaaactattcgaatagccgtgcccgcggttatgggcgggttgaacaatgtttttcgtgattagtctcacacctctcacaataattatagatgctatacctggtaataatttgcttagctcctggtttggagattagatctgtacagccgggtatggttgcttcagaatggttgggcctgtgcagcatgggcgtgttgttcagtgttgattaaaattaatgattaaagtactctactgttttacttgtcttaaatgttttgctaaatgctgtttttgcaaatgagcctatattatgccaacctttggtatccttgtgcacttgcatatttgctgtgtggcttgttgagtatgtcatatgctcattcttgcaataatcaatcaacctcagttgaagaaaaaggatccagaaggagaagacgtctggcttataccccagttgagttgcctgtgggagtggagccggagcttcgctagattttattttccgctgcagttttcttcatggtggggactaagtgcctcttaagtaaatacttatcgttttagttaatttgatgaatctgtatattaaattgtcagtttgtgtacctcggctgattcctggacgaggattttatgcacaaataagttcggaaattactagtgaatttccgggcgtgacataggggctctgctggattgagttttttagcctcaacacccaaaatctgtttaggggctatatttagtgtccctgctggagatgctcttatgtaggctgacattgattgccccccataatcagttttggttgtgcactagacgatgcggaccggtatcgatgtggttcttaatttcttagagggggcgagtgcggataccagtgagggggaacctttccgatatgggtatgatccaaccgatactaattaggttgtgtacgttctgtaatactccatccgtttcagttt

SEQ ID NO: 63497 - DNA, 20994 bp, Oryza sativa
  unsure (1)..(20994): unsure at all n locations
tttttagtcccggttgtttataccaactgggagatctttagtcccggttgtttataccaaccgggagtaaaaataattggagtctgtcttgaaccccacgacttattgaaccgggattaaaaatgatctttagtcgcagttggtaacaccaaccaggactaaagaacaaaaagtacccctcaacttttaaaccgggactaaagatgtttttagtcccggtttttattagaaccgggactattgtagaatttggccgaccgaccaaaaatggtttctccaccagtgaataaccccttgagactattcataaaaagaatagtatatatgagccagctggaatgacagcttcatgacaaccagcaccgtaaaattaaggacttcctttcgaagaaataatgctatattaattcttactcatgtacatgcatacgataaaactgcaaagtattttctcctccctctacacagcagcaagtgtggtttgagcaatttttttgtatttaaatatttttcatccttttagaatgcacaatatgatgtgcatctctgtttacatgagcttgtttcttagtagtcgactactctggctatatatgcttctgccttgcgcccatcgttttttcatttttaaaacagcctaaccccgattaacaagaaataccacactaattaattggtagcttaattttcttttctttttttgaactaatatacttgtcttgatttctatatatatcagcctatagatagctcgagtttgatcgaatgtttgatcaatttgtcctagctagtctatgattgaacttggactcggtccatctgggtccaaacgaaatgtttaatatgtgaaataattgacggatcaaacaactaaaaagtccttgcttgagcgtgagcacgatatgttgggtcaaacaagtaattaagaaactagttatgagatgggattaattaggatataaataggttggcctagctagtcaagtgtacataatttcaactgaataatactacctccgttttttaatagatgacaccattgactttttctcacatgtttgacccttcgtcttattcaaaaaatttatgtaattataatttattttgttatgagttgttttatcattcatagtactttaaatgtgatttatatcttacacatttgcataaaatttttgaataagacgaatggtcaaacatgtaagaaaaagtcaacggcgtcatttattaaaaaacggagggagtattacaagtggagcctatgatggaattagtcgtgccacatgcccggatatccatgcatctcttcaacatgtatagacgactggctatataaaaccatctctatacctttaactaattatcactaaagggttcaaaattaactacctaccattaatttatgtccacaattaattaatatcctctttaaaaatggacgtagtagtaaactagtaattaataatatttgctagtaattcatatacagtatgtacaaagagggtaacatgtgatcatcaactgctataattttattcatatcatatctatcaccaatgaagatcatatgcatagatacgtacacctcctcgatcacgcaactagatcgagaacaacacagacaacagtacggatctgtgagatcctaccgataatatatacagtatatatgtctccttgttgcaagctcatatcgaggcatgggcgtgtactttctagctaacaattcatcagtctaattaattaagttttgcatagaatcaaaactactagttgcacttcttcctagaaaaaaacatgtgcataatctaattataataagctgttagtatagtatatacgtacaccgactcactaagtcagtatgattattttatcggagaatgcattcattccccgatgtggtcgataacgctgttataccgtatgagctactccgattaatatcgtttgtacgtaaatatatgtataaccctttttaaagatattctgtgaaatataaaaacatcgcatgattaaactgccataagctttgtatcggcttgcgttccacttcgacggacgacagtacaaatttcctcgaacatttttttctttatagataatagacaagtttctcattaatatctcataatctttttaagaactctcttgatggttgtagtggtgtgcacatatactatatggttgtgaagtcacctgcccaagtttgagtatcatcttctttaattaaggtattaggggccggggataatccttttcatcatttttttaactactccatccgtcccaaaatataagcatttttgtctatgaatctggacacacagtgtgtccagattcataaccaaaaatgcttatattttgagacagaggtactaattaagctagctattggtgccaagcgcttatataccggcctgcgttcgagtccgcttggatgacacaatttttcaaatttttttatattgatagataagtttctctttaatatcttataagttttctaagagctctcgatgcggttatagtggtgggcatatatggtttgtgaagtcacccgcccaagttcgagtctcaccttctttaattaacacatatgcgggaaaagggaatccctcccaccattttttaaggattaattaattataaattgttgcttactcctccatcccttagtagcgtcatatatagccgatgctctataatattatttgtcggattactcccgtataatgcttcgcctcgtctagtatgtagtaaataatagctactaatctcttttctttatctgaaaaaatggaaaacattcaaacaactgcatatgcgcacgtggcatataaaacaccaccaatacccccaactattccttcaatcctttaacaaataattaacatgagtactaaataatactagcacacacggttttgtctaaggtcatacagtaatacatcttattcgtaagaaaaataagcgaagagtacgaaagaagtattactacattaattatatattatgaagaaagtaagtgattcatgacgtattacttgtacataattaaaaatatatatagctggctggccggtatgtttcttttgtagtcgtcgaaatatgttccacaagttctgattaccatttaattagcaaagtacgtacgtacatgcagtttcaatcgacgctatacgtatacgaaagctgctaagctagctgggtcaaaccatatacacgtacgcccgtacgtaggcagagctagctcaattgttcaatggtcgccggctaattattgaactagctagcattcgcttgtagcaactgaaaagcatgaaataatagcagattaatatcgagtggggcatataaataaatataagtatatccatacgtgtactcttcccgggctgcaagctgcaacctccagaaatgatagataggcacagctcatgttgatcttttacccccttcaattcgtctgactataggcaactatctggcttttatatatataatataaaatgacgtcgtccacgaatgatcgatatatcttgatgtaatacgaatatagtatatgagatcgacgtgtacatacattgatttaattaatcgtagatattacatcaacatgcaaatcttttacgtgttcctaaaaactaatcaattgcatatatgactatatatacagtataatgatatcgatatgtacatatatacatcgatttaattgcagatattatatctagtataatataatggacatatttataagcacataaatttccttattaatatccatcgcgatcgcttttcttgaactagtacttatgtacccgcctacattttcgagaattcgaagttagctgaaagagaaacgtaaccatataatactacacatgcgtacggtgataggttataatttctgaatgtacgtatgtaatttattacttagctacagttcgacacacaagtaagtctcgaagaagaaatataattaaacatacgcacgtacttactcccaattaatctccaatgatatactactccatatgcatatatatcacgcagatgcaaaaataactataattaattaattagctagcctccctgccctcccatatattttgtgtggcttaaaaaaaaaagccaaacttttttgtagacaaaacgtacaggatcttgcatggtgcatctgtccccggccggccgggcaggcgggccaaagctacagatatatcacaagagaatctccaaccaagaaatccacatagcaaaaaggagggaagcacgcactcacgctcacatgcaacaaagaaagaaagagaaagagagacaaacaaagacgagatcacagggggaaaaggcatcaagagctggtgaaacatatatacgtactcctttttatcgattcagtacaaaaatatactaatgttttaatagaaaatacacatattattaaaatatatttaaagttaaatttaataaaattaatttggtattataaactttgctattttttataattttaatcagaataaaaataaaaaaaaatcaaacaacttataaaatgagtaccaagctagctatccaagtcggatccttgtcgccatccacaagtagtagtagatcgcctgaccgacagcttggtaacggggcccgcatgtgtatgtagactaccatcaactctctggcaccacaacgtacagatcaggacgtacgtacgactcatgttattggtacatgcacacagtaaatagtttatatttaggctgtgtttaattcaacgcaaagtttggattntgattgaaaataaagatgatgtgactgaaaaggtgtgtgtatgacaggttgatgtgatggaaaatgactaaagtttgcatataaactttagatctaatcacagccttagtgacattaaaatctttgccacgtgtataaatctcaaagcgaatctgatatagtagggtgtagaaaacaagcggataaggaaggaagatttacttgccgtcaaatataattaagaaaaaaacgtgagcacttcggagagtcgaacgcgggtcggtagggtgaaaccacgtgcctttgcataccttagtttgagtaacaaacgtggttaatcgagtcaatcatcttgtttgaaggtgcaaatcacataaaacttgtgtgttgtgttggagcgtttttgctatatgttacgtacacgcttcttattttttttcacaaatatgaaaacacgatccataaatatgtcaatggtgcaatacaaatactatatgcaggaaatcaaaaatacaaactgcaaagttttgaacagggaaacaaattaaagtgagtggcagtggtcaatcatggaatagaggcccatttggggatggtgttaaagtgaaccacaaaattttgatggtctacaattgaacatgccgatagtaggtggtagacaattaatatagatttatccaaattgatacgcacccattatttaatccttttcttccatgccggccgtaagaaccttccatttagatatatgttcattttcattcttataaaccagaaagttctaaatagcaattatattgagattttttacaacctgtgattcccagatgtgatgaataattaatattggtttggctatacgtacatatgtgtatttcccctttttgtggaccacattgcttattgttgtcattgaagttttgacatatctcctttgaagttagaatatgcgagaaaaatacaaattttatctttaaccattgcagccaaattcatacaatatgcaatttcatgtatggtgttgatctttaatttgtccatgtcatatcaaggttattgtccatatgaaatatatatgtgcattgtagcactttaagagcaacgtgcgcacacatattttgtgctcttccttaattaatgcttctcagcatgaaattatatatgttactacatcattatctaggaaattgttccatttgcttcctaattagagtaagttagttttattataccctcatccttagtttcgattatgtgaaaacacaacattgagctaattaatctctctatactagaaacgtattactagtacaaagttaattcgttattatatcggtttgaatttctagtaaagttgactatagggtaaaaccccaggatgacaccgtgtgcttatatttcccgcattctatatttgcaggtcttgccactcaccgaagctcaattactttacgttattcatatacgcgagataaagtagatgttgatttgttgccaagatgagcagtgacggatctagaaaataattttcttgagccaagtaaattggctaaattattagattaataagtattattttatcaaaaatagaaaatggatgttggagaatagtgtgtgtagctttggccttaggctgatggcatcaagcgttggtgtgagtacgtgaatctttgacttgaattgcttacatggccaatgtagcctctactaaaataggcaaattaagggcctatttggtacaacttcaactcctagatttagcttcagaagttaggtatggagtggagttgtggagctacctaaacccagttctataggcatttaatggtaatccattggctaatacgttcggtggagctcatgcatttgcccatggtggttggccctttgctccgccattggcactagcacagatcctcagacctcatagcgtgttgtaacaggctatccgtgacgggtgaaagcgaaccgttacaaatgataatcttgagtcgtcataaatagacatgtccatgatagtaggggaaagtgatgaggtcgacgcactactacaaaacatcaaatagatgtcgccactataggtgccggtggtgctaaaaccggcacctataggacttttcccaccttcacgggttgaaatcataaaaaaccggtacctttaagtaatcataggtgtcggttctaaatattttttaaaaatggcatctttaatatattataggtgtcggtttttatagaaaaccggcacctatgtaaatcgagccgagccggcgtcgaatgagccgaccggtgcgccccaccacgacgagacgagcatcggataaggtttgatcacctcgctccctcttctctctctctcccttctctcttgtctcactctcttctctctcccctgcgctgccggcggctggctggtggaggtggcagtggcgaccgcgccctcccctccgccagatccggtaggaggggaggcggcggcggcaagtggcttggctcacgggcggcagcagcggcgacctcccctccgccagatccgacgggaggggaggtagtggcggagccctcccctccgccagatctagcggggagtaggcagcggcaacgacggcggcgggctccccacgggcgtcgatgagtacccccaaccgtgtccttcgcttgcagctgcctgattcaaatgtttgattcagtgattcaatgatgtttgatgtgagatgaatgttgccaatttttttttgtgaaatgaatgctgcctgattcaaatgtttgattcagtgatttattttgtgagatgaatgttgccaaaaaaaaattttcttacggatgtgggaggagggactgctcggctcgatgcgtcggcttgatcgagccgatgcatggagccggttttttttattcgtcgaacctaaaaggtgccggttaattctaaggaaccagcacctttttgattttcaatcagtgccacctcccttgtgccggttggaaaaaccggcaccaaagggggtttcccaaccagcacagaaacccttttctcccttttctgtagaagtgtacggtgaaattggtggtgcttctttaattaatggacaagctagacattgaaatgctgcctagaaaggttgaatcatgaggtcatcagcgaaacaacggagtgtttctgtacaagcatataatagtaagcgttttgtattggtcggcatatatcatgatcattaaaatttgtcaacagaattcaatattgtggtccatcgctaaccgacaaatgcatgcagtgcaatgactttaatgtgtgacatagtactagtagtgtttatttccatctcctgtaggagtaaaataaacaaacttttaaaagatactactcacaatattagagtaagttcaatagtataatagtatagctcactactagctccaatttatctatagccgatctaatagccaattcatacaatagttgtttactatactattaacatatggtcccacctatcatacacacattacgtcttggagtccgtactgcagctggctataaatctatagtctgctgctcttctctctcatcttttacctcattaaaatatgtttatagctggctaatagcccgctattgtacctgctcttaacgcactagacactaactattattagaaataaccccaaaatatcaacatatatatgtgcgtgtgtgacgtggaatcataaatgtactccattactttaaaataatatatagatatggaactgtattagtcggttcaagtcagtgctagcaatttacatggaactttactttctttttctcattgaaacaagaaaccaaacaacacgagatttcagtatagtcgacatgcatatgactctagacacgctcacactttttttaaagaaaaaaataacaccaagttcgtctctagcggtccactttttttccctcatccaacgtaaaaaagaactaagtaacacaccaaaattttccctcatccaacgtaaaaaagaaccaagtaacacaccaaaatacaacaattagatgtgatttccatgcaatcgtataaacacatatattaattgttcctctatcatccaaagaaaaagttatacactggtattacgccccccctcttcattatcattttgttatattaggagatgtctcactgttgttgcatggacatagtgaaaccgacttaggggtagggggacgatgacttaggcgtatgttcatgcgtgtaaaggagaggaagagacactcaccatacctgccatgtgcactcaccaattcgaacccatccccaccaccgtcacgtgatgccaccatgcatcctcctgaccaactgcacccatcacgccatgtcaccccgtcccacctatattaaaaaaaggtttcccacaaaaggcggtagcgtgccttctcctttcccactagtctgtctagcaaacggtgactcacaagactgggtgggatgactagtacctaagtcaactgcccaacaaaaggtcagacgggcttagctggtcaaccaactttgttggctcgtatgcattatgtgggggtactcatgcctcagtaatgttgtgtcacatggattactcttttagtttgcaagaaaactcgtcggctttagaatattggatctgtaacaagtaactattattgtgatccattaataaagatatgatgaagtcagttagtccaatatgcatagcatgtttttgcccattatggtgtattttagtgttgaaagtacctcatgataccatcattggtagtatgtgacacatttgatatttccggtagcttttaatttccatcccccactatggaagtaaaaataagccatattccaaaaaatactaacatatttaattaaattttgatattacccacatgaattctaagcatgcacgtccttgcaaattcgatctatatattatatagaaaaagtgtgtgttacattttttaaaatattgtgaaatatcaatagtatagtgaatccatccttctaaatagattcataggaactaacacaaaagttgttgtatcactattgttctatgcatgccaacaaacattcatcaaggaataacgtattcatatgctgcagaatttaccacaaagttacctaattttagcggtagaaatagtactaactattattagaaaatactcaaaaatatcaacagatcggtgacatggagtcataaatatactccattactctacaataggtgaaactgtcaatactcaagtaagtgctatcaatttacatgtaactttacggttgtcttctcgctaaaacaagaaatgaatagcatgagatgtgcttgctggcgtggtggcaggagcgtgtggtttcagcctagtcaacacacgtacaactccagacatgtccacagtttagtataatctatttaacgtcaagtttctctcctgtggtccaactttttttggggttcgacgaaagagacgaaccaaacaacacacaccaaaatacaaacaaaaagatgtgattacttcacgtaattgtacaagtatattgtctctctatcacccgaagaaattaaaaagtgtatgtttcataaaaaaaaaaagaaaagggatataccgatatcactcactcatctttttgttgtattactataggtgacgtatcgctgttgttgagtggacgtagtgaaaccgactgagtagggggatgcggatgcaagcgtaagttcgtgcgtgagaagggataagagattcatctgttatgtgtgctgaccagttcaaaccacaccacatatgcagccatgggatgccaccatgaatcctcccaactgatggcgccgatcacgccacgtcactctgtcttgtctttataaaaaaaattccccaaaaaggtctaggctagtgcgtaaccttctcccaccggctgtccagcaaatagtgactcacgagcctgggtggggtgactagtacctgtaagttcaagtgccttaatttggttttggtgattaatgacaaatctaattatatgagactaacgtttttatgagcctttctttgactagtctcatttggatatgaaaataaaaatgatgagaggtatgtattaaatttcacatattctaacttggtctctcttgtggatccaaaatatagtgtgagctccctcattgatcttgattgattatgtgcatatgtgttcctttatatccatatgtatgtacacttgagggggagcttattctatattttgtttattataagatttctatcttgatttgaaatcatctttcatctcatctctctatattgtttatatcgggttattatccatcaccaaagagagaaaagattgaaagatcttggattaaacaatttgtgtaattgttactttggtgatagatggtaaaccgatgtttatgggattaacctctcttttgcataagttgtctactaggttttttcccgataatgagatgtggaagacttgcattcttttgtgatggaccttaatcatgacaaggatgaaatgcatggagataaaatgatatgtaccacttcttatctcctactttttgataggtttatatatatgatttccatgttattgatatataagtgtgagactaatgtttacttgagtcttatcttatttagtctcatttacattgagaacatggagatcatgaaggtatatgttttatattggtctacatcattactacatatgccttctctatgtgtataggataaacccccattggtcattctctaattatgcatacacttacatctcttgtatatttatttgtatgcatatatttagggggagcaaatcctatacatttattgtgcatgttccagatccatgttgttcacctattatttatatcggatctttgcacttgagtttgcatacgagtatatgacacttgtgatgttaatgaaaactcaacaaacatatccatatctttcatatgcaaccggttggtcatcaagtgaaggatgacaaccgatttgttgagactattgttctcctttgagatgtgaaaaggaataggtcccactatgatgaggctaatggatgacaccatgggttaatggtcaccaagccaaggacatcgccatgttggcaagaatgaaatcaagcttgtgatgagaagaaagtcttgacaaatgatggtaaataccttggtataaacatggttgaatcaaattgtcacaagtgttgatctcgactcaagcttgaccccaagttggatgcgcaaggcaaaggtataatggagctaagaatgttttcttagtcttttcccggtcttgatgtttggtgtagaccggattagctagataggcgtcgtactatcaagaggggtctatgaagcgagcttgtggatgatcttgcgccatattagttcatatgcatgtaggtgtattttgtgggcttgtctagccaagtgtggtgagttttctcaagtcctaaacaaagagagatgtgggcaaatcctataggtttgggtagcctcatgtggttatgtccggtggagtattctttggagtgtgagccctttctcccagagaaaagttgtgtttcttggatagattgttcatgggttggatagccctttgaataagctttccatagagtctaagaacgccaaattccgagacccgagtcaagagatatcgccgttttactaacggtcggttgagctgaaaagtgacttgcggtctgatcgtgggccttaggccagtctgaccgggcctgttagccagtctgaccagcgtggtaaggccggtctgaccggccccactggtctgttgcactggtctggtttttggtggcgatacagagccgccagagccgcaaccggtcagaccgagccgtggacggtctgaccggccactacactgcggtcagaccgaccaggttgagtgggctcaatgattgccctgtaacggctagttttctagccgttacaaagtagtccggtctgaccggcctcacaacggcggtctgaccggcaaagcacagagttagggatttcggttcgaacggctagttttggtggttgggggtatatatacccactccccagcagcaagggtaaggttttggcactccattgcattatcttgaacccttgcaagagctctcatacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtgtaggtgttgcctggtgacctctccgaggagattgtggaggaggcccggcgccgtttgtgagtggtttagagttcaccaccttcagagtgaaggaagaactaccccaagtgatcgaggcttgggtagtcctctccgtgggccggctcccgccttgcccaccccttgacgaagggggcgtgcggtggcttcgtggttgagcggtggagttgggctcgcctcaacggggattaggaaatcggcgagtttccgaacctcggtgaaaaattccttgtctcttgtctcttgtctcatttatttgttgcatttacatttgtgctatttacattcatagagacatatttgagcccatatcacctaggtttgcaaaacttaacttagttgcttagttaaccttgcaccttaccttgcctagcaacttaggttagttttgtttaagtgccattaagttttaaaaccgcctatttaccctcctctagtcggcccccttgatcttacagtacctgagttagtggcccaacaacaacaaaaggacaaaggggcctgcctagttagctagctctgcagactcctacgcattatgtaggggttattcatgtctcactaatttcgtgccacgcgtcaagtactcttttgatttgcaagaatactcactggctttagaatactagatttataacaagtaactattattgtactcctgtttttaaagatttggtgaaacttaattagtccaatatgcatggcatgtttttgtctattatggtgtatttttgtgtttaaagtgattcatgataccatcattgttaatgtgtggcacattttcggtagcttttttccatcccccgttatggaagtaaaaataataaaaaaaaaaccaacatactttattaactcctgatatcactcacagaaaaagcatgcttgtatctcctcgaaaattcaatatatatataaaagtgtgttacattttttaatatattgtaaaatatcgaattgctctcttaaataacaatagtagtgactagtgaatccatccaacttatattcataggaaataacatgaagttgttgtatcactatttcttttatacacgccaatacaaacatttatcaaggaacaatatattcatgtgctgcagaactttatcacataagttacctaattttagctaaagaaatagcgctaaccattattataaaattaccaaaaaaaacatatctataacgcggagtcataaatgtactctattattctagaacatgtgaaacagtcggtatccaagacagtgctaccgatttacatggaactttacattcttcttcttgttaaaacatgtggcaaatagcacgagatgtgtgcataagcctgccaatggatcaaaacccgcaccattcccagtccaaaccatgacaaccagttaaagtagcctaaaccaatccagtccacaaatcaacttttagaacccaaaccaatccaacccattttctacctcagtccaaaccaaaccaatccattcccctcatatggattcaatccacctttccaaaccactcaaacccatttcaatccattgaccaccaacaaggatgctgacctcgacgaaccaatcgtcttcctcgcgcggcgtaggctaatccatggcgccacaattacctccaagcagaactccatggcgccatcgtcaccgacggcaacagcaacctgccgacgcagaagaggcggagcagaaggcagctgcggtggctgggccgtcggtgcggcagtgaccgctggtcgcgccgctcgtacaggagctccgcctccttccacgcccccccgtgcacacgccatcgccctcacctcgccatcacatgtgcttgccctagattgcgcgtcttgccggtgagccacggcagcgaggaaagcatcggcaagcacggcacgggcgatggacgggaacgtctcgccggcgagccacggcagcgaggaaagcatcggcaagcacagcggcggtgcatcgagcgatttgtggatgtggtgttgacttggctgtcgagaagaagaggaattggggattgacgatgcacggcaaccattttgggttgtgcccattctgccatccaatagaaatccatggattgaacccatttccagtctagaaaaacggtgaccaaatccaaaccacaccaacccacattttcttccacccaaaccgccccagcccatttatatcttcagcccattacaaaccatccaaacacaatccaagaggaaatccaatccaataaacccattcccacccaatccactggcaggcttaggtgtgcatgtaggagcagtcacaacgcatggtttcagccaagcatacacgcttattactccagacgcgtttacactttagtttaagctatttaatgccaagtttctctgcagtggtccatcttttcttttctccggtccgccgagaaaaagaaccaaacaccacaacaacaacaacaaaaaacaacaaaaagacgtgattacttcacgcaatcgtgcaggcatttcgtctcctcgtcgtccaaaggaaaaaggtacacgctgatatcatccctaatatctctttttgttgtgttatcataggaggaaggagacgtctcgcttgtcgttgtgtggacgtagcgaaaccgacttgggacttagggaggagggtagtacactgtatgttcatgcgtgtgaagatcgacacacgcacacactcgtacacacctgccgtgtgtgcccacctcctcccttgaccgacagcgtggatctcgccatgtcaccctccgtccctgcctcgactaaaaaatactcctcccgttccaaaatataagccacaaccaccattaacacatagaccaagaaacaattattatcatcttcttgtttggatcaccctaataaatataatgcatgcatccaataaaattagaaatcttgagtgtgtaggatttaaaaaataaaaatataatggagaagaggttctaattaattgtatacatgcattcatatattatattatagaacatttagaaaaagtagctacgtggacggacgtaggaaaaaagtcgcccctcagtttagccgctgtccgtcactaacacgtcgctgtcagcaggactaaatgggggtgtggaggtgggcccatgccccccggcacgacaccgaggcgagcggggcggttaaaaaaataaaaggcgattagaagagcgggaagtgggtaagataattctatcctggcgataagaatatcttaattaccttctaaatcggtgtgccctttaaatactacccaccactaggcttctctccccttctacttctctctgccccccctctctctcctccccctcaatcgcggcgcgggtagattcgcggcggccggagcggagcggagcgcatccatggcggtcgtcgccggtttctccatcaggttggtggaggcgactgcttgcctagctccctcggctggtttggttttgttgtgtttttctgatttggtggggggattttttgtgtgaagggagtacacggcgagcatgaggggagcggcgggggcggaggggaggaggctgtacggcctcggcgctggggatctgccgccgatggaggcgaggaggttccggtggtgggcggacgagctggccgcggcgccgccccttcctccccggtcgccgtccccgtccccgtccccgccgccgccgccgccgacgaagccgtcgaggaggacgctggggaaggcgagggcgccgaagaagcggtccatatcggatctgttcgcggcggcgcctcccctcgcgcttccctcctccgattcgggcggcggcgggaacgacgatgacgacgacgacgaggcgctctgcgcgatcatgcggcgagctagggagaagaagcggaagcggaggctgcaggaggaggcggcgggggctgcttctgctccggtggcggcggcggcggcggcggcggagacgcgtgattccgagggaaacttcaccagaaaggtgcgtggtccagcccaagcccagcccagcccaacccctccctttcctggcaatgccatgatgattatcgcctgtcacttgtggtctcgttccagtagcatgttcccccgctgattattccagtaggttcctgacgcgcgcgtacgcgccgcgagcggaagtcgcgcgcacctgccgacgcgtacgctgcgcccccgtcgctttaaccatatgaatagcactagtgatgacgcgattagtgattagtgctaattataattagtacctacaagaacttttatttatgacatctgtctcgtgccaagtccattcatcactacatatattatcaaccatttctaactggtcttcaatcttcaataacatatatataggtgattatatttggcttgcgctcgggtacacgatgattgctttgcttggttgcgggtacaacaccatgatttgttggtcgaggctagctagctgtacgggttatatctgtgcgccaagagtgataaactaaagctggcttgatcattgtgcttttctttcttggtacgcataattacattgctggctggttggctagctagtcaatagtcatgcatatatatgcgtgagtgactgtttgggattcgtcggtattgttatttcatgctgtattttttgacggtaaatggatggaccggttgttccggagtcgtgcctagtgctgcgcgcgtgcgggacatcgacctagtattgttcccgtaggattcgtgcatgcatggcgctgatgatgagagatagtttaattaattaattgctgggataagcatttatgcagtgagtgaaaaatagaatattgagcagttaataatgcatggccagccggctaattatatactaattaattaccactagtaggcagtaaataactgtactggaagcagactagctgctggtactatatgttgcattttgatctgtcgcgttgccttttcgcgcatcgatcaaaccggtagtggtagtaacactggttgcctgcggcaggtagctaagtttgctactgtgtgaattgtgagttgcatactttgtgtgtgtccagccgggcacatatttccgggtccggccggacggacccattacaagagagaggacgtggagcaggcaattatactagatcgagattttctgcgttattctctttggttcttcatcatggcctgcatgtgtggtgtttcatttgatagttttttccttttggtctaggaaaaataaattttgcccaattgtgtgtgtatgtaggctgtgtttagatccaaagtttgcatccaaacatccaacttttcccatcacatcaacctgtcatacacacacaaactttcaatcacatcgttccaattttcaaccaaacttccaacttcaccttgaactaaacacagccgtagtgtgtgtggtatgtgtgcagattgctggtcagtaaaatgtgtctagtccacgtagtacacaccgtcaaaggatatgctttggttgtggtggtagttatcgctgtcagcctgtcaccgtatgctcgatatgatggtctacactgttcgtacgtgctctgtgttggggagggccagggagcattaattccgattattagctagttgaccagacaaaagggatagtagtagtgtaaggattttaagtttattccctgtgtgggtattattttaagtagagtatataatgatcaaaatatagttgggcacctgttccatttgttatgtttttttacttgcaagtacacatgtaagacatgcaagagagtctcattgtgtgctaaatcccttgaagattaattccacaactaattcatggaatcttactatgaaattcatatatccccacaagtgtttttttttggcattcatcagataattatcttactttgacaaaagtgtgatcttaattaagagtttgacttatattgtttgttttaaattagctattgccttttcgaagttctatggatatgcatccgacacatttctgttctataatttacacaatctaatttccgttctgtagtttacacaatctaatttttcctttgtgtcattttcacaacctggctatttatatgcatgtggtaatctgactgttttatattattgtgtttaccttttatttgtattccacattatccactgatgttgctcaattatgcaggaagcacatgacaagacaaatttgcctggtggattggatactcctcaagcgtcaaggagacctgatggtgtacaccatgcaagaacagacgaggaaaggtctccagactcaaagagaaggaagaaggtaaagatcactaacttagataagaacaacaacaagaagattgataagaaaaggtacagcgagagtaaaagggctaccaataaggtggggaaacagcatgacctgaagaaaatgctccctttgcatagtattctgaagaaatacacaaagcacacatccgtcaaaatggtcaaggagaaacatggcgacccaaaaggcacagaagtcattgaagtctgccgcaaatcagtgaagcgtgtaaaattctcagaagttaatgatgtgcttggtattaacaagcaaaatatctgcaagctgttctcggatgctttggcgtcatcgtcgtcatcatccacggacatgtccagtgaaggggacaagcacatagctgcagaaagctgtagttctcatatgccggagacagcaactaaagaagcaagcaagagtacagatcatgaggattctcttgagctcaccagcacacagttgtcctccaatttgtttgatctgaatgaggcactgccagaatctactgatttgaactacccatatgtgtcaaatccagaggagccaaatcatgagcctagacagcatgagcctttagactctgatgtgcaagttattgacgaaggaggacaaaaccagcaggatctgtctttggattcacatggacttcaatgtcagtccgttcctgagtctgggttagaaagagctagaagttcaatatcgccaggcacatttttgcacggtgagttcatggaagtgtctgacacattttttgttggttcttcacggaagttgacagaacttgctgagtctcatggtgattgtagtagtggttcggttaaagatgctatgacaaaggggaagtcaccttgtgcattgcccaatcatacagttcaggactcatttcagcagcaccagaggtattatgccttcaatctgaatcttggaggcagtcagccctccaatgaaggggaagttcctccccaagactgtaatgcatctgccggagcggcttcaagttctcatgctgaaatgggtgtgcagcaggggtgtaggcctgctccaggacaaactgtgcgtctaatgggcaaagatcttgcagtatctacaaccagaggagagtatgtgtctgggacacattcctatactgaagaccatcccacaaagttgttcttggaattgccgcgacaaggacggccttatctctctttacaagctcaaagtgtgcccaatgtttcagcaaattctgcaagcccaagtcaatcacatatcaggtacactgccccacagaatttgagccactcattccccatggccaatgcattatctggagatcgattgcaatacgacgatcggttcagctacttgtcaggctcacagcaccatggaaatgttctgctggggagtccatcacttacaagtcatggcagtgcagcgctccgtcagaatttgccgtatgtttggagccgttactctgatccttcttcatccagtactgcatcaccctcagcaccaattttgcctacgacggcacagcatgtgacaccatcttcagtttatcatgctaatttgcctcggtcatatggtgtggtctcagctggatcgtcggttcacccccacaactctc

SEQ ID NO: 63498 - DNA, 15163 bp, Oryza sativa
atcatagatcgattgtacatctcagatctatgcaatgaatcataaattgtaatagaagaaattatacatctctcaaatcacaaattaaaaaaaagggccggcagcatgtcacgggtgccgcgcgctgccccgccggccgccgccgacgtgcgccgccgcgtcgcgcgcagcccctgccgcctgccgccgcgcgggtcgcggccccgccgcccgccgacgccggccctcggatgtgaggagtagaggggaggaggagaaagggaaggagggggaagagaggagatgaagtagctagatctctgatctgggagataggaggagaatatgaggtgggagataggaggagaatatgaggaggaagctggtctgggacttaaccgattagacgtggaagagaaatatttactcccagttggagtttttaaccaggactaaagatagatctttagtcccggttgatggttggtgtaaagatcctcggccttagtgttaccaaccggcactaaagtggtaatctttagtaccaaccgggactaaagatcctcggcctcccgacatgcctctgacaggccacgaaccggggctaccaaccgggactaaagatcaaaatttttataaccgggacaaaaaacaatctttagtcccggttctttttggatccgggactattgtggaatttgtcagaccgatcaaagatggtttctccaccagttttaaggctcagaagattcgtctcgcaaattagtctcaatctgtgcaattagttattttttagactatatttaatacttcatacaagtgttaaaactttgatgtgacaaggctggtgtaaaatttttgtgtgggatctaaacatggcctttcttccaaagttggttgtttgctttaaaggtagacggcatgctctctgttggtcctttaattggccggtttgcatttgtgctggctgatgtgtactgctcaaggtaatagttatatcctagtttggcctccgcaagctaatggaataatttactacttttgaaaataataacttttgcatattctgttgaatttttgttaaccctttattttgacgacatggctgaccattcattctttcaatatcgaatggattcttctttgaacaccatgaatgctctctgtcaaggaatttagcatggatgcaatgacaaggctgccgcaatacatcccattcccagctggcaaatttctctagaggagattggttggttacacctggtcataattatgccttcaagcatacatcattagtgtcactagagtcagcttaggggcttagggaagtgttatggtagatgtgactaccacatccaaatttatctattttattcactcataaggtaagaggtaactcatacaatgtatcacctgtagttcacaaatatcaatatatctaatactctcacacctttcttcttgaaaattgtgtggaggttgcctcttgatttaagggtggctcatcatctctctcctcacttctctcctccacctcatcactcaatccaatgtggcatttttagaggcaatatatggggcattatagtacttgcccttaaatatgatggcccatgattaaaaattatggtgtgattccctagttgatacggaggcttatatattattatgtactagaaaaaagcccgtgcgttataacgggaagtgtaaatacagaaaattgaggaaaaaataagaaagatttacattatgtatttttaagtaggtaggtgtataattaaattagtttacaagtaaagtagtgtgagaaataaaatggtatggttggatttagttttattaaattctacatgattaattacgctctttggaattttattagaattttctgagcttaattgttaattttgataatacaaatattattttagcaattatttaaataaaaatcatcctttctctctgggccattttcagcccattttattcttcagcccgcaaccgagccagaccactttcctctcttctcctcccctccacctcagtccgcaagaaagagttcggcccaacaggaagtctaatatgctccccgtactcctcctctccctaccgtgcgtggcccagcaattgtgcggctcggcgaggaggatggcccgacgcggatcgatttgtgccattcgtttcgatggacggcaaacgaacggctcagatcggttccgaattgatcaaaaccgacggggcaaaaaaaatccctaaacctaaatcattttcccctccccctcctctcaccgtaggccgcctttctctcccccaccggcggcgtccctcctctcccccccaccagcaatgcccctcctcccaccgcgagctgcccctcccccaccgcggcgccccttccctctccccatcggcggcgccgctcccactcactctccacccccactatcggctccttccctcctcgtcggggtgccgccactgcctcgctccttgccagatccggcgagtccccctccctctccccccactgtcggctcattccctcctcgtcgggtgctgccgccgccttcctcctcgccagatatggcgagtcggcggctccacggcgcagcgtcgggctcgccgctcgccagatccggcgagtcggcggctccccgcacaacggtggttcgtggttccctggcttcatatatagcggcgcagcggcgggtcggcggaggaggaggttgagaagcggcggcctcccatttgccccttcatctcctctatctcttcatattttggatgattttgtgagaatttcgatttggatttgaattgcgattttgtttttggttggattgtgattgtgatgatgtaggatgtggagaggagataatattgaatcgggctttttttttcggccttctttacggtttttctacaaattgaattggattatctttctttttgttttgatgttttttcctttttttcgttattacagacgacggaaacgttttcaattttctaagtagtagagactagaacatatcgatccaaatgtgttatgataaactcaatacagtatcaacaatcaacgtgctctggtgagcgaaaaacataagcaagctaatgggaattcagcttcaacggcactcgtagtcgagagtcgctccactacactagcaaagtcatccataattcccgccgagaacccaaaatgctgcactattgctggctcgaacaccgctcttaccattgcagctattgtgtttggactcgccaacactccatctgtggcaaggaaagtatcgtgggccatcgccttgttgatttgaaatgagccctcatcttcaattatcccatttaattcattttccataggtgcatagataggtatgtggaatgtgtcgaacttctctttgctaatcacaccctacagcaagttaaaaccattttcagtaaacctggaaatgagccttgattacaattattaattaactgccatgttacgtaaacaaattgcgcccaagtaaacacaaaaataaaaactgtgatattgcaaaagaaatattaacgaagtttttgtacatatctacttattatatagacctgagcatgcatggacaggccaggccccaagaatataatgtgcagattgatttgcatcaaaatttactacggatcggacaagcttgctgtgttaaacttttttgctgggcgagacaggactcaatcttctgttgggttcgggcttggccctgagttaatcatgtgcataatggtgctgttcaagcttgccatgtacgtgcatgtgtctcatccagggaaattgtcgattttttttcatatatatgtgaatttggtcatactttattcaaattcagtaaacatgtattaaaattttaaaaaaaaactcgttcagaatatctgaaattttcgaaatttcaatgcccaccgaaattttctcgctttccgaaaagaaaaactctggtctcatctaaactggataaaactaaacaaagcataaaccatgtaggatacagagattaattaattgattgaaaagctaaagcttacgctgcttaccctcgatgccatgtcattcaaggctacagataccactttccatacttgagtagacacggaggccgggttgcttgaacatctaccgatcagcgagaaaatcaaccgacctccgagaaccagttctcgagccctcaaggacaagaatagcgtgaaatcctttctaaactgtcgagcataagcgtcggcaacaatttcatggttcaacagcctcaagcgctcgtcgctatcatacattgggatttttctcttggcaagttcttcaggtgcctgctttcacaaacgcacattgatagtaacagctgccccattattccatatggctgcatatatacaattaactcaacctaatgttgcatgcctacctttgataaccattgcaagctgatggaggagcagaagaaatgcactgagtcagaagtgaaaagcctctcatagaatgacccaggtaccatgttggcgacgacgacgtgatgagaggacacatcctggctgtgcttgaattcggccagactcttcgcaacggagttgaagtcattggatggaagatcgttgaggaaaaggcacatttctggtggtggctgcgcgcattccatacaataacggtggatggcatcgaccgtagatgaaatgagcgtgagtgcgttcgggccagatgagcagcccaagtccgcaattgccatgctcttgggaacagatactccgcagaaggctgtgacggcttcctctatgagaggcttcatcctatcttgggcagttttctacaagtattattcgttctgaggtcacttttgatttttgactgaagggtgcatgtaaatgccatagaaatataatcagctgtgatgataaccaagggttgaaatttcggttcaattttggaaattttggaccccctccccggcaagtaactatctcggctgaaattttcgttttttacaaaaattcttatgaatttggtcaaaatttattcaaatggagtaaaaatttgtaatgttgtcaaataatttcgaaattcaggatacttcggtgatttccattttccaaaagtgaaaaccgtgatcagaaccaaattaatcaattaaggtgcagacaattgccatttcacaatgttcgtagatactcaaaactgccacctgggaggggaattccctgggcatcgtgcggaaagttttggatatttgatttattgttatttctagcaaacaaaattgttttcaagaatagctttaggtatgctatgatcattgagctatggttcatagcggtttaaaaaccattggtgaaaaatagactacaaaattaattaagttctaaaatttaaattttggtgataagctaacaacgagtacacgataagaggttacagttattcctaagcaatcatcaaaagagggttggaaacaaaagcgcaaaatattagcaactgcttttaaaatactttctacttcctccgtttcacaatgtaagtcattctagcatttcccacatccatattgatgttaatgaatttggacatatatatctatctagattcattaacatcaatatgaatgtggaaaatgatagaatgatttatattgtgaaacggagggagtagcagatgtctttgttttttttagcatatttaatcaactgacatcaacttatttattaaatatgatatacttgaaacctacaaaaatgataagaacaggaatcaaggatttcaatcttttttcaattatatgataaccaaccttgatcatttcatgaagatcagaagtacaagtacaattcaattatgatgtcctcctcaaaggcatgtgtaactcagaaatcagtcaacactcatatgaccagcaaatcaaacgaagtatattgcaaagaagtacacatatacctgaattgtagagttgcgagcatagcttgtttcgccttgccctggattcatatggacaatttgtatggtggccatggcacactgtttcaatatctgattgtgcttgctatgatatgaaggctgagcatactggctatgtatttatagccttacaaatgccctctatggactatggtcattgtagttggactggaaatgttgaaatgctgacatttgtgatatctgaactataaaataataatttaattaatcaccattactacctacagatacgtttcttttaaatttgtaaaatatgcaataattaacactacaccatgacccacttttgccaacacgccattatgtaggggaaacgcagaattaacaatagagcatgtgttgggaaaggctttgccgacagataatggcatagtcggcgttgcagcagtcggcgaagcctttgccaacagataaaacctttgccaacacatgttgtgtaggcgctttgactagcttttgccaacacagacttttaccgacacacataatatcctgaaatggtagagcctttgccaacacattccattttcaccaactgatagttcgttggagaaagtgtaattagcctgtaaatataatccacagtttcacataaacctgccattccgtgtttcacataatttctacagtttgacaagcacattcagatgcaatcatgttcgcaagcatgaatactaacatatccaagtcctaagcattttactaactttttagcttcatggtaatttttaggaagtgatgtccttgccggaaaagcatacttaagtagatctagatgcaaatcaaaacttttatcactccatccaccaagaaatttgatatggagtaatctaacaatgaagcgaagctttgagaagtctttacaccctggacatagctcctgcccagcatcatctaccaacttgtaaaaatccccaatatcaacattacgctgcccctcattgttctcttctaaatctcccatctcatccaacccacatgctagatcttgaagaaaaccagaaatatcatcctcttcatttgacttctctagttctaccctgtgatccccatcgtcatgcataaaagtactttcttttccatgaaacaaccatgttctgtacaattgcatgaaaccatcacaaatcaagtgctcccgaacagtagtacgttctgtccaataactattaccacagtttttgcaagggcataatattgagttcccctttgatgaattagcaaaagcaaattctagaaacctggttactccttccacatatccatctgtatgcctacatgcaattagttactataattttagagacaatactaacacaaactattaactaatgattccaactgagagtttgtggtgtatctaggtagatccatccattgtttatccatgttgcacctttacaaaataaaaacatcacaaaactaattcatatctaaggacgcaaacatgaaacttatttttatttagaagggattatagttttcaattagggcaaccacacatcatatcacaagccattagtgaagcatgaatcaacaaattaaaaggtcaagcacaagaagatacataatagttaaatttggtttcatgcaaacaaagaaatcataccgataattgaagaagtagaccagcacaaggatcccgtccaccaaagcacagagttgttggatcaattcattgtcttctcaacctaaacaagacatagcagcatgcatgcctcagttatttcacctctgttgattatagatattgacatacgctgaaattttaaagcagctttattccagaaaacaataaaaagattcctataaggagcatgtgcagcttttcacccaaatgcaattatatggtgattctagaaattttgaaatatatcatgctgtttattaattgatggctgatttatctactattaaactaacctaattgacagaattgctatagttcttatgcttcgtgatacattaaatctgtgcttgagttccggtacaaattcctaagtccatgactaagtctagattttgattttaattatctatatgtcaagaatatcagtatttgtatggacaaggaactgcagttactaaatttggtaaagacataagactatacataccctactttttcttgctttataacttgagatcttgtttacttgtagtaacattttagtaacagatgcatatctatgctatccagatttctatgatcaaagctaggttcttgcaacagtaaccccatgcatgtacttaaccctgattttgtctactagtccttcaaaaaagagtgtgtttcatgggtcaaacttgcagtcagctagtatctcatagtaggacttaatcgatgaaatatttatttccccagtgttcttacagatctaggggggtccagggtgagggaggaggagcagaaactaccttcccagcagagtttggggaaaatgtggagatggtcgctgaggcgccgtttggggaggaaggagagtgttctcaaggggaggagaactggtgtggaggacgagccttggggactttgaggtcgatgtgtgcggcggcaacgagatcgagaggaggtggcgatggggccaaggatgcgacgagatacggtggtggcggcggatttgggagaagggaggaggagatatatagggtttaggagcagaaaaggttgggtggtacacttcaattttatttattttttttgttttggctccgcaccccctattcctcccgcgctcgtacttcaattttttttttccttcggaagtcctcccgcgtactctaattttttttcaattcctccgcgcgcaaaggaagatatatgcatctttgccgatactagcggctacatgtgttgccaatgaatcaccgacagattatttgtctacaaaaattggaatcgccgacacataatatgttggcattgctacatagctagatttgactacaaattatgtgttgtgtaatctaccttttgttcccaacacaagttagttggtaaaagtgggtcatggtgtagtgtaatctatcttattataactagtatttctactcaagatgtttttcgcatttattgttttcattatgagtaaatttcaaaacaaataccgatacttccatgaaaccataaacaaactacaaatttgatcgaactgcggatttagtgttgaacatatcacaaagctaaatatcaatctgaagtaccatctgatcaaaaattatatgtaatatatcctagtggaactttcagttccatataatttggtgataaaattgcttgtacatctgtaattttgcagttgatggcttgttgttttgcaagtattttcatgtacgaatctaaaggtatcactgtacatgcataatacaaaatatttatgttggcttaattattagttaaaatttaaaaataattttgaattttctattacatgcaagtcctatatttttgtaaggaagcagtgtgttattaaaacgtggcaggtcaactattgttattttttggacctgccacgtgagacaaaataagagtcaatggacaaaagcgccagaactgagaagcagcaacatagatacattgttggggcgacaaaagaatttgactagcattatcgatggttgacagtcacaaactttggattgtagaagcaaatgtgttcaaatgagtctcatgcatgccgcctagctagtcgtcgatcgctccatagccgccaggcgccggccagcccgccactttattgctccatagccgccccttgttttctcacattgttctttaagcttcttaacacgcataaccaccgtttaaaattactttaggggtaacatgactggcattataaaatttaaggaattggatcactgctggagaaaccatctttcgtcggtcggccgaattccacaatagtcccggatgcaataaaaaccggggctaaagatgatctttagtcccggttcaaaagggtaacgggcatatttgatctttagtcccggttggtaacagatgatctttagtcccagttcaaatgctgtcagggcatgtcaggccccccccgggatctttagtcccggtaactttagtcccggttggtaataccaaccgggactaaagatcccggggatctttagccccggttggttaccaaccaggactaaagtcccacccctatatatatatcttcttcctcctctagctgctcgagcaagcttcaaaatttcttcaaaaaagaggggaggtcatgccaaaatttatagtgaatttattttggtgattacatacaaatcggaggtgcctaaaaggtttgcaacttcatcctccaatattttttttgtcatattacatttgcagctatgttttgcacacttttttatctccaaaatttagttgtaagttgatgagagagaaaatttgtgtggggaagaaagaatatatagaaatttagttcatttgctaaagaaggttttataaaatagttgagaaggaaaactctagtgaaagttaatcttaaataatagaaaacaaactaaaatgaaaattaaaagaagtaaaacacattaaaattagtttaaaactttagaaatagtaaataagaattatttgatgtaatattttatgatttttgtatgaataaagatatgtcattattgtatgactgttgaaacagtttgtaattatgttataattattgtatgactgtcattattgtaagaataattatttgtgtacggtttttttcgactcatgtagatggatcggccttggatgtatgctgaccggcggtccaaagagtttattgacggcgtgcactattttttgagagtggccgaagctaataggcaaaggggttttatttgttgtccatgcaataagtgtaagaatcagaaggagtattctgcatccaggactattcatttacacttgtttgagtcggggttcatgccaagctataattgttggacatcccacggagagcaaggtgttgaaatggaagaagatgaattggaagatgacaatattccggactttactcagtatgttggatttgaaggaaatcaaacgggcgaggaggaaatagctgctgatggtaacgacgttgcggatgatcttggtcagatgctgcaggacgccaaggaggactgcgaaagtgaaaaggaggcccataaattggataagatgttggaggaccacagaacttcgttgtacccaggttgcgagcaggggcacaaaaagttggataccactctggagttcttgcaatggaaagcaaaaaatggggttagtgacaaggcatttggcgatttattgaaactcgtcaagaatattcttccggagggaaacaaattgcccgagacaacgtacgaggctaagaagatagtctgcccgctaggactggaagttcataagattcacgcatgtccgaatgattgtatcctatatcgcggtgaggagtatgagaacctagaagcatgccctgtttgcaaagcactacgatacaagattagatgagacgatccaggagaagttgacgggcagctaataaagaagagaattcctgctaaggtgatgtggtatttccctataataccacggctaaggcgtttgttcaggaacaaggggaatgctagaatgatgcgatggcacgctgaagagcgtcaacaggacgggatgttgagacaccccgccgatggttcgcagtggcgaaacatcgacagaaaatttaaagaatttggaaaggatgcacgaaacatacggtttggtttgagtacgaatggcatgaatcctttaggagagatgagcagcggccatagcacttggcccattacgatgtgtatctacaacctcccccctggctatacatgaagaggaagtacataatgatgccgattattattcaaggccccaagcaacctggtaacgacatcgatgtgtacctaagaccactggtcgaagatcttaaactgttgtggaagaaggaaggtgtccccgtgtgggacgaggacaaacaggaggagtttaacctacgagcgctgctgttcgtaaccatcaacgattggcctgcacttagcaacctatccggacagtccaacaaggggcacaaggtttgcactcactgtatggatgaaacagaaagtacgtatcttaagcactgtaggaaggttgtatacatgggtcatcgtcgattccttgcagcaaaccacccggtacggaagaaaggcaagcacttcgaacataaggggccgaccaccatacaaagcctaaacatcgcagcaggaaaacagtgtttgctatggttaaagatcttaaagtagtgttcggaaaggggcctggaagccagcctatagagagcaaagatggtcacgcggcgatgtggaaaaagaactttatattttgggagttaccatattgggaattcttggacgtacgccacgcaatcgacgtgatgcacctcactaagaacctttgcgtaaacattcttggcttcctaggtgtatacggaaagtcgaaagatacactggaagcacgtaatgatctgaagcatatggaacaacgcggcgaccttcacccagaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctactttgtcaccttgtgaaaaagatcagtattctcgggcctgtgtacctacacaacatgttttctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcagtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgataccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgacgagcctaagcgtcaagtggttctcccaggcaaaagaaaaatcgtcggagttgaggacaagactgacgaggattacgatcagttggatgggcaacccccttttacggtgacgattgaccctagcatcctcctatcaaatgaagacaccccttactcacgtagcgatcacaaggagggaacaatagtgatgagaaagtacgtgcggtcaaccgtcaccgccgatgtattaccgtaattattgtgtacacgatgtaaactattttggatgtattgattatccatataaatcaattgatgtatggcatatgttaattacgtacgattattagaggttttaacaagtttaaatcatgtatatgctagttaaatcatgcatgtggcatttacatatgttaattagagttttcacaatttaatttactatcattcatatgctaattatatatgactattcgaatttttaaaagttttaaatcatgcatgtggcatttacatatgttaattagagtttttaacatttaatttaatataattcctatgctaagtatatatgatgattacaatttttattaattttaaatcatgccgtatgtacatacatatgttaattagagtttttaccaatttaataatatcattcatatgctaagtatatatgattattgaaatttttattaatttaagtcatatatttgcttattacgatttatccacttaatttataacagacaaaaatattttttcgaaataattgtcattaatctttgtactttaaataattgtaatgcattatcttctattttagaaacacatatgtaagggaaaataatattcagtgctataatcagtagtcccggttcttaaccctaactgggtttaaaaagaatttggaaatagtgggaaaagatctttagtcccggttgatgagaacaatcgagagtaaagatatctttagtcccggttgttctcatcaaccgggactaaaaatccaggggtatatatattcccggtgcgccctcgtcttctccaccaacacttagatgttttcggccgatcgatctctctcgcctctctccttcgccgccactgcctagggcatccccgcgccgacgccgccatatctcgccgtcgtctcgagctcgtcgtcctcgccgccgcgtccgcctcctccgctgccgccgcatctctggggtgagagccgccgccgcctccctccatctctctctccgccgcctccctccatctcactctctccgactccctccatctctctctccgccgccgtcttcgccgacgcgcaacgctcgcggcgacccgccacgccgccaccttcgccgccgcgcaacgcc

SEQ ID NO: 63499 - DNA, 5240 bp, Oryza sativa
cgcatgtaaatatgcatgcatgcatgcatgcatcgcctaatggccatctaaccctataattaaatcatacggagtataatacttcctgatagttattaatatttaatttctcgatgtccattatagccaatcttgtatgaaagaatgaagagttgcacattaaatctgagaaaatcattaagaagataggtggttggatttaaatatgtctatcataaataaatttttcagatttaaaaatatgtctatcaaaactagatggagagagtatacagcactattgttactactagctagcagtgcaagcagtgcccaactatggcatggtttatttctcaactttttctttacacacataaactttcaacttttccgtcacatcgtttcaatttcaatcaaactttcaattttaacataaactaaacacaccctatatatacaggactggactaaggtagcttgctagttggcagcgttggaaacgccgaataaccagtgatgaagccactgctactgctcatctcctccattgtagtgatgacattcttactcctcctgagcggcgccggcgctctcaccgccgatcacgccaccgtcggcgtcgccgtggccggcggcaagcgcacccgccacgcggaggaactaagtgagatggattcggtgccgtacccgcaaagaagggtgctacaaggtggcaacactgtctacagaccgcttggcagaggtgcggcttgcaaccctatttgccctggtcgcggagacaggtacactggccgtggctgcaaatcccgttaccagtgcaggggcatgtaagatatctccatcagggtgcatgataatatcttcacaccctatgtacgcatgcatgcttggaaattattgggcagttcagcagttgttctatgtacatcgatggagtaggttgaacactcagttgatctcgtcttttttcagtattgttacggtattccaggcatataaacactcatgatcactggtcatctccatgctgaatttgtctgtatcgcaacctaaacatgttcacgtacgatttcataggatgccggtcgtcgtccggccagacgcaaatggctcagcattgatctgctgttgcatgcttcattattgtattcctgttcttttccctactgttagttactcatctcattgaatgagtgatcctgtggtacttgcaaaatcaagtgttcaattttggtacacacggcacggcgctgtgtgagccggtttggtgagagccggcgagatgggagtcggctcccgattggacggcgaaagcggtgggcgatggctgtggcgacacgcagccgaggtcgtggcgcggcgtcgagtggcggcgacgggaacagcgggcggcagcagtgaatcggtgagtgatggcggcggagcagcggcggccgcggattggctatggcggcggcggcttaggcttagggggcggcacggggtgcccccggtttgcagcggtggcggcgcggtgtttgcgtggcggcagcgggtggcacgggcggcgcagctgggcggcggcgcgtcggattgggcgaggcggccacgcccatggtggcggcggcggcacaatgccgtggtgcgcccacagaggaggagaattaggcggctcgactgggcttcggctcggctgggccgggcgcagcccaagatagagtagaggtggaaggaaaaggaggaaaaagaaaggaaagaaggaatcggcctaatgaaggatttttggtccaaaggaataggaaacatgagaattttgtgtggaagaatttggaatagaattcaaaggaaatgaaaactaaaggatagattgttgtggattttttaaatttggacaaggaattcaaatagaattcaaaggaaattgatctaaaggaagaggttggtggactttttaactttggacaagaaatttgaataggattcaaaggaattgaaaactaggggaatttttgaatggaaggtttgaaatagattttaatggagataaaatttaaaagaggaatgtttggtatcttttgaactttataaaaagaatttaaatataaagttttgaaagcaaaaaggagtttaaaatatttttaaaataatatcaaagatattatttttgagatataaattttaaaaaggataaaaataaagatgctccaattttaaaagaattcaataaggatcaacatgctccaatagaattcaataagaaccaaatacaaaacttgtcacaaagattttctttaatattttaaaaaaatcaaagggaaagaaaggcaataatttaatttctaactttggataaatttttgggatggtggtaaaatggatggaggtaaaataaataggattttaacctccattatatgtggtatggattcttggtggaatatttgtggctaaaggaagttggattttgaatagaagggattagaaataagtttcttagcacaagagcaatcactcaattatttgtgatagtatagttcttgtgccgaggaggaaatcaagccgtaggaatcaaattggtggcttgattaaaataggaacttgaacacataatattttggatcgattaaaagaagacaaaggttttagagggtaggtttagataggggttgatccaaattaaattccaacggaaagggagttatactggtttaaccccaaagataaaaatggttaatgggatataacaaagagtcgggtcaatcagggaattattggcccaagttaaatggtagtctttgaaatcttgaatggataatttagatgaacgagatttcaaaggggaaatacttgtgggagtatagaactggattcagaaatatatgtggatggggatttttataggaacggaattagtggtagattggtaaacttctgaaggataggtatattgacttagagggatattgaaaaggatatctcatggactatgggaatatttaggtggagatccaaagggaaggttttggttatggggaaattaagaattggtatttcatgtgtttgggtagagatcaaaggggaaatatttggtggaagataaaactggttttgctggttgtatggtaagctctaaatgaaaaaggtattaactctagagagattgatatttcatgtgctctagagatggttgagcggctctagagatggttgagcgggaatgaaaagggtatttgtggatgttggagatgttcggtaaaggagtcaaaggaaatataatctagagctaaagttagagattaaagaaaataaatacactacaagaaaaattagctattgccacgaaagtattaccacgaaaaataattggtggcaatatatcatactattgccacgataaaacttttcgtggcaaataagtatattctgttgcaacgatgtataatcgttgtaatatcttttattttcgttgcaacaaaaataagttatcaccacaaataaaatatcgttgcaataaaaactaagctatcaccacaaaaaaaatatcggtgcaacgtacaagccctattgccacgacttcgatttttgtggcaataagcacacaatatttgccacgactcagccgaacctcccaaaatttagcgcgaaatatttctgtgtttcgcggttttgggcgcgtgaaaagatcgattaactcccgaaaaagttagttcagttattagtactatttatcaatctaatctattccattcacacggctgggcagtgctcccgtgacttccaaagtctcacggaggagcagcgcctggtgatttcaccgcgacggtgccgccgtcaaccgcgtcacgaggaattcctccactccgttcagtgattcagctttcagccttcaggtatcctccgttttcatcccctcatcctcctcgaatacacaatttcttttttcacggtctagccaaatttcccaatccgtcggcgctcaccgccttctgtgccgcctcacttgcgccggcgaccggatgacgcctgcatcccctccaattcatcttcctcatcccgatctgatcctccagccctagttccacaagcaacatgccggagatgtgtgcgggagggatccaagcgaggtgcctggctagaggcgccacatccgccggggaagacgagggttcgctggggaagacgagggttcagtcaacgcatgagagagccactacaatggaaggatgcgagggtacacagggtcggcttcggccccggcgtcgacgaggaagcggagccggaggatgtcgcttgctgcagatggggggtcggccgcggcgccatcgatggaagttgcacgcagcgccgccgccgtcgatggaagccgagcgcagcgctgccgttgacggaagccgggtgtatcgtcggatgccgaatatgccgcgtcgcgccgctgccgccgccgccgctgggcgtagcactgcctccaccgccggacgccctatgccatcgccaccacactaccacgtaggccagggcacaaagctgccatccaatgggttgtggaggtaattaaattgagttattggagaagatagagagaaatcagactggaagacatgatttattttttttactactgctattgatttcccaggcataaattcatattatttttgtatacatatatagacgtatcccgtatccatgtttttcagaaaatgatgtatcctatccatatccgtatccctgtatctcggtaacatagagcaaaggatgttgcttgctgcagatggggtgacggccgcagcggcagcgacagtgagtagtttagaacttcagattagctatcttagtaggcaagcagagcaggcagggcgagcattgctagcgtagaatagctcagatgagttatgtttgtttctgaatttctgtctttgtttctgaatttctgtctcccacaaggttaccttggttatactgcacaatatccaaatttgctatacacggtctctcatatttattaatttcttcagtttgtccaatttcccatatgaattttgaaaaataagaaacaccttccatgggaataccaatatatctgttactgtccaatgtctatttttcagctcaaatcctcatgattttgtttagttctaatttatctgttcatatctttgtacaggaatattttttctggtcagcctacagagacaagttctggcaaggtgagtttatgttcacacagtttctccattttccttaagatcataaagtgccaaccatattttccttgtttt

SEQ ID NO: 63500 - DNA, 2821 bp, Oryza sativa
ggccaacaacttttcaaacggccatccgggcctagctgatcccatcgactgcagatttttcaaacaccgaacccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggttccagaccaacaacaggttatgtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgtttcccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacagaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctccgaaactatacgcaaaacgggacaactcaacaaacggcgaaaataaagccctattaatgacctctaagcgtgccattagatagatctcgagatttgagaaattttggaatttgaacggagtcaaacggatttacggtggggaagatattgaatttctaagattattggatttttggtctaaaggaaaaggatttaattaaatcctttttggaaaagaaaagaaaagaaaaagggagagggagggaatatagacttccctcgggcggctagggcgcggccagagagaaagggcggctcggccgagcttaacgggccggccggcccaagaaggtggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcgcgggcgggggagggacgtggtgcgcgtgcggttcgcggtggacgcggatgcggcgggcccacgcgcagcctcacggctcgcggtggaacgtgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacgggcaaaagctagcacaccgggcggttgttcgtgatgaggggagacgagccaacggctcggattcgccagagggagttcgacggcggcgaatcgcggcggcaacaaccggcggggagggaagagggaaacgccgacgaggtcacgagggaccgattcccggcggtgagagcatccacgcgaccacgggaatccgatgctagcgtcggattggacggagctacgccgagcgaggctggcgacgtgcgggtgctacggagctcgagcggcgacggcggcgagcacgcggcgagcgacggcgacggttggggcggcgccggctagctacggggagtctactcgagctactaccgaaagctagggggaggagatggggcgaggaggaagaacggagggaggcatcaccgagatgaggaggggcgctgtgacgagaggccgacggcgcgggagtaatctctccggcctcgggccggggaagaggaaggagagggcgcggccgaagtccccttccgcgtccttactcgtgccgactcctttgacacgcgcaacaacgaacgacgatggcgaacagagcacgggggcggcagctatggcgaggaggcgaaaacgagggagattggagggtaaggagctggggtttaaagggggcggcaatgtcggtttgggaaccgacttagggtggtcagggcgcgagctggcgctcggcggtcgcggccaaagcggcgacagggaggatgacgccggcgagggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcgggggccgggcggtgacgacggcgatgacggcgggcggtttggagtggcgcgacgacacgggcgacagacacgtgcagaggctgacggcggcggcgaccgggcggtcggccactcggcacgcactcgcggcttgcaacgggcggcgtccgcgcgggcgcgcgcacgcgaacacggcgtgcgggaagcggcagcgagggagcggagtgggaggacttggctcgg

SEQ ID NO: 63501 - DNA, 2010 bp, Oryza sativa
ataaaatagctctgcattttacatggtgactttctttactttaaatacgacttgtaactatatgtccatacatttgtacaggaggaacaatcaactctgttactgttgaatggctggagcaaaccacgacaaaatcaaacaagtgatggctagaaaagctagtttcgacaacaatgttacaaactcattagtttcagaacttttagttttatcagacaacttgtatttcagcatttggaaatttaacatactcatattgtcatcattactttgggtatctgaaatatattatgtcttattcgcggaaatatcagacatcataattcttgtgcgcatgagttgcaagggttttgccatttaacatatatttctactcatgttgcaatagtaccaaatgatccatccaattactgatgtaacacaatttcttttctataaaagctagaagaaattcatttcattgtaataatacttattgccacaaaaatattttagtggcaataacccatatgatatattgccacgattaatgctatgtggcaataacatatattagatattgcaacgaaactattttgtggcaagcacaactaatgccacgcacgaagtggtggcaataattatttgttgcaacgatgttaagtgttgcaatatgtttttttgccacgattattttgtggcattatcaaagtttgttgccactagataaaaattgttgcaataacctattgctactgtttctattgccacggctagcaacggttttaaaatggtggcaatatgtatctattgccacgattttagcattgttgccacgatttttttcgtagcaacaaatcattttcctagtagtgatagagaggtttacattttaaaagagagcgattaactttgcaaataaagtttaaatccaagttaaaagaaattaagagaaggcaacatcacttcaacagaagaatcgagaagagtgcaactaaaatattttgcaaaacattttccctgaaaatttgagtctgtcaatggtggagaaaccctttgtagtcccggtttataacccccctttagtcccggtttccaaaccgggagtaccaatccgggactaaagatcgctatctttatctttagtcccgggtgaaataaccggtactaaagatcgatcttaccaaccgggactaaagatcgagctgacctttttttttttgcatggccctgtgtacttatacatatatatgttatgcaaatgcatatgtatatatacaaacaaatttactatatatatatatatatatatgaccaaaatatatttacattatagaaaatgtgtacacatgcatatagaaacatatgtagtcatgtattaattacaatccattatatgtcctagatagctacgatttcgacgtagtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcgcacacgtaatagctgcacaagttagttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaatcgataccaagccctacatggagtttaaagctatgattcgtagtagcaattaacataacaagattttcttaattaacagaggaacttatgacggtacctgt

SEQ ID NO: 63502 - DNA, 16643 bp, Oryza sativa
tttgttcgggaagggaagggaagggaaggaggttagttggtggtggtggtgaggggatgtggcattgcccaagatattattgtcggtctgtctctccgcgggtgtccacggagggaggagctagtatacattctgactgcttcccggggagttttaaaatagagtaaactttacgaatagtgctccctccgtcctataatataatataagggtttttaagtttttactcataatatttaatcactcatcttatttaaaaaaaatttagaattattatttattttttatgatttaatttattatctaaagtactttaaacacaacttttcattttttatatttgcataattttttttaataagacgagtggtcaaacagtacatgaaaaactcaaaatcccttatattatgggacggagggagtactttacatatactcacccttccttaaatatttgacaccgttaactttttttagctcatgtttgactgttcgtcttattcaaaaatttttataaaatatgtaaaattatatgcatacataaatgtttttttttaaaaatgaatcaaatgataggaaaaagattaatattttttcttatttttttaataagacgaacggttaaacatatttaaaaaagtcaacggcatcaaatatttagggacaaaggaagtattactatacatatatatgatttgatcaaattatcgtaaaagttatatatttaaaaagaatatgaatcacaaaatctacatatatagtgtcttatggctgtgtgtcttatgacagaagccgaagatgtaatccatttccattatctaaaaaaaatctacagatatagtgtcgaatttattccagaacagatacagtatcaaatttatcataaaaagaaagaaaggtgctaattaattgctggattatgagatagaaaaatgtggagtctaaaattttaacaagaattttgatagtcttccggtccaaatagaatgtgttatatccatccaaaatctattatattttaggaggggaaagtggatatctgtatttttaatggttaaattggaaccataccattataattttgcaaagtttgagatatgtcatcggtatctcaatgacatttagaacccacatgagtcaatgacatgtgggtcaggatggcatatcttcaattttgcaaaattataatggcatggttccaattttcccatttttgaaatatatattttataatattttcaaataaaataaatacttaatcgttctaaaataaatcaattatgtataggatgtaacatattctgatatagtaataaatctgaatactgtgtgatagtattttaggttgatttattttgggagctgcgtactgtatggcggcacatgggggatgtggggcgcgtgggacttgaattgaccagacaaggatcggggaagcggtggatggatggagttttgaggagagttgagtttgggccgacgtctcgcactgcacgccgaggccaccgctttgacccctattctcgcccgcttcgcccgccgcctgccgctgctaaaaaaagcctgcgactgcgacactgactggacaaatcaccgtctcgcatacatgcacagtccttagcttcttagagcaagtttagaccatgtttagataggactaaaactttcaagttccctatcacatcggatgtttggacactaattataaatattaaacgtggactattaataaaatccatctataatcttggactaattcacgagactaatctattgagcttaattaatccatgattagcctatgtgatgctacagtaaacattctctaattatggattaattaggcttaaaaaatttgtcttgcaaattagctttcatttatataattagttttgtaagtagtctatatttaatactctaaattagtgtctaaatatagagactaaagttaagtccctggatccaaacaccaccttaatagtgtagccaactactagcttcaaatcatctatagccaatataataactaatttatacaatagttgcttactatactattaatacctggtcccacctgtcatacacacattacgtcttggagtccgtgttgcagctggctacatatctgtagcccgttgctcttctctctcttcctttatctctttaaaatatctttatagttggtttatagcctgctattgtacctgctcttaggcctttcttctaaactcgctttcaccacaccctccttctaccctacttcttccgtctcaaaatatatagttatttttagcacagtaccttattccaaaatgaagctatttttttacctaccacctcctttcaaccaatcacaaccattcttcttcacctgctttctcttttcaaccaatcacacactttctccaatcattctcatctactttcttaatactcgtgccaaccttaaaaatataggttttttactgtccttgaggttgtgcagtaccaaatcctgaccgttgatctggcatcatccaatggttagaaatcatccgtacctcatggtactgcacctcctcattgaagtggtactatgggtggaagggtatttctgtcctttactgtttcacgagagaaagaaaaaacgtcgggaaagcacagcagcagcgtggcggctggctcgagggggacagcggcgggcgcctggacgcgtgacagcggcggcgggctggacgacggcggcggtgggctggacagtggctgcggcggcggctggagggggctggacgcggcgggctcgagggggacggcggcggcggctggacgcgcggcggcgggggcagctggatgcatggcggcggcgggcggctggatgcgggacagcggcggctggatgcgcgacgccggcggccggctggatgcacgacggcggcggcagcctcgattggcgacgacgacgaccggctggatgggggacggcgacgacggcggcgacgacgacggcgggctggatgggcgacggcggcggccggcggccggctggatgcacgacggcggtggcggcctctattggcgacgacgatggcgggctggatgggcacgaacgacgaagagatgtttttttagtccgatcatacccctgctaaatcaacggttagattagattggtacctcatgatacctcgtagctcatggtacctcttaaaggatgggaaaaatgctcttaaaaatatcttcatttttgggcggaggaagtaatattaagtgacccttgacggaggtttgatatgtcaagtgacaagaaatatgctgccaccgagggcttactaagaaagtcaccacatcctcatgagtatctatcatcttcgttctaatctctccaaagcggaatggtttggagtgaattgtactagaaaattataatattaacaaatatgattgcatccttaagaatacgtacgaaggtagagtctgatataacacgtactcttagtttaaactatcacttagagactacttcattctcttatcttataacacagttgagacaataacgtctcttaatattatcaatgcaccataatattttttattactcttctttccttttcttcatctccatataattaattttttttaataaatatactaagagtcgactgtaagctgatgttataggtagccatgatgttcttcttttctcctctctttgatattattaaattaatttgtttatgtggcaacggagagagtccgctaataagctattgtgcatatccttaatgcaactaccaatagaatgttgtagttatacaaatagatacaatacattcactaggctagagagaaaaacgagaagtctaattatttctcttactataagagccccacaattaactgcatgtgcttcactatacttctcggaccattttttttatgtgaatgactatcaggctttacccaacagtataacttttatataaagaaaaaaaggaaagaacaaagacaattacaaatattgtaatcaatccaacactaattgaagtatagtggaaatacagccccctatcagcgaaaccatgggcgatcgacaaactgaacagcgggcgattactatatggtatacaatgatgtttagccaaacatgaaagaaagcagtgtctaccaccatcataaatgatgaactagctagctccggccatctctgccctgcaccaaccgcggccgtatcgatcacaggccatgcggctactgggtgcactgaaagcgatttctatccatatatctatcttacggatcttgcaactcgatagctaggagtagcagctgggggtgtgaccaccccactggttatccaaagttgcagataatggccggccatttaatttcagatgagttgcatccacaaacctattcagaaaatgcagtcacttttgtcctcttttcagttgtcatcgtcactcccgttagctggctatttagctcgggcaaaatgctgcttgttcatgcatgcaattgttcattcatcctagatatttttgtgtaagctagagcagatgatatggaactgatggattgatctagtcgctttttctttacacaagagataatgggatccaacgcttttcatggggatcgatgcggtgaacgtacttttaatcgccacacagaaataggaggacgcagatgataaaaggggttgtttacataaaaaaaaatttaaatttttgacgtgtcacatcacatcagatattctatagagtgtcgtatgaggtgttcgagtactaataaaaaaataattatataatccgtcagtaaaccgcgagacgaatttattaagcctaattaatccgtcattagcaaatgtttactgtagcaccacatcgttaaatcatggaacaattaggctcaaaagattcgtctcacaaattagtcacaaactatgcaattagttatattttagtttatatttgatacttctatatgttaaactttcgatgtgatatgatataaaattttaggtgggatctaaatatggcaaaaaaaaaaaaaagagaaagaactttctcgagcattcaactgggtacaaactggctttggtccgcagtccgcttgatttaattacttggttatacatggtataagttgatgatccatatttacccatgtattaattattttaattaattactccgtacaacttgtttagtggagtcactcttgtgacttaatcgtcgagggcgacaaacgcgtatgtttaagtcttcaagataggatattttgtccccaaaacaaagttgggtttgtaagctgctttggttacctaaaattttgcaacatttttgtcgcaatttttgttgttatatatgatttttctttattttatataagtttgaatatttatgcatgtaactttataaattttatatggactgtaagtttatttcatgtttaagttaaaataatttattgttcaatccgaaagaagtaacttttacagtggagcgatgagaagtattgtatattgtcattccatgaatgcaaaaagtgactgaaatatttaaaattttatggacccgaaatctttacatccctataaattaaaatgtctcccgtgacgtgagcaaaaaattcaatataaaacaactattacaacaaaagcatgcaactttatatatacatgtatttcctatacaatactccctttatttttaatatacgacattgttttatctcattaaaaaaatagtgcaaaaattggaagaaaaatataagtaatgcttaaagtaactttaatatgataaaacaagacacatcaaaataattgttttcaatgcaaagtgagtgtagcaacatatcatatgggtttaagtcttagacttgtatgagtactcataattaacgggtaattattccttcggtagcatacaacgtataagtgataataagacgatcacgatagtttcgttaatctcaagatatgccggccatgtttcttagatatgctcgtaaatatatcctaatataggatatgtatgtgtgcattaatatctaggaataagtagtataaatgtctacgttaacttatactccctctgtcccactaaggatgtcgttttagatattgtcagccaaattagagttaggtgaaaataaccatattgcccatgtttataggattgcagcaaatcatgtggagtcttgagagtagcacactgcaacaatcagttgtactgccacatctacttaaaaaagaatatttaaagcatgataaaattaattaatagctggtgcttgcagcagcggtacacattggtgccaactttatggattatagtaatccaatgggtcccatcaattacaaaacttcggctaatgttacttttctgtgttaatacagttgatgtgttaatactagttgatgggaaagttcagcgtcgagtattttgggacatttgctactgagcaaagcgacttcctttatgggacggagggagtaccatgtttctaaaaaaatagatattttaaacaaaactaatggttaaacattatatgttcaaaagtcaacaataacgtatgttttttctttaaaaaaagaaaatggtaagtaataaaaggaaaacgatacacatataaataaacaagtaataaataaatacatgcatgtagctgtgccttgtgtggtcctgacatgaaaaatatatactcctatatacacatgcaatgtaccggctggcaataagcccatacctgtagatatgtacagataaccggccggctatcgatcattatcgcatatatagccttcatcccgaagaatgtagagaaatcgatcgaccaaagtaaagatgcgggtgcgtttgttgacggtgtgtcttttataaaaattttctataataaagttgctttaaaaaaatcatattgatcatttttaaaatttaaaatagttaatacttaacttaatcatacgttaatggctaatctcattttacgtatattctcttctcctctcctctaaaggtttttttaaataaaactaaatatgttctaaaacgtcaaagccgttaaatatttagggacggaaaaaagtactatctagcaccataaataatatcctatccagatagatcgatcgagaacaccacgacgctgacgcaccgatcgggacttggggatatgcaccgtatgtcgtatacgtacgcaggcacccacgtatgccgacacgcgtggtgtacgtacaagctagcagagccgtctcgggtcgtcgtatgtgtacgtacggaggaatccttgtacgttcccacgagctatataggggtatctatttatgggctgttgggtctctgaagaagagtgggcctatcaatgtatttttgggccttgatggccatggattgaagcatccaattgggcctaggtccaacagtagaaaatgcccatgcaagcgtgcgtccggttagcccctggacagccgccctggctcacgggtgaaaactccatcaaatttcgatattgatgagcaacttgatggcgaaatttccataacaaatactgtactagttatattgaagtttgctagagctctaaaatttttttggctccgttcactggccatgatgtgtgtgcgcgcgttccagtgatagtcggggcggatctacagtacaatgaccggtatcgggtgacaccgacgactttcggcaaaacctatagcaaaactgtttatccatatgttatcataccatgatttaaacataattagcatattatgacaccgatagacacattatgacactaacgaatcagttttttttggatccgagagagtccatacctcgaaaagttgttttgacgtttttttccattaaaattttaggtttgatcaattttataaaaatgtttcaacggcatctcattaaatatattttaataatatatttattttgtgtttgaaatgatgctacaattttctattgattttttactagaggaaaagtcaacgtgacttataatatatatgaaataaagggaatagtatttgtgttattactactccatctatcccaagaaaaagtacatagtacttcttcctctctaagaaataaaataacttttgattacgaatctggatgaataaaattatttttaaaaaattatccttgaaacagaaagggtgaatcaatattgtgttgtgtgtgcaggcgcacgccatataagtatatacaccggtatgcatagaacattatttttaaaagaaatacaatataaacatagatgatcataacatatgcactcactcattcttgtgaacatataccacgcacatccctttgtacagatggatcgacgacgatctgaaaaaaataacgtatctagtaacgaatctagacatacatatatgtctagatttattattaattgtactagtatgtagtaaccctattcacttttaggtttttttttttttggatcagtagtgagtacgtctgactcgatccacgtacgtgtgtgtgaccacttgccaaccagatgagcagagcagaattggtcaggtcagattgatcgatcggtgtgaggtgagctgctgccacaagaatttaatggcggcgtcgcactcgcgcatttattttacacgcaaaagaatgattcgattcaattcgagcgagtaccccgtaccactctccctccatccccctcatttatgatagagtttaaaaatgtatctcaaaaatataggtttaactttaatcaattatatatatcctctatctgtcttaataaaataaattaatatttaaaatctccaacacaaactttcacggcgagtgtaaaaatgaaagaccaaactatcattcatatttaatcatataaaagtagcatcagctggtgatagataagtgatattgaaggaataaaatttaatttataggccagtggtaaacaggagacttaggccttgtttagttctcaacattttctttaaactttcaacttttccattacatcaagactttcctacacacataaacttccaacttcttttcttccaacatccaattttagtcaaacttctaattttgacgtgaaactaaagacaaccttaataaacaacttagctagctagctaccttgggacaattattaaactctacaaatcaaattatttcgggacgagtcaaaaataaaatttcttttcaatgtctctcacctacctagtcaccaatgctgatttctaccgttaacagcatctttttttccctcgctgcccagtacacggacttatatagagagtggtaattgttagcttttcacttacacgtaaaacgtgaagaatcattaatgtatgattaattgtgttaattattataaacttaaaaatacgtttatttaatttttttaaaaaacttttacataaatgttcttttaaaaatataccgtttaccaatttagaaaacgtgctaaaggaaaaattgaaagttgcagatgctaaaataagaagcgaaacagaggcctagattctttggatgccataaatccatttgttttaggatagagggagtcagttgttgcgttgtacttttgttttcttttgtgctgctggtggtaccagctgacaaaaagttcttttctttagaaaaaaagaataactaaaggtttcacttaaagtttaatagtatatgtactactatacagtgacacaagcgatatgacagtacttaaccctactaattaatagctcatattttgtgttgagatatcgtctcttatcttctcttccatataaagaagaaaaataagtgctacaaaataatacttcctccggtttcattttaattgacgctttggataatgacacgctctacaagatatatatttgaccttatttttctattataatatatacaataaataaatacatgtttacttattatagtgttttgaaagacaaatctatatatgtttttctagtttctttaaactaaatatttttaaagttattggtagtcaaagttataaaagtttaacctcaatcttgtccaaaatgtcaattaatatagaaccggagggagtagtgcgctaggatgtatacatgtatatatcttcaaaatatatgtcatcacgtgcaagctaaaattaattacaacttcgtatttttgctaagacacggttcccaaaaactgcgacaataaagattagttacaacttcgttagctagtgtttaactatttgcacgcatgacacatgatgcattgcaggttaattggaccaacccgtgtcacatagatagaattacagtcgatcttgtgctaaacacgtaacgttacatacgctgcgtacgttgcatttgatgaaatattagttaatatgcaaattcccacaaaatattcgcaagaaatttactccttgttttatttctatgtatgattatgatttaaattgaaagcatatgtaccaaattaaatgtaccactaaacttgtagtactaataacacgctccaaaaagaattgaaaggatcattttaaaatacactagcttaacagtacgttaacgttgttttctgaggtggtaaaaaaatagcatgttaacttcatatatatgataactttttttttctaaaaaaacaagtcgaatttgggatacctcttcagataaaattagattgtccaaaatcttctagtcactaacccaaaaaaaccacatctactttcctaatccaaacagcttaatcgttcccatcctcccgattcttctatataccaaccccacatgtgcaggttaagattgagccaagtattatatatcatacaataaaatttagcataatatggtaggctagctagcttttatttcaggacgctaagaccaagctgtggcccatgtggtttagggtccacccttacacctttatgaaatgctataagggtgtgtccccttctttagtgttatttaattcttttttacatgtgataaaaaaacttaactaattacacaataagatactttaataggctacacattatattgtcaaatagttttgctgggaagaaaaggtaaataaactacctgttattttttcacaagaaatcaaaccactacttattgatcatatatcggaaaaaaaacctcaagcccctgatgatgggtgttgggtcaggcagccagcgactcaaaccacacaacagtgtggtaacctttatatgattcctgctgtttgaatgtgctgggtgtccaagactgaaaataactcattgataagataatcattcagcccaaactaatttcaccctaaattttcaatgacgctagctgaagctgtccccaaaagcagatgccaccgtacatagcacacagtactgcgatacattggtgaagctactagtagctactaggattgtagtaattattgtacatgtgggctttcaacttttttacagtgagaggaggcctatgtccatggttatgggttcatggtcaggactagctgattgatgtgatgggaaagctgatgaaagaggagcacttgactagctggattttctattttctcgcaccttaattacttttggtgtgtttgtgactgtggtggagtgcagcacttactagatccgtgctaaaaaaaggaatcaaattggatatgtgtgcaacaaatctaaacaaacaatagaaaatcaatgcgccggttggcgcttccgctgattaagctatgtgtatgacctttaaaaactacatatagttaatatactaatatttcagtttctcttttatgaattttagcatcagacaatgcttagataagactttatatatggatccaacaccagtattgtttatttgttttatcagaattgtaacgttttcaaaagttgaaatatttaaaatattatatattttatagtataaacaaaaaatacatatatttagaatctaaatattatttattttatagtataaacaaaaaatacatatatttagaaaattgttatcattgttacagagttcgattcaatcttaaaaaaagagcaaattgttcatatcatttatttttctatttattgtttttagtccttgaaatatacgatatgtggtcatgatactttctccgaataatttgcaaagaattttacaaaaaagtattttcccctttttttaattcttcttcccttttttacacgtttgcactagttcgatcacgcattgttggattatggtgccgcacggcccatctacacacatgcaccatcgcaacttgcacgcttgccaattttatagagagggtttcttacatagcgctcttttagccgcttgtatgatatctcgccatgtgtcgctcacctaaaggattgtgagagcaactaatcagctagcataaaaccaaccagcatgagatagatagattgcaaaggggaaaaaatattttcggaagcctctagaatctggatcatgtgccttttgtttgcttctcggtatttcttttcttatggatattctctagatttatctcaaagtggatagataattgggaagtctctagaaattggatttgtcttcttcttttattttggctatttcttatgcttaattttcttagatttatctcaaatttttacatcgccatgtggctcaataagatggctcgaaacacaaaccagttttagaaatatagaaattccatgcgtcttttgacgcgctcatgttatagcctgtccacattgattctgtaattataaagtggaaattttgaaaatttttaaagaataatttgcttttgttaaaatttgaaaatcttttaagttttctctcttttttctatttagggttcctttgtagagtaaaattataattgtattgtctattaattgaaaaaataggtgataatattttaaaaggcattttttgcaaatgcatattttttttatgagctaaatgatttaatataagtatctatgttggaaaaaaatatacttgttgataaaaatttaagtctaaccggactccactgatctatacctgatattttgctccttactaaaattcttttaagccccatgaatccttctagattcttccccacttcacctttgcattttctcttctctctctgtgtgtaagctatagcatctaggtctatttttttttcttagtcatgtttgattctctttttgcctatggatgtttatttcctttttctatcgagccatgtaggactctggagatggttcagcacttcagcactgttaccacgttttttcgcttatttttttctctcatataattcctagatttatttgcaatgtgaaaggtgccacatggcccaatcatcgtttgcatgcacggccagcattagaagataatactagaaaatagacatgccaggtggcgcgccctctgattatataacttgtgtgtgctatttagtgcttcttccaagcgaggacacattagctggcgtttccgcggattatacatgcccatattcttcctagcaaggactatttaagggtttctatatttgaaaactaaatcaagtaaaagagtaatacatttggtcatatcatttaactttaatgaataaataaatgtattcgaagagaaaatattttgaatattaaataatatttaattttgtattgaacatgcataaatactgattatgtatttttattttattttacttattcatgtcttgttgactttgatctaacttggtcagttggtctcatggtccatcggcccaagtagcatatatttggcccaattagtcagtccaggagaagaaatttgggattttactatcgtaaaaggatggtttcgctagaatgctatcgcttcaaagtgattcattaatatgctatcctaaactgaggggtgttcaccaaaatactatttttggtctttttgtctaatactaatgtttttgctctattttgttttgtcttgcgaccaaattacccctgcctctatcaactcctttctcccaacctctctatagggactgtagggtggcgcatgaggagggaatggaggcggagcaagcgcctcagctggcggtgctaaggactggggcagcggcgcgagtaaactggggaggaaggaggcgaggagcaggtgggggaacggcgggggccagcgccggcgctggagccagggccgctgcggaggggcgccgctgccaaagagagaggcagagaaaggcagcgatcgattcgatctggtctctggtcaaagagataagagagaagggtattttggtcagaagaaaaaacaaaatagagaaaaatcatttctattaattgaaaagaccaaaaatagtattttggtaaacaccctcagtttataatggtattttaatgaatcactttgaaacgataccattctagcgaaaccatcctttgcgatagtaaaattctaaatttctcgtccaggagttaggagaccaccaggacgtcttctcgtgtttctcgatggatcgatggacctctatctctctagctttattcttttttttctctgaaaaaaattgtttgggatttatctgttaattcaggggtgacacgtggtccaatcaatactgcccatcgtggccagcattagatatattgattgatatgtttaaatttgtatatagagaaaatatgtatactaggaataccacgggtatatatattggactagcttattgttgcatgttttattttctttccaagcaaaatatcaacatgatgcacttactgcattcgaaaataagaacttctcatttttttccccaagattaatgatagaggtgaaaatttaaatgaaggatggttttaattagttatgacgaaaaagcaggtgaaagaaattgaattaagaatggttgtcaatagttaagatgacagagcagatatagtagaagtaactgtattttggaatgaaagcagtgctacatactactccctccgtccaactatgtaagaattttgtagtatttaaattttaccaaaaagaaaaggtattcctaaactactactgaactagttactttaatcatcttctatccgaatttcatctaatccctaacactaaccaattattaaatgtggaacactaaagtgtttccttcccaatctaaagatgattatattgttggagggaggaagggagtattcgttgtagttggtgccttttattctttaaactttttcgatgtgcgtccctctattttatataagacacattttattttattaaggcaaggtttcgattctctattgtgataataattagtagaatttggtcgaccaacagacggaatgattagtaacaaacgcatatgcatcgatcacgccgtactgtatagtattaagtatatttctgacgtcttctatacccaacattatttgagcatgtcgtcaggtagtatatatgtgaagttgttgtccatgacactactgttcccctacatcatcgaatactatacagtctattattacatcgtccgtaaaaaaatatattacaaatttgaacttaaacacaggttttaagaaagtatattaaactaaatggtggagaattgtgattgattgagaagaaaaatcaggtgaagaaattaaatgagagtggattataattggttgaaaaaaatataggtggagaaattatatatatatataaagataaattttaaattataaaagttacttcctccgtcctaaaatataagaagtttttgttagatgagacacatcctaagactacgaatctagacatgtcatcttcaaatttgtagtactattatatatatgtattccatctaaccaaaactttttatattttaatggaggagcgctatattttggaaaacaggaagtaattagtaatagcatttgtctatttataggtgaaacattagtagtaaggtcatgtcttcctgcagctgcacgcccggctacggtgatgaagcagacggtggtgaagcagctagctgaacgcgtgaaccgacacactagctatagcctatagctccaacaattaactactcctccactactgcagtactcctacacttatgtactctcctgtctcctccaatccactgatgaataaactggtccacacgtacaccatcggtcccaaaaattaaaatttcgcctactccttttgttgaaaaaaaaattaatattatcattcgttgttctataatagatcaatatttttttatggagaaagtatgttttgtatcgtgtataaaaattacaatagtttattttgaaatgaatggactagtatgaattttgtctaacaagctgtgtatgcatatagtacatagtatatatatatattttaaatatagtttattttggaatgaattggactattggagtattatgttgacaaggaatcagtagggacgatggtattcttttctgctttggccatgtttggagatggagtttttgggcgctgcaatttcttaattctaggatctccaactgaccctcataatttagtttctcactccgattgaatttaaatgtggttgtaaaatctagaaaataaatataagagataaaaaaatctggttttagtgtggttctcactgattgattatactctctccgtctcataataagtttatttttatttttagttccttttatttgcctcagaaataaatttagag

SEQ ID NO: 63503 - DNA, 17118 bp, Oryza sativa
acgaacacgtcaacgtgaccgagaacgtgaacgagggaacgaacgtgaccgagaacgtgaacgagggaacaaacgtgaacgtgaacgagaacgatcgaacgaatgtgaacgtgaatgagaacgagcgaacgaacgtgaacgagaacgaacgtgaacgagaacgtgaacgaacgtgaacgcgaacgagcgaacgagaacgagggaacgaacgtgaatgagggaacgtgatcaacgagcgaacgaacgagaacgagcgaacaaacgagaacgagcgaacgaacgtgaacgaacgtgaacgtgaaatgcaatatatatatatgtatgttacttcgcgtttatcctaatacatctttttgtatcttgcagaaaagacgtgttgtcggagtcgttcctcaagccggagtggaagagctagccctagaaggaattcgcgcaggcaagtgacgtaataatatatataattgttatatttgtaatgcaattaagattattagatttgtaattagacttagcatataagattgtgtagtgttctaataatagtcttaattgcatatacgacagttacacttagcatacatgactattttagtcatttattactattggtgcgactccggtctaactacggaattggtgcgactcctagcaattgactattttagtcttaattagacttagcatatacgacagttatacttagcatacatgactattttagtcttagcatgtaagattatttgagttttaatataagattattttatttgtaaatagacttagtatataattattgactagctagggtcgtataatatacgtcacctagacttagcttatatcacgatttgagttttagtatgagattattgactagctagggtcgtataatatacgtcacctagacttagcatatatcacgatttgaattttagtatgagattattagatttgtaattagacttagcacgtaaggttgtgtagggttctaatgtacgacagttacacttagcatacatgacttagattgttaaaacataaatgtctcatgacttagcttatatcacgatttgagttttagtatgagattattgactagctagggtcgtataatatacgtcacctagacttagcatatgtcacgatttgagttttagtatgagattattagatttgtaattagacttaacacgtaaggttgtgtagggttctaatgtacgacagttacacttagcatacatgacttagattgttaaaacataaatgtctcatgacttagcagatgtttcttgtatcaacagatggctgatcgcgatgaggaacagatattgtacgatacaatcgcggagggaagcagccagcactggaatgaagaagaggggaacgaggatccaaaccagtacttgaacgaggaagggaacatggagagggatgcggaggggaaccagcaggggcacgtggaaagggatgtggtggggaaccaggaggaggaggctagtggaagtcaaccctccattggacagaagagggcacgcgggcaacgaggtgcagcgaagaagcttgagggtcggcacatcataacggaagtggaagaagatggacgtcctagtgccccggccgaagccgccaaaaactatgtacgtcacagcggttgggttgtgcgggataacgtgcctgtcagtacggtgtactggcgaagaacaagggcacacggagatcatgagagctttgtcctagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatcctgaaggggcagacaccgaacttccacacattcctaaagttaagggatcactgggacaagttcgttgcatataagacaggtgaacaagggcaagtgatgatggaaagaaacaaagaaaatgccgccaagaagaagtaccatcaccacttggggtcaggaggctatagcgtcgcgatgccgaagtgggaggagatggaggctagcttgcttgagaggggtatcgaaccggcaaccgctaattggccggaacgatcgaagttctggtactatgctcacggtggaacgctcaacccagctgatggctcactggtcttcgccgatcagatacgagaggctgcgcgacgactaacagatgcagtggaagcctcctctcagggcacattccgaccggacagagatagggacgagctgacacttgccctgcagactccagagcatccaggacgaacacgagggaaaggggtgattccttggaagattggtttcaaggaggacatccacatgtacaggagtcggatgaggagcaagagagataccgagacgaagattgcagatctagagttccgggtatcgagctacgagctcggcatgcaagaggaggtggcaaggaaggttgatgaatgcatggccgcacatcggtcccatgatccccagccgaccattcctcctgcaatggtgagcccgtcaggaaaccgtagcagctgcgcctcaacggggcaggtaggatcacagagcatggacgccatgcaaacccaggacgaatcgacctgtcccgttgatgacatcactcagcggacaccatgtgagctgcatattcctttcaagaacttatcaataaaggtaagctcgtagtttatatattttagatttggccatttcgctagttgctgcttatatatgttgattactaataaataatctctcacaacatgaaggtagcgttgggcatggccatcccaacggacccttctggtacttaacactgcaggccgattccagcaagatactcgaaggtcgaagttgagttggtcgaaggcgcgtatgaggacctcgagctggattaccctgaaggagacggtgagacgcatctacgagacacaagccaagccattattctatggcgcaggcggtacatcatcttccctgggcgacaagcggcgtctcgtgcaccatctcctccggctccgccatctcctcctcaggatcctgcactgtctcctcctcatgctccgctagcaccgtctccacctcaggctccagcaccgactcctcctcaggctcctgcaccgactcctcctcgggctcctacacctactcctccgcaagctcctcttccggcaccttcaaagtcaagggcccccccagctccaccgcctgcccacacaagggcaacgaagaaggcgaaagttgatgccgccaagaacaaggacccggggtacgattgcacgcaagaggagcttgacgcttacgtggcatcagaagtcaagagacaattcaagccttgaagtccagaaaagaagattgctatagacccgagtgtcaggaacttcttcaggggtatgtctgcacctgtcaagaggccatcaagctatcggactatgagcgaacgctgaagaaagcatcttctgcaaagtccaaaccagtccctcagcttggagagcaaccaaaccaggagatcgagccgttggtgaacggtgaagacatgacgatagaagaatttattactgacaccggtctaactacggatcaattgctaggagtcgaaccaatagaaaaggcggaagtgaaatacatgtacgaactcggtaaaccgcttgtcaagcccgagctggtgcagtccctacccacacaaatgtacaagttccatcagctatacatagagatgagcaccaccggtagagagatgattggagcgaggatcagggacccagacttcttgcaaggagatgacattctctggatcaatttcaagggaatctacgaactatacgagctggacgccctcgacgtctctattatgagttgctggattttgtaaatatatcgttcagttagatttcttaattactacgtctcctttaattaattaggtccttgtatataagtagactatataaaataaaatactcccttttatcgttgtagaatggagattcaaagggcccgacggcggagggtttttgatactggattcatcgaccctcggaaagtaaacgtcgcaatgctcgaccaatatccgcaagccacagaggacaatctcgtccatctccttcaggcgcagcattacaagacgttcatactgttccgtacaacacagagttagtttaattttactgtcttcctataccaaatttcattcccgtacgaacttgctaagtgtttcatatgtaatgcatcccacgcacattgcagattccactgggtgcttttactcttcgacctgtcggcctgcaccatcaacgtatatgactcaatggataaaaaagagtctacgtttgacaaggttttcgaacttatagacaggtactgtcataagttcctctgttaattaagaaattcttgttatgttaattgctactacgaatcatatctttaaactccatgtagggcttggtattggttccgtcatttggtccacggcaactggagagaaagacttaggcggaagttcaaatttcctgtgagtacacatgctctacatttatatttctccgattcaaattaatacatacaagtgtatattaattagatctcacgccgttaatttgtcatttatttgtagtgcgcaaagcaaaagcagggaactaacttgtgcggctactacgtgtacgagtattgccactgccttgcagaccaaatcatcaccacaagagagctcgatgtacgtacaaataaattcaaattttcattacgtaacgatttcttgtttaattactaatcaatttcatacaatgatatagtttattcgcatgagggataacctgaccacacacaaggaatttatcgcggcggttcaagaacaactcatgggattcatcaacgaagaaatccttgatcccaagggtgaattctactacgacggaaacacaattcatagatccttagcttctgagctagcgactactactacgtcgaaatcgtagctagctaggacatataatggattgtaattaatatatgactacatatgtttctatatgcatgtgtacacattttctataatgtaaatatattttggtcatatatatatatatatatatatatatatatatatatatgcatttgcataacatatatatgtataaatacatatatattatgcatgtacatatgtactgaaacatatatacatataatataatatatatatatatatatatatgcatatattatatatgcatatatatgtattgaaacatatatatgcatggtttatatatatatatatatatatatatatatatataaaccatgcagcaacagggccatgcaaaaaaaaaaaaggtcagctcgatctttagtcccggttggtaacggctcagccggccacgtggctaagccatcttaagtcccggttatttcacccgggactaaagatagcgatctttagtcccgaattggtagtcctggtttgaaaactgggactaaaggggggttacaaaccgagactacaaagggtttctccaccagtggatacacggtttgaaactatatagacattcaaaatttggtgtcacgtggattttctttaataaatatgttgctcatattatatttccttttaagtaaatataggtatttagaaaaatatgttcgtgcgttgtaacatagtctagcttacataagaactaaggctctgtttagttctcaaacaaaaacttttcaccatgtcacttccaatatttggacacgtgcctagagtattaaatagaaaaaaaaactaattacacatattacgtgtaaattgtgagatgaatcttttaagcctaattgcttcatgatttgacaatgtgatgttacagtaaacaattgctaatgacggattaatccggcttaataaaagtctcgcagtttataggcggaatatgtaatttgttttgctattagtccacgtttaatgcttcaaatgtgtgttcgtatatccgatgtgacacgctaaaacttttcgtcttgcgaactaaacagagcctaacataagttccaaataaatcccaacccccgcccaaacacaaggaaggtgtctatcttaatcccacgacaacatctatctgacgacagagatccacgagacaaacccattggacagtcaagacaaccaagaagaccgcacacagtgccttggtgggaaactccttccttcctttgttttcgagtcatttcttggtcccccgtcgtcctctgtgtgttctctgctttttctttttcacttcaaactgctactgtagtacaatattaatgaccatgtgttatctctactagtacttaaaaaatttgcagtggtgatggtgaagccaacataaacaagcgacctattaaccatggggtcaggaaatcggacgctcctccggatcccatcgcaatccgcacttggcgagaaaaaaccgtcgctcccaaatcccccatcgttgcgccccctcctctctacaaccaacctcgccctgccccccatcgccgcgccccctcctctctgcaaccaacctcgccctgccccccatcgcgcgccccatcactagcgctgcagacgcctcactccctccctcctcgaccatcgcggatcgcggcagccggcccccgacgacgctctcgctccatcctccccaatcccggcggctcctcggcgggttcgtcaccacggtgactgagcccccgcctcgcccttgcgttctgtccgtcatgactcctcgcccccacgccgctagccaggtaagcatcattcatttttctcatggaagtgtgtttttgtttccatttcttctaccgtacgcatagaattgcatgcaaaacactgctgctgaatctcctctctcttgagacagtgttatctttaaatcaatgcaagtatgtactgtgttctcaacaagaattgaaaacccatagatggatttagttgggcatgatgtgtccattaacgtaagcgatcacccacataacccccacaaataatagcttcagaacaagtgcaatgttacatctgaagaaataacatatcaatcctgggctgggcatatattccatatggacaatatgatcgaatttgtgaagcatcagacatgcagaattaattattttcccccttattttcttggttttgctgcaattttaagtaagcattcttgatatgatcccatggcgtgtaatagcaattctaaacttatgatacatacctacatcctcaagaaaatgtttttctaccatcaggataaataggtcatggtcatgttgacctgatcttttagatattactccaactcataacattagaaaagcatcatcaattaataattctcgattgtaattttatctcaaacagtctcaatcaaaaaatttcagttcatcagtttgtcaaaaaagtctcacttgatggatcggttttagcattaatattgaagcaaataagtgcataggaatttcagttcatcagtttgtcaaaaattgtggctagatggatcggttttagcattaatattgaagcaaataagtgcataggtgaattagatttttttttcactctataaggatactttgtgccacttgcttttgttgtcaggtcatccaagaactcggcaagagtaacttggtagggaacttgtctaagcaaccaatggtcaattttctcatgaagcggtctttttttttcagaatcattcctgtgcgaccggagaccctgacattacctctcgctaccagcaccgctgtcttctccctttgtcgagatatccattttctctgtcttgtcctccgttgaatgtctccctgccgattctgtgggattgggtgatttggtgtggagctaatcattcggttgatggtctaatcgtgcaaagggacaaactatagtctaaagtcagacatgccagaaaactataaatatcgatttgttcttttcttatgtgtttgtttttaggctacaatggaagtattgactgccatatactcgtgaattaatctatatgaattgtttatgttggccatatgccaatatacttgcagagtactagctaggtgtgggcttggcaaaatacctagctgcaactttttcttggtcaacaaatgcatttctgattttttttccagtttataatttgttccagacataaaagtaaattgtgctctcatttattgctttcaaaacagaaatgcattgtgccgaaagttgtggctgggaaaaatggctactggctattcagcatccttacgctcatgcaacttatcttttttcagatcagtgcagtactttgaactgatcaatacaatatccttatttgtaagcatgttttttcagatcagtgcagtattttcatattagtatattacgaaaatataattcctttaattgagtcagatagtctagtgacctagaaatttatattcaaatgcaattttccccatctaattatcctttgagtgagtgatcatgtgattgcttcaacaatcaagagcatcttgattggtgaacaatgacaggtaataacacatgttttaatgttttgttgtaaaagatcatttcaaaattcatggtttagaaaaataaattacaaattcgaatcctgctgacaactgttatttgattttgtacagtacgccagaagaaacatgtgtggtaccacgtgattgtcacatacataactctttatgtaatttttttcgtgaaccttaatagcatccacaatcaccatctacgagaccaactgcgtctcctatgagagagagcccgagaaggtacaacacgtcctacagtgttagtgccatcttcccacatggaatgtggtatgtgtgcgtctcaggtctccaacggtctactagagtggccagaagggacttgtctgcatcccacagctttattgggtcggtgtcgtttgcggccacctcgactagcctagacaatggtaggaggcctgcctcatgcaacctgcagaatgtaaggtcgacacattaataatgactattaaagtagagttagccgttcgtaaaaaataatagaaaatggcataccacggaacttgtcgacacgcaacagttgtcgcggaggacgtgacggaaggtgctgagttgtacaccctagagtagggatggcaatggggacccgatccccgatcccccgcggggaaagcatctattagggcctagagtgcttttcaatgctatggttattaggtcaatacgtgcattaaagaaacaacaaactttcatatcacaagctataaagattacaacaacatagttcagaatattaggatgcaatactaaaattgctcatagtacaataccttctaattgaaggttatgaaattacaagcaatgacgattacagtagttgtaggatactatacacaatacaataccggactagttcatggttcactaacaatactacaccatcgcatcaccagctgcacagggacgcctaggacgtgctcacctggttattccttcctcctgtggttgacttccatccgttgtcgttccagatggaccaacatcagcgccgctaggacctagcgtatcctttggtcatttctagtaagtcatagactcctatctcctgtttcggacatatacatgttatttctgatgcatcttgtcttacgcctgcctttttaaacccttaactaagttggatcttgaatgcaaataacctggggacttagagttgtgtaagatcctaagatcccgaacccatatatctcttcactttatgtatgaaagattgtttctttccagaaataatgtgacacgtagacatcgggaagtataccacaatcaccggctgtagcaagtacatgagagcaaggcaggtgccaaagcttaggcttcgtacagttgcaactacatctgccatcctactttaggacacatttctgcacagcttgcctatggtagataccacgcctgctcctatcaacacaaattacttcatattgacaaatctatgcccttttgcccttaactattttatctaccatgtccttagtaactactgtcccataagatatattgttgtgtaccattgaggtatcaattttcttgtataggtccttgaggtaggcctgtgtgccatgaaggataaattcaataataccaaccaatggcattcctcgcactcctcgcattacccagttgtaaacctcagccagattagttgtcattatgtcatatcgagaaccatcgatgttgtacaagaggacccactactcctttggctcattctcaattcaatgcgagaaattccaaatcgatgatgccgacctccgtctcatactaggtgaattgtcatgcagtggacctagagctactggaggcttgtcaccttcaaccagtggccagcgagattgctcgtccatttgcttggttttcaaatcatccgaccttttccacaactcgttgaatttctaaagttgattttgtgcacaaagcctcttaaaatgattcatcaggtgcttgttcttgaattgcctgtagaaattagtacacatgtgacacatgcaccatctactctgaacatcaggccacctagctggaagtcccttcttatcccaatcattttgcaagtagtcaattaccggtagtatgcttgtatgacgatcatgtataatgcaaacatcaggcctcttatgcatgactttggtgcacactttcttgataaaccagtactagctttcaatgttctcactctcaacaaatgcaaaagtcataagtaaaacttgattgtttccaaaagctccaattgctgtcaatatctgacccctatatatactggtaaaaaatgtaccatcgatgcacaatatagaacatcaatccacaaaatacgttcatgcaagcactcaatgcgaaaaaagctctgtgcagcattctcttgttaggctcatcagatgatgggaatgtatgaatgtcaaagtaagtattactatcttcttagaattgctggctaactggcgaagcaaattatcataagatgcttcaaagatgccatacatcatctcgataatctttcgtttctccgtccatgctttggcatagcttatgatgcatatgaatttgtcttcattgtggctaataattaatcttggttcaaacccaatgttgcggacaatgctgctatacatcttaagtgcaataaaagctgaagtgatgttgcggtggtacttctccaccccttgtaagtggcatttatgctcggtcatagtgcttacttttcaatagtcattccatttacccttatatgcatgaacatgccactaacactcttcattcacacacctggctttgtacacagatttggttgacttggccaccctaaactctctctacaatgagactgcacaatgcttcaccgcctcttttagatcctccgaatgagcatacctagcaccctaaattaccttgttctccttttattctcaagttacatgatgcccctcaaagataacaaggcctaaaaagtcctcatttgtccaatcagcaggcattacatcatcttcctcgtcagatgatgcatcacccttcacttgctcgagttcatttgcttgaccaagttatcccgtttaatgttttctttgttttaccatgggcatattttaatgcccatgttactaccatacatatctcatgctatcagcacagattctaccttcttgatgagagaacagatgtgaagggaacatgacacgtgagacttagcttcatcaacaacaacagctactgcagttgccctttgtccctatcaatggcgatcctgactcagttcgatcgtgttgtttttctcttcatcccgtcactccagtcaccctttatcccgaggtcgactgattgggagcgattggatcgatcagctttccatcaacatgccatatcttgactgcaattcataggcacaactgggggcgacgtgcaaccaaaccatatgaaggtgttgggcaccacccaaatataaattccttgtatggatagtgatccaagattgggtttggatgacttgcagaccgtattgaattgaagaggatgaccaaaccaacaagtatgcccttgtgattcacctatctgcaaaatgcaggctcaccgccaaacagtttgcagcaatgtaaccatggaccaaccttgaccttcatatgcatgactcatgcaatgtatgggaacactgggaaaacatatgggaaaacaaagaaacccctgaagatgttgatcatcatagtcaattgggagacgtggtgctagcgcaacgcaagaatcttctgacaaaccacaataaccccaaccaccatagtagaaacactagcttaggtgaaagtaggagcagccaacacaaagagggatgccatatattctttctcttgcgggagtgctattcttttcccatatattaatagagaagcagcaatacaaaggcctaaataaatctttaggcctttgtattgctcttctctattaatatacaagtgcaaagctttaaaacttaatagatgcatatgggccaacttcttatagggatgagattgcccttcctaaaagatgtttaggacattaagtaacttttaatcatgacatttcatactctttaaaatgtgtgtatttttagggacatttaactccatgccacttttaagatgtggcaactaattatttgccactcgctgtctatgacatgtaggccctcatgtggctatgacatgtgggtccagtagcaaataatttagcaccactcgtaggagtgacaaatagttaattattctgtatttttaacttgggggatgatacatgcacatcccttaaaaaaaagaataacaacatgacaacaagtatcatgccaagagagctatactatagacacgaccttcatcctcattcaccaagttttcatgtttttatagtaaaactaattcaaattggtctagctcaacactagactgcaggcatgactatatttgaactgttttccttaagtagaggttgcacacttatccatagaccgctcaacaatatcagtaagggaatcgaacccatatgttccatgaacctcatgaatggtaagtcaaggtaatcagcatgggtacaatgacaaaggcttttacattacatgccattcccagctagctcactagaggatattggttggttccaccgtgatcgtaagcactccaagcatataaaatattagtgatacatcattggtgtcatactatagtcggcttaactatatgcctgcaactaaaaattatgatgtgattccctagttgatacaaaggcatactatagaatatatcgatgcaaatgtgttatgataaactcaatacaaatgcaaggatggccatcaacgtgctctagtgagcgacaaacacaagcagactaatgggaattcagcttccaaaaaactagaactcgagagacgctccactgcactagagaaatcagccatagtttcacctgaaaatccaaaatgctgcactattacaggctcgaacactgctcttgtcattgaagccattatgtttggactaggcaacattccatccgtggcaaggaaagcatcatagaccatcgtcttgttgattcgaaatgaaccctcatcttcaatgatcgaatctaattccttgtccaaaggtgcatagataggtatgtggaatgtgtcaaacttttctttgcttatcataccctataaataagttaaagtattctcagcaaacctggaaagaaaccttgattccaataattaattcatgaagttcctttttacaatagaatgccatgagctaaacttaaagatagaaattgtgatattgcacgaatattaaccatttttttcgtgtatagaacttggataggatccatggcaaaaaaatttgccagtttaattttctgtcccaaaacattcaaacttttaacctcggatcgcatcgagattcgtgtggtgaagggaaaagaatcttgcaagtttgcagggggcgtcaaactccagacctcgtatgtagatgcttaatgtggtagccaaccagccatgcacttgtttgctccagttacatacggtatatacataagttacattgtaattatagtgtagttacaatataatattaaacaccaattacactctagtgatatacgaaagtttttcataaaaaaacattaacttactctcgatgccatgtcgttcaaggctatggctagcagcttccatacttgagttgacttggacgcatggttgcttgagcatctgccaaccaatgagaaaatcagctgacctccaagaactagttcttgagccctcaaggacaagaacagcgtgaaatcctttctgaactgtcgagcataagcattggcaacaatttcacggttcaatagcctcaatttatcgtcactatcgtacattgggattttactcttcacaagctcttcaggtgcctgcttgtaaaaaggcacaagtggtgaatattgaccaattattccatggcaacatatataggggattcttatgctgttcacatacatatagtttactgaatctagttgcatgcctacctctgataaccaatgcaggctgatggaggagcagaagaaatgcactgaggtcgatgtgaaaagcctatcataaaatgacccaggtaccatgctggtgacaatgatgtgatgggaggaactgtcctggccatgcttgaattctcccaaactttttgcaacggtgttgaagtcattgcatggaagatcgttcaagaaaatgcacatttctggttgtggctgcttgtgttccatgcaataacggtggatggcgttgaccatagttgaaacgagagtgagtgcgttggggccggaggagcaacccaagtctgcgattaccatgctcttagggagagctgccccacaaaaggctttgatggcatcctctatgagaggtttcatcctatcttgcgctattttctgcaagtgtaattctttcttagatattatgcttgttttactgaagagtgtgttctatagaaaaataatcagctggaagcagaaccaaattatattgtacatagtggagatgctttccatttcacaatgctgctaatttacacattgtcacgtgcgaggggaacaccgtacccccgggcatactacggaaaattctagatagtgggcttcttcaatattcctcagaaaagccaattttggctttttaagaataatctcaggtaatcatgaaattaaaaatagctgacaggttcatagcaacagccttagaggaaaaaaaggtgccatgaagagcctaactgatagaatcctacaataatttatacatacataaaaattatatatgtatatttacaaacagttttttttaaagaaaaagaaaagtaaatttgctgcttgacattgggttcttgattgacattatagaattttaaccaccatcattattttctttgtattgaagttcttatgcttaagtactcataatggaacatagtctacaataaaaacatgatcatgagcatgtaacaaatgatttgtactgtagaataagaacttatacgaggtaactccgaaagccgcaacctcattccccgcttggccagagaccgcaagtggctatggtgacggtagcagcaaccacatccctagccccgatctggcagccccagccccgcggcggccgtggctgctgccctcacggtgtggcacagggcccccccgcaactgacactgtgtagtcgccaatgatctggctaaccatcggagagaaggaacaagtggatctagctggtattttcttgggtgattttttgatgtttcagtctatgtatatggatgttcattagtaagatcaaagtgtttcaatggggtgtttttatggtgtttctttttcatcttcgatttcactcagatcttgttgatgttgccatggctttaaatcatttgttttgtatgttaaagcaaattgtttcatctggtgatccaattgtgtttcactattttcaagaactgaagcattctttccctagttgtctcgtgacttttcttggaaaaaatagtgcgagaaacctatttggcacacagttgtgctttgctccattttctgtcgacttctatgggtctatagggccaaacaaatatgctttttttcttattctattgagtgaattaaaattgattgaaattttttatagttataactcaattttaaaaatcttcatatgtattttagaacatttcaaattcaaactttcaactaaaaatttaaaactttcaattcatattttcaaaattttcaactcaaaatttaaaactttcaactccaatttaaaatattcaactcatattttgaaactattgactcgatatatgaaactttgaactcaaaacttttcaaacctcaacccaaactttgaaaattttcatatcaaattcaaaactttcaattgaacttttaaaactttcaacttcaaatttgaaaatccatatccagatttaaaatattcaaatcaattaattttattattttattaagaaattattgtagcgcttagcactaatcacggtaattagacaggcgaaggagacgcataggccacactttatttttgttgaatgggcctaagatcaatctaaatttagtggttacatggcacatccaagcaatgtttctgaatttaagatggaaaaacttttaggctcatatttaatcgccattttgggccaagaacaagccttccaagcaagcctttagcattaattttactatagttgataccccgctctttgctgtgggatatgtggattaatgcatgttatacatcatggaaatggtagacatatatctttaaataatgtgaaaacaatgtagagataatgatttgacattgcttgcatattgagttctaaaaatacaataaaattgtaaatgatatgtcatgtttgcatgatatttaaaatactatagataataattgttagtgggtgatgatgtggtatacttgcatatgatttaaaatactctagataataattgctagtggatgatgatgtggtacacttgcatgtt

SEQ ID NO: 63504 - DNA, 9783 bp, Oryza sativa
  unsure (1)..(9783): unsure at all n locations
attcctgcagcccagaactgcatgcagaaggttcgaggggaattttgtcgatgacattgaagcagaaccgagatagagggagaacacagttgccgttgtgacatgtcagggtagggatgaaaacggatcggaaacggacgtaaactagctttatcatattcgttttcattttttttggaatcagaatcaaaatcgaaaaccggaacgtaaatgaaatcgaatattatcgaattcaaatacggagcgaatacgaaacagaacgaataagtaacgaatatttgcagtatattaaaatcccctcaaattgagtttctccaaaatttatatcgtcaattttgtagatggtcctacaaccgtatgtgaaaattgattttcatggcaaagagaccaacatgtaaatatgattattcattttctattcccaagactttttactgtatatatagcttacttaccatatcacttatcataagttcttgatgtataaaatggatatgttctttattttatttcacatcttcaaaacgtgtagtgtctgttttatactttaaacattttcaaatacaaattttataaactacaaagtggtagatctcattgagctctacaactttgatatggaacacatctccatcacatgccgtttgaattgtagatctaagatttttaaaaataaatttggtatttgacaatgaatatttagacccttaaatgatcttttatttagtcagcaagaaagctgtagatctcatcaagcccagcttctaccaatntntntngaantanttngnaanangntntnannantncnattnncntngnanccnnttnnccnccttttnaattngaaaaagtttaagtatacatacgtggtttttctaaaatttgatccatgtctgcagatatccgaataaaattcccagatagtttccgaccgttttccgattacgacggatagtacccttactgtatttatttttgtttccgagaataaaaatctgaattcgtttccaaatctagtaatttccagatagttccaaccgaacctatccaaatccgaaaaatggtccggatggacggaaactattcgtaccagttttaaccctatgtcaggatacattgcttttgaggatcatccaccgtgtaacttctatgcagatgcaaacctttgttttattcatcgattaatcagtttcttcgtcccagtaattcatcgaacaacaatgaatcgtataggccggatattaattgtatctaacgctcaaactagctattaactacgagcgtacgtgaatcggatacaacacttaactacatattacatatatgaagtgatcgactaacacaaagtcatcaacagcatacaaattcaccagtatcatttcaacacagttagtttgaacatatcttcccctgcagtacagacgcagaattattgcagaggatcgatcgatcgatcatatcaccagcagctttaatttctccaagcttttagcccttgcactggtagatgttgaggcagctgcgtccgctgtacggctggcccctgccggggcaggagccgtagcacgccgccttgctctccgtgagcccgttgtagctggcgtaccggctgtcgtagaggatcctcctccgcgggtacgctgcctcctcctcctccaccacgctcgccaccacgtcctcgacgtcagccacccggccgcgcagcacgtgcatcggcaacaaggcgccgctgctgccgacatccaccgccgccaccagcaccaacgccgcggcgacgacggtggcggcgaagaggagcatcagcttcatactgtatgtcagtacttgggctagctgctagctagctgagacgaataaaaatggggtggtttttgtgctgtttagctatgtatttaagaggaggtgggactggattggagggtactggatcgaggaggtggtggtggttgagggcagggagagagaagagcgagagctactctcttcgtcaaaaaaaaaaactaatttttagtttaaatctggatatatatatgtgtctaggttgaaactcagaattagtttatttttttatggagaaagagtaggatcaagcaactgaggcagcgacaggacgcctaacatcgcatgtgaagctagaggacgagagagtccagcggagcgtgtctctcatgatggatttgattagcaagaagcgactgctttctctttggaagcgtatggtatggggttcgatcgtactgtgccatccggcacagggtacgtacgtacgcgtgcaggagttaattaaaacattttggatggtgaggacgaaggattaattaattggcagctatgtacgtacggctgttaggtgcacttgatgatcgttagttaatccctaagcagaacagtgccatcgccatgacggaatttggggagtatacagtcgtttcgaaatatatatttagtttcagattttggattcatcttagggttgttttgtataccatcctgttttttggggatacgtcttgctcccacgcaactacgcaaggtacagcacggtaggacagtagcacagtagcagtagtgccttatgttttcctagcctcagatgcacattggaattccgacttgtggatgcacacgctgtgccgagcttgtcgcgccgactgccgacttgccgccttcctcagagacgccggccgagcacggcctaataatccgatgggctgggccagcccaagcacggcccatgtgccggtccacttgatgccggccgggaatataataagttcactctaggtcccttaatttgtcgctcagttaatttcgtccctagacaggaaaaccgggtacagcacgtcctccaacttttaaaaccgtgcaatcgagatccctcggcagtatttgaccccggttttgaccaatatggcgcctacgtatattgtttgactaggtcttcgtccgacgtggcacttgcgtggcgcttacgtggcaatttgatccaaatataataatgaaccctatggggcccacatgtcagtttcacacaaaataatgaaaaaaaaggtagggcccatgtagccccacatgtcatctctatcctctctgtttctcccttcttctctctttctcccttcctcggcaagcatagcaggttgggtggtggtcggagcaggccggtggcaagaaggccccctctccctccttgcccgacgacgacgactactagcaccacacgccgccgccccaccgggagatgacgagttggagatgagatagtggagagggaggacgaggggaggccaacgagggtggcggagaggcctcccggcggaagtggatggccagcgagcgcgcgcgaagagagagaagaacggcggccagcggctggagggaagaagggcggtagacggcggccatcggggagaagggtgatgactagcaggaaggagctaggcgacgacgacctcgagcggaggctgtggatccgctcgccgcccttcacccctcttcctcctggcatccttcgtccctccccgagctccatggcttgccgggaagcaccacgtcctgttgcggagtggctcccccatgacaaggtgttagatgcacacggcgagctcagcgcagaggtagtcgacgctggggcgggacatgcggaaggtcgcggcaccaggggatgtgggcagagcggtcgagacatggcgaatccactcgtctccctccccacctccatccatggcaaccctgcagcaggctcccctccccccccacccccagcggggctcccccttctccatgcgcaccccgctccgcgcccctccgtacgacccccgtctccggagctcccgcctccctccgctcccatgggcgccgcgccgcgtcggcgtcggtctcaaactccagcatcttattccgatggaagggagaggtgccgctcgcctctgcctccgctgctagctagaaggtttcctcccacaagtctaccgccatagcgtcgccgcggcggcattcacgccactccccccatcccactccatcaggagccgcgccgcgaagaacagaggaagaagagcagcagcagccgcaggggattgaggatggcatgtggggcccatgtaggccccaccattttttattatttggtgtgtgaaactaacaagtaggtcccacgggtattattatttttccaaatcgaattgccacgtaagcaccacgtcagctaaaaccgctatataaatcgtcgagggacctagtctgcaccggttttaatagttgatagaccagttatatatggtttttcggttgaatcacgaaaattggattcgttgacaagttagccattcccaaactcaaaccacaatccaccaaccaccaacaccagagcgaaccgggagcggtgtttggatttgcgccgggcggcccggtggagaaggcgtgtcgccgcgcggccgctatcgtgaggcaacgagctcgctgcttgcctgctcgcacactgcctctttcagcctatgcctccatggtgaagcaagaatgaaaattgatagtatcagtttctttttcccgtgccgaagtgctgatatcactgtgtgttggatttgattacggcatctaatcattaggcaggaaaataaattattgccctctaatttttttgaggcatccactgcatattcttgagacaaagtttttgagaaagcaatttattaataatagggatacaaagttattgtctcattaaaaaaaaacttatgccctagaatacagctttcaccgtaagaaaaaaaaaagtacaacagctgacttacactatcacatagattataatttatcacatacattatcattttaattggcacattcgtcatcattattgatgccaaaatccatcaaacactgccattgcttcaacaatctgctgccatccagtcttaaagggcaaaacaatttacacaactatctccaatgcaaggcatgacctacattcttcaataattcttccgatcccgttaaatgcttactatgaaggtatagaacacgccataaccaatagacttgtgaagtgagctaagataagaatagtgtgttgtttttcttttcaccacccaaggagatcgacatccgccattaaacgtttgatcatgttttgtgtgattgcctgattggtgctgaggtagtgggtaagttctgtatataggttcaagtttgacctggtgcctagagaggagagttgttctactcaggcacaaattgaaggtgcttgatctactcaggcacccagcgaacaactcctaacttcatttgatatagacgaaaaaccctatctgttgaaagtgtcaaaaaaatctttagaaaaatcaagatccactgcatcacccattgatttgttagcaatctctacaatttccagctttttgtgaggatcaagtatgaaagcaagagaattaaatatgtggaatagcagtgaagtatttgagaaattttgcttccatgagttgaacaatgggagctcaaattctatcaaaccgattttcttcaaacacaaatgacaactgctaaagccattcaatcaccaaacaagatgtattatagtgaactcaagatagttggattatggcattattagatggctttaagaatttacgcaagcatgtagtgatgtcccataattgctccgtaaaaatcaaaatctcaccatcaccatccttattgattgaattgatgaaaacaaaaattaattcctcatatcctttcacatgacgcagcaagatgtatgttgccgtcgggattacctagcccgttgtgagtgttcttgccatactcgtcattgtgtcgcccctagcacctagcatcgatcgtgcccctttcgttgctagatccacagctcgaggcgagtagggcactatgaccatggatggtttggtgacagtaccagcgcgtgggagcttggtctgcttgatgccgaaattggtgatgattgtgggctccacactctccctagaggcgatgtcacgatggactcagattgggatccaggtgaaaagttggtttcgggtgtctagaatggtgacagctgcatcctttgatgccatgaccttgttgaaggcgtcgcattggaagcccccggctccatgtacggcgtgataatgttgggccgtcggcctaaccttccttcctcccgcgccctctctccctccttgtcgggccggcccattgcccctcctctcctccctccgggtcatcgacaggtggggcccaactatcggccccgtcttcttcctctagccgcctgcgcccggtgggcaaccgccgctcccacgtcgccgtctgcgtctcccgcgcccactccgcgtccacgcgccgcgcccacatcgtcgtccgccgctcctccgcttttcccgcttgcgcgcacgcccgcaaatgggcgggattcgatttgaatcacatcccctctctctctccactcccccacatagccggccaaatcggccacctccccggccacgtccgcccctcccccgcccataaaaaccctcccccgggccccctctctcgtttcccactctcgccgccctttctagtgcttcctaccgccaccgcaccgcgctcaccgagctccaccgccgccgcccatctccggccgcgcaccgccgccgctagagccaccgccgcgctgcgcaatcgccgccgtcgcgctcaccaagcccgcccgcacctcggtcgccgcctggttgtcgtcaatcgctgccggagcccccttctccccgaaagccggtgagcttccccatcccctccgcctccggccgtcaatggcgtgcgccgtggtcgccttccctactcctaaccccctttatgctctctactaaggtgccgtcgtcgcctcctcttccgcgcgcgcctccgctcccgcatacgcgtcgtcgcgctgcaccgccatctgcgctgtcgcccccgtcgccggccactgccgctggccggtcgccgggcaccggccgccgccgtgagccatgcctgggccggccttggcgccgcccgtccccagctgcccgctcggcactcggccgatcgtggccgtccatcccatggcccgcgtggccagccacgtggtgccacgtcagcgccacgtggtacaccaccaccccggccccgtggacccggtccacggtggaccaccccctttgagccactgacctatgggccctgcctgtcggtgctcctccctccccccccccttcgctgacatcagccctgggcaatattgcgcaacaaattgattaaggactttttctttattagaaaaaacacagattatcttctaaaattcttatttaattcattcgagctccattcaagtctcagtaaattcataaaaatccctagaatccattaaaaatggttttgttctctgtttcagtagtcttatagtgtgttttgcttgtgtgctttgtttgtcgcatagatctcggccgtttcgtcgatccacggttcctcgaagacgttgctgaggtctcatcagtgcgagagcaaggcaagtcatgcattacaattgattatattgtacccaatttacaaatatcccgcatttctattaaatgttgtattcttttacaatgtcatgtgggatgagtcctattactcagccatatattgtttaccttatgccattgataacttgggtatcaaaatgattggatgttggtttaggaaatgcttagccatgcctagttcaactagtacacaaacggagatcacattattacatagactttgtctattagcatagctttggattggtgccaccgcaatggtgttaattaattaaaatacactgaatggtgggctgtgggtgcatggtttcgctggtcacacccatggcaattaaggaccggttcacgggaaaccctaggagacttaccgtgcttaccacaagcgggagtgggtaactgcttgatctgaagtatagctcgaccctttcctaggcaccgatggtgagggtaggcgtgatggagttgggtcggccggggtatccggttgtccagctgccggattcatcgcggcgcaagaggggaccgcccactgcctttttaggggtgggggtgaaaccttagcatggtgtggatggttatgggagggttatgcggagggtcttgtcacaatttccccctttgcagtatcatggtgatacttcggggcatggcgacatgtgtggaatcgtgtcttgtgggtagagttgtacacctctggccagagtaaaactattcgaatagacgtgcccgcagttatgggcgatcaaccagattcaccgtgattagtctcacccctagtttagcttaatgaactgttgtagttcaggtggttggttgggcccgttgcaacatgtgtagcgttggacagtgattggttaatattgactaattactacaattgttttacatctttcaactactgtttttaaatgtatgctttattgcaaatgaacccttagcctcctttggttatatcctacatcatacctcctcttccggtatgacttgctgagtacagtgagtagtacttagtcttgctctcttttcccccacaccagagttgaagttcttctcagttggagatgtctcgaagaagttggtttcgtcgctgccgtcaaggatgcctgtggaatggaatcgctcgctgcaggagtcaagtcttcaagcttagctcgcttttatcttttccgctgcatttgtaatcttttatatttttgtaagacgtggatctgtatgtcaataattgtcgtttgtgtaccctggttggtcctggacaagggtttaatgcatattcagcttagaaattctggttcgtgaatttctaggcgtgacaagttggtatcagagccgaccttgaccgtaggacaagccaactggaaaacctaaaagccctctgaaaccttttcatctgcatatgctctttgcacttggatttgtttcgggaaaattttggggtatgttcttttgatttgtgggaaaaatcttggtcgctcatttaattggatttctcgactagggaaagtttattcggaatttattcgacagtcggtcgggaattattgggtgatatgcactaagtagtgtataggttcgatggggagattttatgcatatcattataactatgcatctattttatgcattaatttattgtttagtcagatgcattagtatctttatctgggttcatgaaaaatgttctatgcataaaaatcgccatgctcagttatttgtttgagtcatttgttgctttgtttatttggatttgagcatgtgttgattcctatcccttgtctattttagatgtcagacctgttcttcgatcgcaagcgtcgctccgagcttcagagtcgccgcccttagctttatcgtcttcttatttttgtttgcttgctactttccgtgcttaggtttgttggttgtgggttagtcggcggtcgatatcatgtgtcagtggtatggctgctttaattaggagttgcgtgcctctttttcggtgttttaatcaagattaagataattgcacctaaatttataagaaagattagtttctaagccccctgttttccttcatttttctcatatttctacatatccccctctagatggtgaagacaggaatggttcccgtgaatccaacaacgtcagtggcagcgaagagcagatcggtggagcacgtgccagtgatgtatctaacagcagttcatctccaccgcatgagaacccaacgatcgctcaggtgttggataatcagactcagatgatgaca

SEQ ID NO: 63505 - DNA, 6446 bp, Oryza sativa
atattattaaagtggccaatgcaaaaattacatacagttagtattttagagttatgacaatccaatgagaaggaaacacagcaccaaacaagtatggagtagaaatctctctcagcaaaaacttcaagcaaagtctaaaggagaaaagttcagggcctgttcggtaggactaaatttggctgcaatacagccatcagctacagtactgcgcatacaatctctacagcagcagcacagctgcagaagtatgacagccagacaggcccttagtaatcataccatgcaataccattcaagaaatcgaatgagaagtctacacagcctttgaattcatgagtaatcaagtttaaaacaataataaataaaatcaatttgttaacatcccaaatagcacaactggctaccacaaataatctatcagcacagcgaaaagcatgagaacatacccaacaggcagaggaattggaagtgaaccagtgaactctccagggccagcaattttcagagtagatccaaaaagaatgttgcactcactgaggaatgaaacagtacagaatggccgaacaaaatcatgactatcaatatgtggtgggatgcaatctccagggtcatatatattgacaatacaactgtctggtatgcaagtctttggtagaacatgccaccgtaccaatctcttgatcatgatcttaaataagctaggcatcggatcagaagcaatagttcgaataatgcctggtgggtttccattcttgtcctgtcatcacagattcaaaccttagatggattcacatgtgaattaaatcagtaccactgcagtatcaagctgatgggatcagaggataaaactagagtatgtaccgtggcataattataacagcatccaaattggattgttactcgccctttaccacgcatccacctttggggttccgtatacgtacgatctgacagggggatattatgcttggatttagatatacaaaaatacaaataaacaaaacatggcaaataaataaatgcagctgtgagcccaagaaaattcatgtgcgtatagcatttgtaaagcagaaagaaggaccttggatagcactaaatagagtaggcttcccaatatatagtatacactcacccaaataaggatgagaaattctattccggtccaatggcctaaggtgaatcaaacaggcttaggtgcttcagggtactctaaagtgtggccatttgttagtgttatactgggccctcagtagataaatagtgcatagcttgaatattaaattaattaaattgaaaagaagaacgcagatatgtaaactggaatgaaggtcaggcatctcactcaacatgttacatttacttcaatcgtggttattgtggtgtgcacgactgtaagaagcacagaaaatcatgcatgtctgttttaatatccatgctgagaacgcttatgcagcatataagcaaagaaaccaaaaacactcagagattactgtaaataatacattgaaacatattgaggtttacacaaatggggaaacaccattatgacagaatcatgtgtacagaaaacaatgaaaatgttttgctatccgctacgcttctcctggacagacagatttcggcagatgcttctgattgtgtagtagggtgaaactgtgttatttttgtcaaatatggctgattatgttatgatggcaatacctataatttatcaaataccatatttatcttcctgcttgaaatcacaaaagctaatctgctacttgtggtaggtagatccaatgatttagtagaataattaccaaaaaagtttgtagctttgagtgcataccacatagaacaagacatgagaaaaccaattttataataattcttcggctttctactttgcacgagaacactatacaagttccagttctacacgatagaactactgtggtgcatatagacatctaaatgtttgcctatgatccatatccccacaactaccatagcctaagtagcaaagcatgaccttaattacagctaaaacctttgcctaaaatttacataatcctgacctaaaacccttttcatcaagcatttctcaaaactcaagactttacatgaaaatttagccaaattcaactagcgccatagaaaaacatatcgaatctccatgcagcttaaatctcacctccaagctccccgtgcttgcccatctcctgaagatcgtatacgtagtcgacaatacgcttctgttcggccgcgctaaacacaccgcaatgaagttccaggccagcgaggatattgacgagccgaccattgaccctctcaaaacagatgaaatccttcctccgcaccacgttccggaaccgcctcagctcccgctgctccctcgtcagctgcacacccggcctaccagcctcgctcccttcctcgccgtcatcagccgcggatgccgccgcgtcctcctctgccgcggcggagagctcgtcctcctgagccatgtctgcccacgacttccgcgggttctccgccggctgagggttctgctttgctgctcctgctccggtggcagctgcggcggatccgagtcccatccgctgggcttgaacggcaaatgctgcgggtgagccgtagccggatcggactcccaccccgagggctcatgctgatcgatccgcggcggcgggcgacgacggggattcctcggctgtcagagtcgaggtgaacgggggggcgtaagaggcaacagcacaaaaaccctaactacggcgaacccagcacacgggattgttaccttgcgggggcagcagggaggagacgcggctgcggagggagtcggcgcagaaggcgcaaaggcccgcggagaggaaggggagccacgtggtgaggaactccccggcgatggcgagctcgtcggcgttgtacccctgcacgagcgccatcgcgtcggcctcgccgccggcggaggcggaggaggaggcgtccatcgaagcgtctctcgctgccgtgtgggccccaccctccctgtgcctcgatgtgataactagtactagtacccctagcttctagttgttggtatccggataatcctggccgtccgttgtacgatcggacggtctcgctggtgtgtgggccccacctcgctagtgctctacttgttggtatccggataatcctggccgtccgttgcacgatcggacggtcaggatcggactcagcgaggagaagaggagaaaaatctcgagatgaaatggacgcgtaacctgactccgattcggatcccccaccggcgagatggcacgcggatccgccgccgcggcgatcgccggagttgtgtggtgcttctcctcctcgtgggggtggcgtcgggggcgcgtcttccgggcgggagcgggggtaaccgggggcgggagccgcgcgggggagcggcggcggcggcggtggccacggagacggcggtgttcgcgctgggaagcttctggaggtcggaggccgcgttcgggtgcctccccggcgtgatccgcacctccgtcggctacgccggcgggtccaaggcccgccctgagtaccgcaacctcggcgaccacgccgagtgcgtcaaggtgcggtgcggagactcccacgcttatagctgttcttgatcgataccatgaaccaatgatatgtccagttccatggtcgtagcaattcatttccgtagttagcatcgtaatctgattggccattaccatttcgtatgtgtaagttaaaaactgaaagaaaatactcgcgagttttcatttccatcgtaatctgttttttttgggttccaagtttcattttcattgctaaatagggatcatttccttaaaaaaacaaaaggaatgttctatgttcaacaaggacgattcatcctgccagatctgctttttgtgtgtattttttgtgcataaaccatcggaaatgtttgtccgttgagtgcttcattcaaatgcatgtgtgtgtgtgtggtgtaggttttggagtggtaaactggtattaatactttgcagggcctccttataaactaactttgttggtgttttatgagctaagatgattgacatttttgagtcatttaggttgaatatgatccccggttgattcagtacaagaaactttgagaggtcttctgggcaagtcatgatccacgagaggtctttgggcaagtaccagatgttgccaagccaatacaggtgcgttagttttattagcgcacccccctatgtgcaatagatcagtttgttcacagtttaccatagtcagctttacattcataaccaggtgacaattttgtattcacatgtttcatgtaaaacttagactggtttccaaaccagcatttagcatatggtggctgataagtttcacaacaaagcgactcagaattgagaggcgtgcagctcatttcctcgccttagtctctccagccccaagcaaggacctatgtgttcacaacgttgccatcatggcttaggaaataatgggtcactgcatggtgtagctgtcattctcactagtttgataggatcctcagacagcactgtaatgcgtcaattttaattcttgcttacttatgtggtcacagatccatcatcttcacaaatggatccgtggaagctagattggctggtctaagcaaagaaaaagaacaagctaaggatcgccgcagtgtcattaccacacagatccaaccaataggtgcattttatccggctgaaccggaacatcaggtagcaatcccatctgaaaattcgaactcaccatgacattctatggtttatttccttttagttattgcttgtactttggtaaaaatttgagctgaagcgcaagccgtttctcctgcaactgattgggaacctgcccgaggaggagctcctgacctcaacactagctgcaaagttgaatgcatacgctgctgagctctgctccccaaatacccagaacagaataaactccaagattgatgagattgctaagaaaggatggcccatcctaagagacatttagctcggtgttcctgggttttacatattaatatatcattatccaattgtgcatgattttgccgcaaatcttgtccagatgactggttgtggtcattccttggtcgcagcaatcactaattagcgttcatgtcctcctctgctcattttgagatctctctaatagaatctgcatgtatatccaaactttcgagttgtgtgatgtgacctgaaatcctgaatttatgattggttcttacagaacaggtgccgaaattgtatattgttactctggctcttttatgtgtaaaaatatatgatgtggattcattacattcttaatcaaaaacacttattcccatggaatgctaagaattgttcattcttttgaaaacaaaaatcacattttgttcttatggattttttttcacagtttgctcttcggaatgagtaatgggctaatggccacagtgaaatggcgccagcaacgctatactagatttttcttgatggtacaattgcatggaacacacaatctacaggtggaacataagaccctttttttgggaaacatttcgctattgttgcaacctcacacagctaagcagagactagttatttacatgctccatagaaggaagagattattttgcaaggctatttctcagaaacattctaaacaacaagtgaagacacaaatgcacaatggtcagaggccactaattgggttgctgcttgactctttttgaaaccgttcttggccaaaccatggcttatttcctttttttttccccattttcatcagtcctgccaaaagcgacgttggcctgtcgttccaatgcttccctcacaaaaaatttcaacctccaaagggttgtctcactctgcacccgcataaaaagcatggttagaataaacaaattacccaaattattacgagaggtaagtgtttggacagcacatataaaataccttgaccttccttatcaagttccagttcgtcttctttaactttcaaacctagggttgtcttgggcaaccatttccaatgccttataaagcttttttggaaacagggggcaaaaacctgcacccagtttttttttctcatatgtagtcattttcctacaacatcaagattttggcaacatgccacgtgcatgagtttgacagcagttgcaacttataaacagcagataattaaatcgataggcaacagatgaacatttgtaagatgtaccggcatttctggaccaccatttgccgaagctcctccaactgcttgttgatttcaatcagctggaataagaaaccaaagaaaacacacttaatatctaacatatatcagaacattagtacaaggaatgaagacaaggagttgcagcattttgtgtgtcagccttctagaaaaatcacaaaaaggtatatccatatgtcaggaactcaggatat

SEQ ID NO: 63506 - DNA, 2524 bp, Oryza sativa
accactaatgggcgcataatcgagtttagggacgttaaaatataatttgagagtataaggacctagatgacacacctcgacaagtttgaggaccgtcgatgcacttcactctaaagaaaaactagcgagtcaattgcacagcggtcttttatccggacccgtgccgagcctccgctcatgttccgattttccctgatccgaccgatagcaaaaagtaaaagtatctgcagagtcatgtatacgtaaatatgttgtcatgttccatgtaaataaaaaaaatgatcacactgtagtcacgcaaatgattaatctgtcatgggcacgagtgggtataatgggccgaaaccgaaaaaccaaaccaaacatatcgagaccgaaaactcagtccaaaattcgggtagcaactctcactgtccgaatttatattgtgtttgaaagtgagtttgattaagctattaactcgtttaccgtgagcatggttcttacgctactaaacggaatgatttcttacaaatatttttttatataaaagctttcttaaaattaaataaatttattttcaagtatgtagtaattaatacacaattaattatatgataatgacttttttacgtgccactaaaatataaaccaaactgccgatttaatggtcaattcggttgtttgtctcggctaacccaaatattacaccaagctgctatcgtggtattgctatgatgctatcttcacagtttggtgtgttagacattgtattattgtcgatgggggatacccataaaccggatatagagtgtattggagtccgttggtacgagaatctacgtagtacgacatcaagcaaacgtaagacaaggattatactagttcagtccccttagtaggtagtatccctaatccagttggtataggattatatgatggaaaccactgattacaaagggaataacagaactcgatgataccgacgagaccgtagtcgagttggttcgactagatctcccggtgacttggctcctgtaggctctggctccgtaggctgtggtaggtgtgttggcggggagattcgatgccttaagtcctgcctgagggtcccttatataccgcgggtcagttgatctccaagtagaactcggagatatcggacccctcacgatatggtaaaaacccaacctcgtccgagtaggactccacccatccgtagattctgcttctatcacgggatagatttccttgacgtacacggaaactatccatatacgcgcgggttatccatgttagtatacaacatatattaaggatagagggtatactttatccataaccctaacaattattatcttgtaatattttactatgaaaacattggtccaacttgtaagagaggcaatgcttccaacattcatttgtaatttgtgcaattatttatcagctattctatatatttaaatttggataaccaaaattttcaaaagacccaaccgaattgttcggtcttaccgattaccagtatcattactacggatttgaatcaggtgtagtcggtacgactacaacttatacagtcaagagggtgatagatccgaatccaatgttcaaaatacgtttgtagcccactatagcaaaaattgatgggtacttttcatcgacactgtagctaatgatctggtcaattcataaaaggatgggatatctcctattgtgtatagtaccttaccttgcagtcctgccgtgttctttccggtgagtttctaactcatttttctcgtttttcgcgtgcacgtttttcaaaccgctaaatggtacgcgttttgtaaaaagtttatatatgaaagttgctttagaaaatcatattattttatatttaaaagttttttatagccaatacttaattaatcacgtgttaatctgtcgctctgttttcagtacggaacaaggagttctcaaccccttcgaaagaacacaccatagtgaaaccgcagggaatcccaatcccgttacgacacactgctgcattcggaagagagcagtggaagccggtcgactcaaaacttctttattgatgcaagcaccaacgagtgcttctccggagaaaacgacggtgacgggtggccgacggcgcgggtggagtgagctgctgagccaatcgagtcggcggccgacggggacgcgaaccatcttatctcatctcacggcgacaaggtcgaggccgtacccgatcggccacagcacaggacgccgcgaaataatgctgtgtaatgctggatcagtcaagtcgacgcccgcgctccccgctgctgcaagatgcatggcaccttcttctcttcttgactagtactgtgaagaccaagggcaggactgactgatgagtgaccacttccacttgatcttttcaaggaataggacggcaatggccttctttagatcctccggggttaaatagctatataaaatattgctatttaggagtattaaacataaattactgacaaaactcattccataacccctggactattttgcgaga

SEQ ID NO: 63507 - DNA, 646 bp, Oryza sativa
atccattttaggaagtggctgatgacgccgataaatcccatcaccaaaaccacgacccaaatcaaccccatccaacacaggaggaacaggtggattcaacggcggaggagtcgcggaacctgcaccttgccgacggaatccatggcgagatccaccttggtagtcaccttctcgagactgccaccttgggaatccagccgctgatcaatctcgtgcatccactttgtgatgccttccaacttctccaagagtttggactccatggagtccattagcttgcttcaaaggggctgaaagttttgcgggcgccgtggcgaatcagtaagaatccaacgcacggcgacgcccacaacctggctctgataccactgtaacactatgccaccgcgaaactcgccgccgacgagagagagagatttagacgagatcggagttggggacgaagagaaacagagctgaggcagaggagagatagagtttggagagagatagattcgatttcttttgccaggttggccacagccattctctctcttgagtatttatctcctgattacatgggccattggcccaaacgatttaaggcacgcaggccgcattatatttgataaagtctagcccaaaacacacacactatcattcacag

SEQ ID NO: 63508 - DNA, 7546 bp, Oryza sativa
gcttacaaacattcattcacctcattttcaactttaggaagaagctggagccatttctcttcaaatttctcaagcaatgatttcgccattatatgaacatcatgtcgttcatcattgtacttcattgcattggcaaaaattaatctaacatccgaatatatttctcggacattgttatacttgttgtcatctttcccttccattttcttttgtatggtcgaaaaatccataggtttggtgataatctgtaaataagacaaattgaaaacataaatatcactacaaactcatttcagggaggcataatatagtagtagtagatgtccaaatcaacactgcttgacaagcgcagagcaataaatatcacccaaaagaaaaaagaatgccatttaactgagatgtttatatttatatatagcaattggaggtctcctacaagctcccacgttaatgctattaggggggaagctggaacacattagcccatgaaaaaaggggggggggagggggggagtacaaataaccacattaatctgaaaagggaaggaaaagaaaagatgctaagcgttcatctgagaaacccatggatactctacaatagaacagatctactgtgtaaggaaacatctgattctgctagaaaaagaaaccaccgagtgatgtacactataagcataaaagaatcaatattaacacaccatctttgcatgtctgatttttgcaggattaagcaataaataaacagatagtagaagaggacaaggtagtaaaaaatgcctgacgcgacctgtgaaacatgaaacacaatccaaacacgcatagcacacatgtgcatagctgcgaatgaatccatgtttaaataggaaacaaatcaacaaagcaatcattagacaagagtacagcataccgtgcggtcatacctagttagcaagactctgcatagtcactacattgccaataaattaaacctacatggactcaaacacataggttctaaaaaggatgtactttataagaggtatttgcatctataaaaattaagaacgtgctgtactatcacaatattgcatatagtaggatagaatgcgtacatgattattatgtgccatatatgcagatggaataaatcattcaaaacatttgaaataaaacgggcaagaaactttacaatttagaactacaaaagtaaaaatatcaagggatacaagaattctaaaaattatctgaaccatcgaaatatatgaactctaacaagaaagaacaattataagttcaagattaatcaacagaccatctggcaacaaatgttggtgcctgagccaagaagagggtcaaaattcaaaatgcaattatttacaaataagtcagcagaaaccatgatagaattagatttatacaatttactgaagattacaaaatcgagttaacagtaatttattgccgcacatattcaaaccagaagaataaatacagaaaatgaatttactttccactatttgccatattgaaatgtttgaattaaaagcttgtgataagtttattatagcgttaatactaaagctttggtccaaaataaaatcaaaggttgtgtttgactgattagaattcatacatgcatgttcttcaacaataaacggacacatatacacacacaaaccttaaacgtgacacggtagataatttgttatagatgtataattactagctcatgtgggtgcacagattctgactagttcatttaatcggttaccaagaaataaaataagtgtccctaatattgcaggacacatattgccaaatctgaaggatgcatccataaaccattaggattgacaaatcaatgctgcattccaagagtccaacatcattttggtcgtctgtaatcctaattcattatatcagtgtggaacagtgtcacaagtcgaacaagcgaactcagggaagagagaagagggggttcactctgctagcaaatacaagatgaaatgtgctagcagtattaccttgtaatagtcatcaagctgaaggcctaccacatcaaccggcttgagaaatggctcggcccattcatgagatgtgatctggaagaaaaggaaatcaagaaaaatattgagtgcatatcatgcgcatttcatttggaaagctagtagtgtgttttgagtgtcgagttcaactacgatcaatcaatatgaatttgagaggaaacaatggagcaagaccatacaaatttatcagcatatcatcaagctagatatatctgtctattttgaaggatgttttctatacatggttatggagcaaaattagaatcaaaactagcggcagaaatcttaattaaactgcacttatttatcattggaaataacagtagccacacgtgcacaagaccggacaataaatagctttctagattttttttcagttagacctatcaggtacagtagccatgcactatccaaaattagcctgcaaattaaaagcttttgcaccaagcacattctgaagcatgattcaggatacactaaatactttgagttatccatgccagcaagcaagaacaacatagatcaatgcatttgtcggatttttcttttttttttttcctctcgagatgtggttaagaaagatcacctggcgcacaatcgtgccaaactggcgcataagatcaggcatccctttggaaaggctgctatccttgcgaccagccttccggccaccactgccatgtttcttcccgtcgtagaatcccaccacttcattcaccctcctctccagctgcaatccacataaatctccaatcaaacctctacgccccaattatccgaatacaataaatgcaaaacaaagaaaaaaaaactgtaccctactgtttccctaaccaaaatccccaaaaccgcatactacagcgaggcgagaaggaactcgaaaatccttccgctgaagaatctcatctaccaggctaagcagcgagacggactacttccaaggttgggggagttggtatttatttacctggtcggtcttggagacgaggtcctcgacctggcgccggaacgcgtccacctccgtccccggggccctctccccggcggcggcggcagtggcggccgtctccgccgccgccatagccctccctccctccgccccctgtgggactccacctcccggcaccatatctagggctcgccgccacgcgcgtcgccggcggccgtctgcgagcgaaaaaggcgaaaccaccggcgcctcgactcgacggaatctttttttttattttttttcctttttttttgccccgcatctcttcttcccttcaccttccgaccctgtgggccggatgggatgggccatttcctgggccggaagacttcgccctgcaggatgtgggcccaaggtggggcggatggaattgttgggcctagtcagcctcgtgatttgttaacatgggccggagaaaaggctggggcgaacggtacaggggccgtagggcacacgtggaataagttcatatgagttccttaacttgtcaacgaatccgatttttgtccttaaaccccaaaaccagatataacggtccctcaactatcaaaaccggtgcagataaggtcctcgacggtttagatggcgattttttctgacgtggcgcctacgtggctattttgactcggtcttcatctgacgtggcgcttacgtggcaattcgatccggaaaaataataaaaccagtggaccccacatgtcagtttcacacacaaaataattaaaaatggtgggacccacgtgggccccacatgtcatcttcactcccctccttttcttccttttcactccccatctcccctcttttcatctcgccggtggctgctgggaaagaagcagcgtgtgggcaccggccgtgggctccgcccggagggaggagaggagcggcgcgcgcgggcgtcggccggagagaggagagaagcggcgcgcgcgggcgtcggccggagagaggagagaagcggcgcgcgcgcgggcggcggccggcgagaaaggagccgcgcgcgggcgacttctccctctgcttcctctcccgccgcccctgaagacgacgacggtgacgggttcaacgaggagaaggacgagcacctcaccatcgctgccccgcccccgtttccaccgtcctccgcgctgcccaccgacctcgatgacgtcctcttcttcctcctctctccagaaacccacgggtcacgggaagttatgcggccgacggcggtggcggcggcaggtcatcagcaagtttttctacagtgtcgcgaacaacaacataggcagccgcgcaaagaaatcccatttgcctcattccaccacctagtgtcttcctaagaattttagcctgaaagtccatatttccatcgttacataccatctgcagtttaaggtaacaagttaacaagctcaattgaacagaccttctctatgaaggccgccgaaccaacatcaactgatccaacaggaactcctaagccttcatatatgcacacctgcagtgcaaatttccgtggaactacttgcaccgctcttcagcgacctactgcggcgtagacctgccgacgccctggtccgtgtagtcagaccgcatcttcccggaggctgtcacagttgacgacaagctcatcatctgcctcgatgacggcagtcctccacgatgatctgaaccgcggacgcaaggagcaagcgtgcgccgtcacggacgccgcgcgcgctggcgtggctcaacgcgaagcctacgcggtcggtggtgtacgtctgcttcggaagcctcacccggttcccgcacgagcaggtcgcagagctcggcatggggctcgctgactccggcgtgaactttgtgtggggtcgtcggggataagaacgcgtcgccgccgcagccagggtcgcctcacgccgccccttcctcttacgcccacagccgccggagcgtgcctccgccgccgcgcgccgcgggccgctgtctctccgtcgcgagaaaggagatagtaggagagagatgaactgatgaagagtggggagaggaggaagaaaaggagggctgagatgacacgtgggcccacgtgggccccactatttttaaattaatttgtgtgtgacactgacatgcgggtcccacaaggtttattatttttctaaatcggattgcccatgtaagcgacacgtcaatgccacatcagatgaagaccaagtcaaaatagccacgtaggcgccacgtcagcaaaaaccactgtccaaaccgccatttgcactggttttgacagttgagggacctgttgtatctggttttgtggttgaaggacggaaatcggattcgttgacaagttaaggatcttagatgaacttattccgggacacgttgctacttcgccagagagatcctcaacggctcgattgtcgcagtctcgcagagatcaaattgctggcaagaagtggcaagaagttttatttgcggtttttttttttttggcggggaacggtttctttagttcaagtaaatggtagtacaagtgctaaatgaggtggcttatatgttagctagatcgactactggcatggtattcatggttgtatctatgaacttgtaaactctgaatttaggaacttgtaaactctgaatctttatttgaatgaatgagcccaccttgatttaccaaaaaaaaaaatactcactagctgcttgatttgaatgttcaagtgggttgatagtgatggtgaccatgagtccatgaccgtgtcttggtgcccacacgtgacacgacagtatcgctctcgtagtcgtaggcgtacgggtataccaacttggttacaggatactgctcaacttggctgcctttgccaaataactcttcacatgccaaatttgcctatcacccaaccatgtacgtatgatgaactactaacttttcctctcttttttcaataataacttctaactgaccaaacgattgatatgtcaataagccatggacttgttattctggtttctgaagataaacatggaccagctttcaaggcctctttggatcgcaggtgccagatggtttcatctgaaaacgaaaggtaatcaaatgaatcagatctgggtgggcctgttaaactacagaacagaacagatgctcctccttatcaattctgatgatgcgtcggtggatggatcagtgaaagtcagcttcacagaataacagtgcctgactacttgtataatccggtgctccgtcttcataacacagcctgaatcggtgaattgtcaatacgcgctgtgccggtattcaacagaaagacaagtcaggtgctcatgacaaaggaaaattcattgaggacaaagtacattgatcacagaaccaaatgccacttgaacattttcaaagtcagatatagtaaatgcagcaatacgtacagtatgtttgtgatttgattcacaatcggtatggaaatattcatgtttgaaagtaacttacacatgaccatgaatttgtagttgtgaaatgtgaagaagtcttaccctcacaatattgaagatcatgggcaggacttggagacttgaaatgcatggcattacttcatttacatggtagggcgaactagaatatttggttcacataatcacattacagaagatgcacaaaaatgtgaacaggtaaaatcaccttgaaaagaaactttagttgcaatatgacaacagaaaacccataaaatcccaaatcaatcagatgttgcagatgagtgagcaatagctcatagtgtagcgtacagttatcaaaactgagatcttgcattgttcgacaataggctcagagaagagctgtctgaacaataagattgatgctaacttacatccaatggaaactatgctgattaacaataatagtacagacaatcatcatgtccttttcagttcctaagaagctcaatcctcatctcaaactcacaatccatgacagggacaccaaagaaaaccaaaaccccgccaaacaaccgttaagtattttggctgctgaaggtcaatttaccaccatagacaggatacaaagggaaggcaatacaatactcacaatgcttgtcctgaaggccattttgtcacatatgtcctcccgccttacatgcaagatacgaaactggtgctgactttttatcagatatgccatccgtaaacttcaggaacacatagtttagacccaccaagtcacttacctagatcaacaaatgagggcttgagtccaagatttccattgaactacaggccaggagttcagtacattctatcaacatgagaataatatggacagaagattcatttttccaattgtgcactaaccacatgttacaaagtgctaagagaatagagatggcatcgatccacgatacagaaggacaaatcttgtttcatagtaagacacataactacacatttctttgcaaatggcatcgactcgtttattattattatctgttaagaggacacagccatatgacatagtaaaacgtaatgaaaagcactatatgatcgatcaaacagcaac

SEQ ID NO: 63509 - DNA, 18227 bp, Oryza sativa
aggacatatcgcatcctatgttagattgaggctgtgtttagatctaggggtaaaattttttgccttgtcacatcggatatacggacacacatttgaagtattaaacgtagtctaataacaaaacaaattatagaatccacctgtaaactgcgagacaaatttattaagcctaattaatcctcattagcaaatgtttattgtagcaccacattatcaaatcatgaagcaattagacttaaaaatttgtctcgcagattagccgcaatctgtacaattagttatttttaagcctatatttaatacttcatgcaggtgttcaaacgctcgatgtgacaaggtgaaaaattatgaggtgggatctaaggcatggtttagttcctaaatttttttcccaaaaacatcacatcaaatctttggagacatgtatggagtattaaatatagataaaaataaaaactaattgtacagtttgcatggaaatcgtgagacgaatcttttgagtctaattagttcatgattagccataagtgctatagtaacccacatgtgctaatgacgtattaattaggctcaaatgattcatctcgtggtttccaggcgagttatgaagttagttttttcattcgtgtccaaaaatccttcccgacatatggtgaaacatctgatgtgacacccaaaaattttcttttcacgaactaaacagggtttaaaacatggcctgaattttttgggttagggtgtgtttagttcacgccaaggcctggtttagttcccaactttttcttcaaacttctaacttttccatcacatcaaaactttcctacacataaacttccaacttttccgtcacatcgttccaatttcaatcaaacttttaattttggtgtgaactaaacacaccccaaaattagaagtttgattgaaattagaatgatgtgacgaaaaagttgaaaatttatgtgtgtaggaaagttttgatgtgatagaaaagttggaggtttaaaaaaaaagtttagaactaaaccattccttacagggagcatcctgctgctgttgctgtcgcctgtgtgtgtgatgtgagcacctctcatttgctaccatgttcacgtgctagcacagcactagcttagcaatgtgtagcagcagcacgccagtacgagaaggtaaggtgtgcgaaccgtgcgagacttccactgtgaatatgtgagaggggcaatggcatatgggaaaggagacaacacggaactgggacaaaatctactagggctgtgttaagttcacaccaaaattgaaagtttggttgaaattggaatgatgtgacggaaaagttaaaagtttgtgtgtgtacgaaagttttgatgtgatggaaaaggacacgactacgcgtcggtcgtccgacggggagcggggaaatcgggcgctgacgtcaggatttatgtgcaaaactattttaaactgatttttctcttaaattaattatccaaatcatgatccgattgcactattaaatttgttgcaattaaatcttttaaacaagaccacacatggatatattccgacgaaaaattttatttagcttattattgaattatttttaaatgttgcacgatatttcaccaagtatatcggaattgtttcaataagcacatcgaaaatgtttcactcgtttaaatcggatgttgtttcaccttatataaaaacaatgtttcagcaaatagcgaaagaatatttcagttcactgtaaaattagatctatacatagtgaaatattataagtacactaggtgaaacatttttcggtggaacaacaaataaaatgaattcccttaatagggggttttcaaaatatatgggttttctattgcaatggaatatttcagttcactgcaatattagatctatacacagtgaaacattgtgagtacaataggtgaaacatttttagtagaaaaaaataaaccaaattcccttaatagagaggttctaaaatatatgggtgatttgttgcaacggtagataggagcatagacatggtggggccaggcctgtatgcagcgcgtggggggaggggcgcgcccgggggggggggaggggagcgcccgatccggctaccctcgcgctggacgaccgggtttaatcattctcgggaaaaattagaagtttgaagaaaaattttacaactaaacactgcctagtttgtagtgcatagggttgtgattgtacctgccgggttcccatttggagggtgggagagagtgggagtgccagtgcagttctatctccccatgtaggagtactacaattccacgcatcaatacgcacaagccttcctatcataggctcatagcccattctctctcttctcaaaatatacttcatccattttatattataattctctttaaccgttttataaaattcttttagtttgatcaaatctctactataataaaaattaaagatgtttttaccggtattttgatatgtcatctttatttgagtcggtttttaagtttgttcgcttttgaaaataaagatccgtgtttgagtcggattttaagttcgtttgttttgggaaatataaaaggagtcatataagaaatctcttttaaaaaaaactcgcatgctaacttgagatgaaagttagactcttaattgcagctcatgattttcttaaaaaaaatccaagcgaattccaaaaataaattttatcctagctaaaccgtataataataataagattaaaatagcattcaccggttgaaacgcatgggcattttttcttgtgtatagaaaaatttagctttttctgtaacaccaaactactttcattagatgtaacgttgaatatattttgataatacgtttgatttatgtagaaaatattactatatttttctttgaatttactcgaaaacttaaagtgacttacaatatcaaatggagggagtagtaatctaggactgaatgagacaaatactagtgtcagggttacgagtaaggtgtaccctctacccttcgatatacgtcatatatcgatatggtatatttgcgcgtatacggacgttttcggcatacgttaaggaaattcattatggagttcacagatggaaggagtcctactcggatagaactgggtcgtcattgtatcgtaccgggtccgatgtctctgagtcctacttggagaccagttgacctgcggtataaaagggaccccccgggagtacctaaggcatcgaatcttaccgccaacacatccaccacagcctacgaagccggagcctacaggagccaagtcgccgggtgatctagtcgaatcaacttgactatgatctcgtcggtatcgtcgagttccactattccctttgtaaatatgtggtttctattgtataatcccatatcaactggattagggctattacctatcaaggggcctgaaccagtataatctttgttttctgcctactcgatgtcgtattacgtagatcctcgtaccagcgtaccccaataccctctatatccagtctacgggtatcccccgtcgacagtggcgcgccaggtagggggacttggtgctcaagattctactactgtgacatccagcttcgtcgacaacagcgtcaacaccaacctcaaccaaggagttcctacttcaacgatgctagtgtggactcaagtcggcgaaatcgtcttcccggtttacaccacggtgccgatctcagctggtccatcaatggccggaaacgagaacgcagtggctacaacccagaacgattccatgtcgaaggatcctcccgctgaagcggagatcggaacgtcgacgacatccgagcccgagaaggatcctagtgcggccaaaccttgcctttccgacaagaatcacgagccgacgaggatgacttccgaggtgacaaggtcctggtgtcctatccacaaaaccagaaaacacaccttgcaagcctgttgggtttttctcaacgtccacgctgaaattcgtgcctgcaaagagcgtggaattcagcgtacttctccaactcgtgatgtctattgtcctattcacaagacaaataatcacgacctctcaagctgcaaggtctttctcagcgccatgaaaacgtcacctcctaaggtccagcagtcacacatctccctcagggatgaggacaaggaacaaggagcgacgctgatttcagatcgaatggttggggtaatcggcatcgatccccacgaaccatcagtcttgtacctgctcgaagactatggctcatcgtcaacgagtacgccgcgcgaggtattggctatcgacgagaccggcacatcagcgcgcgccaatgcggaagcggagaatcaagtgactacaccggcccagcacatcagggccgtcaacgtaatactgagggaaaccccctacgatcccgttctgaacgacgatcttgcacgatggacagaacggttacaggaatcagtgaccaacccggaacagccaccaactggcgatgctaatggtgaaaaccctgaacagcgggaatcgcctcatcgagtcacccctccacctcgcggcaccggcgatctccgcgatcacctgaatggccgccgagaggcgcgacgcacacgagacaacgagaaccgttcccgacatcgcgtctcttcacagcgtcacgataacgaagaacgaggaggccgttcgagcgaagaccgagaccgtgataaccgccacgatcatgacaatcgcgaacggcgggtgctgggcgatactggtcgaggacgtcgccataatgatgacgatgatggagatcgccaccaagacaacaacgggagacgatgataagattctcgagaacccggccgacgtcctcataatcgtacgccggagccaagtgacccatcgtcatcgtcgtcatcttcctcatcctcatcatcagatagacatccacgaaggacgtacgatcgccgacaacccaccgcccccagcgctgggtgtagagctttcggtcgttcacttcgagatgtccaatggcctgaaagattccgaccaggagcaatagagaaatacgatgaggagtaccgacccagaagaattccttcaggtttactccacggtactctacgctgccggagcagacgacaacgcgttggcgaattatttgcaaaccgcattgaaaggctctgcgcgttcatggctgatgcatctccccccctactcgatttcttcatgggcagacctgtggcagcagttcgtcgccaacttccaaggaacttacaagcgccacacgatcgaagacgacctacatgcgttgtcacagaacccggatgaatccttgagggattatgttcggcgctttaatgagtgcaggaatacaatccccgagatcaccgacgcttctgttatccgcgccttcaagtccggtgtcagagatagctatactacctaggaaatggcaacgaggcgcatcacgactactcggagattattctaaattgtcgatcgatacgctcacgcggacgacgcactgagacgcaagaatgacaaaccgaagaccggaggagagaagaaaccagtcaaagacgcacctgagtcgagcaagaagaaaaatcgcaagagtgggaaaaggaaagctcaagcggatgttctcgcaacagaatacatggaccctcccaagcgcccagacccacaaggcagcgacacgaagaaaacatggtgccctatacacaagtcagacagacactctctagaagattgcctcgtcttcaaaaagtcgctcgcaaaacacatggcattgaaaaaaggcaaacgagtacgtgtggtcgagaaggacgctgaggcggctactcaggaatcggactcagcataccagactccgatctccatgtctcgcacatcttcggaggttccacggcatactcctcaaagcgagaatacaagaaggtggaacgtgaagtctattcgacgtggcagggggctgcgcccaagatgaagtggtctgagcagaagatagaattctcagaagaggaccaccccaagactgctgtcatcccagggcgatatccgatcgtggtcgaacccactattcggaatatcaaggtcgcacgagttttgatcgacggcggtagctcaatcaaccttctcttcgccagcaccttggacgcaatggggatcccacgaagcgagttgacacccaccgatcaacccttccatggaatcactcctcagtcatcgtccaaaccattgggcaaaattacgttgcatgtgactttcggccaagcaaataacttccgaacggaacagatcacctttgatgtcgctgaattcgatacagcatacaatgccatcattgggagaactgcactcgcgaagttcatggccgcatctcactacgcgtatcaagtgctcaagatgccgggaccgaagggaacaatcactattcaagggaatgctaagctggcagtgcaatgcgacaagcggagcctcgacatggtcaagcacacgcccagcccacccgtcacagctgagccacccaagaaagtgagcaaaacaaacaagacaccgaaaccggacggcgcaatcaagatcgttccactctccagtgccaaccccgacaagaccgtcaagattggggcatcactaggcgagaaataggaactcgcgctcatcaccttcctccgcgacaatgctgacatgttcgcttggcagccgtccgacatgccgggggtacccagggaggtgcttgagcacaaactcatggtgcgacccgacgccaagccagtaaagcaaaaactatggagatttgcaccagatcgaaaacaagcatacgagaagagctcgacaagcttctcaaagctggtttcatcagagaggtactccatccagagtggctagccgacccagtcatggtgcggaaggccaacgggaaatggagaatgtgtgtcgatttcaccgacctcaacaaggcgtgtcccaaggatcacttccctcttcctcgaatagaccaactggtggactcaacagccggttgtgagttgttgagcttcctcgacgcttactccggctaccaccaaatcagcatggcgaaagaggacgaggagaagacggcattcatcacgccgttcggggtattctgctacgttaagatgccgttcggactaataaccgcaggaaacaccttccagcgcacagtccagggtgcacttagcgaccaactcggaaacaatgtcgaggcctacgtcgacgacattgttgtcaagaccaagacaagtgactcattgattgacaatctgcgggaaacgttcgacaacctccgacggtatcgcctcatgctcaatctagagaagtgcacgttcggagtaccatcgggcaagctactcggcttccttgtctctggcagaggaatagaagcaaatcccgagaagatcaaggcaatcgagaacatgaagtcgcctacaagactcaaggaagtacagaagctaaccagatgcatggcggcactaagcaggttcgttgctaggatgggagagcgaggacaaccattctttgctctactgaaaaagcaagacaaatttatatggacacaggaagccgaagagccattcattgcactcaagcgctacctatcaaatccacctgtacttgttactcaagcgccactactttcaagcccacagggtcacagttgtatcctccttccctctcggtgaagtagtgagaaacaaagatgttgtcggccgcattgcgaaatgggtagtcgagctaagccagtttgatgtccactttgtgccacgaacagccatcaaatcccaggtacttgccgacttcgtagctgattggactatgcctgataacaggtcagacaaccaaatcgataacgaaacgtggtcaatggcgttcgacgacgcactcaacagccaaggagcaagggcaggattcatcttgacatcacctttgggagatcaattcaagcatgcaattcacctcaacttcagggcaactaataacacagccgagtacgaaggactactcgccgggataagagctgcagctgcactcggagtcaggtggctgatcgtgaaaggggattccgaactagtcgcgaaccaggtgcataaatattacaagtgcactagccccgagttatccaagtatctcgcagaagtcaggaagttggaaaaaggttcgatgggatcgaggtccgacatgtataccgcaaggacaacattgaaccagatgatctagcacggcgtgcgtccagacgagagccactcgaacctggcacctttctagacgtcctgacaaggccatcagtgaaagacgcaggcggcgaagatagcccggtctccctcaacaacagctcgggggctacagaggcagagcgcgccgttgccgatatcgagaccacagacgactggcgcaccccactcatcaaattcgtaggcagcgaagagttgcccgaggacgacgcagaagcctagaaaatatcccgtaaagcaaaagtctactgtatgatcggcaatgatctataaaagaaggcaccaaatggggtactcctaaaatacgtctcgtccgacgacgacagacatctcctcctcgacatacatgaaggaatctgtgggtcacatgccgccggtcggacattagtcggaaaagcttttcgagaagggttcttctggccaaccgccctcaaagacgcctacgacatggttcagcggtgtaaagcctgttcaatttcacagtaaacacacagggctaccaacgcaagcactccagactatccctctcacttggccggttctggtggtgggggttaaatatactcgggccattcccacgaggacagggcggctacagattcctattcgtggcaatggccaaattcattaagtggatcgaagcgacacccacgggagaaatcaaggccgacaacgccatcaaattcatcaaagggatattctgcagattcggattgcctcaccgtatcataacagacaacggctcctagttcatcaatgccgatttccaggattactgcatcaggctgggagtcaagatctgtttcgcctcggtttctcaccctcagagcaatgaacaggtcgagagggcaaacggcatagtactacaaggaatcaagacccgcgtctatgacaggctcatgtcacatgacaataagtgggtcgaagaactcccatcaatactatgggccgtgcgtaccacaccgacaacgtctaacaaggagacacccttcttccttgtgtacggctcagaggccatgctccccaccgaattacgacatcaaagtacacaagtacagaaatattccaatgaggatcaggaggaacagcgaaacgacgatgtgaatctactcgaggaacatcgcgaacgagttgccgttcaagcagccagctaccaacaggcccttcgccattaccacgagaagcgcatccgagcacgcacactttcgatcggcagctacgtcctctgacgggttcaaagtcaagcagggcgaaacaagctctcacccaaatgggaaggaccgtacacgatcacacaagttctgcggccaggcgcattcaaaattgcagacggtgatggtcgcgagttgtcaaattcctggaacattgatcaattacgtaaattctatgtataagtcaatagtatccatgcttgtaagacatcttacagcttcaataaagcctattttcaggtacagactacaatcaaagtgttccttcccgatgatcccttacccagatgacacctagtgttgaaacctatcctcatgtccctttacgccgtcttgacaaggcctccgaggaacctaagggaacttcggctggggacgcccagagccgataaggccttgtcggatcctatagagacgaaagaccatgtaagatctggtcgtgtaagagttctcgccgtgcgtattaaccaagccgtgtaatcggaaataaactttccaacttcacggctgggggctaggatcaatgcttgttcaaccgaggcaggtcaaaggtccaagagccttatcttccgagaagaattctccgatgacaaggctgggggctagggagagtgtataactcaaacgactgatcgaagtcgcgaagtgagaagacactcatacacgctacatccagagtaagaaagcttagttagatagatttcttttctatttcacaagtacttcttacaattctataaaaatccaaaattatattaaacttttcccctaagacatttgtcacaagacacggagaccttttccgccagcggcgccatcgacttcgccaggccatctatctccgtaggagttctccgagaacgagaaaacccttcgtggaggaactcgaggtgcagctgcggacgatgatctcgtatacaagccaatacatgccccccggcatatcagctcgatcgacgacactcctgcttcagggccttgtcgatacactggtcgatgccctcgagctgggcgcaggccccattcagccacgagatgtatccagccgccgattcctcgggatccccacggggtactcggagctctctacagacccttgacatggaggtgcagcaactcttcagatacgagttgaaccacacctcgcgaccccggagtgtctccacggcctggtccttcttcacttccagcatagtcctctcgagttccgcgacctcaaacttcgtcctccaatactgggtgcgacggtcctggtcagcaagcgcactctcgaggtctgctcagcatggaaacgactaagtcaaactgctcttctctcccgagaatacagcaaatcaagtcgatccagacggaagagtaaaggagatgaaaacgaagataaccaacctaagggagtcgtcgccatgcccgtttccacagcgaattttgagctacatcgccctccggcacatgtggcccgaacacaagtgccggaacgatcactggcaactcaggctgcccgcgctgctgaacatcctcgacatcaacatctctacaaacgacaacaaagtactcaagatcaaaatgctaaagaaagctaaggcgatgactgcacacacagaggcggttggaaccaatgaaagttttacaaagcgtgactaaagagtacaagagagtcaaaatcctactcttcaaaaagtgggagaacagactcccccagatcgccgacttcttccatcacatctttgcgcgcgtcgctagccgccccctgatccaagatcttccgcagatcgagttcagggtgcgccagcctcacacacgcaaggacatggcacgccccggtatagatcccgttggacgtctcctctccgatcctagccgcgtgcttggaggggatctcctccatcgccgtcgcaagctccgcaagagaagtcgtcagcgagaactcatcgggattcgccgggatggtagacttgataccgcactcccggcgagctggtgcagaccagtataggtgacccgcaacgagccacggatttctgacaagttgttctcaagctccgacatgcggtgctcgagtccctgccgttgtcgctcattgccggccaccagctccctcatcttctagaggtcctcgcgaatctccgccaaatcgtgcgccagccggtcgacgcgctcattcgccgacgacaccgccgccgcgagcaccagcctcgaggaggcaccccatctcgacctagagctcctcccaggtgaggacggcagccggcggaccacgatcagccacgagatcgctggctgggccgctaggtgtcgcctcgcggctcctgggcacgaccacgacatccatcgaggccacagcaggagacacgctggaggtccccccagacccgtcttgcaccgccttcgcccgcgccgccctgcgaaaggctacaattgagacagactgcaagagtttgacgaaatcacgaaacctcaaattcattcacttgcttctcgccaagcgtcacaagccgctgccatcgcggaggcgggggagacgcatccgaggcctggagtgtaacgtatatgaggtgaggtggaagttccccgactacgcgacgaaggaccaggagaacttactgagggggtgggcgtcttccgacgatgtccgatcacagaggagaatttcctccccttcttcagaacgttgccgccactcgttgtggcagcaccgtcagacgcctccttggcgactttctccttcagcgacgccgccacctgatggtccacgagcggcccgatgatgtcagtcagagggagagcctacgcttcatgaagtcataatgcgatcccggaagaaaaatgcaaaaggaccgctgagtacacttacattgatggcagcttcgcgctcggctgcccctttcttgcaaagggggacggggacgttgctcaccattgtcgggccactgatcatcagttggccgacgcggcgctccacggttgcgctgtccaagcctgtagatcgagaccagaattcgataagtcaggaagaacacgcacataaggtagtcaatttaactaaaaataaaaataccccgaggagaaacctgggtcgcgtcctccggcccagaataatcaaaggctgggtgggctcgagcctggagcggctggatccgcctaccaatgaagtcggcaacgatttcataccccgacaaccaccgtactcggaggtcatcaatgatatcgatgaaagattggaggaatggggtcaaggcgggtttggtggtccaagatgaaatcttgtctggttgctccttaggaacaatgaagaccagatctaaatcttctatctgaagatagaaccacctcccctgccatttgctgcgagatgaggggcactggaaggggatgtatcgcgacttcaggccatcccgaagtcggaaaccgacacatccgaacacctttttgggttccatctagcgcaactcatagtaaaagcggaagaggtcaagaaacggctctaccccaatgtaggcctcacaaagatgcgaaaagatactcaggaaggcgatggaattggagttcaaatggagcaaggaaaggctgtagaaattcaagaccaagagaagaaattcagaaggcggaggaagaaagccacagagaatatagtcctcgatcgcaaccatgcgacccaggacaggctggggttcagtacctcctgcttctctctccatggtcccgcgatcgggaagggcgccatcctcctgcagcttcttcagcgacgcgctggtggaggtagacttgtcgagatccaatgccgccggggatcgccggagaagacgagggacgcttggaggctagagagttttttcacaacaggcggactttaaattggatccccaaaactcccttaaatagacgcacttccgacggtgcgaattccaaggaaaggagagagatggccgccggaaatttctgggtccattacgcgcggcagtttttcggacttcaatttaaattcactcatgaccgttgagcttcacctggcgttgtcgatcactccttgtctctcgatcctcacaccgagaatgacgacaacctcgacatcagaagtcgcgatcggtttcacgagttcatttaagcagaagtcgggggctactgtcagggttacgagtaaggtataccctctacccttcgatatacgtcatatatcgatatggtatacttgcgcgtatacggacgttttcggcatacgttaaggaaattcattatggagttcacagatggaaggagtcctactcggatagaactgggtcgtcattgtatcgtaccgggtccgatgtctctgagtcctacttggagaccagttgacctgcggtataaaagggaccccccaggaggacctaaggcatcgaatcttaccgccaacacatccaccacagcctacgaagccggagcctacaggagccaagtcgccggatgatctagtcgaatcaacttgactacgatctcgtcggtatcatcgagttccactatttcctttgtaatctgtggtttccatcatataatcccatatgaactggattagggctattacctatcaaggggcctgaaccagtataatctttgttttatgcctactcgatgtcgtattacgtagatcctcgtaccagcgtaccccaataccctctatatccggtctacgggtatcccctgtcgataactagtactatgagtctgaatagatggtatgtcataatttgtagtattagaatgcaccccatgttctaatttgtaggttactatattttgagagttgatggacatacctactcacactattaggttgtgtttaatcttatcctaagttaatttattttgaaacacagagagtacattttaatatctatatctatacctatttaaaaaataggtaagacttcgggatgatatttttcgtaagttatttatctagcgttgtcaccacgcgccagagtacttcgttcgtgtaatttggtttgatcatgagtccaccggaacaattaattatccgggctttgccctgactctttccaaatcaatcgatctacatcctaggatacccagatacggctcacaagccacgtatccatatcggatacttcatcggatacgtatacgtatcagatacgctccgatacgtatcccgtacgtatccctaattaccacgatataaaataaagaaaattacttggatacttctctgatacgttcccaatacttctgaactaacaaacccacgcacgcagcacagaagcgcagatcgaatcctcctgcagcgccgcttgcatcgctaccaggggcacactgcacagggcctccacgggttggccgccgggttccgccgccgctcgccacctgaggagcagggcctccaccgccagccgtgcgtcacgtcgccacccctggtcccctgggcgcagggcctccgccgtcggtagtcgcggcatctccgtcaccaggcgcagcttctccgccggctaccaagcccaacgcgtacagtccatcatcaccggctatttggttctttccccttttactggttgttttgttatgtgtttttccttgttatttagatccggtgaattttagaattggaagcttaaccacttatctagcactagtatgtactgctagcgcggctacagattcatcagggtcacttgtgaccaggcatgggagcatattatttacaaggggcaagctacatgatgagcttgatctcctgggatagtactattaaaagatctggtgcatgagacctgtctgggatgtagctctttcaaccacatcgctggctatgaatgcaagcagctcttgaacttctattgagttgaacttatatccggaacaagttttattctaattatctctaatgatgtcatgtaatttgtataactctatttgcaggcttatagttatttatgtgttatgtttttcctttgtattttttatttttttaaatatatatagacgtatccccgtatcggtgtttttaagaaaatgacgtgtcctatccccgtatcgcgtatccgtatccccgtatcagggtaacatagtctacatctatgaattaggttgttctcatgtgggctggctaggcctgtcttgcactgggctatgacactttctatttctaaaccccaaggtgtgattaattacttaatcttctaggtctaaggttaattgagtaattatcctttcttaatctaattttggttcgatggatccatataagagcatattcaaggccttggtagaggcttttagaaactattatcttatcttataataatagttgagacgataaaaaaaacttacataattaatacactaaaacaatatttcatttttttctttccttttcttcattgtcatacaacgaaaattcattttataagcgttaagagttgatattaagccgttgtaatgcgtaacaacactatgtttctctctttcttacatgttagcaaagttaccttgttaacaactataagaatctaacattgtacatgtcctaaggcgttgtttatttcagcttaagattattataatcgattattgagccagattactataagctagattataataagccggcatagaataagcggttagctgtttgtttctctggattattagttgtttgttagctgttagccacctaataattaaaaaaacacctttagagtggattactatcttatagattgtaataatatatcgtaatgagctatatgtttatttcagtttactcctaataatccagattataataataatccagattataataatcctaagctgaatcaaacagggcctaagtctattattggttgggttggttgggttaattagcctgccaatgttatggtctgatgctaactaccttcatccaacatcctacttcattacatatcatttcctttatttatgctctccattctgggaattatgtaataaatgcttactttatttatgctctccattcagtgaattatgtaatgtaatataagtggttgtagattttttaagcaaaggctaggaatttttctattatctaaaatatcatttatttatttgtcatcttacatactttaaagaaatcacaggaaactattcgtatcaaatttcttttttttcaccaaggacgatggatcccacgcaagttcaccggatttcacccattgcaatgcactaacatattttttagttaaaaaagaaaataatacatcttaaaagcattaaaacatatttttcacaaaacctttggtataaacccaggttttactatttgtttcattgaataccagatttaagataaaatatttcataaaacacatgtacaacattatatcgtttatttaactaatatattttaatcgattatggtttgattttttatgtatatattttaaccgattgccaggttgttaactattaggattatcaagttttatgagtgcaaaattgagaatacatgaacggtagaaaatgcatgtgcacttaagagcccactaatgtgaattcatgtaaactaatcatatataataataaaatatgagtattttatataaatataaggttttaaataaatgttgttttaaaatataaggttcctcaaaataaatcacaataactgaggttgtgttacctacggatgccccaacacctaagattttgtgaaatttactcttaccgttaatttgcttctttggaaatctgcaagtgtgaactttgaagatggatgctagtatgctatccaactgctttaccaaagagccaataagatgagtcattttcatagtcggtagctgctgatgaataaacctatacagaatgaaatatcccctaaaataacgggggtacacaaataaaggacatgggggtgtctgttcttctaagcaagggagaagaggtagcaaacaacatagctacacatgcctttctcagccaatttccatgcttttgaagctatacctaaaaaaaacccatccaatgcaataatagcattagttctcacaaatatagagcatatccaggcaaaatttcaagatgccatctcttcaaccttttttttttctagcttcaaaaatggggaaagaaaaagacaagataagaaggcgattgaatgatcatgctgaaaccagcctccaccacagaactatgaaaactgaaattgcatccttcagaggccccccaaggtgctgaaagcctgaaatatgtataacaaaaaaatgaaaaaaaaaaactggcttattaatatagagaactatggccaattacatgcaattcagtaatagacattcatgcaattacagaattgtttcttttactagctgccacatatcttattccatgcacctcaaagttatccttgcaaattcaccatttactctatgcaagctcttaaataatcgagagggcaacctttctaatacctctgtcaagaaacaacaatagataaaacgggaatgaatcgtggaccatggattgcatatcctaccacactttttagttgttttttttagataagggtatttttgcctggcttctacatccaactggaacttagccctgtaaacaacccaatctgaaattcactcctatggagatttgaactcagcacgttgggatgctactcaggtcactgcaaccaataggctacatgccctcgccccacattttttagtatagcaaaaatttgagtaaaagggtaggcagttcacttacattcttgaatactacatttgaaccacatcttcaccagcactt

SEQ ID NO: 63510 - DNA, 8449 bp, Oryza sativa
tatgtatgtattgttggagcaaaagaggaagcggtagtacactagttgttagtagtacactggtaccaatcagatatttgttagtagtatactagtacaatcagagcccgatggattggttcaccaattcggggcattctccaacaaggttagctccctcattggttgtcccaaaaaaaaaagcaaaagccaaaaaaaatatattcaacgtagtttcttttttagcattggtttttaagtcgttaagagcacaaatataaaagctttacgcatacattactctctccggactgataatacttgtcgttttagacaagggtgaggtcaaactttaaaatctttgattatgaatcattttaaaaatatttgtctttcaaatatggtgactacaggtatatattagtcttaaaaagtactttaataaaatcgtatatttgttaacacttttatacatattataatagaaaataatggtcaaagttgttttttttagaccgtgatcttgtccaaaacgacaaatattatcaacccgaagggagtattttatagttgttaataagccgttactttataatcagtttaggggcaaccgatgaggtcctaggatgccaactagtgtagaaaaagtgtggctactgtatttcttcctttgtttcatatatttatttttttgaaacagtttaagtatcaatgtatcatgttgcatatagctagaggcattatgcaacttatcaggagtacgctaacatgtacttaaaaagggatagcaaaagcaatactgaagaaaagttttcaaaaaagagagaaagcaataatgaagaaggcaaaaagccaagatgtagtgggcaagtggcaacctacttagcagaaaagtcagggcatgcatcctaggatatctgattgatcaaattatcaaattattcacatggggatagaatatgcaggggcattgttcattggttcatataaaagggacatagcttcacagggttggccagctatataaaccaaaacaacttattagcgaaaaaaatttataggtaaaaaaattatgtgtccttagcaacttaaaaaaacaaatgttgaaaaaaaattacgttgagaacaccctaaattctccaaaattaagtgagacgcacaaaccactactttttataaacaatctttcataagtggtatgccaatgttggcataagtccagtaaagaatggtttgttatcttttgaaacatgtgtggtgtgtgttgtagtcatagcaaccaaacaaacacttgtctaataaaatatgggacacctatcatttaatacggtaaacagtaacagcaaaccaaacagacgaacattttgcgaaagatgagaaatctacacactgatcactgattgggccgggctcgctaggtcttatacagctaatcaaattaaggccactagatgctgcaggtaataattaaaaagaaaattattacgaaacaaaaaggcaggattcctcgggtgctcacatggtaaaggaggaacaaagcgacaaaatctttctggttaaatgtattggagacacaacgtgaatcacagacgaatcaacaagctgaaagacaaaatgtgaatcggcttgacttcagggtggctatagcagttaacaagagcatggtcaacattctactaagtaatggagtctctgctaagtaaataattatctcagtaaaccctcatacaaagcaatgtactctctaatcgtcaaaagaaagctctagctagggagcacaagcacaccaaaaaaatgactttggggaagtttttgtcttgtttagccccttatacactcattaactaaattaggatacatacttatctttatgataattgatagctgcccttctcagaatttggaggttggaaaaacactcttcacgtctttttaacattcttcccttgattattttactactggtattggtaaatagggtttggcctacgattttttaaggagcatttgcattcacaattccaaggaagaaagaggggtagtgttggagcaaataacattattaatcacatattggtatcagcaaagatgccctacctttgtctggagggaccaattactagaaacttctatgtaaaaagtcaaaaaaagggcataccatatagaattttgcagtatcctgctttagatctggagaagtgaacggaataaatgcacctgtgttgcccatcagcatcagaataacgttacgtacttgaacagtgtgattgatcagagtaccaatgaggaagaaaacatgtgcaggggaaatgaaatctgttgtcttttactatgtgaaactaaaaatggaatcagttgccttttactatgtgaaactaactggaataacatagtttgaatccaatggatatgtaagatacaatttagggatgcaaaaatttgagactttagttactaaccataatttcagtaagtactttagacatgaaaaataatatagaaagacattttattcaagagacaggtaaagcaaacaaattgaagtcaccaactgatgcaaacgtcagcttgtgcaaggaaagaaaatggttacaattactaaagcatacctggtagaaacaactaggagcagaaaaactgaataaactttccatcatgtttgatttcatatccttcactttgtggcatcggataacaaggtctgacatgccatcaggcacgttaacactccatcatgtttgatagtagaagacaacatgaaagaaaagaatattatatgcttacatcgtgtaaaaaattaaaaaaagacagaaaaataagatatcagttaagcagttttcaagataagaatgaatgacagtttgtgatggcacctacccagattgtttccatccaaaaacctctttatcgcatcaacaccaaaggaaagaactgcacctcttttgcgtgaacctctctgaagctgaggcttggcacattaaaccagtcacaagagagcccagaaggaatatagcaattatatatattgaagcaagctttgtttccatgtaaatatttttgctcgacattgcagtgattcaaaacagtcagaactcagaactacaagggtggcatatagcatcagatatataatgtttgcagacttggggctatcgtttacatattacataaattcaggttgcagttgatggtgtagcgaattttaacgtgatatccttataatttaagagaatcaaagaaaacacaatcaatccagagcacaactgtttgtgttcataaaagaaaacataagttccactcaagattggacaatgataactagagaactacgtatatgccttatacaggaggctcacataaataaccgatggccttaatgacataaaagatataacttcactccatgaacactaaataaactcccaaaagctacaaactccttacttattacatgagcgcgaggcaggtgacaaatacctcagaaaacagctcaacaaatgtatcgctcagtttggactcagttattcctcaaaaccatatatagttttgttcatgctcttgctttcatggtatcctcatgctaggtagatacctgaagcataaaaaatagccacacaattttataagtaaagcctgtgtatccatttaatttaaatttagctagtaccagtatgtaatggaaaaacacatactagagcaaattaagctagcttcacaccatcaaaataagaaccacacataatacatgttggattgagccaccagaatgcaaaatgtgtaaaaatgacttcaggagaaaatgatcctctgtccagagtctccattgaaaaagtaagggttttctgaagcccattgagctcaaacatatttaaaagatcaaaacaatgaatgaaaaacaagagattagtccaacgaacaaccacaatttaaagtttgagtaatggcgttcctttcatgaggtcaaatctcctactgttttctgtcaaaaaattttcactcggtatgatatataataatataacactctatttgttaccaatcacaccggattatgacattgtcaaatgcatccgagaaattgtaatgtatagagctatattatgaaacccctcaaatgataaaacaaatatccgaccataaatctccacaaactgtaaaaggacaggctctcagggcattcacatcaacaagctggcattgattgaaataagtattgatcttgtaacacaatctggaaggaattgtgtgttcacaaaatgcttcagttaaatatcagcactatattagtgaaagaatggcgagcattcaattcatcttagcacaaaggaaatctagaacctcacttgcctctatttccgtagatatcaggatttcaagatctagggtgtgtttagttccacgtcaaaattgaaaatttgactaaaattggaagtttgaagaaaaaagttggaagtttatatgtgtaggaaagttttgatgtgatggaaaagttggaagtttgaagaaaaagttaggaactaaacaagggcctagttgacaagcgacaagtcgaagagacttaaattttttcaagcactctatgtttgtaattcagagacaggatccctttcacaatcaataaacaaaaaggaggtaactcaatcaactgaaataactcatcagtcggtcagtcccccaccttcacccaaccacaaacatgccagttttttcttcagctggccaaaatggcccctccaattgcttgtcgattcgctaaggcaactagcttaagccatttcatctgcatatctgcgctgaaaaaaaatataggataacagggacgcgatctcagtaatttgggaatacatatctcggatcaaaccatgtcgcggattatgcattcagaaagcgcccgtgtgcgcaactgcgcaccagaactagcggtcagatagggtttaacatccgaggtttagggattaccgacgagctagcggggccaccactatgggcgatcagcgagggtgctcccccggggaaggccggagaagagaggccgcggcggaggcggcgggttttggggattccgtggcgggagtgcggccgcagatcctgatcaccggcacccctctcgcctacgcccaccaccgagcacccccgagcaccgagcgccggggagggaggcggtccgcggcggcggcatggtctccggcgaggcggcgactcaccgacctcgccgacgcggatggccaacatgccggtttttttttctctctttttccctcattttattttgggcctgtacgggctagtgggccgaggatccttgcagtgtacgcttctgctcggttcgacttggtttgcgtgggctgtgtgggctagtgggctgcttagcgtaggcaaggtttgcgtgggcttagtaggcctcggctccttccagagaaggaaaagtgcaccggaggtccctgaacttgtcaccgagatacgaaaacgtcctcgaaccgcaataccaaatatgcggggttctctaactatacaaaaccggtcaccagagatccctcggtggttttgacccgggttttgatttacgtggcggctgagtcagcgtgggacccacgtgggccctacatgtcaggtgtcacgtcacactctctttcccctcttttctcatctctcttttccatctcttcactcgcgccgagcaacgcgaggcgcgatgagctggcgaggtgacggtggtcgcgactccagcggtgaagggtggtggctggcttggagctcagcggggcgaggcaggaggggcagcgcgagctccagaccactccacgcgggggcggctgggatttggcccacttatatgttcaaattttgggtattttaaaaagatatctgtatcttgcatattggcgcttttttataaaaaaaaataggcacgactctctcttctttttttttctttttttttgcagaaggttggagagatggattgttaggtgtcctcctggaaagcacaccagaaatgctgtagtgaaagtgataataaacacgagtcgtgggataaatgacaatgacaaacaggcagaatgtagtttcatttcgcatctttactaatttaaaaataaagtcgtcatcctcctcctacactatcgtagttctcacataaaaaaatgcttttaaacataccacaccaaaaaaaatattaatgtttctacgtaaaatcaacccggaaattaagttggatgaaaaaaaactggaccacataatttagtcgaagccctaatatttgcagtcccaatattacaattttctctataattccagtcacgttgtaatacgtggccatgtcattaatgcacatcaacaacgggtatttaaatttctgtctccatctaattttcgtgtacatatttctttatcttttcgcttatatttatgtttatcggttaaaatttgatttttcaatttaaaatttagagttgattttgagttaacatatatataattttatttataaattattttttgtttgtaaatatattatttggcttagtttgtaggagtatttgcctgcttgttttcagtaactccttttattttattttagccttcaagatttgtcctaaaatataatattttttcatcagtattctcttctcaaccaatcacaattctctatcattcaatttttttacctatctctacttctcaaccaatcacaaccttcttacatttaattttatttattttcttaatacccatgttcagtcttaaaattctttatattctgatacggaggaagttgtatcaaactggagcagtagacggaaaaccacgtatgctcaaattggcttcagcttgccgtacgagtttcagtttggaagtttgagtgatcatctcctacttgtactaataataaataagagtactatgaacgcgattactcggtcaaaacgcaattagctgtcgccaatctcattacgtgccttttcgcaaagtcagaacgaattagtgcgaaacagtcctccataaatagcaaaacagtagtagcgacacaaaaaggcacagatttttttttcaggtgatacgtcaatgatttgtgacagcccaatagcttgcagccaaggccatctccagaattgaagaatactcgaaaaacttctcgtacctaaaattaaactaaaacacttttaatgtcctaaaataactaaaatttagtaattagacataacataatattataaatataattagtggatgtatctaatctaattatctaattatagtttgctattctcctgttttatattataaattgtttggattttttttccgttacacaaactttttacaatctgataaaaattttgtagaaaaattaacaatatttataatatcaaattagttagaacattaaatgtaacattgaataaattttgataagatgtttgttttatgttataaatattgttatattttatataaatttggttgaaactaataaattttggttagagaaaaattcaaagcaacctataatataataaattatataaaaattggagggagtatattttaatatggacgtagtatgtaaaattcctgaattcaaaaaagggccaaaggacatatccggaggcaaactgtatgaaacaaattgatttgcaattttctccactttatttcgttttcttttcactgtccttaatttctattccctccgtctctaaatataagggattttaattagacagccaaaatcacttatatttagggacggaggagagtagtaactaacacaaaacgttacacaaatgcagcattgcagcccctaattaatcagatccaaagctattatatccactaatacagagtaagcgatcacctagtagcaggctagctagccaagtacatcaatttacttcaacggattaccactaattaatctcacactcaaatactcctactacatgtaccaactcgaacattttctctctctttcattttttttctctcattttgttgccgcgcttcttaattagcatctcctccggcgtttcatggtatggtcaccggcggcggcggcggcgaagcaacggaaggggttctccggcgaggagatgtccggcacgaacaccgcgctggcgtcggtggcgccgccaccgtagcgcgggtcccgttgccagtggagccctgacgccgtgggcggcgaggggagctccggcacggcccagtgaacttccggcacctggccgaagaagtcctggccgccgccgccgccgccggcggcggcggcggaggaggaggaggacgacgacgacgacctgccgccgttcggcgagccgtccatgctcccgatcttgccgctgtccgcctgcatgccattggaacgcgccacgttagctcaagctgtgtctcgcaaaatatctcatgccatcgatcgctcagatcagcatgagcgaataatgaggtcataaatagatcgattttttagtag

SEQ ID NO: 63511 - DNA, 1981 bp, Oryza sativa
  unsure (1)..(1981): unsure at all n locations
gccatctgcaccatcacccccatcatcgaccgctgccgttggccgatcgccggtcaccggccgccgccgtgtggcatgcccgggccggccttggcgccgcccgtccccagcctgccgctcggccctcggccgatcgtggccgtccatcccatggcccgcatggccagccacgtggtgccacgtcagcgccacgtggtacaccaccaccccggccccgtggacccggtccacggtggaccaccccctttgagccgctgacccgtgggccctgcctgtcggcgctcctccctcccccccccccttcgctgacgtcagccctgggcaatattacgcaacaaattgattaaggactttttctttattagtaaaaacacatattatattctaaaattcatatctaattcatccgagctccgtttaggtccattcaagtctcagtaaattcataaaaatcccaagaatccattaaaaatagttttgttctctgtttcagtagtcttatagtgtgttttgcttgtgtgctttgtttgtcgcatagatctcggccgtttcgtcgatccgcggttcctcgaagacgttgctgaagtctcatcagtgcgagagcaaggcaagtcatgcattacaattgatcatattatacccaatttacaaatatgccgcatttctattaaatgttgcattcttttacaatgtcatgtgggatgggtcctattactcagccatatattgtttaccttatgccattgataacttgggtatcaaaatgactagatgttggtttaggaaatgcttagccatgcctagttcaactagtacacaaacggggatcacattattatatagactttgtctattagcatagctttagattggtgctaccgcaatggtgttagttaattaaaatacactgaatggtgggctgtagatgcatggtttcactggtcgcacccatggcaattaaggaccagttcacgggaaaccctgggagacttaccgtgcttaccacaagcgggagtgggtaactgcttgatctgaagtatagctcgaccctttcctaggcaccggtggcgagggtgggcgtgatagagttgggtcggccggggtgtccggttgtccagctgccagattcatcgcggcgcaagaggggaccgcccactgcctttttaggagtgggggtgaaaccttagcatggtgtggatggttaggggagggttatgcggagggtcttgtcacaatttcccactttgcagtatcatggtgatacttcggggcattggcgacatgtgtagaatcgtgtcttgtgggtacagttgtacactctgccaanggtttaanannnccaanccttnaatntncgnanaataangncncngntnggcncncgncggtnntaatgggcgatcaaccagattcaccgtgattagtctcacccctagtttagcttaatgaactgttgtagttcaggtggttggttgggcctgttgcaacgtggagtagcgttggacagtaattggttaatattgattaattactacaattgttttattgctttcaactattgtttttaaatatctgctttattgcaaatgaacccttagcctcctttggttacatcctgcatcatacctcctcttccggtatgacttgctgagtacagtgggtagtactcagtcttgctctcttttcccccacaccagagttgaagttcttctcagttggagatgtctcgaagaagttggtttcgtcgccgccgtcaaggatgcctgtggaatggaatcgctcgctgcaggagtcaagtcttcaggcttagctcgcttttatcttttccgctgcatttgtaatcttttatatttttgtaagacgtggatctgtatgtcaacaattgtcgtttgtgtaccctgactggttttggataggggtttaatgcacattcagcttagaaattctggttcatgaatttctgggcgtgacacatatcctc

SEQ ID NO: 63512 - DNA, 2420 bp, Oryza sativa
actgcatgtatgcatgtgaaagtttattactgcatgccaatgccactttttcgttgggaatccgcggcttgtcttttgtctgaactctgaacttgtttgtctgaattgacaagggcagttaccattaactactcggtaatcagttggggatatttgggatgagcagaattgttctcatcagtttctcacactgactgaaagccgaaagctggaagcctgaagccctgaagcactggaggacaaggatgttttaaagtactcatctctccaaactccaaagctgtggaagcatagtagtagtaccggcagagaaagaatagatatagatagcctatagctatagatgatgagtagtaggagtaggagtacatcctaggactggatgagcgagtatcacacactgcactgacaagagagtgtatgtgtttctgcttgcagatgcagaggcagggcaggcaggagtggctcaaggctgatgttttcctgcatgcttgcttgctttggttgtgtctatctacgagcacgtttcgggagctgagattttaacaaacagtaggtaagtagcccgccgataaaaaaatatatatataaaagtaaatattaggaaagtaactaatatcaaataaatagaatggatgaggtttcgaacccaaaccaactagcccatcaccttgtgagaatagtccgaagaccgctgaacgtttctcttgaatgtatacaactactactgattctaagaatctaagagctgaagttgtagctaggagggtgtgtttagttctacgccaaaattgaaagtttgactaaaagtgaaagtttgaagaaaaaagttaaaagtttatgtgtatagaaaaatttttatgtgatggaaaagttaaaagctagaagaaaaagttgtaaactaaaccaggccaaactcactcaaacaaggtcagcagtctcatttttccatctgaaaaaaagtagtctcgtttttcctctgcctgtctgtctgtgtgtggtatgtgcatgcatgccctgcaggtttatccttctcaaccactctgatgaatgatgatgctgaccagtgaccactgctgggacccacacccacaagatggggcccttttcatgtggttttcagtttaattaatttcctaaagtctcctcctcttgctttccttgaagttggtgctgtgaaagaaaggccctacctgaatgtcattatcacactaacaaactgtgctcttatctgcttctgttttgtacttgtcggcagaacaagcagatgcagacatccaccttctactattcggccggatttgaagggccatgcttacttgcaaccattcaatttggcctctgaattttgaatagtactaggtcccaagaccctgaactaaattgtggcacttactgaatgatagaagctggagcttagcaaacaggttctttgttcatatgttcataaaaatgaagagtttatgatgatagataggcactgctaatgtttggagttgtttcacattttcatctgtttcagcaacgaaatcctgcagcctttgtgagaacagtaaatgtcaagcaggtttgttacaatctgtggcagcttatttgggctaccaagaaactatttttcgcctaccaatccccatctctcacagaaagcgttcattcatttttttctgacgaaacattctgcagtttttttttttttgtgtaggaagtacggtaggttgtcaccaccagggttgctttgagcctttgacctttgagaggaagagtacaagttccagtcccagttcccaataatttttgaagcttttttgaagataacaaacatgggccaacgcatacggaacatgtgcacctgatataactactccctccgtttcacaatgtaagtcattctagcatttcccatattcatattgatattaaatatgtctagattcattaagatcaatatgaatgttgaaaatgctagaatgacttacattgtgaaacggaggaaagtattaagtttgaaacagttgtgcagccaagaattcttcccctttggaccttgccctgtgatcactagcatgtgtactgatacagagagttcagttaggagtatcatattgcagaccacagcaacctttctgcagattttcaggcaacgaacacattatttaacaagaacattctcgcctgatatcacaaaatgtatgacgcgtctctcgatatgtttgacaaaatgagatcaccagaatggcaactagagtaccgtatttctcttatgactgctacaacattattctctcttttaagtccaataccaatggagacagcaaaacaaatctcatatctccacatgaactcctgttgatgaaataaagcagtaggatttcaaagcaggagtaatgaggggagaacaatacaatctaacacgtataact

SEQ ID NO: 63513 - DNA, 47313 bp, Oryza sativa
tcatcagagcaggaaacaaaatatgtaggcaaaaaattgacagaataaagtcgatataattaagccatttaaacaaacctgtatccattaagtacaataaaaagcttgaagcatgatctcaggtaaaagtgacaatcattaatatgacaaacagtcaagagttaggaggtaaacccaccgatacaaatatatttggaagagaaaaacaagcatccttgttagctggagtttgatttcaattgttagagtgaactccacagcatatgtgctaaagaatccaactcatcattgtgttgagtatgtaatattctcagggaattaatcacatattatgccacgccaattccccaaattcccaaacgtctatatttatggcaacacaaaattaacttgatcacagtcggttaatctggcccttggatatcatgtagattcgtgctgcggctatcaatgcttgcatttaacagtcatttgatttgctaagtctgtagctattcgctctgtactacgaccctgctgcccctagttatacgttagtttctcattgaatttgcactagcatcttctatttacatctacttacatatgtaattttgggacttacattgtaaatacactcactaaaattacatatgcaatgtaatttagggaactattttcttcatgttttatatggcggcataaatataggtagtcccattcccaaattgtgcaaaattagttggtacatgtaacttatggttctactgattgtagccacctagctattacaattagagtcatcatgtgtcactgtatatgtttgtattttagttgcacttgaaatttgaaaccattttgtagaatgttatgtctgccaatcagcatctcattttgtacttagctgtcaaaatgcagcagtatcagcagtagaggacactaagattgaaaatactagttcagcattttaacaaattagtagagcatgaaagatagcgcatctacaagacagaagatggccgtgatgagcagcaaaaaataatgctggcaaaagagcaaacatgggtaaaaaacatactcaatcatgcccgatgagctgtcagcataggtatagaaaagttggtcgatccgttcaatttcctttgaaactcccctagttgtacctgatatgataatgaaagcgtgttaacctaaacagacatattgtttgctgaagatcactgtatatctctatctcttaatggtacgaagataagacacaccatatattattattgcagaacttgcgacaacaaaagatatgcatgcatttggtagttatattatttcataataatagcctttaaaagaaacaaactcagggaaacaaacaatagcttgacatatatcagttagctgaataacattacaactgctgcaagatttcactaaacaagtaggaaggtacataaaaatgctgccaagtcacatgcatatgcaagaattactccagagtttaaaaatgagtaatccaaaacagtctgtaaaggtaagaccgacaacatataattctgaaatgtccaagacaatatgtattcacatatgtttgtgtaggaagataaatcatccagccacacccaccgctacattattacacccaagatggataaatacaaacaattagatgagtaataacagaaagaaaaggaatcagttcatctcaccacattgtgctttcctgctggtcaggtttgtactgactccttttctttttctgttttttttttcatttacttgtacatcacctaaatataaccgtttgtttagtattcattcaagtatgtataccctcagaaagagaacaagggatttcctaagctcacgcatttgaaaaacaggaaattccaacaagaatgtcaacccataaaatgcatgaatcaaagccagctaagacacaattagagctagtgacaaattttaccaggaacttccactaacacatgattgcacggacaactacccaaccagtcaaaacaggcttttaaagtaacatcatagcattgaaaactcttaaggcagtgaattctagacatcatctcatttttattggcagcctcttccaatcttcagttggcatcacaactaatcgctgatattggtgttcatctccattaatttaattatttagggatagcttcttcagatagaagaaagtttttgcactttgttttacctcataacacttgaagtggttcacataaactaacgtaattgtaaatttgcatcatggaaacataacgcagaccgtaatattttataaacagctcaatctaggcttgcttacaaacaggttcagagcatggccggccaccctgccaaattttatcaagttcactacaaaaataaatccgttaacccaggagcaagcctacatcgaattccacatccccaatctacacacgacccccatccaatccaatctcgtacacgcgcgatccaaaccccaacaggccaatatatcatcaatcaacacgccatcaacgcagcataaacctagggcatggcagggcagagtccatccatcatcaactcgagattggatcttcccccgaggagaagagcacagaaccgaccaaatctcgcagcaggcaaagcaatcgggccccgggcccggcccgacccgccagccccgatcatctcaacaaatacgagagagaaagaggggggaaacggaggatccgagggcggaggagggcgttaccggcggtggccgccgcggcggacgacgacgacttcttcgaggagcgcctcatgacggcgccgcgccgcgccccctcggatactcggttggatcccccctcccctcccggagcccttccccacagcagcctcctcctccgccgccgccgccgcctccgccgccgcgcgggtggaacgcgcaggcctcgccgagctctcggcttcggttgcgagtttcgagttggctgtcgagcagaagagaggagaggagaggagggaggcggaggtgtgggcgcaagtggaccctcgactcttataggattcggcccgggggcaggcgggctgggccccacgtgcgggcccggccacgacgatacctgtgggcccccactgctccccttgggtttcctggatttggtttttgggatgtcgagaaatcggatttcctttcctttccatttcgctttgggtagctgaccggccttgtaacatccattaaaagaaacgcgttgaccatacttggaatgtcaagaggctggatttgtagatatgtatttttattttttcgaccgaattttttatttgtagtaatattcttttctaaaattaattaaatagtaattctaaatagggattctgagaaataggaaggacgctagttagaagagcgtccagatgcggacgcttgggagaatagcgtccatcttgatacgtggtttgtaacagcgtccagctgtttgggccaaacacagcatgggcctgcgtccaggtgcatgggagcacacacagtaaaacatttatctaatccaaatctttgagcatccacgtggtgtttactgtgtaggttatagtacatataatttgtttagaacgatcttatactaacagatattgaacaaatttagtagttaatatcggtagtatgcatattggcttcggtcctttaataacgcagtagtcttataaatctatggatagtttgtagccattttcaaccaacagataatgtcaacgagctagctatcacgaaattccagcagcaacacgacatgacaacaatagtgcaaataaaaaaatccagggtttttcctcaattgcattagcatgcatttcattaaattatggtggattatcgaatcataaaaaaaaaggtcgaatagtatatgtacaaaggaggacgaaatctcaaagaggaaaccagtgagaaaactgaaaattggaaggaaacattgacatacccctaaattacaagaaagggctaattacacctcaattcagtatgcaacagaaagaaatacctatgcagactcccttcgtcagattatgcatttgccttttcttctgatggtcaaccaagcaaagaatttgcatttgcctccatgtatgtgtttgtaggtaagatatgtttttctgttgtactaggtagtcactccagataaaggtccaccgcactctcactgtttctatgactgttgaaccgtgcaaatcagttggtaaataaatatcttgaaacgaatttcaatctgaaacaaaaaaaaatcagttacagtgaaacgtctaaatgtcattcgatatagttccctgaatttatatacaaaatgtcattctaataatcagtttgtggagatgataaacatgcaaaagacacaggaagagccaagcatcaaggaagaaaccgtgttcactaactgaaggtgaagggcagcgctaaccacaaacatagctccgcaagaacgatggcatctcgagcatcaatgagaacgccggtggctgcgcctcagcgcctctcacagtcgagttgccaacggcctcgcacctaggactctatgatcgacatcctcaaccagacaacgtggaggtgggagaacggcgtccgcagaccgcagcctattggcgtagtgccgtagtcagcgtggagacgacggtgacggccgcctctcatgctttcacttaatccctccctgatactacggcggcggtggccgtgtcgcgagtgtgccctacgaggctgatgaaccgatcattgatcagttgttggccttgggtcgtagcgagggaggacgttgctttaaaccgcgtccaatcttggacgctttacataacaacgtccacatctggacactaatagggagggagtccttcctatttttacaaattgtagtttagatttaccacttatttaaatttactattaataattattatgaataaaaaaatcggttttttcgagcattcgtattcatgcgtttttctaatctagtcctcaacaaacactcgtgttaaatagtttgatttagtttattgagtcgatcattatcatgaattatttatttaactatagaataaatttaataataaataacctaaaataactattctactatgtttgtttttgtaagtaatataccggtacaaaataaattgtatttttcggagcacggagcacataatccgtttcagtaatccgaagaataatctgaaaagaacacggcaagtatcagctgaatccggatctcaaatcgacctaaacgtaagccagcaggccagagtccagacaatcgtctgctgctggctgctgcacgcgaggtgcaagaccagaggcaaaacagaattctccaacagggggacaaccagtatgtgacttggaagaagaagcaacacaaaccttgacttcctttcagacgtgaacacgtatccagttgggatacgccacgttgccgagtggaccagccaactttgttgttgactgcgatgttttcttttcaagacctcctggacttctcttgaccaactatttcaagaccttttggccacaaactccatgtccacaagtaccttggcacagctaaacagactccacaattgtgaagtggcagcatgagaagtccagtaaggctcactgggaatccttcggttgctgtccccaaactggagataaataaacgctcatttcctctatttgtatgtacgacagcatcatgtctgtaataggtaatctgtacatgtgaaattgatgctaccttcttttttacaaatggtatgcaaccacagataataaagaaaattgcagaaaagcagatctgccaaaaaaaatcccaccttttctgtgggagaaaaggataattgagccaagaaatatagaactgactttagatgggtactgcagagtcgggattcgcacgatttaggcgaactgtgccaagaatgtattcaggcagctctttctcttcctttgcctgaaaacatgaaacatattagcactcctggtgttacagtcacatctgcacccctgactcaacaaacccccaaaaaatactctttttcattagagaccgtgaacattgttagttgagtagactcctacatgaaatcagagtctttaacatttgcaagcaaagagtggaactgaaggctaggcatatgccagatatggaaaataccatactgaaaaggcgaattagccttagaagggggtttgcattgagatgcgctataaagcacactaataatgagaaattgtactgcgataatgtccttttgctctcaaatgttgggcaggggtggacacaatcgacgcaaaccgagcaaccaagccgaattaatcgagcaagggaagtgctttaaacatttatttgtgatttctttgattttttggatctcctgaatttggtcggtcactttggtcatgaccgaagaatgaaccgaaatgaccaaaaccgaatagttcggtcttcattattttgtaatgcatttttgtcttcatttttagatgacggaaattttcaatagacagaaagaccaaaccaaaatttttgatctggctgaatggccacccataatgttgggaatctccaatagagtaaatacaggatgttgtgcaactgctgttacgttacaatcggggttgcacaggatgtcagaaaatcaactattgttcacactattgaactccaatagacactttagtcttaaagcttagctagaagtaatggaggtatttgtagaatctttatttgtttaaatccacttagaaataggaaatatatgaaaaacaaaaaagcaaactgttgtttcaggtctgattttgcaggttcatacctcaattagaatagcaagatcaacaacaaggcctgtgacatatcccaggactagaccaataatgctccgtgcaacggatgaagaaccaatgtcaacatctatctgcaaagtaaattttacttgtaaggtcaccgaggatttttttaaaaaaaaattaatataatataaatatagtactcggtttttttcccaatttaaaacaataaaattataaaattgagagattcccgattatgcaaatctttaagtagcttgagttcaaatttgaagccaccatgcacagtagtccttccctctgcttaaatagatatttcaaaaaggttcaagattcaacaaagccaaagttcactagatcacctctagaaagttatcctggcgaaggtaattgcatgttactgcttttcccagaagacaagcttttgttccaactgcacgttttaccatccaataaccctgagatcatttatagttcaattcacatcaaaagtttgacttatcaccagtttcacaaatcaattcacatgcaagataataagaaacataaattaagtaatgcatacctcaacaatgcttggtataagtttaaatctggcatctcggaacgcatcggttccatcaatgaatcttcccaacagagaatctttattcacgggcctttctgctgcgtagtacatgaccaagttatagtttggcttcgctggaacctacatgtttaagagttaatatactatccatcctgatcatccatataacaaagatgatatcctcctccaatcaaataaaatgtgatagtgtggaacacaaaaatatactaacaaattaactgcaaactaatttccgatactggaagaaaaaactacaaacctagtttccagagcttatggtgttaagtcgttgagattttctgaatgataaaatattgtgcatagaagctcagagccattagatagtaaagacatggtgtacatgagacccccaaggtcacttccaatggcccggtttcatgaaccaaccattcccttttgagcccacattcatgtgcaaacgacatcacgttaatgagaatagtgaaaatgatggtacacacgagagtttacccaagtctatcaataacttggtagaggttacccatgtgtttcatgtgaaatttggtacatgtctgcatgtacagtatctctgaaggacagaaaaacctactgtttagtctgttatatatatcactatctattgagctgaatccgtagctttattcgttttcatttaatcggtgtctgttacaccattactttaattagtagagtgttgtcaaatagacagcgcaagactcgtgtcatgctccttttaaaagctcaaatgcatgtatgcaatggacggacgaataatccaaaaccataccatttcttgtgtacacttgtggatccacctctaaatgttaccttggttggataatccgtttaggcttgccggtaaattctccattgactttttatataaactactctatagtggagagtccgtacgttacaataaaaaaataagtggttgcattacttctttagaaactatatgagcaaagattttttgtaggacatcttgatcaaaatagaaaaatgttgaccatctatctatatactacagaaaatttctgtccaatagaattatattttgattttgatttttattttttgaaccttttcatttttttattttaaaaataaacccttccaaaacttatttccaaaatttgaaccttttggccacgccaacctgcctggcgtggcaaaacaacactaacacgctacctacagcgggtgtggcagttttgtcttgccacgctagcgagaccggtgtggccaaataacactgtcacgccatcgagaccagcgtggcagtattgttttggcacgctagttcggcttgcatggccaaaaggttcagatctcaaaaataagttttggaagggtttgtttttaaaattaaaatttcaattttttaaaaaaaaatcttctattttggtctacatcaaaactgaggatttctatgttgaacaaaaacaaacattagtcaaatgaaaaatatgataatgccatgtcaggaaacgtgagtagcatacaatatctagaccaaacattatggatttacaatacaattagaagttcccaggttcatggtggtaaacttgcttaagctctgctctctgacccctgccttccaatacaattaagaattacataatataatagagacctaaatataatacttaacacctcctttagaaaatcataagcaggaacatattccaatccatggatcaaatcactacaggaagttcactcattgaaggactgccatatttgtagctatagaacttttgactgtaattttgaactacctaattctcaaaataacaaattagttaatataaccaataattacctgcaagtttatgaccagtatgaagggaatcttctttgcagcttctgactgtaatgtaaatatgtaatgatcagaaaaatcggctgcagtatatggtcatgtcataaagttcagcattgcaagcaagtagacagcattgcaggccctatctaacacttcaatgtgtgttgagtttaaactagagttttgcctgtaggttcatgaaagaataatgaagcttacaatgatattaaataaggacttaatctcttcaaaataaataaggtattaatcttagccaattttattgatgaaaacgaaatatcatcataaagataatatgtaaaatcaaccattcaaggtcaaactagtgctaaacagctgttcttttagcttaattgtaagattaaaccccatccagaaatagaagcttaccatagtggagataattaatgccttattggtacggtctaagattttgattgaattttatatgattgtgattaaaaaaaaagatagattagaggcttaagagtacgtgtttgcagcaaagtcacaatccacaagatagtctaacacatatgactactagattatggatactgatattagaaattttgttaacaaggacactgaagctttggatacttctattggttgtgccaagaaaaagaatgaacaaggaatgtacagttttactctagcatgactgcatcaatactttgaaaggcatattgattctcagttacataaaaacatgatagagaaaaagctggttgcattactttgggatattggtggtggtcaggtaaccttttttacctgaacgaggctcttggggtgtaaggcaactgaatcaaaacgctcatcagccttaaaccaatcgacagcaataagctttagaaggggatcacctccaacaacctatgcaaatgccaaattaaaaccatttgataggtcaaattatgaaacaaggatatttctcagaaggagtaatataatgtcttaaccacaaaatattcagtgttatcttcatggccaattgggaccatattctcatatggccttgtcacaaaaggatgattaaacataaaactagtcatgcatcttccccgcatagcggtttcaactcaataaggcgcataaccaaatgctgggctggtatctgaattttttactggttggtctttggtaagaatactgatataccttattacacttcagactggtcaaaataaactaacttatccacacgataattattattctcctgacattttctaagaagttttgatatacacaccataatgtatagaataaaacccttctacttctttgaagcacaccattatgccttctaacttttttcaacaaacagagaaataaaaaatgtaggttatgcaattctctaattagtggaatagaaatgtagtactctgtcctaccttagtgtaatctgtcaggtaagtctttcctcttatcatgaacttctctccaccaggctcactccaagagtttgggtcattctcacttttcgctcgtcgaagggtgccatggaaatggtttgaatcaatagttaccggagttgaatttgtaaccaattcactcttctcaaccgaagctgcaggagaacatattagaagtaaaatcatagttaagaaggacagcttcctctgtgaaaaaaaagaaaagaaaagaaattcaaggacagcgaaatttcaacatgatctctggatttgagggtacatggttacaactatagcaaattagtgattcttaccgcccttctgtgtaccacatttttatcacctatgttctccttcacttgaaacaaaagggaacaagtgaacaagctttaaaaagacaaatgcccataggatatatcattctttagtttatcccatatgctttttggtagtactattttacttgattaattacaatttacaacatatcactttttctccttctccaatgattaccttaagatatccaaaatgactgaaatgaaccatgagaaatgttgtaatgcaagctagcaacttgcagttatgcattctagcaggttgaagagtaaaagatggcgtgctgcaatttccttcattttcaaatgattgtcaccattgactccattgttcaaactttaatcataattctttttagtaaatttataactagttcaaaataaaaaataaatattgtaatttttatgcatggcacacctaacagtatgattttccttcgatctaattaaatatattagatgctataattggtcggattttgcatagaagagttaacttgacagttattgaaaaacataaggaatattaactggcataattttttttacaaatatagacaaaggcaacagagacattgcatccactataacacagatgtgcacactttgtgtataaatgtcctttttgtggttgagaaactaatggtaaatgcatgtatttttttatcaacatactgtctaccagtgcttgaagagttgaaatgtctcttgtgtttacgattatgacctttagtcggtttcatagcaagacctgcgatagcccatgaaatattcttgaacttcacttttccagcctgtacagaaatttcataaggaaaccgagtctcaatttattactgaacataatataatacataacagtctgattgcataacgctgataaacaataaaatatcaccttaggaatcatatcatcatcgtcatcactatcctcatcttcaaaggattcgcctctagcaagtgcatcatagaattcatcattaagttcagaatcttccagttcactctggatgatcaaagaatcagactgtttgggcttcactactgttgaaggcaaatcagatgtcaaagctggatttgctgcaaagtattctcttagacctggccatatgaaatacaagggcatcattataatgtcctaaatggaaatagtattccttgcaataaaagcaaacctgaccaacctgctacttggctgagcaaagcaaaagcaatacttctgtcaaaattctcgttatgtcttctcttccatctatcccaaaaacttgggctcatttccaacatatgagtaacaaggcatttcggagttgatgatcctggtgggttcaaccttcttagttcccatgttgaggctgaaagaaatgttggaattaacaaattacaataaaatgtgaaaccctaattttttttccagttttgagagtgatgggcaaaaagttcttttttctcgaaaatgcaagagccatgcatttcatttcattaagaagaagaaagagtatgtacaatagagtgattcacaagaaacactctagagggaaaggaagaaaaagcctcgccgaagagatacgcaacaactctcacaggagctaggctcctaagtgggaagcgaccgggacaagagttcatggagtgctcttgccccagcagcaccataacaaactctcttgccacagcatccaaaatagcagtagtgctaggcgtggcattgctatccacccaagttatactacgacatactcaagttatctatgaataggctggtgtgatattgctatccacccaagttgattacaagtgattcattttttttttctgaaatactcatctatgcaactactgcaacatactctccggtcacaaaagaatgtcgttgtcgacccatgcagtcaaaataagtttactttgaccataattattgtttagaatataataagttttgggcatatgaaagttgcatagccaaatttctaataagaaaggatccatccattaattgtttggagaagatgagaaaggatggtaagtaataataaatgaacgcatatgatgagagaataaatgggggcatggtacgacaaaacttaactaactgagaacatggtctgaccaaaattttctgaaacagaaaaataaatggttattcctactctacctgcttcaagtcatcacaaaacaagctgatgctaagatacaggaccaacaaacaactcaaactcactgaatcatgctaaaaatacaaataaagtatgaaagatgaatcttacaattgatttttgtacgctcgtagccatgccttgaaggtttgttcttgtgacaagcaggaatctgcaaaatggctgcaccaaggggggaaaatgaacacataaccaactcatttgaaccataacacaaagtatatcgtggaagacggctgctatatgtgctgttaacacacttgacagctagttgccctatacattgaccacaacatgatttcttatgttcaaaaagcttgtgcgtcaaactgaaaacctaagggttctaggtttacttaattaatttataccctagaacctaaggctgagttcggcccccaaagttgggaactcactcccttttttttccgcgtgcacgcttttcaaactgctaaatggtattttttttgcaaaaaaaattatataagaaagttgctttaaaaaatcaaatagatccatttttgaaaaaaaagctaatatttaattaatcacgcactaatggaccgctctgtttcccgtgcgggagggattcgctcccaaccacaagtaacgaacatagtagcatttagatagctggtcactggttcataaagattgggcaatgctgatgcagaccaacccatcaaatttatacatcaatttgatgtgacttttgtgcactatctcatgtaaaacattatcatgtcacagttctttcagaaatatgaaggaatttggtcctcaactgatatcaactcaactacttcaaagtcaactccagtaaaaatgtattcctggaagcactggccagcacagtcctatcaatcttggtcgatattttttccctagggcatcctctatagccctactgacaagtgttaggaatcaattgattctttgtaggcatccaaccttcctatcagattcctcagtccccattttgctagtgattactagtattcactactgatggacatgccccaaggtgaccaccaccacctgcacctcacatcttagcacaccggattatgtacccctcctgctgtccaagttaaccaattcatttcctgttgttaatagcacctaacagaacataacaacacacggggaaatcaactgatacgtcataagatctagaaaattgtcaagtaatttgtattcaaagttgataggttgaattcattacatcatatttcaatctagctaggtgaacctctaattatatattttaggaccgtccatttaggagtgtcaaagagtagtagtagagatctaaaatatattaaaataaagctgtgatataataaagacttagtacttactatatgccccatcttgtccacgaaaccattgtctggaaaaaacaaaatccttctttgttttccacctgaaaacagtctccatacttaagagctgaattgacatattttaaaaactgttcaatcaggaatagcaacaactcttagctaatataagctgaagcttacatgtacaaatataagcaacatgcttcctaaaaagagcatgtcctatatcaagcttaagttgtccaaattccaaaagaggtctgtttgatcatgttcagacaacccttgtggataccattggtacaaaaagaaaagcctaaatatgtttaactagcaaatgcttcccccaaaacaaaaacagctataagcaacatgcttcctagaaaagcatgatctatgtcaagcttaagttgtccaaattccaaaagagagctatttgatcatgttcagataatctttatgaatatagttggtacaaaaaaaatgcataaatgtgtttaactagtacattaatttataatgttaaacatttatttcaccgtatgcagggaataatgcaaaaaacattgaattaaaaataccagcttaaatatctaggttcataggttccataaaccacgtcatagtatccatcaattgtttctaccaattccaaatcggcagtcagcatatcccacctgcacaggataatttcagtagagcaagttgtcaatatattgtagtacaacttgtatttggttccactgtaagtgtaaggtgcaatcaactgctagcttactcatatcgcttatgcttatcagagctgagaaccactgcaaatacagtatcaggattcgccccaaccacaccaacagacttaagaagtaccccttttccaccctacaaaagttaggaaatgatttgtatagataagcttttattctaaaaacatgtgaatgaaagagaaatggtcctatttggctcattcccaaaatcagccatttttttaaaagaaaagtttatattatgaaagcttggccaggaaaattagtagcttgtggtcagaccataatttggcaaagaaatgaacaacaataccaacaggcgcagacttttgcagcaaacccaatgtgatcaatctgacaaaattttggcaactactgtcttcaaaccaaacagtcactgaagcagcaactttgctgggagggatcacaactcattggatgaaagatgattatccacttcaggcatttcaatcattgaagaacagaactaccttgctctaattttgtactagggtacaaatgtttaaactgttaaaactgagaaacaagtctgggcaaatacacactatcattatgtatggagtatggggctgtctgaccaatattggctgctgcatagttggacatggagaaaccattgttacgtggcttgctccttgcttaatcattattgcatcataaagagtgggggcaaagacagatcaacaaccaagtaaccaacaagaacatggaccatgagaaaatggtgttcctctgttcttcccctttctatctccccaattccccagccatcatctctggctcttgcaattgatccctcagtcatccaggatcataacaaatggggataggttcatctaactagcaaagctacagcaatatgttatacatttcttacctttgtgtttgcaatatcttcaaaaattcttatacctgcaaaacaatcaaacacaaagaaaataagttcatgataatttggacatgattagagagatttcaaatttcatcattatatatgccctaggaattgaataatagacataaaggtaaataatcccacttggtcatgctagttaaaccatgtttagatatcttgattggctagctattttttcttaaatcaagttgcaagttgatgtatgtatcgtgttgcagaacatatgggataaaattgactcggtatcaatttaatttatccgatagatgttaggggtacaaactgagtctcaaggtcattaggacatagtgtcaactattatcctgtgcacttaagcaatgaactcagaactaaagttaactgtccaagatacaatggtgtcttatagttcataaaaataagtgactgttggtcatgtagattgccaggtgaagtgtagagtcagtaattcacaagaatattatttttcagcaagagaacttaaaaagatgttttctgtaacttcatctaacatagattagagtagacatccaaaaggaacaaaagaggaatacacgcagattaaccagattagttataaggtgccaataggaatagcgtaaggataccattaaatgttcgaacatatctccattcgtgtgcttcgaatgcatctccagaatcgcctccaaagtttgtattaattatctcatggctttgaagatttgaagactgccgcaagagcttttctggccctgtaatcaaaaacgtaaataaaagaattgtaggtaagtaatggatctatcacatagttagcactttcatgtaaaacttcaaaattgggctaactgaaaactatctgggtcaatttctttccgtagagttagtcatatgctcatatccaactcttctgcagagcttcaaagtcaaagtgggttggcctgctggctgagttgacaacaattggacacctcacttttgcagagtaaagagcccaccaattgaaatgtttctgaaactgagtaacatcggtcctctataaaacaactcaatctgactaagccctaaactctgttagaatcgaactaggatgcctacaaaagaagcccagtacttttttttcaagaaaattaaattgataaataaatggaaaaggattagcaagttgtacaatttaccgataccacatttggatttcagatcttgattatcacccttctggacactggacaaccaaaatgttttttttttggtttttttttggggggggaggagggtgttaaactgatttatggaaaaaaaataaagtcaaacattcttggtttatttagccaaggaattgagtgaattgtctaacattcaatattgagctgtctcaaaagttatagagtaaaactgtaatctaattatcatggtacaaattaatattgcatttttgttatcttacctttaccaattcgtacaagtttccccaagccttgtgcatatctccttacacgtggtcgatgcccatcaagattaagcctccaggtgtaaataattatatggcgtaagagcttggcttaacaaagaactgtaaattgcaaattggaaaagaaaaactaggtatcatctcacaaagaagctcccatactcgttttcattctgggatctattccaactaacccctctcgtcatcaggtcataatcagcctgttatgagaaatcaggataaaagaatcaaatgaaatgtagcagaaattattaattgtatcttatcttgatttaaagagggtgttaagggtgatattattggaaggttctacacccacctccactcaagatcttttgtgactgcaaatatataggcatgcacatattatttgtaagaattttatagaaaaatgtcgcatcactgcatacaagtatacatatgtagtcaattggtttcacataaatatgtatataggtttcagatttgaatataattatttatttattacatcttgtaatttagactaatatatttatttgggacttgttgcaacacatggacatgatgtgacaattggaagaagtcatacctaaaacaaaaggccagtgctgtctataaatttgaaactcaattttcaagtaaacatttttgtacaatgaattatgataatggttttacagcagaaataacagatagccggcggagattttattaaggacctatctgagtaatgaattattgaaatctctattccccgtgacaaaaacaagtgctaacactcaggggcaggtgccagtgcaagagtggcacatgactcaatgagcttatttgttaacacttcaacatttccaagatttcattcttcccttgcctccctcgtgccagcaatcatgtttattggaagcaagctcgatttcaagagcagctgtttaaagtttctactgctgcaatgccaattttcatgcatccctgtcataattcttaagtatttctggttattgtactgtgatgagccattgtctcaaggatttgaatacatgttaaattttggtgcataaataaataacttcagtggtatgctatcacaacctgaatgccaacaacacaattaggaaaaaatagaaatattttttttaagatttctttgagctgaacgccatgaatacagtatttccagtttggcagttacaggtaactgaagttagcccacattttcataaagggtgtagaagatgaccccaaaaacacataatctactttacaccgacaataacagttagcattttatagaattattaaatacctgctgttttgcctgctcaaatgcttcaacccatttcctagcttcaccggggtccccacatgcaatctagtaaaaggaaaatagtagtaaacttttaatcattatataggagcattgtttacaaatattcaagagcataatgagctgtgcacctctcctttctttgtttgatccaaccgattgtaaaaccgcaagacatacagttcctgggttttgaaaaaaaaaacatatttggttatttataaaggcaatcacatgagacatttagaacaaaacgttttaacaaaaagacatgatttatgctgcactagaaaaatagggacataatatgacagttaaatgttaatcaaaggacagaattggaccattaccccatggctagtaatccggcgaccaagctcctccaccataagagtgtgacttacaacaccctttcggataggttgctaagataaaacaagaagaggtaataagattccatatgcatgtaatgtccaaaaaatctcaagagaaaaaaattctgcaaataaggaatcactttgtgatgttatgtcaaatgtagatctacacatctacccaattgtcttgctaccttgaggctatgtagggacaacagccataaatcattttacgtatatattctagcaagatcaacataaccgtttcttaaaaaaggttcatattatcaaaactacaactcaaaattcaaaacaacccaaacgctgacaaggcacatgcactgcatccagcccaagcatcggtcctaaaattgccagcaaccttcttcatccttaaattgcagacagtgtcagtcgtcggtcagtaactgaacaaatacagaaagcacacacagcttagcagtttactctaaaactcccattttctactggttggatttcagaatcattggtaagcagacaatatataagcggggttataaagcaataccagcagaaccaaagaaaacctgcaacccagaacagccccaaatgcagaaacgatcagtttcttactgtaaatgacacggttgtcatcatccaaaccaattgaagccgcattttcgatagcagtcgcatctatcgatgcatcccctacattacgccaaataaaataaaaggttcgccaaaacaaacccaattcaattctgacaaggtcgaagagcctctgtgcaaagcaacggcgcagtacaaaaccaaaccaaaccaaacccaacaaagagtaaagcagctccatgcctccatccatccaacccccgctcaccgctgcagctccgacgacaagctctaagccgaaaccctcgagaagcgagagcgatcacaaacacgcataagaaatccagaaacgagactaagtgggagcaaggagggaggaggagagagagagagagagtgggggggggggggggaaccgacgattccggggttcttgctcgggtcgcgcttgtacatggccaccgtcttgccgcggatgacgaggaaccggaggtggcggtactcgtggccgatggagttcacgccgaggtggtacacccacccggaggaccccgccgtgctccgcccgctcccaccgctcccgctgctctggctgccgacatccggcgatcccgcctccgagagctccacctcggacacctcccctcccgccgccgccgccgtcgccggcggcttcaaggtgatcgtggccatcgccgacagcgtggggcgcaatccgatgggggaaaaagttggaagactggaactctggaagggaaggggggagaaaaggacggggaattttttcagtgacgcgcctcgtttctgacgttattatacggatactcttcgaaaccagctcacatgttcccaaaaatttgataagttgaccctttttataaacttattttgaaactgtggctgtgtttagttcacgctaaaattaaaaatttggttaaaattaaaatgatgtgatgaaaaagttgaaagtttgtgtgtgtatgaaagttttgatgcgatggaaaagttgaaagcttgaagaaaaattttagaactaaacaaggcctatagaccatgaaagaacttcaacaaaaatagtccaagtctaaggctgagttctttccccaacttctcaaactcacatgttcatactcctattttaaaatcttattttaaaactagtccataaaaagttcatactccctccatacaaaaatctaagcatatatttttatcaccaaaatcaagaagaatttaactttatccatcatgtaacaaaatcaaggaattgtatccatgtaggcaaccaatgagtagtaagataacttcctatgttccgattaacaatttaatgtggtacatggatactataagagcaagtccaatagagtatataaactagctacaagcatatatggaggagagagaagaaaagcgggttacacatatatagccagctacagcacgaactttaagataatatgtgtatgcgaggtggttcaagtattaacggtgtagagaccgagcgcttgctcaggtggcaagcgtcgtcggtgggcacgctgcccatgagcattcgaaccctaggtttgacgctcgtgctcgtctgggaggatttttcccctctttccctgggactgactttggttggtcccggctagataatagagtacatacatgcgtgcgcgttcagtgggactgcacgtttcccgtgcactgatgcctagtgcctccaatctcatccctagcgtgtgttagggacgtgcacgtgtgtgtgtgcgtgtgtcgtggtgtgagtgtggtgtgtaagtgtgcgttctgaattgtacccttctaaaaaaagtattaatggtgtagtatatatttatataaaagttttgtatgagtaggttattagattagcagtagatgatgtaatttttagagttagcagttagctatattattaaacatgctctaaatattaccatctcattcagaaaaacctgaaaatgaaatataacttaggctatgttcgttggtgtgtgttgagaacacatttctagcgcacggaaaatgagtagtccattaacacgtgattaattttgtattagctattttttttcaaaaatagatcattatgattttttaagtaactttcgtatagaatttttacgaaattttttaaaaaataatacactgtttagccgtttaaaaaagtgcacgtggaacaggtgagttgggggaagttggggaaagaactcagccttagacttggagtatttttcatggtctatagttaattttttcttgattttggtgataaaaatatatgcttagatttttgtatggagggagtatgaacttttttatggactagttttaaaataagtttttaaaaagggccaaatgatcaaattttgggtcagatcttctagtctcagatagggatgaaaacggagcggatacggacggataatgctcataccatattcgttttcatattttttaccggatacgaaaacgaatacggatagctcgaatacggaaacaaatacggattatctcgaatacgaataagaatcgaatatcatcggacacgaatacggaaacaattttttatcggaacacgaaaaccaactcaacttctaatagaaacaaatatcaacatatataattagctcattttatataaaatgaggtataatttataaatattttttaaaatttaaataatattaatagtttggactagtgttaagagataaactacaattaaaatctataaaggtatattgaaggttatagagttagaaagaaatggggtatgtcttatgggtcctgcggatatccgaatagcactgttcaccggatatccgaattattatccgtatctgacggaaaccctgataccatattcgtattcgtatctgggagaaaatattcgtattcgtatccgaaatatccgagaattatccgatccgaaaggtatccgtatccgtttttgtccggagctaacggaaactatccgctccgttttcatccctaactctcagatactgtcagctgtccccgccacagcggaagctgtgccggaagcgcgcaaaaagtagccgttagcttcgaggtcgcttcgttattctgatttagtcctcgggtttacgcttttaaaattaaaacacgtagtcacctggtgacgccggtcgcttcctagtttcttttttttaagatgacaatacttgaattttgaccgggctttcaactccaattatcagaaatttcagtgtacaaaatgagtttaaacttgtcttttaagagcagtactcctatgtttgaagggttttttttttgtctattccaatttgtaggagaagttgtcgattatcgtgaattcgaacacatgattttttttctttaataaaaaaatataacaacatgattttcacacgaacaattcaatttccacctaattcataaaaaaatcatgcatttccacggaggccttagcttacaggcaatcaaagcgtaatataacctatttgtggaagtttatttataatttggggatatggaagtaagattggcaccaactgataactagtcaaagttttagtgggccatttgttggacaatcggactatttctagtctttgccgataggttatcttgtcttaatccagaccatcttacctacatccatccgaaaatttagatgcttactaatttattggacgcgactacatcgagagtgctaactgaatagtgctaaagagagacatccttcttccaaaaaaaaatctactagtacattcaatatctatgtatttttttccttcttagataagtttctcttaaattacttatccgatttataatccgattgtgccgttatgttcgttgcaattaaatctttacaacaagatctcacatgattatattttgatgaaaaatcacaaattacttttatgatatgtctaaattagttttagatttcactaagttacttcttaaactataaaagtaaattcagtaagtcttaaagtaatttatatacattatagaagtaacttacaacaaaacgaaggtaactttggcatgtcatttgaagtaaatccgttgtagagataaaaatatgactctatctagaaattaaattaagggtttgctggaaccatgccaccctatatttgcaaaatttgagatatgccacccgtatctcaatgacatgtaggacccacatgagtaaatgacatgtgggtcagggtggcatatcacaaattttgcaaaatttgtgtggcatggttcaaattgtcccttaaattaatcagcacaaattatggaattaactaaaaagtcatattttatccatacaacgaatttacttctaatgtcgtgacaaagttacttccgttttattttaagttacttttagaatatatgtaaattacttttagactttattgaatttacttttatatgtctaagttttatagccatcactctttgtctgacctggatgacctatttagtatccattgccgaaatgctggtccatccaaagtaaggacagtgacgagctaactgatgtacaccaaccatgttcgacgcaagtagtatgatgaatgatttgaagaggagcccaaagtaggatatacatgtaatcccccgtcctaaaatgtaaacattcctaatggatctatactcatatattaaaaatttagataaaaataattagaaacatgttgtattttttttaaaaaaattagagaacaatattttttacccggcctctatatccaaccggattatattggtttaaataagaaagtatgtgaagaaattaaatagagaattattgtgtttttgttgagatgaggggatgagtggagaatagttttattctaaaacaaatcttataagtgatagaaataatatcattctgaaacggagggagtacgttgcatctttaaatatttgtaaaggacacaaattgaaaatttggagtagcttacctaagaaaaccaaacttgggaaattgtcaccgagcgaatagtaatagggtcatagtgtacagatggaacaagatcctctgcagtcggaacaaatgacttttgtctacagtcgatggatatctggccgttcgcttccatccaacggtaaccaagactgcttgcgctgcccccacttggctcgtgggccggcccaacgtcagcagacgcacgtatacaacgtatagagctgcggctgcagtaatttctggcgcgaatcctctctgttttggcgccgggttcacctttttggcgcggtgaaggttctgcgccggcgatcggacttatgctgcctccatcgacagactggtgccaaatctctgcactcatgtcgtctattgctgtgcacttaaacttgtgttgttctaatttgatttttttctgtcctcccgtattgttgtgtaccccaacttgtgttttgttgctggaattgatggattgaaggaaaactgaaatggaagattgaagaaaaatcaacttagcttgcatcagattaaaatttgcgtatttaagatggaagaaaataggtgcgtaatgtcatggttgtttctttttatccatagggggcggcaggggagccggccacgaagccggggcgtcgcggtggcagagagggaagcgccggtgaggtgaggaacgccgtcgtcacaacctggggcgggcgtctgcagtgagctcgatggcttgagcacggtggcaggggacggaaggtcgactggtgaggtgagaactctgctgtcgtggcgcgccgacggatcagggaggggaggggaggggaggggagcgctggcgaggacctccgagcgtagcggtggcgtggagtcaaacgatgcgccgacgaggacctccgagcgtagcggcgccgcggaatcgaacgatgcgatgcgctgcggcggagtcgaacgagccgtccaagggtcccttagctattgggctgatatgggcctggtacaaaggcctgtgtttccacagttttcttttatcacggttggataggaattggatggctctgatcagcgactggagagacgagtcgttctgcctgattttagaggatctgattctatctgtatgatggtcaccgagtgaatagtaatatgatttcaagtaggaatatttgatttcccccctccattcaacgtgggtacagccctacacaattattttccttgtataatgtctcctctagtcctttttgaatggaaggagtatgactttagagggattttacagaagtcgaactaattcatttggatctctataaaattttggcattacaaagaagtcctaagtatggagcacaagggttactcactaattttacaagaaacgacacgcacaaagactaatcaatcggttgaattgtatctcgtatacatgattctgctactagcttcttccactctgttcatcacacacccttgctggacccattcaactggacaactgcaacaccggccacccaaccgtgcaccgacaagtgacagacgacaccatcagcgagtaattcaaccagttcccacgtgccggtgcccgtgccactctgccacttccggctgccaataatttgccctttagcctctatgctagcgtggcaaatgttagcgccatattatctggcgttgggacgttcgatcttagcgccagcgtgattggcgctgagcccacgacctatttttgttaaattttttggcaaggtttaattacgaaataagttttctaaaaggaccaagttataaaaaaaagcggaaaattccactatctacgaaccgagtagacgtgtattcgtatcaacatatgagttttgtgtacttgtgtgctagaattgtactcccttcgttcccttcgtttcaaattataagttgtttcagctctgatgaaagtaaaactactttaagtttaactaagtttataaacaaatatagtaatatttacaacactaaattagtttctttaatcaataattgaatatatttttataatatattcgtcttgggttgaaaatattttttttaaattttggtaaaacttgaaactgtttgattttgactaaagtcaaaactatttataacctgaaacgaagagagtactttaaaaaagaaaatcatacacttcttacgtataaacttgctatattttaagacagactactgtcagggttacggataaggcataccctctatcctatgacttatgaaaccgataagatataccttcatgtatacggatcgtttccgtatacgctgttaggaacttgtcttaaattatgaaaaatatttctatgagttaagaaattgccgaagtccaacttggaaggggtaaaatctttggtgtatcgtgtcggtttacatatccctaagttttacttgggggtcaaggtattacacggtataaaagggaccctagggggaggtgaagggcatcgcatctcattgtccacacacccaccaaggtttacgaagccggagtgcacggagccaagtcgccgggagatctcgtcgtatccctcgactacgatctcatcggtaccatctgtttcgacaactctctttgtaatctgttcttatcgttatcaatctcacataaactggactagggctattacctgataaggggcctgaaccagtataattcttgtcttctatttgcttgatgtcatactacgtagaccctcgttccaacgtaccccaatacttaactcatccggtccgcgagtatccctcgtcgacaactataactagagactattgactcggaagtcgctgatgggtgaccagttcccctcctctagtctccttagagcaggtacaatagcatactattagccatctataaacatattttaatgagataaaagatgagagagaagaacagtgggctatagatctgtagccagctgcaatacgcaatgtgtgtatgacaggtgggatcatatactaatagtatagtaagtaactattgtatgaattggctattagattggctatagacaaattgaagctagtagtggactatactattaaacttgttcttagtatatactttacatacaaacgtataaagctcagaagttgtatagctataatcccttcccatttggggcacaaatttttttttttgctcggcccaacccaatccaaaaggcatcaccggtgaggtcaacgaaccccaacggcatcgccgtcgcatcgcatctccagatatccagcagcatgtgctgttccccggcatctctctgcccacccggccccaccactactccccccctccgccggccgccgcgagcacgctgcgtagaagggagaggagcagcgagcgaataccacagcgcggccacaaccaggagcctctgctccacgccatttccccaccggagtcccgtgctccggcctcgccgccgcattcccgcttcgcgctcgtggtacgttgctcacttgatctctctctctctctcctcagattcgcgcgcgagtcgtggccgtggctgcgctcgatcggctgcctatacgcgccgcggcggcgcgtggtggagccgctgctccggctccggagaaccgggagcccgtttggacggtagcaagcgctggagctgtacgcattactgcaaatggcggtcgctacctgccggattcgcctcgcccaatcgcctgcttcgttcgacaagcggatggggctgtgcgattccgttcactgtagatgcggcactgtagcggtagagctcgctcatcagctcgccgattgggtggctccagtccagcagcgccacctcacagggcaaatcgctgtgaatccctgactttaatgggctaaagatggagaatccgcttccgtattggctgcatgtgcacgggataataaaaaagtctcctgctctgatgggcatgttagtttttgtctctacactcggtgtgtgcgattgtaaatagtggacgcatgggcaccgcactgctggactggtatttgtccgccatgatttggagttttgttggattgtgtagacgaatttgggttaggtttttatattatatgattccatctcacgcggtaattagtactggtgcgtggtcatgcagtgttgtcaggttatgatgtgctctggctagtttttatttacacttcatcagacttcagtaagtaaaggttcatggccttagttatcttagggaattttgattatagtgttgtaatctggaatcccaagttgtgtgataaccgttttgtttattttcagtgttttttattatcctgtatcggagggtggtgaactactgcttctaagaatgtaatttagtttagtcagtgagcacaggagccttagttttctcaactaattggcattgcttgttaggagttcgccaaaagttgatttaggacataaggggttttcccactttcccagagcttgattcactgctaaactgcactctcctgagtttctttgtagcttcttagccatcatctagagctggttattgccttttagtttcttaaagttgatttttactcaatttcttaaagtctgttgatggtataaactatgaaaaggtaaatgcacaatttgctgaatatcttttccagactgttggacgataaccactttgagctggtgcacatccttatcaagatggctgtttctttaaaatcaagtggcagtttttgtagcacaccgcctcagtggctgcattcaacaagggatcgaattttatacggttattctcattcaaatgccaaagagtgcacttgcaagaaaacaaaaaggcctgctccactgtgtgttaaagctacttccacgaaagtggaattagatttcaatgatccatcttggaagcagaagtttcaggaagactgggataaacgttttaatttgccacgtattacagacatatatgatttgaaaccaaggccaaccacattctcactcaagaaaaacaggtttttttttgtgtctttaactgaattggctagctttcccttaagctgctaaagatgtgaacaatactttcttatgcaacactgtctgctattactcgggcagaagtcctgcaggtgatgaaaatggtacacctatggataaatggaatggttatgtgaacagcgatgatcgagcacttttgaaggtcagtaagcaggcaaaattagcaggcagtgttagattttaattttcttgtgtttaatttaagtaggatttgtatctaagtcatcaaagttcaaaatgtttgattgcacagattttgaaatttctattaggttatggagggagttatattttgttttacagtgtactccactgtatctgcacttacttttctccaactaacatttggtatttaaagcaggatgcagttcataaaagaacacctttacttttgttcattgctgtgtatgctttgcacttaacgtaatgtgcttgcttttaggtgataaagtattcctcgcctaactctgctggagcagagtgcattgatcctgactgtagctgggtggaacaatggtatatttctcatcacttatgagttagtagctctttcgattctgctaatatacattgtttcttcaaatatttgattacgtattacatcatatcagtttccaccttcagcgtttagcagttgttaattgtttattagacttaattcgttatattcttaaatggtaaggcgttgataaatagttttatgtagggtacatcgtgcaggccctcgtaaggagatatactatgaaccagaggaagtaaaagctgccatagttacttgtggagggctctgccctggtttgaacgatgtcatcagacaggtcattgtcttttagcattgttcaaacatctttgaattgctcatactgctacctcaaacatttgatatgaattctggtagctacatccattttgggattagggttatgaagcatgcatatgaattatcagcaatagtcaataccctctaattgcttcactttttcttggcaatgtctaattgctgcacttagctgcaaagaaaatcaaaacaccaaataattaattgcacttcatgtacaggtggttacacatcaaacattggttttttaaaaatgcagattgtgaagataaaagtgggtaaaaatgcaccactttatgatactgtatttctgtgtgtcccttgaccttgaatcagaaatatgaacattcctttcattcgaaatccccatgctgtttttagaactatgctctgtagtctattatgtactttgatttcaactggtattttttacttatgcctagaatatgtgctgattccttctgcaatttttagcaagaaataatgttgcatgtatgacttacaaatcgttttttccgcgtttgcagatagtattcactctagagacctatggggttaagaatattgttgggattccatttggttatcgtggattttttgaaaagggcctaaaagaaatgccagtaagatacttttctatattcataattgtcaaaaactcactactccccaattttttttcaaatttcatttgatagcatcatccagctttcacgtcatctggtggagaacataaatcttgctggtggaagttttctaggagtctctcgtggaggagctaaaactagtgagattgtagatagtatacaggtaagcactctgcactgcaaggtttgatgctgtatttgttattcctctctttgagggaggctgaactgttttcaaaattattatctgattattgtaggccagaagaattgatatgcttttcgtgcttggaggaaatggtacccatgcaggagcaaatgctatccatgaagaggttttatgtctttaattttcattcacttcatcattcaatttttatttcccagtaaatctttcaggactcattaggccttcttttacgtgcaaactaaaacagaggccaatgtacctatgtacagaagaatttgcataacatattccgtgttcatccttctttgttataaaaaaaaattatattcatttttctccacaattgcagtgccggaagagaaagctaaaagtttcagttgtagcagttccaaagaccatcgacaatgatatacttttgatggacaaaacatttggtttcgatacggctgttgaagaagctcagcgggccattaattctgcatatatagaggtaagttaaattactgatattaattgtgtgttaagcttttcaaatcagttgtagagatgaaagttcaagggaataaatcactactataattaggcacgaagcgcataccatggcattggtttggtcaaattaatgggaagaagcagtggcttcattgcaatgcatgcttccctttcaagtgggcaggttgatgtctgtttaataccagaggtgtgtaaacattacactgtattatgtttgagactaccaattctcttatgtacgatctaccgataaaagcttactaatatgaatgaaggttcctttcacgcttgatggagaatatggtgttctacgacaccttgagcatttgttaaagaccaaaggattctgtgttgtttgtgttgctgaagctgcaggacaagtaagctaaacttcagagtgatttcttcatgactttttggctacttttgttccagatacagctggaagcacgtgagtcgagagcctatgatttagttattctacgttcattacaggagtttacaaaaatcaggtgcaacagatgcatctggaaatgtgatacttagtgacatcggtgttcatatgcaacagaaggtgtgtatgcgataaccctcttttactttgtgctctgatgctgtagttttagaagcgcatggttgtgccacattttgttgttaaaataggtttgccttaccgtctcatttgctttttctgtacattcgtagtagttcagttctatttagatagttgaacccaaggcttccctgcttttgtcttcccacgtttcttttctgtattgtcaatcataccatcataatagataacatcagttacaattttcagattaagatgcatttcaaggacattggtgttcctgctgatgtaaaatacattgatccgacatatatggttcgggcatgtcgtgccaatgcatctgatgcaattttgtgcactgtacttggacaaaatgctgtaagtcgcttcaggcatgcaggcctctgacatctatctttcgaagtgtggaggactagaggtagcattgctgcccatgtcatatggttggttaaatgaaaactgcatgatggtgcctgcaggtccatggagcatttgctgggttcagtggcatcacttcttgcatctgcaacacgcactacgtctacctccccatcacagaagtcataacagtaccgaagcgcgtgaaccctaatagcaggatgtggcaccgttgcctaacgtccactggccagcctgatttccattgatcaattctttgaaggttccagctcgagatgatttgctattctttcggtgatgtgcttcacacaatcacactacagcacgaactagcctagaagatagtcaacacaatagtgatgctgttataacacttgtttgcaagaaaaatttcatggatcaatgtgattattcaaactccaaagccataactacggtgtacatcagattctcagttctcactctggagtctagccacggttcttgtagtagcagtgttctctgaactgtttctgaagaagaaactctgaattttgatttggttttgctgtttctgcttctgctatctctaatgcaaaattcaggccggtttggcaagccggaagagatagccggtctggtgaagttcctggccgtccatcctgctgcaagctactactccattcaaaaaaagacaaaccctagctacgaacctagacacgcatatgtccaggtttgtaattaggattggtttttttttttttttgacggagggggtacatcactgggcaggcaagcacaactgcagagatgttcttcagatgtgcgatcaaatgaacatgttttgagagattaagttgcctaattgtggtgtcttagatacaacagatcaaggatgcaactaaaattgtacacgagcccaaaatgacgtttctctttcgtgtcttcactgaaaactagtcgacgactcgggtttatatcctctaccataatgtcgctattattatagacactgacatgtgggataatagcagagtggaacccacgtaccagtgatggtggtggtagtaacattatagtagatgatcctaacccatgacgactcccttcaagaatcaattatccatctacattcatttggtttcctggttgcaaagttgtctacgttgatttatcagcttcatttggcattcggttgagttggtttattgagcaccgtccaggcgagtaggcgatccaccccaacttcgccggcgatcatcgcctgcacgaaacggtgaactcgcgcacgaatttcccttcaacaaattcggccaccttaattcatgtcgacaaattcagtccacaatcgaattcggcccactaatttctcatcaataaatttggcccaccaaaaaccatgactgaattcagcccatgaaattcccttaaaaaattcggttaaccacggccacaaataaaatcggcccatatttcccgtcaatgaagtcagcccaaaagtaaattggcccaaaaatattaatggacgaacttcgcccacaatctaatcttcacacctcaacgaagttagcccacgaatttggaccacttaattctcccaacaaattcaacccaagggcaaatttgaccccactgaattcatgtcaacgaattcgatcccaagagtatatttaccccacgtaatttccatcaacgaattcggcgcagctacgaatttggaccacctaattatcgctgacaaattcggcccaccatcgaatttaaccctccttttttctgtcggaaaaagtacaccgaaggtccctcaacttgtcatggagttacaaaatcgtcccccaaacataaaaccagatactgtgagaccctcaactaacaaaaaccgttcatttgagatcctttagtgggtttgactccggttttatccgacatggcggctaagtcggatgccaaatcagcctcctctttcttttgctctcttctctcccttcctcatctctctctctccattctctgtggtgatggcggctacgggcaacgcggggctgagtggtggccagcggaggtggcgtgcgagcgcgcggcggcggcgacaacgctcgcatcctgtctttcccctttcttttttctctttttttttcttctctttgccgcggggagtagcagcgggcggcagcggcagccggcggaggcagcgtgcgagcgcgcggcggccggcggagcagagcggcagcgggcgagtgcatggcggagggtgccgccgccgccgccgcgccgtcacgaagcgaccgggagacgccgacgcggttgccgacatgcccagaaggaggccgggggaggcggtagcggtgcactggctgcgccacgccatgttcgacgcggccggggacgacggcgccgccggcggcggccacgggcgcttcatggacaggttcgtctccgcgctacaccactactcgtgggcgcgtcgtcgcagccgcgttgccttgccttgccgttctccagggcttgctcctgctgctgctcctgcgaactttaatctgaatcagtgaacttgcatttgcatttgcgcaggcagaaaaaaatcagttacttgtctaaaactccgaagttactaacatgcatagcattcactccctccgttttataatgtaagtcattctatcatttttcatatttatattgatgtaaatgaatctagagagatatatctagattcattgacatcaatatgaatgtggaaaatgctaaaataaattacattataaaacggaggaagtacgtgtttaaaacgttgtgtatttgggttgttttgttatagactgttttggaattgcacaactgaaactaaggtaatgataaattttccacatcttcttgtttcaaatggatgaattgaacaaaatttattgtgcttgcatttgcagaaacaagaaattcagtttcttgtcagaaattatgttgttacagtatgaattgacttgcttaactagattgaattttgacgacgaacggatcaacagtgaagaggcgtctacattcatggttcgttcccatgaagatgtacaggtgcaaaatctgccgtccgttcgtcttcatcgacctcctacgccccgtcccagtgcaggcgtcggtgggagagtgcggctgtggagaggcggcggcgacaggtgagcgcggctgcggatggggagcggcagcgccgacgactccgcgccgctcgggctcatcgtcgtcggtggcttcgtgcgcgggcggagcagaggtgggggaagcgaagcaaaggggcggggggcgtggcgggcgagcggctccgagcagcggctgggatagggccaacgggaggaacccgagtcgtcgtcgtgctccgtgtcgcggactgccgcccgtcgcaccagccctcctctcagccgcgctcctccctcgccggctaccgcccgctgcccgtcgcaccggcctcctccccgccaccgaaggctgcgccggccctcttccctgaccggccaccggacgcgcctgccgcgccggcactcctcccgtgctggccgtgctcctcgaggggagaagagtatgagagagagagaggagggagaggaggggaaagagggagggtgctgatgtggcgatgtggcaccatgacatgtggggcttacgctgactcagccgccacgtcagataaaactagggtcagaaccatctgaaggataactcgatgacaagttgaaggaccttcagtgtactttttccttttctgtcactaaattcggcccacaaataaatgtggcacatttagttcccatcaacgaatttcaggcctcgaacgaattctgacgggccaaacattaatacgagataatccggggcttttctgagaaactacctccaatggacaactgctgcctcgctgaccggtgggaccgcttgctccggtgaagcgccggccaggggagaggcgccggcgtccgcggccgcggccgcggccgcgaagagcttcctcgggaagcacacgccgccgaacttgcgcttcctcctcctcgtccgtcgcgacggcgatgcggacgggacaggcgctcggcgtcggcgtggcggcggaatgcgtcagcgtgggcaacggggatcgcgggggagggcggcggatggaactcctggccgtggcggtggaggcggaggtctaggagtgcgcggacgacgaagagaaggaggtggtggcggctgagaggaacgcgctagctgggtctactccggcggcggaggcaaaccgccgcgcgcgagccgcgagtttgtgcggcggcaacggaggaggaggacgacgccgccgccgactgattgcggttgtcccattggagattgaggtaatcactgatgatgattttctaatttagcctatgatgatctgaatgcgccctgataccttttagaactgatccaatccgatcagtttggatcttagtgctttgcagaagaaatgccactgtatcattgataataatgctctatttggtaatcagtaaagcatcaacattgtgcttgtcatcataattcgtcactagcaggcttgcatcataaattatttcagagaaagcctagattcgattgctgataaaatcctccaatattgaacttattgcatcaggcaactgctgctcacgttgtgcaaaatattaaaagagaaaatccatgaaatgccattgacaagcacactaatccaagaaatgccatcgacgaacgcaacttccaggaaatgccatcgtacgagccattttgtcccagaaatgccatcaccgtcacttttactctgttagataccgttaattttgtcaaaatgaccagattgcccttctcaacctaggacaaatccccttcaccgccggccactcctcttcctcccctccacttcaaccactcctcttccacctcttctcccatcgtcggcggctatcaggaggatcgacaccgttgccgcacccccgcgcacgtcctcactcggagcaccccggtcgtcctcgccctcgagcttccgccgccgccaccgctgccgtccccgagctcccgcccccggcgacttctccccttccaccaccgtgagggggccctctctcctctctctctctctccccgacgacgaccttgaatgacgaagtgagactgtggaagttgaggcggactcggtggctgtgcgcaagtggatctggacgtcgttgaggatcgacgccggtgacgtgcgcaagtggatctgggcgtcacggccaccggcgggaggtcgccagagctcctccgcacctcccctggccgccgccgagccgtcctcgccctaccctggccgcgccgcacgtcgccactcacgctgttgcagccggctagaggaagaagacgatggggaaaggagagcaagcagccgggcccacctgtcattagcctatcaaaatttttccatagaaaaataaatcagcagaaatgtaaatcaaagccttggcccacttgtcagccactgtagactgaggatatgtgtcggattaaaaaaatacattatgaacagtgctgtttcatttggtgaatttttgagatttttctcatgtatagtttttcctatgaaaattccaaaatcttaatttgcatatacattatacatcaagggcaaaatagtctttacacatcatctaacggagtacaaatgacagagtagtgacggcgatggcatttctgggacaaaatgactcgtacaatggcatttcctggaagttgcattcgtcgatggcatttcttggattaggatgcttgtcaatggcatttcatggattttctcatattaaaaagcaagttcagagaacgaaagctctgttgtaagccttgtagcaacaaaagtattagataataaacgaacaatttgtctcttattaatacatatttcgtcaacactggtagcattatcctcctgataaaatatcagctcatcagcagagagagagagaaagcagcctcacggcctcacccaatggatggctgctcttcctttttgttctctgctttatttactcttcagtgcaaagttaaagaacaaagcccctcgagctggaattgcttggttaggaccctgtgcattccaccaagcagcaccatgcgaactcacttcttttcttgtttaaagtaaagagaattagagctttagtagtgccccaagcagcatgctatcatgtgtgtgggcgatataatattataatgtgcaaagaggcagcttaaacttgaatgaagaaaagaagattggacgttgcaatgggtgatcttttctgtttgctgttctttgaaacttcggtttgagggtaaaaatccatggatcaacaagatttaaaaaaagggggcatcatttaggacaactacttaagagaaaggatcatttagcacaatgaactaagtatcgatgttttctctgttccttgttagtttgcatggggttgggagcttcttgattcaaaggggaatttctaaagcataaagcaatagttcttgagcttgttaaatgccctatcccaacacttctcttctttacaagggttgcttggtgtgcaggacagggactaggggaggagaccagggaaccggtgtaaagattcttagcttcccaaggtttatgtcaccatctctttattcatgcctgtcacaaccttctaaaacagccttgaattaccctcaagcggcatgcatatgattgtgacagaatctaaattgcctgctgctatttctttggaccctctcagctcatatataggagcagcaattgctgctggcttccctacaaaaacagggaaagcattggaggggaaagggaaatggcattgtctgccaataggctgctaactgttcttctatgcttgttgctgttatctcatcagcagaaggtgtatggcttgaaaggcattagtcttgccttcggaagggaagaggatgaagtgcccgagaagaagccgcgggtgcttgctcaaagtaatgctgccaatctcaacaacaagggcgggtactcagcaagtccttcatcagctgatcccaacagaatgagtgaaagaagggttcggaggggttcagatccaatacacaacaggtattgatgcttcatcatgtagggaggatcagagacaacaagaacatcatccaagatatgatggatcagttgatgcgaggcgctaaaggttttttggtgctttctacttgtttttaaacttgtctgtttgatgcttcttttctatttcatttgtgtttcttaattatttcgtaatggatatatctgtaaaaagtttttagtggtaaagaatgacgacgtactgcagtaatcaagtgtggttttgaatgaaaaagtgtatgcgaaatctccatatgttcatgttttagcttagcttcccaaaatatattgctgtcaccaacatgtatcctgcgtttgcttcttttccgttggctggttcacaataaggttaacatcaaaagcgatcggtgcaatttgaacatttataaccttatcacatcttattatcgccatgtttgtttgaatcatgtagattactgtatttcctcaaatcattatttctttctttggggataaaagaactaataagaataatataatttataactaactgtctaataattacctcttggacaaagactggctgcacatagtccttgcaacttagattgcaaaatgaccatagaactttaccagccacatgaaaattattgatcaaaaactgcaacctatagctctgaatctcctccatgctttgctaccctaaccttttatgattcagaaaatgtcctctgatatctaccacgcttgtgaagttgcagcttcaccaaatgcatcttccgagctacagctccccagatcatctgaacagcgtcaccaggctgcgaagggtactggtactcgaagtggtgtgcaacctccttcagcctcctccacattgccgtccattcttcctgggagatccccctgaggagatgcagcaggaagcccctcttgacggcgtcggaggcgcggacgaacacgcagaaggcggagtagtcgaggacgtcctcgaaggggagctcgatgtcgtcgctgatgatcacggggacgcagtggctgacgatggcgtcgaagaggcggttggaggagggggtgtcgccggcgatgttgaggcagaacttggaggaggccatccccttggtggcgcgcctgatgccgttctgacggacgctgccgtaggtgaagtggacgtccttctcgtccttgatcagctggtacagcctctgacgaacccttccaccctgaaaaaaacattacagtttggctgaaaagttcagtgcaagtgtgcaactcacttagacagtggcaactcagtgttttataccacctatatttgaccatagtcctttagaagaacttgcaatggttgagccctagactctggtagaaaatagagtttataaattaaagtttgaagtggcttaatcctcttattttggtttaaaattaaaatatgaacaaaatgtctcacactactaaccataatctaccagtagctccaactccaatttacttttggagctagaaaaaacccaactccagaaatcttttggagttgaaactgtagcaatcaggggcatagattttaaatcaactccaaatcatgaataagtattccagaacgatatgttttcatgtccagaggaaatggtgcttcaagtcgaagacaaacttacatctttcctatgatttaatttttaaattttgtgtgagcaaaaatcattttccaaaagtcaatagcgtcgtgtatttaaaaacggaggaaatactactttgatttggtggaggaagtagtagtttgatttggtggcgaacttacatctttccaaaagacacgaatattaggaaaatgacctaatatcaaataattagaaagggtgagacttcgaacccaggtcatctagcgcaccaccttatggagctagctagaagacccctgggtgtttctcgaacttacatttttcctatgaatggcgccctggaagtaagcgaggacggggcgctgctcgaaccccggcgagtcgccgtcgccgagggaggggacgacgtgcttgtacggcgcgatcacgtccttcctcaggttggcgacgtccggcgggtacctgccgaagtcggagaggacgaacatggcggcgctgagccgccgccgggcgtccatcatgctgttcgggtggtgcggcacgacgaggtggtccgcgccgccccaccgccgccactcctcccgcctcgccaggtacctcaccagctcgccctgcagctgcctgtcgctccggccgccactcccatggccgccgtgcggcgacttcgactgccggttgtagctcagcgacgcgaagaacggcaccaggaacacgtcggcaaggctcgcgttcgtcaccctcacggcggtgcacggacggcggcggcggtggtcgccggaggtggtggaggagaggatgtccagggtgagccagtactcgacgctgtgctgcaggttcaggccgcccgggtagcgcggcacggcgcgcgggtcgccggccacgtccggccacgccgcgccggccgccttgccgtcccaccccagcatgccgaagtggaactccggcgggaggtcgtagaggtacaccctcagcagcgcgctctccgcgtcgcacgtcgccgccaacgccgccgtcgtcgtcgtctctcccgacgacggctgccgggtgatcatcgccgccggagtacccacacccacctcgacggcgccgcgcgacgtcgcgttcccgcctctcgctggcatctccgcttgggtgctgcttctaacaataatgccatcgtggtcgtcatgctcgccgccggcggtcgccgcgaggacggcgccgtcgatccgcgagctgacgagagcccagcaggagaaggcgaggagggagaccgcgaggaacaccacgtagcgcagcagcgcccgcctccggtgctccgccgccggcggcgccgccggcgatggctgcatcttcctctccgccaccatccacgacaccagcgcgcgcgagcagcgcaagaatccagccaaactcaccgctggaatgaaattcgcccaaaacaaaaataataaattcaaaccccgaattacttactgccaaagatcaaatcaaagaaacgagctgctgctccatttcaacaacacccctgctccctccctgcagatcgatcgattgagccgcggtcgtcagttaattcgtcatccaagaacggattaactcgatcatggcagggatcagaggaactaaatatatatatattctctaaccaacacaacaacattaataattataattaaatttataccttcatggagcactggtttcttcttgtgcgtggtggagaatttgccggcgttgaaaaggcggcgtcttgacgagagatcgatgaggaggcgcctcgtcagggccatcgtcttcttgaccggcctatgctgcgatgcatgccgctgtcttcgttctgttttttttttttgttctttttttcattttcttttccctgatgacatctactactagttcgctgtttctgttgaaagatttctgcagggctcgacgggaaaatcggatgggaatatggggatcgcaacggactttgtcaagataaaatcagtcagatactcgcggcacaactgtgagcccgtgtactctcctagtagtcgtcaaccgagttggaattcgcacatctaaaaaacaagcaaagtgtacttaggatatcgagacttcgagatcattttgatagagtacatgttaaggatcagtgttttgatattagacgtcagttcaaaactctagtattccgggaacacggcttcatgaagatttatttggttagtgcttctcaattaattaagtttggctcacccaactaatgttggctttgacatttctaataacgaactagtaccgaatattttgagaattctcttctttgttttggtcaggaattgagtttcgttgtggcatgtgatttgatggcgatgagtttctgttcactataaatttgttttaacaaacacatgctcacatactaaacaccacactcatattcatacacgcacgcgtgcatctcctaacacggctcaaagaaacatagaccaaccacatgcatctgtggggttttaaatttatcatgtggttttgatttagaaaaaaaagtctactacctccgtcacaaaataagtgcagttttacaatatttatatctaacgtttgaccgttcatcttatttaaaatgtttttatgattagtacttttattgttattagatgataaaacatgaatagtactttgtgtgactaattttttcataaatttttcaaataaaacggacggtcaaacgttggatacggattcccatggctgcacttattttgggacggaagtagtattttacttttccgaacaatttcaccgaaacttagtatatttgtctcttcccctcaacccatccctatccttctcaccaatcacctccactatacttattggcataataatgacctgtttggtagagctgtaactcctaaatttagctacaatagttgtgtctgaagtggagttgtaaaatagcttaaacccagctacatctctctagttcattttgtgagagcgcttcaccaagctccgctccgatgttaggtggagtgaaactatttggctgggctccagctctaggagagagagagagctggagctgtaccaaacaggtcctaaaccgtcaacatttcctttcgacgtgctaacacttatactatgtccaaagaggtgatgtttgtgcgaaaaaaaaactcatccgtcccattttaaagtgcagttgtgggttttcgtgtccaatgtttgtttgtcttatttaaaaactataaaaaaaattaaaaaataagtcacatataaattactatccatgttttattatctaataacaataaaaatatcataaaaattctaaataagacggacagtcttgtacataaaaaaatccatagtttaaaatagaacggacagagtatttaagtctgtcaagtccatctttgacgtaggcatcagcatcactatccacgtgaactggcacaatcatgtacactatggaaaaaaccaaatctatcgtgatttgcaagagattaacaaaagctagagcatgtggtacaaagaaattacatgagatattttatggtctcgagagataccaaaatttttaatataaattttaagaaatagtaaatcttacataaaaaatatgatacctactttttcaatgactgtaattcactcaagaaacaaattaaacaaactagacaatcacagagtaactggtcatagtgttttggaagatagtactaggaccgaaggagacacatgctgtccggattcgtaggattacaacgcgtcatattatgtattaggtttattttttaatgagacgaaggaagtaaggtgctaagagcacccgtaatggtaaagtaaggtgctatctataaaacatttacatctcagcaatagactagattaatagtaaaccacttcaatggtatgtctacatggatatctatagctctctaatgcattgcctcgtttttctctatagactatctccaggttagtagatagctttactctctctcttcatttaatctcttccaagtaggaaaatatgctgacatgtatctcttgtagagagcctatagataaccattgtgggtgccctaataaaatgttcatttggtactttgacttgaccgatagcttcttcctccttcctcttcctcttgacctatgcaagttggggagaatggcgttaatgcctcaccgccctcgtagctgacgacgtcggccttcccgctgcttccttgtttggcatgagtaggccggcgaggtcccatgccatgccctcgtcgatgaaagtggcggcaacattaggcttcctcgtcgacgcgtctgaagagaggagaaacagaagtgaggagagggaagggagggaggtgaggtggagggatgaaggttgtcacttacacgtgggttctagtgtaatttttctttgtttttgttgctgactgtgagcgccacgttcgtcttctttttccctgctgattggattgctatgtactcccttcatattaaaatatgtatgacgccgttgactttttgataaacatttgacatttcgtattattcaagaaaattatgtaattataatttattttattgtgacttgatttatcatcaaatattctttaagcatgacctaagtatttttatatttacataaaaattttgaataaaacgagtagtcaaacgttagttataaagtcaacgacgtcatacattaaaatacggagggagtgcatggaaccgctgttgaaacccgttcagggagataatatgaggcggattgtcgagggagtaaatatggatgtctttttttcctttgccatttgagccagtgtacacaaaagttgaaaacggcccaacacggcccagtaaaaggaacgggtgccgtgggcaatgggccgaatatcgttgggcttgtagtaaaacgttgcagcagacgagaagcgaaagaaaaagaatcgcccgcgcagatgagcacgccgcccagggtttgcaaaaccgtcggtaagcgcgcggttacagtgaaaaaaaaccacggtcacttgcttaaattcgaataaatttaaaaataatttaaaattttgataaattttacacggtttcgtacaatttgtcacggttgggccgcttggagtagtggagtagtagcagagatgaaaaaacacggcgcgttttcataggggaaggaagcaagacgtgcttagcttcgatttgtttgtaattgtacgccgaggctcgtcacagcctcacaggtcgcggttgcggagtggaccgagtacccgatctgaggacagtagtagtcgtctcgtcactgcaaggaagtgatgaaccgtgtgcaacaagtgcagcgtgctgcttcccccctttccgttccactgggaccaaaccaaaccaaaccaaaccacaacacgtgcgtccgtcccgtagtccggcccactcgtgttggtgtgtctcctccgcgtcaaccactacacctgaccaggcaaagccgtacgtaacgtaccatcgcatggcatcacatgcggcgcga

SEQ ID NO: 63514 - DNA, 2316 bp, Oryza sativa
tttgagcatgcatgatgtgatcgtcatgctcatgcatgcatgctgtacatgcagacgatccagcagtgttgtgcatggattgatcgtataaaattgccgatcgatgacgatgagagagggcgtttcgtgtcatctaaatttgtgtgaaatcaagactcaagcaaaggcatgaattattcagtactcagtcccatgcattgcatgcatgcatggccgcgagaggtgaatgatcgagcatcttcaggccatgatcttttttttggggaaaaaaggagcatcttcaggtcatgcttgtgactgagatcgagttcatgggataacgcagaacatgttatgcatcgatatgatccatattgctgcaggagattcatgtggagatgcaaaagcttattgatacaccccccttcgatatatctgataatctgaaaggagttcttttttttttcataaagaaagtctgaaagaaattaaaacaccagtactctaaaaaaagtcttaagagaaaactactccagcatgcagggcgtgatgaactctcgcaactaatttcatgcgattttgagtcatatatattggacagtgccagcgttggcgatcggttatttctccattagttatccagctgcgtgaactgtgttgatacacaggatttcaatagaaaatcaagagtgcagcaaaatactatgtggaaacacaagtgcatgcgtgctagctccggccttagttttttttttttggagatcagtacataccaccagctagcgatatgatcattcagcgacgtgcatgtcatgactaactgaattttttgcttctgaattcggttcatctgttgccggcctccctgctagtcagctcatcaaaaagactacaatttttttcagagatgctgaattcccgtacgtaattctcttctcctccagccctttccattggacaattgcagctactagtagcttaccagcaattttttggggttttcaaacaagttgctttgtactctctccatatcaaaatatatataaacatttttagactctgacacgatctccaagatgctattttgaccaacagtatctataaaaattaagatgttttaaataaaaaaagttatatattatgatagtttatttaatgataaatctagtaacatcaattttacatgagtaatattttttattttgttgctattaatagtcaatgttgaaatagtttgacttgtcactatgttaaaaatatttatattttgggacggatggagtatttcttaggtaatctgatttttttttcgattacatggaagacgcgtacgcacacataacacactcacacactggaaaatatatgtgtttcttaattaaaacatgcccaaattagagacgatggaggtccaactatagttcccctagcttcataaaaaatatgttaaaagcgcacaagtatacataatattcctcagcgtcaatagttaaattctgatggatggagtcatacacccataactttcaagcacactatactagtgcttcccttaggtcgccaacttttctcttatcaaaattttcattttgtctgaatattaatgtgatgaccttttctattcgacctaacggatgaaaaagtcaccaactttataaaatccggggcctctgctgccccgttgtccctctgaaatctgaatccgatccccacccaagattaatccggccagttttgcccgatgccattggttgccgtcgttggcgaagaagctgccggagagagctagctggaggtcgaagaagcacaggcaataaactgtgatttcttttgttctcagccttccagtatcagcttgtcccatatatccaaaatctcttactccctttgtcacaaaatgttgctatttaagatgggatttgaaatcccatcctaagacaacgagaaccggatttgactcatcctaagataatgaatctggacagaggttctgtctaaattcgttgttctaaaatgtgtcaaatctcatcctagatagtaacattttgtgatggaggtagtatattttaggacggggagtagctagaagtaccaattagttccatgaataaaaaaagatcgttcttctcggtgaaaaagatgcctaatttaattcttacaaagggatgttttttctactatgtattatatcatcatccatatcatatactcatattcggagtatatatgtactgtatgtctgtatatatcttttgtctgaatttttcttacgtgcacgacgaacagccggccggccggcagagtagcgaggctggagagattttggtcgtctcggat

SEQ ID NO: 63515 - DNA, 10060 bp, Oryza sativa
cccttagcttcgggaatgtgttgaagttcggtgtctgccccttcacgatatatttctggtacagatctcccttgatgctatgaaactgttctgccattttctttagagttcaccttttcactatgttctctatacccgcgggaagggtgaatgtctcgagcattgtggtccacagcatctctttctccgaatctgggacaaagctctcatgatctccgcgtgcccttattctgcgccagtacaccgtactgacagacacgttatcctgcacaacccaaccgttgtgtcgtacgtagttcttggctgcttctgccggggcactaggtcggccgtcttcgtccacttccgttatgatgtgttgaccctctagcttcttcgcggcaccttgttgtccgcgtgccctcttctgtcagcggagggttgacttccactagcctcctcctcctcgttcccctccacatccctctccacgttcccctcctggttcctctccgcatccctctccatgttccattcctcgttcaagtactggtttggatcctcgttcccctcttctttgttccagtactggctgcttccctctgcgattgtatcgtacaatatctgttcctcatcgcaatcagccatctgttcatacaagaaatatttgctaagtctataggtcatatttgctttaacaatcatatatgctaacaatcatatatgctaagtctaagtgtcgtatattagaaccctagataataattaaaactataccaatcttgtattaaaactctaacaatcatatatgctaagcctaagtgtcgtatattagaaccctagataatcatatatgctaagtctaattacaaatctaataatcttatattaaaactctaataatcttgtattaaaactctaataatcttatattaaaaatctaatagtcttatataattagtcctatattaaaaatctaataatcttatattaaaactctaacaatcacatatgctaagtctaagtgtcgtatattagaactccaataatcatatatgctaagtctaagtgtcgtacattagaaccctagataatcatatatgctatgtctaagtgtcgtatattaaatctaatagtcttatattattagtcctatattacaaatctaataatcttatattaaaactctaacagtcatatatgctaagtctaagtgtcgtatattagaactgaaataatcatatatgctaagtctaagtgtcgtacattagaaccctagataatcatatatgctatgtctaagtgtcgtatattaaatctaatagtcttatattattagtcctatattacaaatctaataatcttatattaaaactctaacaatcatatatgctaagtctaagtgtcatatattagaattcaaataatcatatatgctacacattagaaccctagataatcatatatgctatgtctaagtgtcgtatattaaatttaatagtcctaattatattaaaaatctaacaatcatatatttacatcacttgcctgcgcgaattctgtcacaccctaaaaatcctaaatatataaattgttgtttaaatggaattattagaatttattttaaaagcctagaagagaagatctaattttaattaataaattccaacataaaatggggccagttaaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccttctctctctccccggcccaagtcggcccagtccgcagccgcgcgcgctcgtgcgaccgtcgctgacaggtgggtcccgcctgtcagagtcgtcgtcttcctcgcgtcggccgccgcccgaaaccctagcgtcgcgtccgccgccgccgctttccaattcggccgcgtctttcccgatccggtgaaatcgtttgaggggaaacaatcttcgggatctcctctaccttttctcttttggaatcatcgtctaaatcgctttggaagttcgtggattcgaggtcgaatcggatcggtctctttcctccgaaccccgaggtttccttcgcgtcgccggtcgccgtgggcctccgccgccgcctcctagcccctttaaaaggatccccggtgtctcctctacccgccgccaccctcgccttcatctctcgtcgtcggaagcgccctagcgccgtgtgacctcgagccgccgtcgtcgccgctgctccagccgtgcttcgccgtcgctccagtcgtcgtcgtcgctcggggaggtctccatcgtggtcgccgtcgcgtcgccgtcctcgtccgcctcttcgccgtcgctatcaaccgccggagcatcgtcgccgccgtcgacccgatctccgccgccgcttcttcctcgtcgccgacgtcgtccgttgctcttccgccgcttctttggtcaccggtgagttcgccgtgccgtccgctacccgtgggtgccctccgttcgcgccgccgcgccgtcgttcgccggcgagcatgcgtgcccgagccgccgccggtgctgacgtcatcgctgacgtagccgctgacgtcatcgttgccgtctgtcgtagaccggtcgtggaccgatcgatctcggccgtccgttttggataagatcgatctcggccgttcgtttccgtgaaccgccgccgtgcgcccggtccaccgaaaaccctagccgctgacacaataaatccctttttccttttcaaaaataattcattattgcgtcataattcaattaaaatcaatataactgttttaattcgatttaatctttgaaaattcataactaattcatcttagcttggatttagttggttcaagtctctaaatttttctaaaattgagatctacatgttaaaaatatccacatgtactgttcatgcttgtttatgtgctgttctggtgattttgctctttcctgtttagattccgacgtttccggagagtctgtttttgcaggaaaagaatttgaagaattccaaggccagcaaggcaagtcacacagatcccaaacaaccctttgagcatgttgatcccgtttaaagctattgttttcattcaactattgcatttattttcgaatgtcattgggtggaattaacctattgtttgttatagcccttttgttcttgattactttattccttgataccttgggttattttaacttgactagttgggctttatatattggttcagctagatattagatatgattgcttagccatgcttagaaacattagcacactattgggataacttatgactcactattatttaatgatggcttaacgatagctcacgatggtcaatcgtgattggttaattaattaatgtgccaattaaaacctgataatggtgggttgtgagcacatggttttgagagtagtgctcatgacaatcaaggaccggttcacgagtttcggttgtgaaacattaaccgtgccaaccacaagccagcgtgggcaacggctttaccttttgtatagcatggtttattgcggggcaccagactgagaagtggcggagataagcccacaggcgtcgctggggagtcaatgccttgtttataagggggtgattatgatccaggaatggtgcgttgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcttagtaaaagatgctataactggtaataatttgtttagctcctggtttggaatggtatattcctggtttggagatagatctgtacagctgggtatggttgttcagaaaggttgggcctatacaacagggtatgttgtatagcgttggattaatattgtttaattattacttaattgttttattaaattctgaaatgtttattaaatgctgcttttgcaaatggaaccctattatgccatcctttggtatccttgtgcacttgcatatttgctgcgtgacttgctgagtatgtcatatactcaccttgcaatcattcatcagaggaagagttctacaatgatgctgatggtgtggaggattaggtgtagccctggtcaagctgcctgtggagtggagccgtctgcgccatttatcttattttccgctgcttagatctttattgattgagaggaactatctacctctgtaatgacattttattcgcttattaattagagtaataatggtactctattatcaatttgttattgtgtgcctcggctgattcctggacgagggtttacacacatgtaagcgtttggaattttggatagaaattccgggcgtgacaaattccttcgagggctagctacctctccggcttgagggacaacgacgacgacgtcttttctgcaacatacaagataatgtattagtctaaacgcaaagtaacatatatagtatttcacgtagtgtcgtataaggcgaccgtttgcgtttcattcacattcgttcacgtttcattcacgtttcgttcacgttcgttaacgtttcattcacctttcgttcaatttcgttaacgtttcgttcacgttcgttcactttcgtttaggtttcattcacgtttcgttcacgttcgcgttctcgctaagttcacatttcattcacgttcacgttctcgttaagttcacgttttgttcacatacgttcgttcacgttaacgtacgttaagttcacatttcgttcacgtacgttcgttcgttcacgttcattcatgttcgctcacgtttcgttcatgtggcggcagcggagcggtagcgtggcggcgcagcgtcggtgtggcgcggcggcggggcgtcgcggcggtggcgtgtcccggcggtggcgtggcgcggcggcgtgccgaggcgggggcgacggcgtggcagtggcgtcggcatcgtcgacagtgccggcgcgacgtcgtcggcggtggcggccgcatcgaggtcggggtcggcatcggcgggaggcggagtcggggtcggccgcgtcaacgtcggcggcggcgtcggcaacgaggcggcggtagtttggagagagagagagatcgaggtcgagagagagagggaggcggcggcggctctcaccctagagatgcggcggcggcagaggcgacggaggaagcgacgacgacgcccgcgagacgacggcgagatacgacggcggcgtcggcgcggggatgccttaggcagtggcggcgaaggagaagccgagatcagggaaaaaccttctaagtgttgatggagaagacgggggcgcgcatcgggaatatatatacccgtagatctttagtcctagttggtgagaacaacagggactaaagatattttcccgctatttccaaattctttttaaacccggttagggttgacaaccgggactatagacaatagcactgaatattgaatttcattaaatacgtgtttctaaaatagtaaataatgcattaaaattatttaaagtcgaaaaattaatgacaattacttcgaaaaattattgttgtctgtagtaaattaagtagataatacgtaataagcaaatatatgatttaaacttgttaaaaattctaataatcatatataattagcatatgcatatttaaaattgttaaaaattctaattaacatatgtaaataccacatccatgatttaaacttaataaaaaatctaataatcatatataattagcatatgcatgatttaaaattgttaaaaactctaattaacacatgtaaatgccacatgcatgatttaaaacttttaaaaattctaattatcgcatataactagcatatgcatgatttaaaattgttaaaaattctaataatcatacataattaacatatgccatacaacaattgatttatatggataatcagtacatccaaaatagtttacatcgtgtacataataattacggcaatacattggaggtgacggttgaccgcacgtactttctcctcactactgttccctccttgtgatcgctacgtgagtaaggggtgtcttcatttgataggaggatgctagggtcaatcgtcaccatgaaagggggtttcccatccaactgatcgtaatcctcgtcagtcttgtcctcaaatccgacgatttttcttttgcctagcagaaccacgtggcgcttcggctcgtcaagccctttgcccttctttcctttgctagacatgtccttcatgtaaaagacttgcgttacatcattggcaaggacaaaaggttcgtccgagtatccaaccttgttaaggtcaaccgttgtcatcccactgtcatcaatcgttacgcctcaaccagtcaacctaacccattggcacaagaacagagggaccttgagaggaccatagtcaagttcccatatgtcctcgatggcaccgtaatacgtgccagttgttccatcgtgtcccatggcatcgatacaaacagcgctgttttggttcgtgctcttcatgtcttgggctctcgtgtagaatgtgtacccattgatctcatttccttggaatgtcgcgatcgagccagatggtcccctcactaggaaggccagttgttggttaatcgtctcgttacccatgagatgttgtcatagccacgcgggaaaagtatcaatgtgatgccgtgtaatccatgcatcggacttaccgatgtttctggcgtgaactagagccaagtgctcctcgatgtaaggagccaccaatgaagattgttgcataaccgtgaaatgggctttacggaataaattattgtctaccgtcattattgctttccttccgagagtcccctttccccatagtctcccttcatggcgtgattcaggtaccccgattgggcgaaggtcttcaataaattctacgcagaattcgatgacctcctctgttccataccccttggcgatgcttgcctctggacgagcacggttacgaacatacttcttcagaacgcccatgtacctctcgaaaggaaacatgtattgaaagcagatgcgtcattatattcaaaaatgaaggtggaaatatcaactcaaaactgacaacacattgcaccacatcattctgaagggcttctaatctattcggatcgatgaccttctgcgaaattgcgttcatgaaagcacataactttgttattattgcccggacattgtctggaaggataccccttcttacaactagtagcagttgtgtcatcaacacgtgacagtcatgacactttaggtttgtgaacttattctccttcgtgcttactattcgctttatattcgtggagtatccagacggtacctttatgctctccaagcattcaaacatactttccttctctgccttgctaagagtgtagctggctggactcaagtaatagcttcctttctcctttggttccgggtgaaagtcgccaagttgttccatatgcttcagatcattacgtgcttccagtgtatctttcgactttccatatacacctaggaagccaagaaggtttacgcaaaggttcttagtgaggtgcatcacgtcgattgcatggcggacatccaagaattcccaattgggtaactcccaaaatataaagttctttttccacatcgccgcgtgaccatcttcgctctctataggctggcttccaggcccctttccaaacactactttaagatctttaaccatagcaaacactgttttcccgctgcgatgtttaggcttcgtacggtggtccgccttatgttcaaagtgcttgcctttcttccgtaccaggtggtttgcaacaaggaatcgacgatgacccatgtacacaaacttcctacagtgcttaagatacgtactttttgtttcatccatacagtgagtgcaagccttataccccttgttggactacccggaaaggttgctaagtgtaggccaatcgttgatggttacgaatagcagcactcataggtttaactcctcctgtttgtcctcgtcccacacggggacaccttcctttttccacaacagtttaagatcttcaaccagtggtcttaggtacacatcgatgtcgttatcaggttgcttggggccttgaataataatcagcatcattatgtacttcctcttcatgcatagctaaggggggaggttgtagatacacatcataacggaccaagtgctatggctgctgctcatctctccaaaagtattcatgccatccgtacttaaaccaaactgtatgtttcgtgcgtcctttccaaagtctttaaattttctgtcgatgtttcgccactgcgaaccatcagcggggtgtctcagtatcccgtcctgttgacgttcttcagcgtgccatcgcatcattctagcattccccttgttcctgaacaaacaccttagccgtggtattatagggaaataccacatcaccttagtagaaattctcttctttgttggctggccatcaacttcacctaaatcctctcgtctaatcttgtatcgtagtgcttttcaaacagtgcatgcttctaggttttcgtactcctcaccacgatatagaatacaatcattcggacaagcgtgaatcttctgaacttccagtcctagagggtagactatcttcttagcctcgtacgttgtctcgggcaatttgtttccctccggaagaatgttcttgacgagtttcaataaatcaccaaattccttgtcactaacaccattttttgccttccattgcaagaactccagagtagtatccaactttttgtgcccctgctcacaacctggatacaacgacgttctgtggtcctctaacatccgctccaatttatgggcctccttttcactttcatcgttctcctttgcatcctgcaatatctgaccaatattgtaataccctgaaattaaaaataaaataacatgtttggaattgggccgaatcaatttgggccacgtcgcagtagtccagcccacctcccccacctaataccctagggagaggcgactcccaccttcccagccgacgccgccacacctccccctcggcacctatggaactcacgtctcccctattaaccctactccatggatctccaagaaccatagccctaatcaagaatctgattggaaaaacagatcgaggaagaggagacgagcaggaagagtggtgggttggttttcccatcatattctctcaagttctccaaagaggcttaactctcctgtgcagaggttataggttgttttagggttgtaattcgtcgttattggagggttagaggatgggattaggtgttgtgttttggattagtgtttctgggcgctgtcagctttgctgtgtctctgtatttcgccaattagaggatcaaaatgatttttgctgcgaaagtttataactaggaaattgtagagtttttccttagctttccatattggtaaagtacactttgattgggcgagtagaactccagatatggctgttttaagtgtggcagtctgaattcttgggcagattctgaatcttgtcttgatttgcagtttagggcatctaaatggcagaataaaaatatgggttctacacgaaagttgtaggtctcattctgtagattcccaaaatgtatttatttgcagtcatatcatttttatttttcgagatataaaggtttgaagcaacagtactgtttatagtccaagcggcgttccttgtttttgcgttttgaggtgttgaggccgtagatgcatgttatttactgttctatatgcatatttgagtgtgttttctgaggctttgtttgtgattaggtggtggtccttcagatcgtgtatgataccaacccttcattagaggcaagtgaatgtagctgtgggctgcaggaa

SEQ ID NO: 63516 - DNA, 728 bp, Oryza sativa
ctcggtacccccaaccaaacagaaaacaagaatttcacctccgggtagggcgggaaaggcggcggcttggaggcttcgtcgtcggcggccatggcggaggaggaggagggggtgggggagaggggatggggaattttcgctcacgaagaggaggatatatgaagaagaagagatggatttggatcaggaatagataagaaaatatggaggaggaaggaaggaagaggagatggatgggctcgccttctttatttcttttttttttctctccatttttttttattgttaagctcggctgtgtcacctgtgtgagaggggaagtgagaagatgaggatggacggctgggatgagtcgatccgccgccatcggacggcgcggggagggatgggtcacgcggatcggtgacgtggcaggggtaggggtaggggaggggagaacgcgcgcgctcgagagctttatgttttgtttgcttttgcctcccgtcccgacccgacccgcgggtgccttttttgggggagctgtggaatgacggtattgccctccgtggtggcctcttttttttggttttttctgtggaagtgggcggtggtcaggcctgtgatttggctgcatggacaaagcggaaatgccctccctcccctgagttgggtgtgtttatatcggtattattgctaatattgttacatgcacagctgaggatgtacaacggtatagtgtggctggaaat

SEQ ID NO: 63517 - DNA, 541 bp, Oryza sativa
gtcaaacaagccacgtaggcgccacatcagccaaaaaccgcggaaggaccttgtttgcctgattttcgtaagttgggggacgggtcgtacccggttttgcggtcaagggacgaaaatcggactggacgagaaatagaggcacccaaagtgaacttattccaaattctgcagctcgtttcagtaggaaggaataagttcactttgactcccttacaagtgacccgaatctaattcatgaccctaaaccacaaaaccagatatctagacccccaaactattgaaaccagtgcaatttaactccctgggtggttttggaggggcggttttgctgacatggcgctgatgtggtggtgttgacctagtacgtggggttgacgtggcgcttaggtggtatttgaataaaaaacatatatgtgggacccgtttgtcattcacacacataaattttgtggggtccactgacatatgggccccacaagtaatcctctttttttggttcctccccttttcctcccattttttctttctttttctttctctg

SEQ ID NO: 63518 - DNA, 12294 bp, Oryza sativa
  unsure (1)..(12294): unsure at all n locations
aattcataataaattcatttgaagtcagaatgaggccgttcaagtctcataattcatctaaaaatatgatctacatgtttgtttactttatatgtactgtttatttggtttttattagtctttttccccgttttgcgtgatagcttgtcgtttccgtcgttgcgaaggttcgcgagtgcgccggaagtgttcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgactagttgagctatatatattggttcagctagatattagatatgattgcttagccatgcttagaaacattagcacacaattgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttggtttataagggggtgattatgatccaggaatggtgcactgtggtgagttgtgttatgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagtagagcaatgtttttcgtgattagtctcacacctctcacaataattattgatgttataactggtaataatttgcttagctcctggtttagagattagatctgtacagccgggtatggttgttcaggatggtcgggcctgtgcagcatgggtgtgctgttcagtgttgattaaaatttctgattaactactctactgttttatttctcttaaatattttgctaaacgctgcttttgcaaatgagtctatattatgccatcctttggtatccttgtgcacttgcatatttgctgtgtggcttgttgagtatgtcatatgctcattcttgcaataatcaatcaacctcagttgaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttgtagttaatttgatgaatctgtatattaaattgttagtttgtgtacctcggctgattcctggacgaggattttatgcacaaataagttcggaaattactagtgaatttccgggcgtgacaagttggtatcagagccatctcgactataggataagccaaatggtcaaaccttaaggactaattttccgaaaacatgatttgtgaaaatttctcctttcttccttatctagaattctttgcaaattgtttcattgtctactctcctctctcgttcaacttgagtagttctgaaactagttgttgaaactagaagatgttgatgaggtcaacttatggaggtcagtaaagtggatcgaggaagaaccgaagtgccaactggtcaagatggaatgaagtttgcatcctaccttagaacctatgccaccaaagtgactttgaagaatagttagtaggatagaacgtttgttgcttgcttgtgtgtaggtatggttgcattcccgtcattggtgtggttcaatgatgagtgtgtaactatactaggttgcttgcttaatcaacttgaacaatataatggtctacacacatcagatcagtgttaacctggttaaggtcttgtctttagtgtaacccctctccttctatcttctctaatatgcaacagatggtgaacactcgcgccagtggaagtgaaaacaataacaatgaagggaacccaactcttgctcaagttctggctcaacagactcagttaatgaatatgatgatacagcagatgcagaaccagcttaaccaagggaacaacaatgctccactgccgcagaacaagttagctgattttcttcttgtgaggccacctaccttttctagcactaccaacccagtggaagcaggtgattggttgcacactattgagaagaagttggaactgctccagtgcacagatcaggagaaagtcgtgttcgcttcacatcagttgcaaggacctgcatcagaatggtgggatcatttccggatgaacagagcagaaggacaaccaatcacttgggaagagtttactgaaggattcaagaaaacacacatacctgtaggagttgttgctttgaagaagcgtgagtttagggctttgaagcaaaaggatcataccgtggcagagtatcttcatgagttcaatcgtctggcacgttatgctccagaagatgtgcgcactgacgaggaaaggcaggagaagtttttggaaggtttgaaggatgaactgtcagttacgttaatctcccatgactatgtggattttcagcagttggttgacaaagcaattcgacttgaagacaagaagaataggatggataaccgtaaaaggaaaatgactgtattccaggaggcacaaggtagtagccagaggcagcgtatcaagccactccaaattggtgaatcttttcccgctggtccaggacagtcgcaacagttgaacatcggtggtgagatcaaattagagactaatgaaagcaaagaagttaacatcgagcaagctaatcagccggtgctagttcagcaaggtcagtctcaagagaataacagtagtggaagggagcagcaggtatgtttcaactgttacaagccaggccactttgcaagagagtgtccgaagccgaagcatcagcagccgcaaggtcaggttaacaacattgttgtcacaggagccaatgcagtgccagttgcgtcttcaagagttgtgtcttcaagtgttacaactcagccaccagtttcaaagcggcagtagttttctttaaagccttagaataattatcggagttatggaataagatagactgcagtttacctatgcccttttctttctagccgttccgaatctcgggacgagattctttgtaaggggggtagatttgtcacatcctgattttcgtttcaggatttataaattatttaataaatcattaatagaatttatattaaatgttctttaatttacaagtgaagttaaatgtgggaaataaaatttcctaaatataaagcatggatggatttaatttttattaaattctccatgattaagtcaactctctgaaatattctcggatctttcggagctcaattcctaaatgatacaaagaacagttcagtaattatttgatcattaatgatctaattatttttgttaagagcttttcttgtttaaaaatccttaaattataaattgttgtttaaaaggaattattagaaataattttaaaagcctagaagagaagatctaattttaatttgttaaatctcaatataaaattgggccagataaaatttcattaaatactttgcttaattctataattcctagatttttctgggatttatttgagctaaggaagtatttttaataaatgaaattgcatttaaaaaataatttaaattgaaaaaggttttaaaaagtcttcttttggctttgggccgaaagccggcccaaaaccctctctctctttccctcggcccagtccggcccagtccgcagccgcgcgcgcgcgttcggtcgctgacaggtggggcccgcttgtcggatccatcgtcttcnncaanccnccnccncccnaagccctatcgcaaggcagggccgtcttctgccaaattcggccgatcctttccttctccggccgaatcttttgaggggaaataatctcctcgatctcctcttccttttctcttatagaaactccggtcaatttcctttggaaataggcggattcgagtttgattcggattcgtttttccccaacctttccttctcgtcgccggcagccgtgggcctccgtcgccgctcgctagcccctttaaaaggatccccgagctctcctctacccatcgcctccctcgccttcgcccgccgtcgtgtgtagcgccctagccccgtgagcttttgcgccgccgtcgccgccgccgctccagccgtgcgccgccgccgttccagccgtcgccgtcgctcgggaaggtcgccgtcgtggtcgccgtcgcgtcgccgtcctcgtccgccccttcgccgccgccgaagaccgccggagcaccgtcgccgccgtcgacccgaaggttgccgccgcttcttcctcgtcgccggcgccgtccgttgctcctccgccgttgctttggtcatcggtgagttcgtcgcgccgcgctctacgtcctggtgctctccgtttgcgccgccgcgccgtcgttcgccggtgagcttgcgccgcccgagccgccgccggtgctgacgtcatcgctgacgtcatcgtcgccctctcccgtgagccggtcgtggaccgttcgatctcggccgtccgttttggatagggttgatctcggccgtccgttcccgtgaaccgccgccgtgcacccggtccaccgcaaaccctagccgctgacacaataatcattcttttccttttcaaaaataattcattattgcgtcataattcaattaaaatccatataagtgttttaatccgatttaatctttaaaaattcacatttgaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcctaattcatctaaaattatgacctacatgtttgtttactttttatgtattgtttatttggtttttattagtctttttcctcgttttgcgtgatagcttgtcgtttccgtcgttgcgaaggttcgcgagtgcgtcggaagtgttcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggaccttttgttcttgattactttattccttgataccttgggtgattataattggactagttgagctttatatatattggttcaactagatactagatataattgcttagccatgcttagaaacattagcacacaattgggataactaatgtttcactatcacttatggttatatttaatggtagttcacgatggtcaatcgtgattggttaattaattacttgccaactaaaacttgataatggtgggttgtgagcacatggttttgagagtcatgctcatgacaattaaggaccggttcgcgagctactgttgtgaaacattaaccgtgccaaccacaagccagcgtgggcaacggctttaccttttgtataacatgattcattacggagcaccagactgagaagtggcggagataagcccacgggggtcgctggggagtccatgccttgtttatgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattattgatgttataactggtaataatttgcttagctcctggtttggagattagatctgtacagccgggtatggttgttcaggatggtcgggcctgtgcagcatgggtctgctgttcagtgttgattaaaatttctgattaactactctactgttttatttctcttaaatattttgctaaacgctgcttttgcaaatgagcctatattatgccatcctttggtatccttgtgcacttgcatatttgctgtgtggcttgttgagtatgtcatatgctcattcttgcaataatcaatcaacctcagttgaagaaaaagaatccagaaggagaagacgtttggcttataccccagttgagctgcctgtgggagtggagccggagcttcgctagattttattttccgctgcagttttcttcatggtgaggactaagtgcctcttaagtaagtatttatcgttgtaattaatttgatgaatctgtatattaaattgtcagtttgtgtacctcggctgattcctggacgaggattttatgcacaaataagttcggaaattactagtgaatttccgggcgtgacagtagcgcccgttccgtcgtggcgcctagcggaaaaactatctcttaaaaaccctagttgcgaaatctgtttctttgcttgttgtctagtgtccgtgccatctcagatctcaaatccccaatctatcgtcgagttcaatcccgaatccaaatccttcccaaatcaaatcgctccgcaaaagtctatttagcctccctcgggttcgatgggccgaatccctctcggcccatctccccctccctccccggctctgtctctctctctctccccgctctaccgtgagccgcgccgagccctccctcccgctctcgctgccattcccgccgatgccgcccaaatcgtcgcgccgcccgcgcgcgcgcgcaccgtggtggccgaccggccagtcaccgccgccgtcagcgcctgccgcgcttgccccgcgtctgccgcccatgtcgccgctccactccaaaccggtccgccgtcatcgccgtcgtcatcgacccggccccgccaccgccgcacgctggcttccaagggacggaggctgagccccgccctcctctctgccgcatcgccccctctccctcctccttttccccaagtggcaaggaggcaagccccctttctctccccccttttcccttttccctcccgccggcatcatccttccctccctgtcgccgatttggccgcgaccgccgagcgcgagctccctcccttgaccgcccaaggtcggtttctaaaccgacatcgccgccctataaacccaggcgccctcccttccttttcccctcccaatcttccccgtttttcgcccgcgccattgccgtcccctctgtcttgctgatcgccgaccgacgccatcacgtgtgccgaaggagtcggtgcgcgttaggacgcggaacgggactccggacgcaccctctcttcctcttccccggcccgaggccggagagatcgctcccgtgccgtcggcccatcgtcactgcgccccgtccgcacggtagtgcatctccccgttctccttcctcaatccatctcttccccttagttctcggtagtagcatgtgtagcctccccgtagctagccggcgccgccccgactgctaccgtctctcgccgtgtgctcgccgccgtcgccgcccgagctcggcaacgcctctcgtcgccggcctccctcgatgcgattcctcctaatccggcgcaaggggtgggttcccgtagccgcgtagatgctctcgccgccgggaatcggcccctcgtgacctcatcgccgtttcccccttctcccgccgtcggttgccgccaccgcaatccgccaccgtcaagcatcccccgtcgaatccgagccattggctcgtctcccctcgtcctgtgcaacatcccggtgtgctcgccttcgcctgaattgccatggttcgctccggccctcgccgccgtcgtccgccgtccgttccgaccggcgtcgtcgtctacctcccaccggcccgcgtggcagccacataggcgccacgtcggcgccacctcggccgtgaccgggtcaagcagaccccggtccgccgcttccctccgccccctcgcgcgcgcggtccaccgcgagccgtgaggctgcgagtgggcccgccgcaccgcgtcctccgcgaaccgcacgcatgcgccgcgcctccctccccaaaccctagcacgccccgcgtgcacctcgctcacggtgagccgagtcgacgacaagcgggtcccacccgggaccacgcgggatggacccggcccaccggctctctctctcccctccccgcccgcgcgcgcgccttgggccgccttcttgggccggccggcccattaagctcggccgagccgcccctttctctcgggccgcgccctagccgcccgagggaagtgtaatttccctccctccttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatctaatggcacgcttagaggtcaataatagggctttattttcgccgtttgctgagtcgtcccgtttcgcgtgtagtttcggagcccgaagacccgcagtgcgaggattttgaggatcaagctcaagatctcgagcgaggcaagccacctttgaacatcttgagcctatatttgaacttaattatgttgcttgaaaaatattatgcattgataggatcgcacttaatctgcttgtcccgtctgcaaggcagattagcggacctacctaatttgttgcatttgacccttccattgtaattgttataccatgttcccttgtacccacctagttgcgcctcggtaatcgtgcactctgcacgggtatcgacggtcgccttcaaacttaaaatctgagaaacatcttgggtaaaacttggattttacaaaagacttggaaaacccgacacctgggtcggtgcttgcgaactaaatgaatttccaaaatcgcggaccggggaacgtaccgggtgtacggtttcccgttcttgcacttaaggaccatttccttggaatttcatccgaacacatgacaagtacgaccacatgggtggaatgggacacccctggctgagtaactagcttatcgggggagccatgatgctaagagacatgtggattcgccgggtggtgtcggagaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgggctcgatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatttgcggctgatgggatcagccaggcccgggtggccgtttgaaagctgttggccgggtgccaatcttggtcaattcaaaagactaatacattgcacatactccgaccggacgagacgcactgtctcatccgtgtcgtttgagaagcactcacttagttgtttcagaaaagagttcaaataaaatcaattgcaaaaacaacagcctttctctgaagcctgcattaaacacttatttcccatggctggctgagtactcccgtactcacccttgctctatataaataatcccccccagttgctgaagaagatgaagcggatcctgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttgcgctcgggactagttcggggcgtgacaccatatatgagagacaccattcacctatacttcaaatacaattttctaaactactcatctaatctacgatccgattacaccgttgtgttcataacaattaaatctttacaacaagatctcacattattatattttgatgaaaaatcacaaattacttttatgatatgtctaaattacttttagatttcactaagttacttcttagacatacaaaagtaaattcagaaagctttaaagtaatttacatatattatagaagtaacttataaaaaaaagtaactttaattaatacactttttcattgaacaaattatcatatatttaattatcatatatataagttactttttgatttgattaaaatacttcctataaattcataatgctctgaggtgattacttttattattgtttttagttaatttcataatttgtgctgattaatttaatttctagatagagtcatgtttttatctctacaacggatttacttcaaataacatgccaaagttacattcgttttgttctaagttatttctataatatatgtaaattacttctaggctttactgaatttacttttgtatgtctaagaagtaacttagtgaaatctaaaagtaatttagacatatcataaaagtaatttgtgatttttcatcaaaatataatcatgtgagatcttgttgtaaagattaattgttacgaacacaacggtgtaatcggatcgtgtaatcggattatagatcggataagtaatttaagagaaaatttcataagaagaaaaaaatatgcacaacctaatagcaaaaactacttgcatgcatgtctgtaatgctactagtacttttctcacgtaactgtccgcgtcgctcgttaagtctaaatcgaaatgcctcttgaaatagtttttgcgattgctctatgttcattttttcttatgtgaattattagagctatttcttctacttcaagtgccaagttttatgtttccatattataaggttcataacttggtgattctacggaaatttagttcatccagattggagctaaaatgaattttatatgcaatttacaagttaacctatttttctgttgattagatattcactaaggcattttccttatattttccagattttaaaaacatagggcccactggtcagtgagagatcttttgcagaaaggtccctagagtgtgggggaatcaaccctcactccaaaaacgtgtctatgacatagtttataaagactcccccattttcttttatatttacgtttcagttcttgaccctcctgtcagtgatttagatgtttacatactgagacctacagttgttcgaattctcaaaacaaagtccctgcttttctctacctcgttcattcgatacagaggctgagcagagccatggctgagctcgatctcgagctcaccggcggcaataggtggctcctttggggttgaggtcaaaagatgaaatgaagagcacgctctcgggattccattcctctacttttctcggattgcggtcatcggagtaacgccggcggcgagtccgagcggcggctgtgcacgggctgctactgcatgtgcgcctatagccatgtagtgatcaaatggatgcatgaatgtggcattaggaagtgctatgacgctcaccgaagcttgaccgcggcttgaaaaggtctggacagcggtgacagtggaggagatggctcggcggcgatggatagcgtcggcttcacggcgacggtttgttccggtcttcgggctgccaaggagaggaggggaatggatcaaagatcatctaaggatgcttcatatgcgaggaattgcgccgaagctcacccgagagcgaggaacggacgacgttggccggcg

SEQ ID NO: 63519 - DNA, 11817 bp, Oryza sativa
ttcccttatgtccctttcccttatcgtactttggtatgagtgggtgacacattccacatttcaaagatgccatgcaagggacattttctgcttttcagattgtaatggcacataggcacatagcttgaacttgctatttccatcttatgatcttgtccatgagaccataactgagatttccttttctagctaaaggactgatgactgatgatactctgagattagctattatgcagttctcattatcttgaaactctttcaaggaaacatatctccatgctgatctaatttgacacagtaaatcttgtgaccgttaatgcagttctacataattcttgtcagaagccaaatttttatgtataatcttatgccatcactagaattgttcttcatgttttaaccatgtctttctaactaacacgttggcaattttatttcatcaggaaataaggtgggaaaatcgttattaattgatgatggtgcgcttccctggattgtaaaaaatgcaaataatgaagctgctccaattaggaggcacattgagcttgcactgtgccatttggcgcaacatggtatccctctctctcgttgcttgcaacattgctccttcatacactccgttgttcatacagtatgtacatgtaattgtaaaactatacgtttattatacttatggtgttaattttacctttctgcagaagtaaattcaaaggatatcattagtgaaggtgctttatgggaacttgttcggatttcaagggattgttctcgtgaggacataaggatgctagcgtaccggacattgacttccagccccactcttcaatcagagatgagaagattgcgcatagaatgctgataaccgactatttgctgctggttcactgcttggttttacattccgccctcacaatcaaggtgccattgcgccaagagctggcaatcaggcatataggtcatgatttacccaatttttgcaagcgtatgggaacctgagttttcatctcgacaggtcccctgttctcctcaagagttttatattttcgttgtgctggctgctgagaagttgaaagtctgggttgcaattgatttattcattatggtaggggttcgtattttacgttgtttgtaaaattgttgtaaaaatatcagcaaggccaaaaatgagagctgttatcacttagagaccgagagacagcagataggtgtagatttggccatgaatcataatacttgtattcattgtacagtagctgatctttactgtaagtctgtaacttattactgaaaaaggcgtgatattagttgctactctgattacctctgactcgaactgtaccaattgtactcatggcatgcaagggatggaaggcttaaggctgaatctgaatagcctgacacgtgtgcgtttacccatgaaattcactcttccatcccatgcatgattgtagtttttggaggatttgcgttgaatatttgtttggtcagtagaaatatggacaggcgaggcgcagacagtggtaaaacactgcaacacgcagagttcgaggacgtagattgtcgcacggttgcaagcagaacgccgcggtcgctcgccgtaaatcgatgaaaaacctaccaacctacctctacggctctacctgaggagggaacgaggaattgaggagcaaccgaacaaacgaaaagggaagaaactcgcctcctagtactctcctagcacagcaaatactacatccgtccaaaaataagtgcagccgtagatatccgtgcccaacgtttgaccgtccgtcttatttgaaaaatttatgaaaaatttaaaaatatttagtcacacataaaatactattcatgttttattatctaataacaataaaaataccaatcataaaattttttcaaataagacaaacggtcaaacgttgaacatgaatcgtgtaaaactgcacttattttgggacggagggagtacttgctgtgctaattaattagcaacgcggctgcgctgcgactgcgagccgagagagacaggcagacacgcagtgcgaaggcagcggtgtacgtcgtcgcgtagcacggcacacggcagacggggcgcaggacgcacggaggctggcgagaggacggacaaggtcagcagcgtgcgtacgtgcgtgttttgtactacacctctttgctgttgtgagttaaaacaagacgaatggcatgatgatgatatgatgatgagtcgtcgattatccttgagattttcagaggtggcgatcgatggcccccttgccccctgaatataatcctgatgacctgatcacgcacgcacgtatggtattgcacgtcaaagatcggtaggaccaacgtccaaaccttgaaaccctgaactgaaacacaggccggctcctacctaaattaagttgttggtagcacgtccccggagacacggctctcctccatcgagcgcgatgcgcccaatgaccatcagattcttccactgatccgctagctgcgtactcatattgcaccaacgcgcacgcaacgccttgccggttgcggcctctcctgccactgagacggacgtagtcgtagtcgtcgtagtggggggcaaagggcaaaggagacgacggggggccacgaccacgagcggcgcggcgcgaggattttataaggcgcgggcgggtcgtccaccggcacctagcgtcgctgtggtgacgagacggaggctgaactgtccgcgtcgggggcgggcggtggacgacgtggacatgtcacgtcacatcatatatatatatctccacaggatcatacatccatcgcgcgcagcctagctaccaccacacctgatcgagccgagccggcggactcgaagcatcacccaatccgtccgcccgaaacgggccgagatttttccgcataatatcgagggttgattggatccatattactacaaattaaatataccatttcagataaatgacactactatttgcgatattggctgcgtttactataaaattttgaaaaagtgaaaccccacgccatcgccatgacgttttccatcagaccccgtagacgtgggaaccacatgtcagttccatcttcctccattctccctgttctttcttcccatctcttcctccattttccacgtctaatacgagggacaacgatgttggcggttcctgagccctcccgctgtggatggggttgaagacgatggcggtggtgcctcctgagctctcctgccacggatgggagaaggccagcgatgacgacggttcccgagccctcccgccacggatggagtcaaagaagacggcaacgactcttgaaccctcttgccctggacgagagaagttcggcaacagcggtggcaacggaaagagggagagactgacaagagagaggtaggggaaagagaagacaggggagagaggtgaagaagatggaactgacagctaagtcgtcccacgtgcagttaaggctaacagagatttttgacatatatcgcgacggagtggcacagttccaattttcccaaattccagtggcacatgcatgccgatatcatgaacaatggtggcatttatctaaaatggtatatttgtagtggcatggatccaattaaccctaatataaaggcgcaccaaggccccccacatactctttcaatctcaaaataaaggctatttttactccccttaagttttgtcctacaataaagatatttatttacctacctacctcatctattgttcctcatttaattaatttcttcatccatattttcttctatcaaggcccccacatactctttcaatctcaaaataaaggctatttttactccccttaagttttgtcctacaataaagatatttctttacctaccaacctcatctattgttcctgatttaattaattttttcaaccacattttcttctcagctaatcacaatatataattttggattaatttcacctactttccttaataccttgtatccaaaactctgcaaatgattatatttgggacagatgtgtacgtagcatgtcgctagctagaagtactacctgtatcgctatcagccacaggccccctataattgtccggtcctacgtactccctccgtctaaaaaaacaaactctagtttccatatccaactttgactgtctgtcttatatgaatttttttttataatttgtatttttattgttgttagatgataaagcatgattaatattttatacgtgacttgtctttttaatttttttcatatttttttaaataggacggacggtcaaacgttggacacggaaaccaggtctgtctttttttttttggacggagggagtactctccatcgacgacgcaacagtaagtggcagcccaaaccctgaatgcatatgtacaaacacgacggggggcgaaagcgacgcgatatggcatgcaatttagttccctgtctgcctcgttaaattggctacatatacacatatgcaattatttttttgaggaggacacacatatgcaattatgcatcatgcgtgtatagctttgaccgatcgatctcgattggttggtcggtcggtcccgatccatgaaattatagaacgagaccatgacaagaccagatggggttcatatatatagcttcaaaactaagttattacctgcagccgttcattctcgttcgtccttggatgcaggcatatatagctgatactactctacctcggaacagagaatcagataagtatatactccctctgtccttaaatatttgataccattaactttttaaaaaatatttgatcgttcgttttattcaaaaacttttgtgaaatatataaaaccatatgtatacatgaaagtacatttaacaatgaatcaaatgataggaaaataattaataattacttaattttttttaataagataaacggtaaaatatatttaaaaaagtcaacggtgtagaatatttaaggacggaggagggaatagattacatgcatgtaacgcagtactccctctgtcccataataggtgacgtttttgactttttatttgcaacgtttgaccattcgttttatttgaaaaattagtgcaattataaaaaaagataagtcatatgtaaagtacttttgataataaagcaaatgacaaacaaaataaataataatttcaattttttttgaataagacgaatgatcaaacattaataaacaaaaactcaaaaagacaagtaatatgggacggaggtagtacaagaaactatatatatgcaggccggccaattaaggtcgtcgtctgatcgtctctccgttgccgacagcagcgagaggggaggactggtcgtggccacagcctgacgaagacgacgacgagtcgaccgatcgccaaacacacaactgcactcttgcaggggcaggcaatgcagccaggcgcccatgctgattttgaacggccagctcgatcgatcacaaaattaaccaagtacgtcaatgcaaaagcatgtactacatgcagatgcaggctctggatgatctgaatgcatgcgacactgcacgacactcatcatctgctgcccgatctgcatgcctgtcagtagtgtatctatcgctctgtgcaggtaccctgtactatactgatgatctgatcgatcgatcgatcgatcgagaacatatgtacatccattcctcggttgaatctttgatcaacttgtacacgcagatgcagctacaatctatcagtatatatatactactcctatctatgatctatcagccgtggaccatatgcacgctggctgccggccggccggcgcctgagaagagacaagctgtacagctgcttgaagtaattgaagtttgtctagcttgaagctgagctgaatgcctgaaaccctgaagcaagctagctaggttgcgtcgctgcaggccggctgcagctaaactaggagctatatatgtactaggtagcactagcagcagctgctgcattgcgacgtcgatcggagaggggacgggcatgtgtaggggtccggccgtcgcgcatgccgctagctgctgggaggaggcgcagtcatatgcatgcatgcaaacacacatactcagctcagattgctgttcatttcactgttcgatccatccacttttcccatcttgcattgcccttgtgggccggggcgaggtcgacctagctccctctcgatcgatctcaccgccggcagccaccacgccatggccgccggcgaggagatagctagctgcaaatcgcattgctgcaggtgttgctgctgaaaattggagcggtgattcgatcgaagagttctattaattgttaattgggatggacggctagctgagctcctgttttaatttcttctgaatcattgatcgaaccgaatcaataatactgctcgatctctcgttggttcgtcagtaattctctttcctgcagtacctatcaagcaaagcaagcatatatgaatatgacacgctgattggatataatattacacagcatgatcgagcatgttgatccagtcgtctgctagtgcatgccaatactactgcagtatcatcatcgacactgccgttgtttcagtactgtaatatcgacctatggattgttgacctagttctactgccctatatatatatatatatatatatattgattctctctttggatttttcttcagaagaaaatcagtgtcgatacgacgacttgatcacaagcagctgggctatatgtgatgctcacgcatcaaagtgcgtgctcattcttttgttctgaattaacatgagcacaaaccaaaatatatatattcttgctagtccagctcgcgtgatatactctacttctttggatcgagtatactatatactactatatcactgtttctctatacctttttaaatatataagttctctatacaccagaacatataaaattaagacagaagaactaatatataattcactccaagttggcggcaggatgaatgagagccacagaaatataattatgatgcacttgaaaaatacacctgatcatcagatgatgatgagtagaaaaggagaagtgtcagtgtatcgagatcaatcgatggaatgcacacggctggagaagaacatacctcaaattttgtcaggttgtacccctaaaaaaatgtcagatatagctgtgctgatagccactggtacatcaagtgcgtagataatacaaaatgtggatgaatggcaacgaccaagggtcaatatatactcaatattcatgcatagagtgaccatatagacacatctactactgctaaaaccattttttatgtgcggataaaatcgatttccaccaatgacagctctgggtgctcctcttcctcgcttgtggtgatgcactgaggttggtgtaacgagttcgctatggcaggagactaggagccgtggaaagagcggaatttcagggttttcgattactctctctctcttgttagtctcagcaattctggaggccatcctacaggaagattgtctgtggtcatccactggcgccgctgcttttgggggtttattagaagtatagtggggctcagccgccaccctcctatagaggagcagcgtttttccgttttttttttactttagcagtccttttgtttctttctattttcccttgtccccaggcaatggtcatatgatcggttgcgttatataacaaaagctttgctttcttctaatatattgacgtgtaatcttttgtgcgttcgcgaaaaaaacagccagagacaaggagaaaaaagataaaagaaagtgtgatgagaaaaccaacgttgtcctctatatattatatttattggaaagaagagaagaagcagaggatagaaggactagtggtaatggagatgcgaccagcgtttgatcgacggcttgatttttgaagcgccgatcaccgaagagttgtgaggaagacgacaagacaagattcaagcagataaataggagcatagcctggaaaaaataaaatttcaatgacggccagcttaatgtcgaaataacatcatttccacgagcgatcagcttaagtgaccacttttaaaaatataatttttgtagacggttgcttaagacgattgcctttgaaaaatatttctgctaccgatctttcacgcaatgacacacccactactctttagatgtactgcacaggcagtggcactatgccgcctgtgcaattagggggtgcttgtgaaaaccgttttttctactactcctccgtttcatataagttgtttgattttttttctagtcaaactttgttaagttgacgaagtttaaagaaaattcagcaacatctaaaacaccaaattagttttatcaaatctaacattaaatatatttagataatatgtttgttttgtgttgaaaatgttactatatttttctataaatttaatcaaacttaaaaaattttgactaagaaaatattaaaacgacttataatatgaaatagaggaagtagtagtgatcatttgatcgactggaaaacctaaatgatcctacatattgcattgacaaagtgtatcccatcgtggtaggatgaatctaacaaatctttatcatggaattaatgctaatacaaattgataattcgcgacatttttgtcaaggagtatttttctaatctaaattatctattcgggttccggtagtcaatcccctccatatttacattacgtcatatatacaattagtttcctcggcatttctgtggttctgtcttcaagtcaacaaaatccttgcatgcagagaaccaagctagcacaatcgtaacgggaatcacactattatagtacatcatatctctagtgatatatctctctcatgcattcagtataggtcaaagactcaagacgacccaaaaatagtcttctttcgcaagaaaataaaatgccacaaaggtgtgcaccaataatagctgtcttcagtcaaaacccatcactactttttttcttttagtttgaagaatagaacccatcatttacatatatagatcaaattaaggttacacaaagtgtgctaattaaacatacattgtcatgcatgatcctcacaaacaaataatatgtataatatatagcatactatctctatttttaataggtgacgccgttaactttttaacacacgtttaatcattcaacttatttgaaagatttacgtatcatttatcttattgtaatttgttttataaataaaaaaatatactttaagcatgatttatatatttgcataatttttctataagacgaataatcaaatgcatgtctaaaaaatcaacggcatcatcaattaaacaatgaaagagagcataaagtcctttagaggagtacgtgaccggtactcagtagcctagctagaacatacatgctccatatagttatacttgacatgtactatggtgtaaattaaagccatatatttgatcagttgaccgatcagaagacattactcatgttgaatgttattcctaaatatatatacagcatagtcaaagtatatcaaaaactgtacacccacacacatgcctttaactacagagacaacgtcacactacctcttgtgatgttgcccctctatatatctttcatccacgtacaagactgaccctaaaatagtctaacttctggataatatatagtagcatacatatatataattatttggtgattctctcttgatcatcagggaattcatttcactacttctaataagatatatatatatatatatatatatatatatatatatatatatatatatatatatacacaatatctagaataaatgaaatactagtaattccctacatttagagggcgcacttattggtctcaattggttaattagttcattaattatctaggatgtgaagcaaaactaaaacacataccttagcttgcacctataaaaacatgctttagtcaaagggatgacacatttacatgtataattaatgttgatatacaacaatcaaattctagttcagaaaacataggtttgtactgtagaaacaaaacatacatgtcatggttacaatatggcaacaatatagttgcagctgctgaagatcatgttccttggagtgcatagcatatattgtatcaaagtgtgtggatcatgcataatgctccacattttgatatttgacatgtaattcatatatttaatatataaactaattcgtatgtgaagaaaacttacaaatgcatataacattttattcccacattggtagcatcatcatagtatccacgtgattatactcatgcctatatggcatatttggttggttgtatcaggctggcttgcttctctgggtgcaacttctaaatcgacggctctagtggtcaacttctaaatttgtcatttgcaacgtgtcaggtcatacaatggttctatccttgcctcagcaaaatcatcacgcaacgccaaagcaaccgtaaccggtaacgtatcacactatctgcagtgatacgtcttatctatcccttccgtactaagccccaattccaaaagaagtcttctaaaaaaagaatagattgatagacaaatagagtaacgcacacaggcacttatttgatgctccatttggtgtacgccgcggcgtgaatacgtaccaccctatcttgtagtatctacagatggcgagtagataaggtaacgcacaatgtagtcgccaatttgatgcttcgttcaggttcaggtgttacggtgtgaatacgcaccagtctattctataagatagggtaactaacgcgcatcctataagatagagtaaagcacatgtatagtcacttatttgaccctccgttgggcatcgcggcgtgagtacgtaccacccacaccctatctctgattctccccaaaatccatactttggtagtgtcttgacaacgttatactagtagccatagtgacgtggccgtggtggcaatggtggaggtgcaaaggctataagaacacggtcaacacaacacggccgcaaatcagccatgtcagcgatcgagcgaggtgtgacatagcaagagatagagacgtgggcagcaccagccagccaccgaggtgctcctcctcgtcagacagcccagcccagggcccgctcccccatggtgggtcccaccgcaccaccccctggtgggccccactccccccttccccaatatacgcgcttgtattttaacccttctcctctcctctcgtctcctcctccaaaccaaacccctcgcctccgctttgaccaccgccgcgccgcgccacgccgcgccaccgtgagagagggagacagatggatccggtgacggcggcggcggcgcatgggggtgggcaccaccaccaccaccacttcggagcgccaccggtggcggcgttccaccaccacccgttccaccacggcggcggggcgcactacccggcggcgttccagcagtttcaggaggagcagcagcagcttgtggcggcggcggcggcggctggtgggatggcgaagcaggagctggtggtgagagcaacaacaccatcaacagcggcgggagcaacgggagcggcggggaggagcagaggcagcagtccggggaggagcagcaccagcaaggggcggcggcgccggtggtgatccggcgtcccaggggccgccccgccggctccaagaacaagcccaagcctccggtcatcatcacgcgcgacagcgccagcgcgctgcgggcgcacgtcctcgaggtcgcctccgggtgctacctcgtcgacagcgtcgccacgtcgcgcgccg
